United States Patent 9,487,797 (GENOMIC PLANT SEQUENCES AND USES THEREOF) - sequence listing, part 94

SEQ ID NO: 82175 - DNA, 835 bp, Oryza sativa
tccccatgagcttcctccaattcatggctttccttcaattgcaagaccacggcggacatcattggcctttgagcagcaatatctgctatgcacatatggcagcatctagaaccttccacatggagttgacgttataagaacctccaagacgtgcatcggcaactgagctgatgttaccagtgaccatcttctgcttcacacgttcaacaatgtgaccatttccaggtattatggtaggttcaccactagttacctctagtaaaacaacaccaaagctttaaacgtcactgctctcagtgagtctaccggtgatgtagtacctaaaaatggcccacattatgttaaacacaatgattgcaccaagtgattaaggataaaattgaatagaatcattaaaatatatgaatacacagcacaaaattagcattaattgtgtagaaagaagctcatactcagggtcaatgtagcccatagatcccgctgcaatggctgatatgtgagtctgggagtcactatggtaggtttttgaaagcccaaaatctgctatttttgcttttaaatttccacccaagagaatgttatttgtctttacatccccatgaattattggcaggttacaacccttatgtagatattctagccctacatacaagaaaactacagttagatcaagagatgagcgataaaacatagaaatccatttatatcactgagatcagtttagttcgatgatttgtcatcgattttgtctttcctataatacgccactgactttgtcaattttttctacaatataccattaggggtggatacttttagaaaatacctaaaatgc

SEQ ID NO: 82176 - DNA, 2007 bp, Oryza sativa
gggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacgtgccgcatctcaattaccttcccaaaggtaattgcccaagcatatagcatttgataaatatgagtatgcatgattctagaatagcatttctaagcaattgtcataattgactagggactcatacgtaatcaggggtacaaggattttaagggtaaacaataatcaaggcacggcataatcacaagtaggacgttcatcattgcatgcaattttatttgtaaacaaaacaatttcgcaattaggatcaacatgttcaaggaatagtgataacttgccttgctcaaagtcttgcgggtcttggccttcacttggatccgcaactccctcgggctctatagttgcgtgcaaaattgatttgaattcggttagaattcaaataaaaatccaaataaatccaaatgaaagtcgaacgcgagagttgattctttttttttattaacattactatctgcgaactacggcaaacccaatttcgatttaaactattttgcgggtataattatttcgttgtcaataatttagtctccccgagcattgtatataataggttagaaatttctaccacgagctaaatattggacgaaatcctagaaatgctatacaatttaatttagtctatgattaaatgattaaatataatatacggctaaaatccctagtaattaaatccgaatttctaccgttaattgattacttacagggattacccagaaataatccataattatttacgagaattcatacatttgtttaattattaattacatctaaattaataccgcgaattgatttcttatggagagtactaaaaattatctataatctataggaattcatccaattatattttcattaatcctatatttaaatgctagtattttaggtatttaattagtaagatttcatctaattatattttcattaatcctataattaaattctaatatttgcaaatattttaaatttcccgtggagaggggagaggggaggaagggtgagatggggtgggggagaatggagagagaggggggggtatttgtagagaggggagaagcggcggggcttggggcggcgcgcggctcggtgtgacggcgatggcgacgcgatgatgacgcgatgcggcagcggcgcggggcgcgaggcggcgacgcgatggcgagcggggcgcggggcgcggggtgtgagacggcgcgcggggcgcaaggcgacgggacggggcgacagcggcgacacgacaggcgcgcggcgtggcgacgggacggtcgcgcggcgatggaataggcgggcgacgcggcgcgggacggcgatgcgcggtgacggctatgcgtcggatggcgtggcaacgggacgcgcgcgcggcggccggtgatggcgacgagcgggcggcgcggcgcggggctcggcgcggcttggcacggggctcggcgtggcgacgacggcgacgcgacgggcgagcggtgcggcagcgggatggcgatggggacggcttggcagcggcggcgcgcggctcggagcgacgatgggacgcgcgcggcgacgggacgggtggtgacggggcggcagcggtggcgcgcggcacgaggagggatgcgatggtgacgccgagcggcgcgcggcgcggcaggcgacagcggcacggcggcgggcggcgacggcgatggctcggggcacgaggcgcgcatggcaggggaggggaagggcctagggaacacggtcgagcacgtggcggccgatgaacag

SEQ ID NO: 82177 - DNA, 7197 bp, Oryza sativa
atctatcgttcgatcgctacatgtcatgcatccccatgtggggtgcctagctctctcggtgttctttctttctttctttctgttttgcacgctcgtacgtactccatgctttcttcctgtaataagcagacacattattcagcattcagctgcgtgattaatttgactgcatcatgcagggctctctctcttttgttacctacctatgtgagatctactagcactagtagttcacaattgccgaaatttcccaatcgatctttctgcactttagatgtgcctaattaattaaacagatacttcagaggctggttattatttgtttttcaggtgaaagtaattagtaccagcacgagtagctagctagatagaggtgggagaaacactattttttttaaaaaaaaacatttttcgtggagaacaaccctttttattactagcggattaaacatatatacgcttgtaaaaatgctaccgctgtgggcggaaagactgtgccatgctgataggactgttatcgagtcctataaacatattctatcctctcatctccgttcaaatacaacttaaagtccctatactccaacttccttttaattgaaattcaggtgggaagctctccccaggatgaccagtctaaaaaaacagagttgctagaaatatggcgccatatgctatagtcgattttttttcaaccacttacacagtagttatacctcatttacaccccacttacatatataattagtatgtaattttcgaatttacatatgcaattttagtacttacatatgtaattttgagacttacattgtaaatacactaaaattacatatgtaatttatggacttacaatataaatacatgccgactattttttaatgaaaaatatggcgccacaaatatagctacacaaaaaaaaaattgtattgaagggatttccggtcacggatcaccggcgagaatcaatttttacaccaaactgcctaggaaaaaacgtttcttgctgatgggcttcctagggcatagtttgcgaaaacatatatccgttggcggcataaaaaccgtcagcgatcatcatcgatggttgcaggcaatctgtttccgtcaacgaaactaaaagtgaaatcataagtaatttcccattttgtagtagtgaaatcataaaggtggaattaaaagtgtgagtgattgagggagtgtggcattagctcgcaaaagtggatatatatacatagagagagagatggcggcaggtaagctgtcaaattcagacaagtccatttcatcaacatcaactttttgtttctctgttttaaattctttttggagaaaaaagaaaaaggaacaggacgatcgagaaaaagataggaggcaatcgaagccagggataagtggatcacaattaacttaggcacgcagaggccgatagatcacctggcttcttgtcagtctcaatttcgatctgaatattgttttgctccagtaactgcacgtatacatgtttagttacaaatatgtagcatatcacgtcatttctcatttcctcacatgcatgtgccggcctgcctgccggttagctctagtagcaggggctggctaacgggcgatcgatctccatccacccctatacacttctctccccccttcttcctcccttcttctcttcctactacactataattttttttacaaaaataaaaaacaaagtatatgtatatatatatatatatatacacacacacacacacacacacacacacacacacacatgaatcgggtatgtaaacttttgacttataaactttgggtctataaactttagatgtataaactttagatgtatagaaatactatatataaaaaatatttgaattcaaattcaaatttgaatcggatatataaacttttgatttataaactttgggtctttaaactttagatgtgtaaacttgagatgtacaaactttaagtgcataaatttactaaaatagaaaagtaatatggtgccaaaaaagaaaccaggtaaagggaggggatccgaatttgatcgctccttagcaatctcgctagtagcgtgccatccaccgatggatgcatgttcactaatccagcactcaattagatcaattagcttgattagttaacaaaacaattaagggttgaatcaaagtaagaggcaaaataattatgtttcctgcgtcgatacgatccacgtccaccactacttagaaaaagagttttttctggcggtcaaaattgatttttttgcttgcgggtagccagcaaaggctagtgaaaaatgcattttcactggtacgcagccggctgccagcgaaaatcaagtttcgtaggcagcatgttaatacaaccgctcacaaaactaccatcttcactggcaacaatttaagaggaccaccagtgaaaatattttttgggggtaaaaacaattgaaaatcagtgcgcgctggctaccatggccgcatgcaccgcccaccgcctagccccaccatggaggctcccttgccaccactgagccctattcacagttggtcaccgccgccaccggtcgccaccgcggagcctgtagaggagaggctcccttgcaccacctcactctactgagcccagctatcgccaccagatcaagcgcctgcaggagtcctcgccgctggtccgcctcctgcgcgagtcgccgccgccacctagggatgcaagcggggcgggcaagcgggtttttttaacccgcttatcccacttctggttcattttttcttctaaattttgtactaccatatgaaaaataaactagcaagcgggtttttatgcgggtagcgggactacccacttgcatccctaccgccaccccctcccctttgcctccgccgagcccgaagagaagagactcccctatgccaccccactctgccgagcccggccacctccctaatgccttactgccacggccgccgccctctaggtccgcgctcgcgagggagagctcggccggccggcggtggttccgccgctccgtggcccgctgacgctggatttggagcccttcgtcgcctccgtaacgccctaccggagccatcaccgtcatggccgccaccctccggatctgagcccgcgagggagagctcgggcagccgacggtggatgtacctctccgtggcccgctgacgccagatccgcggaggtcgatcacgtgccgtcaccatcgccgccgagcggtgtcaccgccaagccccgccatgcaccgccgattcttccccacgcgttacctccgagtcccctccttgtcgccgccgccgccagtggggatggaggaggagattggtgcgacgacttacggtgggtaaggaaggcgccactggtgagggaggaagagagggaggcggtgggttgggggatctggagaagaggaggcgatgggtgggtggatgtggagatccggtgggtggtggtggtttttaatgtcgtaaatttgttttagtgtgccgatgtttttcactagcggacctatttagccgcctctggtaaaagtaattatcatttattttacggtgacttaatttatcgtcaaatgatttttaagcatgatttatttttatatttacataacatattgaatcagaagaatggttaagcgtttgtaaaaaaattaatggcaccatatattaaaaaagggagatagtagctcgtgaagcatgctggttggtggcagatcatgctcgatcgcccccatcgtcgcccagcttatattcctcgtccaaactaaagaaacaattaagctccatcggagacggtcattatctatagagtaaagtgcacgggcggtctctaaacttgtgtgggtgtgtcaactaggtcctttaattctcaaaataaatttttgggtccctcaacttgtctcgggtgtcatataggtccaaaagggtttcaacccgctccgtgtgctgacatggcatgccatgttggcgcctacgtgttagtagaacccatatgtcagccacatatagaaaaaaaaggacatattttttctcctatcttttttcatttatttttcaaaaattaaaacatcattttcttctctctttttaaattttatttttttctacatgattgacatgtggatcccactgacacataagagttactgtggcttgccacattatctcatagagtgggttagagcccgtttagacctatatgacacatgacgagtttggggacccaaaaatacattttgagagtttagagatctagatgacaacatatatatatataaacttaggctaataaaatcttgctactaaaaatatcatgcactctttagttttaaatatctaaagagtaattcctttttaggatattgctggcctcggccgcccgatgcagagaaaaaaatcggtagacctcacactactatacgtatgcaatattgtatctagccactagtttattctctttccctctttcacactttaaatattttatctcctaaactacttatccaatctacaatccgatcacaccgttgtattcattgtaattaaatttttactacaaaatattatatgattatattccgataaaagagaaacatgtgtttgaaaccgttaaattaaactcaatattttatatgtgatagcggcacgtttcaacccgtgtttccgatgtgtttcacaaaattgatgcaactacatgcctctattatgtcttctctcttcattccatccatccatgcattcatgtatttaatgatcttaaaaaaattctcctaaattacttattcgatctacgatccgatcccaccgttgtatttattgtaattaaatctttacaataagaatcacatgattatatcctgatgaagaaaaatgtttcaatctgttgaccctcgatatttcatacgcgcgtgatagagacatgttttaatgtgtgtgctttccttgtgtatcacaaaaaatttgaatgtttgaatggttgatttttttcaccatatatgacctaacatttttagaacggtcaaatgaaatgtttgaccggtaagaaaaatcaaacacccaatttggaacattggtctggtaagaaaaaccgaacactcgatttggagtttgctcttttttttcaagctattattaattgttccatcaagaataggaaagctccatggaagtcatttaggccctgtttagtttctaaaaagtttttcccaaaaacatcacatcgaatctttggacacatgcatgaatcattaaatatagataaaaacaaaaactaattacacagttagggggagacgaatttttttagcctaattagtccataattagccataagtgctatagtaacccacatgtcctaatgacggattaattaggctcaaaagattcgtctcgcggtttccaggcgagttatgaaattagttttttcattcgtgtccgaaaaatccttccgatatccggtcaaacgtccgatgtgacacccaaaatttttcatttctcgcgaactaaacggggccttaggtccgtgcattgcagccacagacgtgcatatcacctcgtccgacccggctttaacatagctagcgagtactacctttatttatttacaactagttaattattaattattactgtgtgatcctctagctgtagctaacccgcgcgccgctccgagagataagataaacccgcgagtagtgagagtcgacgatagatggcgccaacgctgccgtcgtggtggttgctcttcctcctgctcctcggagttggcgccaccgcggcggccagaggcagcaagaagctgactcccccggtgtcgacggcgtacgagtggccggagcggttccacgcggtggtggtgtcgatcaacctgaccaaccacgaccgcggcggcgggcggctgcagctaatcgagatctactacgactggccgcatggccgcgaccttaacatcgtcagggaccagctctccggcgatccaccgctgtacaacgtggagtgggtgaatggcacctcctacctcttcgacaccgccgcctccagctgccgcaccttccagttccccgtcggcatcctgcctcgatcgggcgtgacaccgtggacgccgacgtcgccactggccgccccgtccgctggatattcaacggcaatacgcggcatgtgctcgtgttcgaagccggtgtaatcctccaagtggcaggcgccgccgtactgcttcctcaacctcaataatctcgtcgctcgatcgatctcgctgcctcatgattatattaactgtgatcaggttcgcatgcatatatattggaccagctgatgattatatccacccatcgatcaattcatgccaaagtcgatcaatatatcctgtgcacgcgcgtacaacttactgagtatatatgttgtatatatagtttcctctctgctaccaattaattcatccgtattttaatgtatgacgccgtttaaccattcgttttatttaatttttttttaaaatatgaaaatatttatgtcatgcttaaagaacatttgatgatgaattaagtcacaataaaataaatgataatacaataaaatttttgaataagacgaatgttcaaacgttggacgaaaagttaacggcatcatacattacaatatggaggtagtaattaattaactgtgacataccatagtcaatacatatatattctgtgctaaacaacactaatataccaacctgtacttacttgcacagttatattttttttctcctgctatatttaatgaaattaacattctctactctggtcgtaaaaaaaaatataatacaacaccttattaactactcctttcctaaaaaaatattaactactccctccgtcatattatataacaatctagtatcagatacgacatgtcagtactacaaacctgaacactatgttgctatattttagaatggatgtaagttgctggctatttaatttgtttaagccagcctccatgggaagggaaagggaagggatgatggggacatgatgcaatttcaggcacaacacaacaacactcatatcaatcgataggatatagtaccttatttttataatattggataaaacacaacataacactataaatctgaatagtgtgtgttccattaaattttagtttgttgtattttaggaagatgatgagggagaatata

SEQ ID NO: 82178 - DNA, 2358 bp, Oryza sativa
aatctacgtttaatactcctaaatagcaagattccggagggctatttaatagcccgaaggatccaaacaagaccaatgagatagtactaagttactttctccgtcttaaaatattaaaagaaaatatgatcggatgggatatttcttaatattatggatctggataggaaatgacgcattcaattctaggtttatatattttgagatggagaaattaaagtattgtatggcagaaacagaaagcgaaaagagcaggacgaggcgtgagcttatggagaggggactgaaaaaacgagaagcaggatgtctatatatcaagtagtaaagcactggttttttagtgttatcgtaaattagtatactttgagaaatgaacttcacaacagatagctttcgaacaaatgctttaagcaatacggtacaatttttatttcgaatcatattttatacaacccgtgataaagttttggggggaaaagaaggctggaaagaaccctctattatctccatgtgcttatatttgtggctgtctctgtctgaaaaagagaaaagaaagaaaagaagaaagggagcggtacatgaacatgtacttgtcaggtgaagtgaggtaattaagcggcaaagagaaaaaaaggtaattaagcggcaaagataaaaaaagaaaaaagaaaaggcagcagtgagcagaggatgagagccagaggaacaggcagatacacacactgcagagtgcagagtcgcctctagcattcttcttcttgttgtattactttgtttttcatgtgactgatactttcttttaatttttttcaaaccagattggtaacgacatgtggatcttatttgtgtttttatttttaattttgagtaattttttaaaaatagagatatttagatgaaactatcacaaaattacaaatttaatgacatgtatcacagaactacaaatttagcatcaaatttttcatgaaactgcatattcaagacatcatatcgtatcataaaactatagaattagtgataaagttattaaagaactaattttagagtttagatccatgcatggtactattatctctactattataaaaattgaagatgtttttgccggtattttgatacgtgatccgtgtatgagtcagattttaagttcgtttgcttttggaaatatatatccgtatttgagtcagtttttaagataattgtttttggtaatacagaagaaatcatataagaaatctgtttttaaaaaaaactcacatgcaacttgagacgatcggactcctaagtgtagctcatgatatatatatatatatatatatatatatatatatatatatatatatatatatatatatatatattcaagtagactccacagtgaattttatctaactaaaccacgtaacaataataaaattaaaatagacttcaccagttgcaacgcactggcattttttcttgtttatttaaatttgtaaaagctgtaggtttatgataatattgatgttaaatatgatatcttaaatctgataatattttctgtgaatgacaaatgggtctcacacatattttttaattctaataccacctaagcgtcacgtcaacaccacgtggaacgaagactatcctccaaaataatctagagagtcaaattacaccggttttaatagttgagggttgatatatccggtactatggttcaggatacgaatcaaattcgtttattagttaagggagtaaaagtgaacgtattccacttcatatatatgaatgcatggtctctgctagctaagctgctaattattaattgggccatgattttatacgtgtgctaggcccaacgcacgcacgtttgcttcattgagcgagctggacatactgttggagttatgaagctgcactgtgacctaattaacctacgtcgccttcccagctcgtacctgtatgtacgttctaattaagctactgtactactactagtcattactactgtcaacaaattaactaaagtcattcgtatatttactttattttgccttagctaatgtaactgcaaacgatttactactgtgttaattttccttgagaaaaatactaccgtgttcgtcataattaagtagctgtaattaatactgcatacagctacttaattacgtaggatagatatgtatggattgatccataggagactgcctctatacgtatatatgttcatacatgtcgatcgatgatgtagatggttgatactattaatttggatggattcaacgtacgtaattgaccagacgaagacgactagatcaatctacccttgactttgtctcctacgctctcttttgaccgtctccctaattc

SEQ ID NO: 82179 - DNA, 6457 bp, Oryza sativa
agcgggggaaaaagggaagagaaaggactctagaggggttctggagcctgaactctcttgctctccggctttctgtaactccttcacacacagatccaccagaacacaggagtagggtattacgcttctcagcggcccgaacctgtctacatcgcccgtgtctcgtgcacttgctctctcgcgaacattccccagatcgatcgaggacgaagaacctcacttagcgcccccggccgaaccggcaaaggggggcctacgcggtctcccggtgaggagtcccacgctccttcatatatatatatatatatatatatatatatatagagagagagagagtacttttacggtataatatactatactagtgctatatattgatagtataaagaagattatgttggaaatttctcacaaaatagaaaatgttctttagtacgtaatttcgtgttagatgttaactcagataataatcctaatggatcatgcgtcagatcggattactgactggatacgtttgaattaataaatggcacaagatctctatagattgctcaaacacataaaaacattagggcttgtttggtttaatactaacttaaattttggtaacttcaatagtaacaattgcatgtttagtttggtaccaaattttattcacaataattcaaattcaatactatccatttggcactatcaagattttggtaggataaaaattggttccaaaccaaataggcccttaatttgtgttatagctagagtgggagagattatctagcatagagaaagatcattttacccccattaaaattttatattgcagtcgatttaaatggatatataggcaaatcaacctacacccttgaattgtttctactagcggtatacattgtaccataaaagttctctctatatataatatatatatagagagatacaaagatagatatatatagccccaggggcggagctagtgtatattagggggtgcctaggaacccggttaagaaaattttttagttataccttatctatttttaccatgtatgcactcccctcaatacaaacttagacatccacatcagcttaaactcggtctaaagtatagtaaattaagcaagtggtaccaccctctatttcgctctagctgcgcccctgtatagcccataaatccatcatccacatgtacatatacgtgtgcacatcgatcgattgatctctgcctcctcctatactacactactactacgtcaacgcctgcgttttgagtaattacgaaaaaaaaaactgcggggtttgacaccatcaaaacatgacaaagtagtagtacaagatatggtagttgctttccaattcagttccagcaacagcagcttgaaatcagtctaagcgcattaatctagcttagctgctcactccaatctcgatcagcaatcgggctaacttagctcctcacagtacacatatatatagtcacacgacacgctcttcttatgtacatgtatccttcaaacaagccctttaatatatatgttattttgtttaaataaaaggcccttgaaatgttacttgtacgtattatatatgaagatactacacgatagatgttatattgcacacacataaaaattctcatacatagttagctaactatgttgataagaaagcatcgcatttttttcaagtctttgtagaaaagacaaattatgcaaaaactggagtagatcaggtggttatgtaccttatgataggacctactaatttatactttttataaagttatagcctactaaatctaaaactcaacatgcaacattgccacattatcacccattaacaataattgcatatttaacctcatgcaaacatacaacggcatctataatttatttaattctacaaatcaatatgtaagcatatccaatcatatcccctcacatcatttgcacaatattttaacaaatctatctattattttttataatatttaaaatatacttatcaatatgtttcacattaaaacacgggtatcatatgtttcatgataagcactgataaaacctaatgtttcatttcattatttaccctgattgtcgaaaaaaacatattgagaattgcttagcaattcccgtagcaaaatgcggggaaccatctagttttataatagtagacatcgtacccgtcgacgtcaaagtgcttgtactagtttttcttccatttcaaggtacgctgattcatagagataggagagagaggttatgcgcgagtggacatttgtattgagtttcgtaaaaagaataggaaaagaaaaagaaaaactgtaggaaaaataaattgggtttatcacggcacgtaagtggtaataagaaaagaaaagaaaataggtaatgggtagagaagattgctaacttgatcgttgagctgctgtcggatgaaatgaaatgaatgaaatgaaaggtaggaagcttcttaacagaaaaaaaagagcggttatgtagagtatataattatatccgcagtaaagcgaaagagatatgtatgtgtgacgacttggcccactcaaatctatcaaccaaaagctgatgagaagaaactgactgactaagtgcaccatataaaccaatgaaagcaatccacgtctatacgtaaatagttagggacagattcagcacaaaaaatgtatcgtattcaagcagcagaacatcgattgagatcgatcgatcgatggatgatcggtccagctagcttaatgaaattattagtaatttgacgttgtcaaaaggcaagcgcattttccattttttgaggacaaaaggcaaggcattggtgaatggtgatagctactgcaattcactttttcttggcgatcgctagctttatactaatattttgcaatcgatcgatggagtgcgtccatgcgaccttttgttgactcgatcgaacatcgatgtatcctcctacctcagcttacatatatgcataccaaatcaacgggaaaaattcaagcaacaattaataatttcagtttgcacctctctctctatatatttaccaacggggccggctagacagtttactttcaggcaggcaggcagcagcagctattactatcgagctgaaaacgagttcagtacagctgcgggcatcgccggccggccggccggctgctccccttcaaccaaccaaaaaaacttaggcttaggtcgtcatggagcagcagttgtcctcgccgtcggcgtcgcagcgtggcggcgggagggagctgcagggtccacggccggcgccgctcaaggtccgcaaggagtctcacaagatcaggaagcaggagccggtgcagcagctccggcagccggtcatcatctacaccatgtcgcccaaggtcgtccacgccaacgccgccgacttcatgtccgtcgtgcagcgcctcaccggcgccccgcccaccgcaccgccgcagccgcagccgcaccaccccacgctcttggcgcagatgccgccgcagccgtcgttccctttccacctccaacagcaagatgcttggccccagcagcagcactcgcccgccgccatcgagcaagcggcagcacggagctccggcgccgatctgccaccgttgccgagcatcctgtcgccggtgccggggacagtactgccagctatcccggcgagcttcttctccccgccgtcgttgatcagccccgtgccatttcttggtgcaacgactacttcttctgctgcgccgtcgacgtcgccgtctccaatgggcggcagcgcctactattgggatctcttcaacatgcagcagcagcagcactaccaccaccaaaattaattaatttcatccatcaattcagatatataatttgcacggatatggcgcggtcatcatcacaatattggcatccatttaattagttcctaagctagttagggtttaccatattttttttagatatatgacgtcatagtcatacaggagaaaatccactgtcagatgatagagtacattgggattaattattgatagatagtcgatgctaattacctcgttagctagctagcttaattagttagagtgcacaactgtaactaactctagctagctgcaaggaagcttcatcgtatcgatcgccagcacctactaattgattttctccgatgtacttgctgtaatttttcactcttgtaggcaccccacttaatttggaggtgataatatacctagatgccacagtgtataatgtaatattcacttcattcattttttatataaactacaggtatgttaaccagttgtgccctcttgtattatatatgctcttgattctaccgtacgtaccacaccatgcacgcattgcggtcagttcagagagaaaaaaaaaatcagaattgctaacctactgccgacataaattgcacccctaaatcttgcagattttgagccactggatgagcttcgagattcatgctccaggccttctactccaactccagtgacctcctcttcttttccagcgccgacgacacctagactccggcagaggactctacgggttaaggtctcgaggtgaggttggggtgggaggggcaaggggaaggggaggagttcttcggctctagagggttggctaggagaggcggcagcccagcggtgggcggcgagacgccggcagcggcgccggagcgcagggctggaggagggcggtggaccagcgttggtgtcgggggcatctcgccgccgacggcttgaggaggaaggaggggggaggaggaggaggctggctggccgagggatctcaccggcgccgttgacgccctccggccagccggcgaggcagcaggcggcacagtggggcggtggcggtggaggaacacgcgatgggaggggaacgggaggaggagcgctagggttaatgcctctgtacgaatcttaaagcatatttgatggtccaaaatttgaaggataggaggtgggattttatgtcagcagatatataggccgtctcaacaaaaaatttgcgaatgtatacgatcgatcaatgaattaatcatgcattcatatatatacaagagtgtatgcaaccatgtcccgcgactggcaaaagaactagtcgttctcgctctcctccctcgtcctagttttgcgtaacatagccgcatcgccatactcgggcgctgttgtctcccttcctcgacgcggcgaggctacaccaactggctccttggacgagcagtcgccagaccgtgcatggttaagttcatccgtcgtcaatggatgccgatcgagtttaattggcgcctcctccgacgccgtcgacttaatcttggtgagggcggcctgccttaggagcctatggtttgcatagctctgtccatccccattgccgttgacctgatctcgtcgagctgaggcctatgacgatcgagcagatcaacataacgagcatcaacctctccacgctcctccgccaagagcatcaacatccgttgctaacaagtctagttggaggctgcccagtgaaacgtcccatcctccactgtcagattggagaaattgattggggaggataaatatctataggagtgagaacgaaaaaaacaaagagaggctgataagtaaaacccattatcagattggagcgcaagccacatatggctctaaattgtttgcctagctaaccaaataagggcacctttgaatcaaaggattttatgtagtaatttcatacgattcaaattctataggaaatttttctatgtggccatttgattcaaagaattgaagctttaatttctaaagaattgaagctttaatttctaaatcctatgaaattcctatggaatggcttatttcatataggtttttgaaggaaacatagcaagagctctaacctcgtggaaaatttcctttggatctatctctctcatccgatttctgcgtttttcatgtaatccaatcaaacgatcattcatgtgttttacctatattttgcaataatctattttaaacttacattcatgtcttgtgtttttttctattcctccgtttttttcaatcatgcgattcaaagggaccctaaatgtttggagaactaaaaatatccactctattagagatgctccggtgaagtgtccaatgcatggagatacaaatgatggcaaggaaaaatggcatggaatttctgtttttagcctactcactcattaaacaatctgaaaatagagtattttcatttggatcaccttttcattgttgtagtaattaattatcatcaatcgcacaaatttgatggtttggattaaactatctattaaaatcaagacaaaatttgttctcacctgtcaaaatttgttcattagcaattattgcttttaaatatgaattaaccactcgttataaagatagattaaaaaaatggagggagtactcgtgtaattttattcttttttgtgctgg

SEQ ID NO: 82180 - DNA, 2407 bp, Oryza sativa
aaatactttagcctctgcaggactcccccacacacggaggtgagctagcgagggtactcttcctgtccatagctcatacggtgttttgggcaccgatttgcttggaactctgttgagaatatgaatggcggtttttaacgcctccatccataaacccagtggtagtgtggagtagctcatcatgctacgcaccatatccataagggtacggttatgcctttcagctaccccattctgttgaggttcgctcggtgttgaatactgggctactattccattctctagcaagaaccttgcaaaaggtctagggacttgcccataaggcgtatgttgaccatagtactccccccccacggtcagatcttactactttaatctttatatcatgttgtttttcaacttcagccttgaatatcttaaatttatccaatgcttctgatcgctctttaattggataaatataaccataacggcagtaatcatctgtgaatgttatgaacgaatcatagccatccacacttttcacaggaaatggaccacaaatatctgtgtgaatgatctctaaaattctcgcgcttcattttgcaccctttttgatgctatttacaaattttactttaatgcattctatgcattgttctaagtctgagaactccaatggaggaagaatttcattcttaactagtctctcaattctccccctcgaaatatggcctaaatgacagtgccataatttcgatgagacatcaggagtgctctttcttttcttgttttcttttgtcaacgagaacacaacattcacattctgagaaagagataacaaataaagctcgtcttgcaacacaacaagaccaatacatgcattataataccatagttcacatttgccacttccaaagcggcaatcatatccatcaaaatccaatttcgatacacttattaaatttctttgaaaagaaggaacataaaaaacatctcgaagtaaaagtgtgaagccattcgtgagctctaggcaaagatctccagcagcttcaactttttcttcaactccattggcgactccaatggagctttcgcttctttgcgtagtcctcatcgaacagaatgcctttaaacaattacatgcatgaatagttgctccagaatcaatcctccatgtggatctagaataaacaacataatgagattcatttacaaatgtaacaatgttcttacctttccttgccatgatcattttcaggaagtcgggacaatctttgttgtaatgtcctatcttcttgcagtgaagacaatgatccttttcaacagtgaactgttgttgctaaggcagatgctaagacttttttgcttttgaggagggagatttgtggttcttttccttgttatctttaacatagttaattgagccaccatttgactctttgattctttcctcctcttacacacaattagcgatgagcttttcaaagttccatttctctggacttatgttgtagttgacaataaaattgtcaaaatgctttggcaatgaggccataaccagatggaccagaaagtcatctgttatgcccaaatccattggcttcaatttggaagccatgttgctcatcctaagaatgtggtctctgacagcttgatcagctgtgtcgcataagtctttgaagagctagtaaactgactctttattctttcaaggtactctgagacagcgtcacactctgggattgaacccaatatcgatggctcaaccgtgttctttaccacagccaaacatttcttgttggctaaggaccatttcgcatgctcaatgtcatgcgacattatggtgggattattgtccctttgtctcttttgccagtcagcatctgactcattttcacctctgacaagtgcagcaggttctgtaggacatggggtagtcaacactcagtccacctctcccaagatgaaagcaaggtcgagttttcttttccattctccgtagttatcttctttcagggtcggaatatctttaatacaacccatcaaggagtagccacttgaaataatcatgtacggtgagaacaaaattaacactaaaatattgtgcattaagcctacatcaccgttgggcagaattagacataacacatagaaccataactataatattgcaattaacaacgttggttagaaaattacaacatcatagcacataattaattttccaaaaattaaattctcccgttggttcgaaatttaattttagaaacactaattttcatcaatttcaactatttgcagcggaagatctatataaaattcatatgaacagtagcaattctgttatttacactctgtaaaaaaataccactctggttcgaattttaaacagagggaaaacataaaaaaaattcaaattctattg

SEQ ID NO: 82181 - DNA, 1480 bp, Oryza sativa
aattacaaatgtctacaactgaaaagagactagacatcagctaattaactttagcgtgtagttttaaaataatggactaggcttgtctcttatgtgaagtacagacatcctacatgtgttagttgctgtgctatggcttgttcaattcttgaggcgcataagttattagcacaaggcgcataagttctctgtgcataagttctctgttttgtgacagaaaggtcatccagtaaatttgatgtctttaatactaacctttcacttgtgtattatgtaggatcgaaacacaagaactaggccaaccagaggggggtgaatggttggtatacccaaaaaccgaaaacttttagcggaagtaaaagttaccctcaatttcgatgagatcggtctgaccgaagtagattagccggtctgaccgaagcgtagcagccggtgtgaccggtgttgatctaccggtctaaccaccgagatggcttgccactcgttgtcgccgccgctggtctgaccgccgtgctcccgccaatctgaccgccgcaatgccgccggtctgaccgctggtgagttgccgattagaccgccgaaacccggtgaaacacaaatcgaagaactcttaaagtagatgacaactttattgattctctctgtgtttacaaagtacaccaacagcactccttataaaatttcaactaaactcgaaaccctaactcaaaactcaactctattgctctgaaaagcgataccgggaagcctcacgctccccttctatttatacatgaggtaggcagtctaaagccacgaaccaaactcatactaggagtcctaaacaccttaggaaaccctctagtacaagaaagaagctttacataaccaatcgtaccaaatttggattccttccaaattcaactctgcatcccatacgcacacaatacctccatcatatgccatatggaatctccatcaaccacgtgcatcaactctagcctaagtatcccgcatgatctctgaccaccacggacatcgtcttatccccaagccgactcccggtccatcaccgcaaatactctcccgagacatcgagtcacctacacatggaacaaacaaagaaaccatattccaagtccaagctatctccaacttgactcattagtagcaaacaatagtattacatacgtatagtatccatctagaagtcataatcatgaaataaactcggatattcaaataaacaacccgaaaccgaaaccgacacagtgtcggccggtcagaccgcgggctggccggtccgaccgctcgaacaccaccggtctgaccggcaacacctgcccggtctgaccggtcacatgaaataatgaacctacgattcacctgtgaaatccagtcatctccaaaaccacttcgtaaataaattccaaataacaaaaccaataatctctaatgcccaattgttcatcacataataataaccaagggctgcaggaat

SEQ ID NO: 82182 - DNA, 20022 bp, Oryza sativa
tcgtgaacatattttgccaatcaaggatccgaccgcctagaacatccgtataagtagtaattaacggacagtcccttatttcttagggatgtggctaagttatttcttaatgatgtggctaagttattctcttaatgatgtggctaattaagtaatttgcaggaagagtttcacctttcagttatttagatatatcttattcagtgtttgcccaagtgtatatatgcttatatatagcatccctctgacgtgtttgcatgcgtggcatcctaataacattcaattcagcaagactggccatggtgtctctttttccccctggattgcgtacgcatcaaattccccctgatttgcgtatgcatcgatcaaacaagttcatacaatagaaggagttctttgaaagtttatatactagattgcacacgtccaataaattcatgtacaacacatgacgcaccaacacaatttaatatgaggaaaccgactcaacattcaacttttaatataaatacagttttatagtttgttcggtgcaaagtagaatgaaaaaaatattgaagtaattacgacatatattgtactaatgagtgtgaaacaaaagaaagttgaatgaactgtaagtgctctgattattaggaatagtgaacattgccttgcaaacaggtccagccttgaggggggtcgagctgtgccaccgcactgggccctacaagtcaaggggaccaaccccatattcgtatgcggattgttggcggatggcatgaggcccttcgaccaaacctgccgaaacccatggcgaaggctatggagcaagagcggcgcaaggcgaagagtagcgccaggccagaggcgtctcaggcgaagggtgcaaggcgaagactgtctgccgaaggaggatgacttcgccttgacaagttcgcccccgcgaggaccgaggaagcctctccggcccatcaggccggtgatcgccagacggctcatcaggggcccatgagcccctataacattatgtacccctgtaaatgccctttttgtaagggtaatcatgtaaattcccctgtacaacctaaacgctggtagtaaggacctgtaatggggctataaatagtcccctagggccatgtaatggggggatccaagaaaaattaaaaatttagtacacttcattttcccaaccactgttgagtaaccacgtcctccgacgtatgcagttgtcgtttcgacaacagctggcgccgaccgtggggactccgagcgaaaccactgagagcgaatgccatcgaagagggtcgtgaaggagaaggttgtcaggcgaaaggagagcgacgccggaccggaaatggccgccgaggaatgagcagagccttcggcgtccgtggctgaagatggagaagcacaagcgccatcacagccgccttcggcccccgcgccatcacaaccgtcttcggccccagcaacctcagtgcaagtgccgaacacggcagacgtggcgacaagggcactccagaccagggcggagatcctttcgacaaaccaactggtggtgcctcaagccgccacatcgcagccggcggcgccaactgcgctcgccgttgtactggcccaaatcagcctggaccccaaagcgcaagccgaagccgacatggaagccatgcggtagaacatgacatggctccaagacatgcttcgccaaatgcaagaacaacaacaagcatacgaggcgacaaggcggaccaaggccacgtcggctccaatccttcagtattcggcaggctatgccccacctcaagtccggccgcaagtggtgacccagccctctccgccactagccgcacagccgccggtgtacttcgctgggcagcatcaaccacctggccaagcgacaaaaacggtggcggaaggggcttcggctctgcaggcgcaactccaagcccactacatttcaagtacaaccccatcggctcacccggtggggaatacaagtcaaggtgcgcctaattggttgccaccgattcagcaaggctcgggaccttcgccgtggagtcaaggacagcagttcgacttcggcaacactgctcaggtgccaaccgttcggcagcaagttccaaccccaggcttcggaacaaaccaagcaccaatccaagctgccatgacgtggtcgcagccaatttttgacccatccatggcggctcagcaagtgcctccagttggagccgggcagccgaacgccatggcccaacttcacgcacaagctgcgatttcacccttcgccacaccgtacccgcagcaaggtgcggtaaagagggcgggaggcgaaaaggggctaccgctgagtgggggaatcaagactcgtccaatcccaccccagttcaagttcccacccgtcccgcgctattcaggcgaaactgacccgaaggagttcctctccatctatgagtcagcgatcgaagcggctcatggtgacgaaaataccaaggcgaaggtaatacatctcactctagacggcatcgcccgttcttggtatttcaatttaccagccaatagcatttactcatgggagcaattgcgcgatgttttttgtccttaactttcgaggcacctacgaggagccgaagacgcaacaacacctactcggcatttgccaaaggccgggtgagttgataagggagtacatgcgtcgcttctcgcaagcccggtgccaagttcaagacataactgaggcgtcggtcataaacgccgcatcggctggtctgcttgagggcgaactaacaagaaaaatcaccaacaaggagccgcagacgctcgagcacctactttgcatcattgacggtttcgcaaggggtgagaaggattctaagcgacgacaagctatacaagctgagtacgataaagcctccgtcgccactgcccaagctcaagcgcaagttcaaattgccgaaccacctcccctctctgttcgccagtctcagccggcgatccagggacagccgccaaggcaaggccaagcccgcatgacttggagaaagttcagaacggattgggcgggcaaggctgtgatggctgtcgaagaagtgcaagccctccgcaaggagttcgacgcccagcaagcaagcaaccatcagcagccagcccgcagacttctactgcgcctttcacggacgctcttcgcacaccacagagcaatgccgaaacattaggcaacgtgggaacacgcaagacccaaggccgtagcagggaacaactgtcgaagcaccccgcgaagcagttcaagaacaaacacccccggtcgaacaacgtcaagacgtgcaacgaaaggtaatccaagtgattacgagggccgacccgccaggccaattatctaaaaggcagaaaaagatgcagatccgagcggtccacagcatcacttcagcgggtgagggggcgccacagtacgtgaaccagctgatctctttcgggccagaagacgccgaaggagtcctgttcccgcatcaagatccattggtaatctcagctgagatagccagttttgaagtccgacgaatcctggtcgatggagggagttcggccgacgtgatcttcgccgaagcatatgctaagatgggcttgccaacccaagctcttacaccggcaccaatgtcgctctgggggttcggcggagaggcagtgcaagttcttggccaaacacttttgctgatagctttcggctcgggagaaaacaggcgcgaagagcaaatactgttcgacgtcgtcaacatcccatacaactagaacgccatcttcggccgtgcaaccctgaacaagttcgaagccatttcccaccacaattatctcaagctcaagatacctggcccaacaggggtgatagtagtcaaggggcttcagcctgcggccgcttcaaaacgcgatctggccgtaatcaatagagcagtgcacaatgttgagaccgaaccgcatgagcggccgaagcacacgccgaagcccacccctcacggcaaggtaacgaaagtgcagattgatgatgccgactccacaaagctcgtatcactggggggcgacatgggcgaagaagaagttgagagcatactagaggtgctcaaaaagaacatcgatatcttcgcctggagccctgacgaggtgggggggcgtcccggcgaatctcatcatgcatcacctagcagtcaagccggatattaagccaagaaaacaaaagttgcgcaagatgtctgcgttcgccaagaaacggcgaaggccgaagtacaaaaattactccgggcgggggttatccaagagattgaccatacggagtggttggcgaatccagtgctggtgcggaagtcaaacggcaaatggcgcatgtgtgtcgatttcacagatctgaacaaggcgtgtccgaaagacgatttccccttgccgcgaatcgaccagctcgtggattcaacagctggatgtgagctcatgagtttcctggatgcatattccggttaccaccagatctacatgaacccgctcgacatccccaaaacgtccttcatcacttcattcggcacattttgtcacctcaggatgcctttcggcttaaggaatgcaggagcaactttcaccaggctggtgtacaaggtccttggcaagcagttggggcagaatgtggaagcttacgtcgatgacatcgtcgtaaaaagccgcaaggctttcgaccatgcgatcgacctgcaggagacgttcgacagcttgcgcgcggcaggcataaagctgaatccggagaagtgtgttttcggcgtccgcgcaggcaagttgttgggattccttgtttccgaaagaggcatcgaggcgaatcccgagaaaattgatgccatccaacaaatgaagcctccgtcaagcactcagtcgattcctctcaaaggcggccgaaagaggtttgcccttcttcaagaccctccggggcgcgggaaagtttaattggacaccagagtgccaagcagcattcgacgagctaaagcaatacttgcaaagcccaccagctctgataagcccacccccaggaagcgaactactattatacttggcagcttcgctagtggcagtcagtgctgcactcgtccaagaaacagagtccggacagaaaccagtctactttgtctccgaagcactgcaaggagcgaagacaaggtacattgaaatggaaaagcttgcttacgctctagtaatggcttcacgtaagctcaagcactacttccaggcccacaaagtcatagtcccatcacagtaccccttgggcggaatactccgaggcaagaaagtcactggccggcttagcaagtgggcggtagagctgtccccgttcgacttgcattttgttgcacgctctgctatcaagtctcaagtgctagctgacttcgtagctgaatggacaccggtacttgcccccaaccccgagcccgaagaccagttctgggtgatgtgctctgacggttcgtggtcgcacaagggggcaggcgttgcggcagtcctcttttggccgaatggtgtgccgattcggtacacagcgaaattgcagttcgacacaaccaacaatgcagcagaatacaaagccgttctcctgggcctaagaaaggcgaaagcactgggagtccggcgcctgctaattcgaactgactccaagttggtagcaggccatgttgacaaatccttcgaggcaaaagaagaaggaatgaacaggtatctggaggccgttcggtccacggaaaaatgcttcaccggcataacagtcgaacacttgcctagagaccagaacgaggaagcagacgccttggcgaagtccgctgcttgtggtggcccacatttgcctggcatctttttcgaagtcctacatgctccaagtgtgcccgtagacagcccggaagtcatggcaatcgatcaagagaaactgggccaatacccatatgactggcgaactccatttgtgaaacaccttgaaactggctggcttccggtagacgaagcagaagcgaagcgtttgcaactcagagccacgaagtataagatggtctcgggtcagctttaccgctctggggtacttcaacccttacttcgttgcatctcttttgccgcaggcgaacaaatggcaaaggagatacaccaggggctatgtggcgcacaccaggctgcaagaacagtggcttccaaagtatttagacaaggagtttattggcccactgtgttgaaagtctgtgttgagcaaatcaagaagtgcgaaaattgctagcgtcatggccgaagccaagccacgccctagtatgatctgcagcccattgcgccagtatggcccttcgccagatggggactagacatcattgggccattcccggtggcgtgaaacgggtataaattcgcaattgtagctgtggaatatttctctcgatggattgaagccgaaccccttggggcaatcacttcggcagcagtacagaaatttgtatggaaaaacattgtttgccgtttcggaatgccaaaggagttcattactgacaacggcaagcagtttgactctgataagttcagagaaatgtgcgaagggcttaacttggaaatcaggttcgcgtcgatcgcgcacccgcagtcaaatggggcggccgaacgtacaaatggcaagatcctagaagcactgaagaaaagacttgagggggggggggcgaaaggcaaatggccagaggaattgctatcggttctctgggcccttcggacgacccccacaagaccaaccaagtttagcccatttatgcttctttatggcgatgaggcaatgaccccaacggagctaggggctaactcaccaatggttatgttctctgggggcgaagcggggcgcgaggtatcgctcgaactcttggaaggtgtaagggtcgaagcgctcgagcacatgcgcaagtacgccacaagcacttcggcaacttacaacaaaaaagtccgacccagggagctgatgcttggtcagctcgtcctaagaaaaaaggcgaacccagtagcagttggcaagcttgaatcaaagtgggaaggaccatacctcatcaagcgcaagtccaggacgggatcttttcgtctagcgacactcgaaggcgaggagttcgatcattcctggaacgccgcctgcctcaagcgcttctatgtctagaatgggtggcacccaaatcgccaacttgtaaaaatgtacatattttcatgtaagcctttcggcactatgtaagcctttcggcaagaaaaaaaaagaaaagaggagaaaaagaagagaagagagaaaaaagaaaaaaaaactggatgtagggctattatccaccatggaggcccgaaccggtataaaatctctgtgtcctccgccttcttcttacttttcgtgtgattgataatttgtggaaaaaccccaaggcaaactcctgatcagcgaaaaaggccaggggggcgaaacgaatcggctgaagcattgctcgccgaacgttgaaaccgcaacagcttgtctcggaaaataaatagccgaacgacgttacgaccgatcagcataaaagcaaaagcgtttctctcgacatagaacgctacagatcgaaaacgaacgacgaaaagctgaaaagtcactacacctatttcgctaatgttctgacctaacaaaagcacaaagtttgacgatgcgaaaaatagtgaaaaggaaataaagcacgttctttattagcttcgaaaaaaataatcgaagaatacaaggtttacaacccgatacaattcattttacaagtaaattacatttccgccccagtaatcattatccctacttaaggaatggtcggacgaactaggtttgtcatcactactaatatcatacacaattttaagaggagtagggggcgaaacacagactaaactataacgacgctgaaagatcgattcctggcgtttactcttctgatggtttcgccaaaagcgagccatatcctccaaacatcttgaatgaacaagatcgtaatcttctaaggttcgcccggggtgcgcccgcagccagttggcaaccttgaaaactttatagctgcgaccgtttatttccatttcgcgataaacaggccgaaatagacatcgcaccatcagcaaacccttcaatgccacaaatttctcgttttgacttcgccagctcccagaagggggccgaatgcatgattttcgacagaccccctggtagacagtgcagaaaaggcaaaacacatcttgcatggtaagaataagcgaaagaaggggaaggtatggcataatgcaaaatgagcgaaataataatatgccaaagactttgatcattaaaaagtggttaaaattatcatacagtccaagtatgcaaaaaagccttttttaaggtttagcggcagtttgccgaatatacaatggttgccacatctagcaaacaccaaaagaaaactatgaaaatctaagagaagggcggagggcctcacacctctgggtgatcctgggcatcgcctccaccccctccggccactgcgccctcctcttcacaaatgtccgccgcctccgctttcgccagctgctccaaaaggcgcgccttagcggcggagcggccatccttctgccaaaattgttttcaccacgcacgaagtgcaggcgaaatgtcttgcgcactgatttcccaatcccccttcgcgtacttggggaactcggcgatgtgctcgcagccgaactgctgcaggaggcccatggtaaaggccgctgacacgcgtgcacagcaatcgccgtatgcggtggcgcagtccgaaaccgaaccaccagcctgttgggtccattcggagaagtcgaaggctgaggcatcttcagaggggacaccccgcaccttcgcgcccatatcggtaagggcaaggcgaagcgtttggcacgctgtccgcgcggactcggtggatttcaccatctcccgcgaaaaccgccgcgactcctctgcagcgcttgcttcggccttgcgaacctcctgccgaagagcctccatcttcggctcggtgaggttataataatctatgagcacggcggtgtgggccttctctttctccagttcggcctttaagcgatcgacttcggccctagcttccttccctttctctagttccgattggagctgcttgttttcggccttcgcctccttaagggtgttggcaagggcctccatctccaaatttttgcggcctagttcgtcatccttggcccgaagacagcttttgaacccatcaagtcgagctcgcacggttcactccgttgagcagtgagccgcgaggatctgggcgcagaatacgagcggcaaagagaacaagtatcaattgtaaaaacaagatagaggaagagtaaagataaaaaggggggaaaaaacgtacccgaacagccaggctttttatagcagagcactcctcgtcgaactcattcagttcggtgaacaagctcggggcgctggcgggcagtacaagattgcttaccccctccacaaaagaaaggaggtccgctcgcatctcgaagtcgccaggggcgaagcggggtaccgagagcgaatattccgaagcggatgtctcagcgaccgctctctttcccttcgcctccatcagcggcgaggcaaccggctgatgcggaggactgccgaatactttcgccgcggccatcacaatcctttccgcagaagccgaagccccagcggtggtactaccgtccactccagtggcgccaagtggaggaatgggggcggccgaaagatccaggctgcgaccagcgggtgaagtcggagtcctgtcggaggactcgtcatcgctaaaaacgcgagcgacatcgacgagccctttctttttagccacctttttgacaagacctcccttcgccgacgcgcccgaagagaacgcaactagggccttcgccacttccaaatccttccgacgaaggggggagctgttcgggtgtcggcgcggtcttcgactgcctcacccgcggccttatcagccacaacctccacctcctcctcttcctctccttcctcctcgccgtcacgttcttcggcatcatcctcgtcgtcggcgtcagagtcagacgaagcaggaacccttcgcttcttgggggcaagcttcacttgtccacgcatccgctttcgcgaaggccctgcctcgtcgtcgaccttttggggattcgcccggggaggcagttcgccattgtaaacccggttcgcccgcccagtcgcttgacgtgttaacagctgactatactcgacgaccgaaacatcgccgatcatcctgcgggctttgtctttgggcctggtcgagggtcaacactgtaaaagtagcgcgtgaagctacgtcaaaagacaaataaggcgaaataacaaagcacagcagtatatagcaaaagaagtcttactgttcgccccctcagggagtatcaggttcggcaaaccgtcgacttcttcgccttgctcaaccgcgacttgccatgactgggagaggggaaaaatgcgaagcatacaaaattcctccaccaagtcacggtagctaaggcaggagcaaaccttccgcagtagaacgaaccgcgcctccatggcgccgtccacagcgatcttggatctccggttcagcgcaatcgccctacgccggcaccggagggctttcgctgattcagaaccagcctcgaaggggatggtgtggtagaaccacctcgccatccaatggcggtcccacttcgacatagtagcgttcactggccagagatcggaccgctcggggcgaacgttgaagttcacgctcccgaacacggtttttttcgttccagccggggtgatcactgtcttcgagttcacggtggcgaaaaatatggcccaaagagctcggcgttgggctcaaacccggaagtccggaacgcccagtcgaagatagcgatccgaacaagcgccgacgggctcagctgcggaagttccacctcaaagaggcgaaggatctccggcaacaacacgttgcagggaaaccgtagccctgcctcaaaaaatacggcgaacaccaccgtccggttgtcgacaggtttcggcaccacggttttccctggggcgaaagcctgcccctcaaccaacgctccggagctgaccagcttcgccagctcgacgtcgtccacaagagagacccccagaaaagcggtgctgtcgtcatcgactcagccgggatctggccctttcgccgaagtagggtttggcttacgtggagccatggcgaacggtgcatttgcggtggcaaaaaaagatattcggcgaaacgcctgaggggtcgaaagatgctgtgaaaggaagagacggagaaagagagcgcgcacggtaaaatggcaagtgtggcagtgtaaaggaaagagcaacgggaatatatagcccacccaagcgaccgttcgcctacccaccagtaataaagcgccacgtgtcgcaagggtaggcgaaacggtaaattcccatcgaccgagcggcacagtaaaaagtccaaagataggaaggcccaatactgttccgttcggcccaggaaaaaataatatatataagcatcaatctcacgaggcgaagcgcggcaaaataataccagccgcacaaataacaaacttcattcgcaggaataatgttgatttcggcaggagcatcggtcgaaagggggcgccgcataccataccacatggtttgcacggtctcggccgaagctccagtctcacccttgcccatgaggggcttgttggcggatggcatgaggcccttcgaccaaacctgccgaaacccatggcgaaggctatggagcaagaacggcgcaaggcgaagagtagcgccaggccagaggcgtctcaggcgaagggtgcaaggcgaagactgtctgccgaaggaagatgacttcgccttgacaagctcgcccccgcgagggccgaggaagccttttcggcccatcaggccggcgatcgccagacggcccatcaggggcccatgagcccctataacattatgtacccctgtaaatgccccttttgtaagggtaatcatgtaaattcccctgtataacctaaaccctggtagtaaggacctgtattggggctataaatagtcccctagggctatgtaatgggggatccaagaaaaattcaaaatttagtacacttcattttcccaaccactgttgagtaaccacgtccttcgacgaatgcttttgtcgtttcgacaacacggatataggagcccataggccatatataggaacttagatttacgaaacccaggagagaaagatatacaatttgtttgataagaaagtttattttatgctttacatttgttagaaacattcttatactttcaaagttgtattgaaggcccatcattctagcttcactccgggccactatattgacaggaccaggcctgcttgcaaaacaactagctcctaggaacatggaaatcaaggtaataaatttggtcctagttaattaaaaatggcatgacaagttagtgtgcaagaaacgaaagttcatcacaaactcgatcgagtggtgcatacaaacgacagaactatatcttgtcgtgtcatccgaaaccccatgatttgatatgcccagtcgtccagccgtatgacactgttagcgtgttggtttgtttggcatgtgccgcttattatgtttatgtcgtatctcccgatatctctaggttctattccaatatgtcggttgagcagatatgggaaggttcgggcgcatatgtactccatatcattgtcaataatcaatatatttcgttgaggcatatatcagacaccattgagagttgatgacagacagacggcacaaagtttcaaaaattatgatgcacacatatatactgttaaataactagtggcctattcgctgatccggagtagaagacgacatcttatgcacacaatcatatagtagatgaacacggatatagagagaggcatcacagctttattgctttctcatatatggatacatcaaccaacctctcaagccctctctctcagtatatatacccataataggaagagtcctattaggatacgttttcatatatttggtatgagcccatatttatctctggtaggagataatagtttcataacactccccctttgacgaataccgcgctatacacatgtcttattaaaaactccatctaaaaacccagtgggagaaaaggataggggaaaagagtacattgtacacgctagttatattgcacttgttgcctcgttaaaaaccttgcgtgagaaatattcaagtaaaaactcactaaggaaaaagagtacaacacacgatcttcttgatcgcataatctttaagatcgactattcttcgtaaatagctaatgatctatatgctttattatattaatcaacttggattaacacaacaatatagcagtagtaaccttcaaggtaaattatcaaaacaatgattaatgtgattaattgttggcaaatcaaatataagttccaagtcttaagtatgataatcaatgtttagcatatatgctccccctcaataagacatccgttgaaacttcatgttccaatgtcataaccacatttttattaatgtgtaaaacaatgataataaaattaccacaatgtttaatctttcgtttacttatttcataagttttactatgaacatgagaaataaatcaacgtataggagcaatatgtataaccacttattcaaatgtgcaatacaaacaaagtttaatccttacggaggattatgggaaaataagttgcaacaatacacatatgtggtatgtataaaataattagctcaatacaagaggttaaatattatgcaactttctcttagtggatttatcaatcattatcaatttgattgtttcactaatcttcaacaattagcttaaaccacttagagtgacataaaccggtctatattttggcattaggagaattaataatattgccaaataccatcaataagtatatcttcgagatatataaattcttacaccttcatagtatgtagaaaactaccgatccacttgcatgctagtggatgtgattttccaattcattcgtttgaacgggtctgtccacttcatgggtgtacgagttatcggtgttatatggagattaaccggtaattcatacattagcgtagtcctacagggattaacttattcttccggaagccattttctctgctatgagaaatattctcacttctaggagaaaaactcttcgtgagtcatcataaactcttctacgagtcttgcaattctcttcatgagaatatagtgtgcttcatgacactaattagtatgagatttacacatatgttacgaaattgttttctttctagtgaaagcttcatatggattttcataacccataaactgcatatcatttatttattcatgccttttgccagcgatatatatatagcggaatttaatacattcatagtaggagaatattagtcttttccatgaccatatgaaccgttgcttttcaccacttcatttcctattaagtctgaactttcatgttcacatagacttatttagcgactatggttcaacctcgttgctttcttcaatagactcgatatgagtgctactatgcaactctgccatggactttggttccggatccagattctcattagagaaatattaccaatcatagaggcgatgttgtcaacaactattcttttctccacatactcattccgtgaggttaattcattataaaccatatcttagtcatttcccaaacataagatgtatggttgttccgcatcccataattagatagatatgtgcactttaattctgggttttcatcttcatgatgaacctcttcatgaggcaattcaccttcatggtgattactccgtagattttagaacattgacttacatgtcactctgcatttgtggatatactattcaaaacccggggtataccactgttagcagaaagtttactacaagtaaacataacttctgattactcctttaattcataattatctagcaagctcccgcttctggcttacaggagaataaactaaatcttctagttcagattggcttgtgcattattcttacttataatgatccttttcttcttgaaaatataaggcatctttaacacatgggcttttctccccctgatgccgatattcaatctttatctaatagcatattacaaaaatcccctatcataggcaatggattaatggaattcggtccatttgtatccccaacttcatgtggaggcccatatatatatgctatggtggtgatatatgagggaaatgttcattcattgaacatgcacttatacaaaataaagggggtaaagatattatatgcagtgagctaacataaaaattgatgcaatagcatgaaaaattgcacatccctaatactgtaggttatcccaattcatagagggttattattctgtgacaatggtgcccaaacaaatatccactactcgacaaaattactctattttctagctttttttttatttgcccaagacttgatccaattactcatactatattcaattcttgaattaagttggatcaataaacttcatgtttatatttatgcaacatagatatgatcataagatgatgagttagtattatataacttaatgatgtcttcaagaacataactataacactaaaacattaatctatgaacatagtttaaccatcatggaacttttcaaatcacccaaacattattctacgagaatatttattcttcttgaatatgccaataaattaattgggtgacatgtctaacttttatttattacgccaaagtaaatgtggtgtcatttgatcattcagaatcattcgaatccaaaaggtcattaattatttaggatattgtttactacaaataaaccaatagctttcaaatagctatatgcaatttcatacttccttgatgaagatgcaattttcaatggccaataaataacacaattcgttgtgtgacaataattcataatgatcccaaataagattcgctaatagtttgggctatttttgcttctagcattttgacctataacacaccaatttgcctgccacgtatccacaatttcttatgcttctttattgcaaatattttaaaattaatttgcaaaatacacatattcctcccccttttcacgccaatcataagaaaacttacaaaacagttgtcgtgaaacccacatatttgttgtaacttcatgatacaacttttctaaaagaaataatgtggttacatatggatatatttaagcttcaatgcttaaatataaatattctaattgttcatgtgcataagtaaacaactttacatgtatgccaatgtggcgtcaatgcacttagaactatcaacctacatggttgattgaggcttagtggataataagaatacattcaccaaaaatacttcaaataacaggcaagacaaatatttacattcaatgttagacatacaattcacaattttattccacaaaagattaaagaattactacaggtaaaagaaaggcaatataggtaaggtgagatgacctatataaaaaaaatattctgtaatctaatgctgaagcttctatgcctaaagcaaaagataaagatactctacatgagcttaaccatgttcttcaaattgaacttaatctaaactataatgtaactcgtgtattgtaaaatactatctcaaaagaacgaatgcaagattactgtcattactattcgtctccccttgagttgaacatcaaattcaaatacaccaaattcctttccttccacaaattttgagttcttcatgaacatattaatagtacaagtcatatatgtgcgtgcaaatgcacatgttgacagtaatacaacttcttgtgtatcaattctaacaactaaacatgttgcatctaggccaaaattgcttcaaatacaaatgaccaatttactcaaaataatttgcatacatccataaaaacaatacttcatttgtaaattcatttatacatagaagatggacataacattatcaatcaaattaactatagacactgcataggtacatagtattttgatagataattttggtgcagggcatattggcatatagacttcttgtctatatattcgcaaattcgatgacattgtatctacttggacacaattaatataaattagttgtagcttatcttctctgatagtcatgcactaataaatatctctaagtcaataatatactctcttcatgatgagtgtatacatttattctatacggagaatatataattgtgcgttctgcaaatgtggcgtcaattagacaaagagaagatatatgaataattttattactcatttgcccaataaatgtatttgctacatgcaactacttacatgatgtccttttatgcaactttctaccggtttacttcttgtaaataaagtgcacaaaacgagtacaaaatagtaaagaatggttttctatacacaccttttattacaatcctagcaattaacatgattttctaatattcaaaggtatgtgtaatttacagaactactaacccacagaacaatcaattatcccaaacaaacaattgccaggaaataaaccataaaatattatgcttccaaaaggggtgctaaaacaaaggtttcacaagttcatggaagctcttttgcctaaaaacaatgtttctaggattaattatggttattcaagaaactaactaaatagttaaagcaaatacatagaaatacgggactaaggaataaatccttaattcttctctatttggcgtaaacccaattcatgaaggttcaaagtataaatggcgaatgtatatttcccttagtttctaatgtctcataggacttttccgcataatttccgagttccgcataatgccttggaaaccaaggacttttgaaataaaataccattttcggaccaaaatcacggttcgtgcccgactccttttaataggccaatttctacttggcccacctccttatactggctagctttaaaacctggccagcccatctcatatgtcgcctaatgggctattacgaccttcccccacaagaagtgggtgaggtatgatccaattgccattcttcaatggagacaatggatggaaccaatggcaaacgtgctagtgagccctcggtagagatggacgtctatggaaagttgccatggtcagaggcgaagcggcgatgcaacatctagtagcaccgacactggcattcgttggcatcaggccgtgtccggcgtccgacaatcatagctccatgttacgtgtcgatgaaactcagctcggcatataggccggcatggcggacggctatcgacggcgggtgctcacggcggcttcgaccctcgtcccggccgcgtgcggtagcgtgggaggcaagccgtgcgtactggcggcgaggggaggcgggcgtgctccttggcgtcactacgggcggcgaccgtcaattgcgttgtggatggcctcgaaaggccgtcgagtcggcatttcagatggcggatcgacgagggaaagtctctggattgattcggcaaccgttgacaaaggggaagacgtcatgcggtggcgtccgggtgtcgctacgtgcaggcagcggcggtggcgcctgcaggtgccgatgactcggatttgttaccatctacttcatacagatagcaatatgatggattattaacatacaagtcacaaccgacagagtatcccaagcgcgctgatccataagatcagcgatgacgagtgtgttaatatattcatagattaatgactatgttagccagaaagacgacaacttctaggtggtgtcgtgtgttactgagtgttaggtgtcgtcgttcgggacaacactccgtcgttcaattcaacggattatgtatgtgcaccttcctgtgtgcatggtaagcgcattcgggcgcgtggtgccaaacttcgtggtcggcgatataacaagggaagagtcggcgcaaatgccggataaatacatctattcatgcgagaaaataaaacgactagaggcatgatctagcatattactctcgctactgcaaagtattagaatagataaaaccgatactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtctcatcatgcccctagaggggctccctgccctccttatataggttggggggcagggttacaagatagaaaccttaaccaatacggtatcggtttcctaaatctactttacaatcttatcaaaccaggactttaggctgttccataatatacagggaaacgtaatacccaagtcatgatctgttacatatttcatatatataagttatcccctataactagtcggataaccatgccgtgtgggtatggggtacccataatctccacagtagcccctgagaccttcacagtcggaaagataatcttctctcgaactagattactccaaagccgagtgcttcaatcatcttcgccatgatctcccgagtactttttccaagtcagaagactgtggagggctgaaaaaataaagtcagatgcatcgactagatgcacctaataggtgtaacccccgactatgtggttaattgaacaaaccaaacatatagtcaaggaataagtcatccaattaaccgagtggtttttgataattatagtcaaccaagtgacttgataccaatatatagcatatgcggtgtgaatccccgaataatatgatccaagtgatataccgactgcttggcaaaatatgatgagtgatatagcaaaatagctataaag

SEQ ID NO: 82183 - DNA, 12864 bp, Oryza sativa
attggcacgcctgcatctcatcaaactttggacctacactggagctaaacagatctcccagaccgttgtattcgtcgacttagttcgcgcaacacaattccggcaccatcgactaagcgcggatttttcgtcaacacaaccctacctaacacgacgatcaaatggaaattttcttttttttaaatatgatgattaaacggaacagagggagtataagttattcacaagaaaaaaactaataagaaaaaataaatacaaaattgcgatataacatatcgcacaactttccttattctccgacaacatagtaattcctctctaaactctaacatgaaaaacaaacatgatgactttgtcacagaacactattcatgtataaattttgatcactcatcttttttgcaaaaaaaataacaaaaacaaaaaaacaaaaagataccatattatcaaaacgtgttgtatcctaaacataagcgttaagttttcactcatcctagtctaaccattttataaatattagtggccaaaatttaaaaagtgccaatcaatttgtgacaagtgtttggtaacaaagagagtagataatttagataaaattttcattttaaccgctcaactgcatgacatcgaagcaaatttcctttcagttactatccctctacaggtattgattttgcaggctattctttatgtacaaaaaaaacacagtttttggtagccaaagttgtaacccctaactgattgcggctaaagttaaaaaagggagagtatgatttaatttgacaaactgaagtgtgaagaagcgacatgagagcagttctgaatatccacaaacaacataaccatagtatatcagcatttgttgtttcaattaagttgatgaaatcagatacaagtcatgagtcaattcaccaaggaagcaacatatagagacagagagcagcaaaggaaggaagcccttgagaatggaatggggaagaagttgcactccaatcgaatccaaaaaaagagggataattaagtcgtctaatcattcattcattcattcacttgatgtgcaggtcacactgcaagcactagtagttctagtactagaagatcaccaccaccagaatcaatcgatactgctgctcccactagcatactagcaatgtgatggatccgccatttacaaaaagagaaggaattatccatccatccatccattggaccggtggcctagatgtcgtcgtctagctcgttcttctcttcctctgcaccatcttcatcttcttggtcgtcttcatcagtgcctttcttgggtggctgatctacctcctgctcgcctgcgttgccaccaacattgttctcctgccatcacaatattgatcaattgtttgtccagtaaaaaacggagggaggaccggagggaaggcaaagagaaaggaaaaaagagcatacgtcgctgcgctcgccattgtggtactcggccttgagctctgcagccttgtccaagtaaggcttcttgtcctcgtcagacatggatttccacctctcccctccttccttggcgacagcggagacgctcttgttgtcagggtgctccgccttgtactccttcctgaagtcactcctgcatattaagcatatcatacatcttcttcttcttcttccatgggaatggaagccaagggaagggaaggaatgtttgttacttacatgaagaggaaaaaggcagtgggtgggcgcttgccctttttggccccctcgccattgttgttgttgttcttgccgctcttcttcttgctcgctgccacctccacggcctgctccaccacctgagcctctgtaagcacagatcataggaagaagatgacgatgagaatcgcagattcgtaggcagacaaagagagagagaaatgagcagcaacctaggctgatgcggatcttgtcgtcgaggctgcagttgtgcatgtcgatgaggaccacggagacgctcttgccgcaagcctcgctgcaaaccaaacccaactcactcccatgtttggattgtattggaaatgcaaatgaaagggggaaatcaaagaaaaaggaaacggactgaccagcgggtgaaggcgctgccgtcgcgcgcgcgcttcaggacggcggaatccgtcgcctccacgcgcttcctcgtgcgtgcgccggatttccccgccattacagaggagaggaggagggctatggatttggaggagatggaggtttggcggcgagtcggcgaccgccacgcgcttatataatcgaatcgaattgggggacccaaatccaattttatttgcccgctccccgctcgcgcgcaatctcttctcttggatgccgcgaaacaacattcattacttggcgccactccagccactcatctcgtccgttgagccttccatctcgctggatccgacggtccacagtgctcgctgggaatcaggagctccgcgcccacccaaattcccaaatccatccaaatttccaaatccccgcttcgttttggtttggagccaaactgaaagcattttcattttcaggtcggctttccctccatccctcctcttcagtttagtttggttccctttcaaggcttgctaatattatattctcaagtgcacatcttaagctataccaatttcatttctcgacaccacacagccacaaaacatcaattcaacggattgggatcacctgcagtaggaatagcgaccgcaagttaaactactgcatgcgattacagccgttcattttggtgatgaatggaccagatcttccgctacagtactgacgcaagaatattgaatatttcttgttacagtgttctacagtatccggatgcatttgaaccgttagattcggatctaacatgtggcagtggactgcataagggcatccacaatgtaggggagaagtgggtattaggaattaaaatattcttactactaggtaagatacatcgtggaagtagtaaataactactaccaagccataagcttgctacaggttatagcactttgtggtgggtcctacctaatttttaattgtgacatggctcatgtttggggttctttttcagataggtcccaccttattacccactctacacatatatacattgtggtgcatcttcaatctactattaccatcttacatgggcccaccttactacctacttttgcaacatacattgaggatgccctaagttgcagtgatagtactaactgcacatgatacaaatcccaattcaacaccagctgctgtcaatttcatttcttcatccaacgatccaaactcaagcaactattccctccgtctcattttaattatagccataattttccgtgcacaactttaattgcctgtcttatttgaaaaaaattaaaaacataagttacgtataaagtattattcatgttttatcaactcataattataaaaataaataaataagatagacgatcaaagttaggcgcggaaacttatggttgcagttaaaataggacaaagggagtagtactactaccactacagcaattcaccacaaatgccacccttttcaccaaaccacaaaaggtatcttcacacatatgtacacagctcatcttttttcactggaatgtatagtagcaaagccatttgggttagtttcctgagtacttctcatccacaacttaatactcagctaaactgtcttatattcaatgcagtgcatcatgaaccctaattcaatcttattaactttaattgaacatgaatatgagctaatcttcactaagcaataaagataagaagctaaacagattatattaggcttatttgactcgaaattgttcatgtcgaaccaagatggcaccgatggcttctaatcacatggatgatgtgaataaggaattgagtaggctaaagttaagctctaataccacaatgttggagttctaattcaagatcttattcttttagcatataaataatcacctttcaattacgaaaattaattctctgacttgagatgaagccattaaagccgatatctggttttgaaataatttcatttagaggctaaaataatttttcatcaactttatttggctaagaaggcttataaacaaatttcttaacattataagcattaaaattgacaggatttagttaaatttgctttcggcccagggcttccgaagctggcccaaacttgggccggcccgtctttgctcgagccgagtcagttcgacggctcgcaagccgagcaaccgagcgcggcccacatacgcggcaatggcccgatgcacttctgtggcccattgggctgcgtaatcagcggcggcagcggcccgacacagggcaaatctgaaccgtccgatctaatggacggctccgatcgtccctgcgccggatgaagcgccgaccgggagagaggagcaaaaccctagctcctaaatccttctctcccgatcccctttctctccggtgacgagagagcggaacgatggcgaaggcagcgatggtggtctagcgagctggtgcgtgtgggtagtgacgaccgccgagcagctcctgcttcaccggctggggggcaccaagccatgccacggcatcggcggtccagcgaggcgggcgcgcaaacggtgatgagcgccgagcggcccagatctcgtcggtagggcaacgccaatgccaatgcttctcgtctccggcaagggacggtggaagagtgctccaggacagcgcacgcacggggaactcgacgcgactgcgaggaggagaaggtgcggcggtgccgcttcccggaaagctctggtgagattataggcttcaagtccggtaagtaacctgaacccttagcttaattgatttcaattttgactcttagggttcttacccgaaattagggttttttgaatttggagaattttgtcgggaaatttcaatctattttattccctctttttaagtctggggagttttgatgaaacaattattattattattattattattattattattattattattattattattattattattattattatatgggtattatctattatattattaaaacaactttgaaaggaggcaccacattccctgtggaggctgaaaattcccacattactcggagaaaaagaaaaaaaagaaaagaagagtccaagtagaagtataatttaaaaatagatgaaattcggaattaaaaataagcaatattgaaagaagtttccatataagaatcaaatacaagattaatcaaaattcgaaataaaaataaaataaaatctaaaattagaaaaggaaaggagagttcaagtagaaatacaatttaaaaatagctgaaaatcggaattaaaaataagcaatattgaaagaagtttccatataagaacccactacgagattaattaaaattcgaaataaaaataaaataaaatcttaaattataaaaggaaaggagagtcaaagtaggaatacaatttaaaaatagctgaaattcgaaattaaaaataaggaatattaaatgaagagttcatataagaaccaaatacgaaattaattaaaattctaaataaaggtaaaaataaatccgaaattagcaaaagaaaataaaataagagttcaagtaggaatacaatttaaaatttgctaaaattcagaattaaaaataagcaatattgaaagaagaacccatataagaacccaatacgagattaattaaaatttagactaaaaaaataaaataatatccaaaattagaaaaattaaaagagattttaagtaggaatacaattttgaaacaattgaaattgaaaataaaaaataaaaacattaaaacaacacaatacaatatcaactaaatttttttaaaaataaattctgaaattaggaaaagaaaaataagatttcaattaggaatacaatttataaataactaaaatttgtgataaaaataaagactattgaaagaaaagactatctaaaacacatgatgagataaattaagtaacatggctataaatgagtagagtggtggcggttgatatgacatataaaaattgttaataaaacaccaaatagaatcctaatgacgattaaaaggagggatgtcaggcatgccgtgaagcaaacaagtaaggcggttgccgggacttctaaaagtaaaaaaaaacccattgataatcatttcaatttttaaaatctcaatgacaataaaaagaagaagcagcgtgcggggtgtataagagtatagttgcagagccgccgacggttgatgggacttctagaaaataataaatgaattccaatgatagttatgttcaatttttagaatcataatgacaataaagagtaagcggcggacgggctgtagaggggcatagtggcatcgtttgatgggacttttaaaaattataaaaaaaaactacaagtccaaattttaaaggtttgtaacttttaaaaagtaaaaaaaccaatgataatcatgtttgattttaaaatgtcaatgataataaagaagggaggcaacgggcgagccgtagaggagtataatggcaaagccgttgacggtttggattttggcggggcttatagaaagtaaaaatgaacccatacgataattatgttcgatttttaaaatctcaatgacaataaagagaagagacagagtggacgggtcgtagaggagtataatggcaacatttgacgggacatctagaaattataaaaacgaaacccaacgtgacaataaactctaaaaactataaaatacattttttaaaggttccgagaagaatggattgaaatagtggtagaatatagattgtcccaaagatgcaaaattgttttcttttttctttttattctaactcgaataagaagaagaggaaaaaattgcaatggatttaaaactagaacttattcttacgtaaatccattgggagatgcttctctagagtgtcccatatatgttttccatcttgcatacgaaaactgtcaatttgtcaattctcatcagatcttcttccgtcttactcaaaaggtcaaatagtgtatgaatattagcccttttgagacaattatacgttctagaaggcagttctaattgatcgataaaaatacaatcaatggaattctttttttgtttttctttagattagttaatcttttttaaaagcttaaaaggggaagtaaacctgtttttattttcttggaaacgaaaaaaaataaagaaggagatgacataagaggtagcaactggtgtgacttttaaaactactccctctgtttcgaaatgtttgacatcgttgactttttagcacatgtttgaccgttcgtcttattcaaaaaacttttgtgagatatgtaaaattatatgcctacacaaaaatatatttaaaaatgaatcaaatgataggaaaagaattaataagtacttaaattttttgaataagacgaacggtcaaacatatgataaaaagtcaacggcgtcaaacatttcgaaacggagggagtatataattagaaacacgaggatgataaggtttggtctttcaaagtcttaagacaatgagacagctatttaataaattttaagtgaaatcatactttaaaaaatatatgatctagtttgatatatatatatatatatatatatatatatatatatatatatatatatatgggtttattttaaaaatttttttattattatgagtagttaattacagtaaaaggggaaaaaagagagaagggaaaaggcgacggcagaagagaagagaagaggcgggatctggattgtggagatcgaggatggtgaagacggtggtcggcgacgaggcgcaggtcaaggcatcggaggaaaccctctcagcttccacctctccagctcaggtttaccctactctctcatcgccggcagccgcagccatggccagattcatcttgatcttgatcgcaggtggggctcgtcgtcggcaagctcagcgcctcttccgaccgtgccctcgcctactccctcatccccacgccgcccaccgattccggcgctcccgcttgctccctcctccgcgccaagcccgccgccaaagctgcctcttccggcgcgtcctcgtcgctcgacttcgatgtcgactggctcgccgagcacgcgcgccaggtactaactaacgttccttcccaacctagctaagctacctcatcacaatgccaaatccttttattgtcttcctcctatatcagatgcacaaacccaatattttcatatatcaaaatctgatgtaacaatcacaacccccataatagtattgcaaatcggaacccccttagtctctctcactcatgaactttacgtgggtaagatgcgagcccccttttccctattttgtcttggaaacatctgaatacataccttctatcaatcacaggtctcgaggatgcttcttggaggaatgaccgtcataggtatttacatatgggcgtcagaagcttcattcaaagcgacttcccctgctgttttatcacaggtaccaaccttctccttccattgataatatgggttttgggagtcaggtttcatctttatatcatgccattttcttttgttttcgcatccacgccttttttttcccaatgatgcctcgtaatgtggcatggacctgtaatgtaaaggatagtttgcttctcctattttccaggttcttagagctgtttctcaggtagctcctttgtatggcactggtgttgatgagaggctgctcattcatatttcttacagcccaagaaggtgctccactatttattttttgcggctattgcattcttacccctactttgaagttcaattgtgattttaccctcgttttttagggtttgtatttttacccttgtttttttattgaaatgaagaatagatttgcccctactttggatggctgtgttaacggtgttaagtcgagtaccaaaagacatttatatccttgcttctattgcagattttctcttacttctgaacaaacaattgtgtttttaccctttatacatgaaacttggaactaactgtcgaaacaagatttcggcaatataaaggggtagcgcacgagacctaaaagtggatggatgcggagacaaggatttagacaggttcaggccctctcaatgagaggtaatactctactcctgtttgaggatttgaatccgccggatgtagtattgatctgacaatctggttgtgaatcatgccccctagagggcctcctgcccaccttatatagaatggggggcaggattacaagatagaaaccttaaccaatacggtatcggtttcctaaatctactttacaatattatcaaaccaggattttaggccgttccataatatacaaggaaacataatacccaagtcatgatccgttacatatttcatagatataagttatcccctataaccagtcagataaccgggtatggggtacccataatctccacactaacttgtacacaacgttttcttgactaatctctcgtcatctcgcgatgctgctacatcctgctcatgtgctccactccaggccgtatttgccggtccaaatgcttctctaactgcaaaaccatgttgatacatacatcaatattatagtttgtttgttcttaagattaatcaagatgtgcacacaagaaagtatgtttggaagaaaaagagaacaaatagcatctggaagactgaagaagtaggaggcttactctgcacgcgtcgacgaccggccaccgtggcctgcttctcgcgccgctgcgagtcaccactgcaaattgctgctagcgtcggggagatgtcactgctgccttctgctcgtgaagccgccgccgcgccctgctgcttgcatcgaggtgcgcttacctgcttctcgtgacaccgcgccgaggagcggccgctggggcttgctgctcgcgtcgaggcacgctgagaagccgccgctgctgcctgctgcttgtgttgtcgagccggctcgccggagccgcctccgccacctgctctttctcccctagagtttggggattccttggtgtgggataacaaatctgaccaaacatatttactcaagggtagattgggaatcccatatttcctaaatattttttcccttttcatttatatttctttcacttgatattgtgggaccaccaaactaccgtttaaagtaggggcaaacagtgacttcgtttagaaaaaaacaggggtaaatatgcaaaccctaaaaagtaagggcaaaatcacaattgagattgaaagtgggggtataaatacaattctcccttattttttcctacattactttggttccttctttaactgtccatgttctagaaccatgagctagaaaatcacttttttctttaactagtaccatttctactttcttagttcttttttccttttgcttcatgtggttcagcttgcgttctgtctatagcctaccccaacttggttgggcctaaagcctgatgattttattgtactttgtattcttctccaagtaagttatatggggtcagttgtccgcttagcacttgaatcaagctttatcacttggtgagcctggtcgtcaccaaatcagttgacataaatgaaaatttagtgtagttcagtgttatggtggttctggtattacaattctccttcttttgtatgccaactgatgatgctgctcttcaaattctgccctgctcaactgcattttgagttaagctattatattttaggataaattctcagtacatgctgacatgcacacctcataatacaaaatgaaaattttgatgtgttacaggtgggcctgtcgtatatgtgatatgagctcaggacgtttaaggccatgtgacttcaagtatagtaaactattagcttctcttcaaactttcagatgcacatataattttgagataaggtactgctttttgaattctgacgcatccttagatccaacaattcttgtctactttatgtcacaaagctagaaaaacaccattcgatgaagtgttctggactatcaaacattaaagatacataaaaaatcaactatgcatatcagttttaatgtgtcacatgcactttagttaatccatgcatttggcaatagtacatttccctgtattgcaatgagatcccttctgtcacattctgactgatgacatacaatttgcattgcatactgccatagactgccagttgttcaagctgagccttttaagaaggttatttcgaaggcaatcagtcatctcacgaagcaagtgcagaatgccaaagctttgattgatggagtcctggtatttacacaacttcttagcccttattcagctggagaagtgaaaaaaaagatactatgagtcagaataatttgcattgtcttagaattttggagtcctctagttttgtttgtgcttgacatcctctcatagttataatgtattttcaactagtttttggatggcatggacaacactttggagggaccacataacgttgaatttcttgtgcctttcaagaacaatttgcctgccgaaggtgccctagctaatgctatttcctattatatgtgatgatcagtttctctttatgtcattatgggagccttatggtaaatgcttgcactaaagaatgcagtttagaaggtgttgctgggctacttctctttgctggatctgtcagcgccttggcatacctgggcccaaaagagtccattgcagaagttatatctgatctaaaggtagttataatatactaatttccattatttatcactgcaccttgtcactttttcccatgatggactagccagaactttataaccaccttcacatgctaagcttctatgattgaatctgattgattatcaaggaagtggcaatgcatttagtggtgaaaatgtgagcaagctcttcagttaggatttcagcactggattgggaatttcaagaatctgatcctggaaaaaaaatactgaaacttgagttgtgactgtaatgtagctatatgtcttgagttaaggagctttatggctactggaattttgattctgaggtataatttttttaaagatgggattcccttatatggtactgaatagtgaataatgtccaaagggttcatatcatgaatctcccttgcattggttgatttctagtcccaaccatcgttttatagaactactcgaacacttgtcgctgttcagcaaactaattagtgctttgtgctgtctgtcgacctgtgcgtattcagctggacatcatcacaagcctgagaagcagattggacatcatactagatgaggcagatgatgactctactactaacaatttggagaattcactgtctcagaaggccactcaagttgtttttcatgagttgaggtacttcatattttccatgggacatttatattttggagtgaatcaaagtacacaaaccatgtcttacattttcaagaagtcaggcctgtttggtgttatggtccaaaggaacatatcttgatgatattaaattaaagcattaagatttcctgtatttacaatagatagaacaacaaatatgttgccacttagtctgttgttttcttcatgatctttgcaatgttttatgcagctgattacatccttcttttcgcatacagagcaccttacagttttccattccctagaagaattctgataccttggttggctggctcctatatttgtgactacttgcaacaatcagaaacaatggaggtatttgttttttcgtgtagctaatctgaatgcacaaggggccttttaattgtcttaattgtcaaagcctactagtaatattccaattcttctagaaca

SEQ ID NO: 82184 - DNA, 3527 bp, Oryza sativa
  unsure (1)..(3527): unsure at all n locations
ataggtgtcggtacctttacctttatggctttattgggactagcaagtatgcgcgcattgcagcggtcatagacaagccacgaccagatgtcgcagtggtacccgagtcctctgtgggggttatggtcgttaaccgaggcaaaccgaaggtggttataagcgactgcttcttccagaatacaccggtttaccaaaatttcccatggccttgtgcacttgggtagccgttttgtcgggtgtgcccctttaattaaaagggaggagaagtgtggggagggggggcgactttgtgtctctttcgtgccattgcggcaggtggagggtgagtggaggcagtgtanctcaaatgagggggaggatggagcagcggtctggcgttgggggcgatggcgatggcagtgagcggggaactggtgaccacggcgctggtagcggaacggagcaaggcgctactgagccgggcgtcgcgggcaggggcgagcttcgtcggtgcccggtgttggcggttgtggatctcggcatgtggcggcgagcttccttgccggcgagggcgacaagcgaagacatcgtcgtcgatggtgcttgaatggcggcggtgccgaggagagttggccgcgacgacaactttttagatagagtatccgccatttggcgatgggtgtgggcaagggtgtggtcccttggagtggccacttgtgccttcttggcttggttgattgtcaatttctgtgatcagcaatatattttatggggtgcgcaagatcaaggagagatggtgacgcaggggtttatcctggctcaggccctcaatatgaggtaatatcctacgtccagtgtgtttttctctgtatctgggtggaaaattaaccgagaggccaagaagccgggttgttgagatgatccaacctcgcgggacccctgccccctgttatataggatgaggggggagggttacaaggaaagtatgtgatggattgcaactagatcattctattctatctatgaagatatgcatgatccctaagatttatatcttattctgggaatctctcttcctctatttacaagtatgccgcatgggcctaggacactcggcccacaccatgcggtccggcccaaggcttgtcgttgggtacccgggtatagtgtaccccacattgatgtacctggtggcttctctctggggttatggcgcaagctgacagatgatggccattctgactacctttgggtggcggtccttttccttaccttgctagcgcccatagtctttctcaacttcatgggtgcactgtaggctagttgtttggtgttctagttgtaagatcctggctggtatcctttcttgtacagatctggcgattctctatgtggaacatggttaatcttaggtttggacttgtgccgggataaccttatacgctgggtttagcttgccgacagtgttgtaaggagtggtttcggccgccaagattggtgctttcactctggcttgtatctcttgcaacaacaaacacctagatcttgtctagaagttcaagttagaccagaatggttacaagtgaagcactgctaaattagcaataagatccatgaagttttgctccctaacatttcaatttgtccaaacaagtccttaaactatcatctagctcaatgcagccatttaaccctcccaaaaaacacaatttgggcatgccatatcatcctcgcatgcaaataaaataatatatcaaatgaacattatatcgttatatatatatatatatatatatatatatgtatatgtgtatgtatatgtgtgtgtgtgtatatatatatatatagggagcgtatcttatgcacacaggccctcgcgtgtacaccaactaaaaattatcacaaaaaattctaggaaaattcatacatgtactttcaatagtattacatctacgtgcaaagtcgcatcttcaaattcattctacaaacgatggtaattgccatatatatatgtgcgtgtatatatatatagtatgttacagaaaatagaaaaaaaataaaattaaaatataacaacgcacaaattcataatagaaacaatgttgggctggcccgatatttttaatttgattttgttttttctttctttttctttattatgatatttgtaagggtagaatgattattaaattattgcccttgcatgtgtggatgatgtggtaagtccacgtggtgtttcctgtgggtccaaggactatagatttcaaggatttgtttgacaaattgaattgtcaaggactaaactgactacggagtaaaacttcaaagaccatattagctattcacccaatatattcttaataatattaagatcatagtttttttttaagtatgaaaccattgtatatatcattccttatttgaaaatagtgtaacaaacgatggtaattgacttcaaatgcatggtaatgaataatccttatcacactttaggtatgactttatttgcttggtatttttaattaaaacaattagatattatttagaggtagtatttggctatgtgcatcatagatacggatgtcagggatgtaactcatcttacttttttttgtgaaaagtactactaggacctagtagtatttttcacaaaatatatgaagaaaagaaatacgggctgtgcttctgtcctcttcaaagaacaaactgcacggattttaaaggagatgagatggtaattttgtctctagagagaaataccccggatcccaagcccatatgcatccattcagtcgctggccatcctcctctctccctcgttcttctccgcctctgatgccgtccagcctacataggcctatacgcctagcacaccaattgtgcctccttgttgtcgttgtaggatcgaatcacaataactaagccaactagagggggctgaatggttggtatacccaaaaaccaaaaacttttagcggaaataaaagttacccttaaattcgacggagatcggtctgaccgaaactgtcctgccggtctgaccgcgcctgtgccgtcggtcttaccggtgtagatcaatcggtctgactgccctgagatcgcctgccacgcctgttgacttcgccggtctgaccgcaggtcacctgccggtctgaccgtcgtaatgctgccggtgtgtcgccggtgagaccgccgaaacccggtgaaacacaaatcgaagaactcttaaagtagatgacaactttattgcttctctctgtgtttacaaagtgcaacaacatcactccttacaaaaatttcgactaaactcgaaactctaactcaactatcaactcaattcctctcaaaagcgataccgagaagcctcacgctccccctctatttatacccgaggaaagcagcctaaagccacgaaccaaactcatactagaagtcctaatcaccctaggaaaccctctagtacaagaaacaaactttacgtaaccactcataccaaatttggactccttctaaattcgactccgcatcccatacgcacacaatacctc

SEQ ID NO: 82185 - DNA, 4085 bp, Oryza sativa
tgtaaaagcattaatcatgaaacaatcacggatatccaaacaaacaacccgaaaccgaaaccgacacagagtcggccggtcagaccgcgggctgcgccggtctaaccgcgcgatacacgccggtctgaccggacccaaatccagcactacctgtagattcacctgtgaaatccaattatctccaaaaccacttcgtaaataaattccaaatatcaaaaccaataatctctaatgccaattgtttatcacagaataataatcaaaaacacctttgattttacagttgtttcttgaatagtagtggcaggctatcagcgaccatggggcaaattttctgccaagatcagtgatataagccgtcgcaacatcaatgcattgctccatatggatgaaaagctaatgaactcattgatgcttgcttctcggtcacatggtgcagtgccaacaaaaactggatgattgtacgcgagaatgattggagttttggatgcatctttcttttttatgtttgtttgtaaaactgaagtgctcaatacggccatgtttttgtagcgcgaaccaaatgccatggccaggtgccaggcgttcatcattgtgatggcgacgagcagcaacacttgccggtgctttggtgtttgatccggactgataggatcagagattaactccctcatcgatgaaattaattaccctttataaatgatggttaggctcttaactaacactttatctgggtctctcattttctttaaaatctgtgcagtgttttttctttgaagagcagcgcaaccattctaacatatactccctccgtcccacaatataagagattttgagtttttgcttgcaattcgtcttattcaaatcctttttgcaaatataaaaaacgaaaagttgtgcttaaagtactgtagataataatgtaagtcacaaataaaataaataataattttaaaaatttttgaataagacgagtagtcaaactttacaagcaaaaactcaaaatcccttatattatgggatggagggagtatattaataacatgcatcatgcaaggtttcggatcagtcatcacattgggcaacaatttaccaccttgaaattaatttcacacttagaacgtcctatctgataggcaactatatatgtgtcttatcctacaaggctatcgtttactacaccaaatactgcatcatggccttctgcatcagcatgcaaaatgcacagcaaacaaactcaagcattattacgtacctagaacctcaagatggtagaatagaagatcgatctaatctgtttttctgttttgagagataatgtttgcaacccactacagaaaactatacattgatttaactctaattataaccaacagcagaagaaatgcgtcaaaaagcatatattgactctacaggtgctgccactcccttataaatcgagtatagcaagcttgtaatgaatcaataaaatttcgctccaagtatttacagtgccggtaagaatttgcttacagtatctatgcttgctccttagtccttagcaatgttatctcacaagtagtataccttggctagtacatatatcttaatgtttcctcaaagataattgatatacctttttatatatatgttaaacttatccgttgtccatgaaagatctatatagcacaagtagtcgatattctgaagacgcataaactttgtgattgcacgaattaattaatctcactgtgaatgcgtaggttgaaaaaaaaagatctccaagatatcaagcaatgaagcttgtggtgtgtgcaatgctcatgctcgtgatcatcagctcttgcactgctgcaacgtccaaggagaagaaaggtgcagaaatgaatcaactgaaggacgccgtcgatcaggcactggccaaagctggtcaggtgaactatgcacactcaacaaatactgataataatggaaaaagaactccctgcccactcccttgctaagctgtatactgcaccgccatgaaagaatgccttggctatacaaaatccggatatagatatgtatcgtaatactgatcgacgtaatggtatcatgcatcagccctgatcatgatgtttatgtatgtgatggaagatataactaaataaaaaaggatgtaaaacaaggtcctgtctttctataccgagaagcatttctaagtgtgttcagcaattaatggggtcaagttaattatctgagcaatgatcttgggatgtaatatttaatttcgtggtgcttggatttcatatcagcgagatcctcctgtatattatttacattgaaggtgtcatgttctatgtggacaccatgttgtcagggtgattagcaggcagaaacttttgtaaattcgtaattatttattcaaattttgcaatgaaaataaatattatggatgcttgaacctacaacaatgaaataaattgttaccagcaaagccatgcatacacccttgcatcctttcaagttttaatatgtttaattaatttcagcatgcaatatatgttggtctctgccatctctacacgtccgtgagaaaattgcaatatttggactgcaaacattggtcagacaatagattcacatagacatgactatatatgtacaaacaacaccacatacacccgtgaatgcgcttagtatatatgttcaaacaaacagaatccagcagcaatctctaacctcaataaaaccctgttaaaaatgcacctgcatttgcgtagtattcatgagtagatttaaaccctaattgattgaatcatacaatcacgactctattaatattccagtagaggagcgttaccaattgttctaggattccactacatttacaaaggcactataataatttcattttacttgtatctttaaaatctgttggttcactttttcctcgttcaatgagcgttgccttgtaagaggggcaactttttaaatctcccatttcctttctcctctacctccatctcctccatgatctatgtgccttaattcttagagctagaaattcaggtcttattgcacctgcaataagggtgctgctattctctagtttgggcataggcacatttgcaatgggtcgaatgattggctgtctggtcctggggatcaggtgtttcggcttttcggtcttgcgcagccgcactgaacagtgagggaggggcagggtggaaacggtagaggtaattaccggccgaccgggctaccgctaccgaatttgactgatcggacgctccggaaacagtaaatgtcagaaacagaaacggtaaaaaaatacggaaatgatatcggaaatggtttggtaatttacggaccgttttgtgaggttacactacaccagatcctcacatctctgacgggatacctgtgacgggcaaacgaaatggtcactgatgaccgtcacctctgacgggtcatacgggatgccgtcatcggtgaggcatccggctacgacccgtcataggtaactagtcacctgtgacgggttgaaaatagaacccgtcacaggtaaggttacctcacctcaaacgggtttaagtcctaatccgtcacaggtgattagtacctgtgacgggtcacaaccggatagcccgttagaggtgaggtttactcacctcaaacggctttaagtccggcccgtttgagatgacttctgccactgtatatatatgtctcctctcccagcggggcccacatgaggagataaggccggccggctccctcttctccacttctcctctatctcttccacttcttctctatctctcctctctttctctgtgccgtggcgaggggaggcgcggcggcgccgggccggctggggcggcggcggcccggccgccggatccggcaggggcaggaggggaggcgcggcggtggcccagccggcagatctggcaggggcgggaggggaggtgcgtcgccgagccggcgggggcagcggcggtggcccggccgccagatccggcaggggcgggaggggaggcgcggtggtggtctggctaccagatccggcaagggcgaggggaggggcagtggcggacgacggatctggagccgtggcgcgg

SEQ ID NO: 82186 - DNA, 571 bp, Oryza sativa
agcgccgccgccttcgtgtcgcctttgcgccgtcgcctccgccgccagttgccgtcgccggcaacgcgttcgcacgcgcgcgccgtcgccatcgccgtggccgacgggccggccttgagccaagccgagccgggtcgccgccgcccgtccgatcaaccccgggggcgatctgggccgtcggtcccgtggaccggcggtggaccacccgcgtggtcccggtccacagtgaaccgttccccccttgagtcgctgccgagtgggcccgctcgccggcgcccctttcctccctctcccgagccgctgaccggtgggccccgcatgtcggcgccgcgcctcctccccctcccgtgctgacgccagccctgggatttattgcacaataaatgatttaaggactttttgttatagtaataaacacagtgaatcttctaaaattcatatctaattcatccgagctccgtttaagcccattcaggtctcagtaaatcaagaaaaatgtgtagaatccattaaaaatggttttgttctctgtttcagtagtcttatagcctgtttgcaatgtttgccttgt

SEQ ID NO: 82187 - DNA, 643 bp, Oryza sativa
taacttttcctattttctacctagcacataatatatagaaaaataataatagctaaatgatcatgactctcaagttacatgtacttttctcagtttatttgactttttgtgttatttataattaaattcaagacccatattgcacatatttactatatataagttagataatattgctattctgactacaaatatttgagcaaaatagcacttcgaaaatgatgaatgaattcaaatgtgtgggtctaaagtccaagttcaatcaccaccaaagaagcttggaaccagaatgcacactctgggcctgatcccgacgaaggcggagctacaagacattattagcgaggtggcatcatcaacttctacaagttcctggacctaatagcgcactaaatgattagatgaaggacaaggactaagaggaggggagcagagggagacgttccatgtcttcgacaaggactagaaaacagcttcatctttgccaccgagccccgccacgtcatgtccaatgtatcaaaagaggctcactgatgaggaggtcaacaatgatccgcgaggctgatggtgacaggcggatcaccacaaggagtttgtaattaaattcaaacaaaaatataaaacaagcaatttgattaaaata

SEQ ID NO: 82188 - DNA, 8018 bp, Oryza sativa
atatgtgcatcatggatagagagtaaggaatcgaattggggttaattatcttcaacaaaagaaaaaacaatacaattaatactcaaaccacaaaaaatagaaagaaaagattacatgaaacagaaaattgttacaggtagtattgtagccgagatgaatgaaaaccttctggctctattagagagaaggtttattcattgaagcatgcaagatagataggttgcaattttgcgcagttatttggattaaccacttgactagcaatccttggtacacatgcagcggcgccggaagccgctgcacttgcctccggagaagccctcagtcaggcacacgttggcgcagttggccaccatcatgcagatccccttgaactcgttgcttggcgtctcgcactcccttgcctgtgcagctggtaccatctcaaacaacaaaatattaacatggctaaaacatgaaatcatggtttttcatccatatataccagaccagataagtcgtcctaataatacaccatgtcaactgaatatgtgttatagtatttctaccactagcggaagtcacaaaattgaaatttaatgatgttggaatgtatgtgacactgacgcaaaaagttagaagccaaaaaatattaggccaaaaatcctttcaatttttggtagacgaaagaaaacaaaatctggtattatgatctatacacatgaatatatggattgtcccaccaaaaatttcaatcgaaaggaaggggtcaaattaggtagttggttctaaatatatgtgatttcggacttaaccagatcatatttagaataataactcgcaaactgaatttcataaagtgctatacatataggatgacatgacagaatggaactattggttgttctattgtttattcagcaaagttcagtggtttctcccaaactaattatgtcgtctctttatatttcttcagtatcaaaacttattaggtatgtgccaaacataaagaggcagcagatggtgtaaacaatttccgttatctaagaaaatgaacaaaaagctggaacatggaaaaggatgtaaaccacatgtagctaactcagatatgtatatatatactcctactgtacctgtggtgacaacgagcaggaggagaactacaattgttgggaagaacttgcgtgatgtctccattttgatcgatttgtctttgtgttgatgatcaaatttggcactagtattgaatcccttgtaactatgataattgaagtgattgtggcgaggtttatatataaagagagccaatatcatgcaagtaacgagaaccttaggaaatttataaattgtatgtatatttttttaactgagcactctatatatagttttccggttattattagtaaaaaggtgggtggcattgcgacttttgctgtgaatcgcacattcttttcaccatgcacacagaggttttttcataattaaatgttttgatttctagatatagattaagtatgtatatatatatatatatatatatatatatatagcgagatactatactacacctagggtgtagtacagctaaaacacacccacaccccctcccccacagccctcgatcgagtgttagattgcgcaattagttggtgttttattttgctacatgatctgtctgctcgattgatctctatagactatagcttctgcctttttttggaggaagcacagctgctgtgtttggtcaactaattgcagcttatttgccggcgccagatatgtgttgattgcttgtgttccttcgtgagtttgtataatgtacatgcatgtcccattgatccatcgtggatcaatttgttcctgtttggctagttgcatcttccttgctgcactttaatttgcactgggttaaattaagctatacacttcaattaacccaaagttcaacccagtgatgttttagcacctgtgcagtgatgttttagcatctggaaacaccttttcctatttttattgtgtgactgagctgaacataataatttcacaaatttgttgagtcaggcctgttgaaaacatatagttgctggctgttttgcttccagttccataatcattttgtttccgttcatatccttgtgcatttttaatacatagcatctgcaattattgaggaaatcaagtgcaattttcagttttgtttcattctacctgtaattctggatccgtttttgttcagatatttaagtgggaaacaaacttactatgagaaattatactcctttcttttacgtgctccctctagctgttgatgtgccattcagactaatctttctgtttgtgttgtcatgctctgtgatttcaatttcctagcaacaacatgatgaattaggagcgtacctgatatttcagttttataactacacattattcttgagcaaaagcataacatgattaggaggctctctgaattttttttctcatccggagaggcagaaagtggtgtcctcctgttaactgcgttggtgcatgtcaggtctagggaggagtgacggcgaggatggcttcacggtggtgacgacgataatgaggcaaagcacagattctggggagacttggcacagcaagccaaagtttgcgcatgtttcaaacggaatgttgagaagcatcgatttaatagtaattttgctactaagagacaatatgttgttgaactatcagtgtaatagtaacttggttactatgataaactttgtggcaagatcaatatgttatattgagaaccatcggtgtaagagtaatttatttactaagagaaatctcgtggcgataccaataagtcaattctaagtaatttatttactaagagaaggtatatgaatcaattaggaatactactatcgtaagtaatttatttactaagtgaagagttgagaacgacctgagactctgagagtgattcatttactgagaggaggaaccaaattagactctcagagtgattcatttactgagagaaggaaccaaattgagaagggccgaaaataacctcggagtaatccatttactgagggaaggaatcaatttgggagcattggagtgttagtaactcattttctgagtggctgataaacttagtaatcttgttactgatgggataatcacgaaaaaaagtgcgagaggaaataaaaaaaaagaggaaagaaaaaaaggtgcggcctagttctgcaggattgatggtgtggagaacttgatagtaactcgtttacttatcgaactaaaactacggatagtaactgatttacttaacgaaagaactttttgtgtgggctgatgggtgagtgtttgtgcgggctgcatggggtgggggggtgggtgggtgagggtgggggtgtacgtgaggggaccgttttagttatagcgcatcctgggtgcggtttagcgtgtgtgtgtgtatatatatatatatatatatatatatatatatcttttacgttttacccacaaacaaaacttttagcaggatgagagataagtccaacacaactgcacatcaactggtctatcgaaatatgcatgacaatgaaatttgatattagctgataatgtagttcagctttggtatacatcgattgaaagatcattgtctgcttgcaaagaccaaagatcgaatttctgcagttattggggcttactgaacaaccaatcttataagctaagctggcctctcaagtctaaagtcctaaacagagagaaatgcgaaaaaactgaacaagaaagggtgacactataccacaaatacgtggccaggtgagcgtcagcaaaattatttactgaaaatggcttggcgtcatatctgtggtgccacaggttgagggcttgtttagctggtaccgatcgacacattgccacattaatttgaatatataccaagctctgccacaagtgtgtccaataatttgctagctacatcttaggtaagttttgccaaataatttaaacaggtgatgcacaaggttcagggcatgtacaacggcatttaataacacccacaaaaaaaaaacggcatttaataacaggttctgttcgttgtcatgaaagtaaatttggtgatgtgaaaaaggagagagagaaaaggaaaacatggttgttatacatgacaacggtttaaagtcgactcttatcatttaccatagaaaattttgttgcatgggatggacacaagaaaaaaaatagtaataagaaattattttagtgcattaattaatggttaagagatattgttgtctgtattacgataggaggatagtttataagcaatatgtattatatgttaactaaaagcccacaccgggttctatctctctttatacatgccctaagggtaacatgttaaaattgtgacggcaaactatatgttcacctaagaaaccgtgacaacgtaagacatggaaccaattcaactgaccttagatgctcccgtatatttcgattctagtgtggtcaatgaaaacaagacttagtaaattactccgtacaattatataattacaagaaatcagataattagggaccaatcttaaaaatttcttgtcacattgcctgtgattatgactggtgtagtgtgaaaaatccctttttttcgttaatagtggcattccttggttcccttgaaatagattggcattcagcaactccacgcaaggaccataaacccaactccaaacgatgtctctcacgctgatcgtgttggaaaggtagacactcatgcacgatctctcgcacatattccttccccaatagcgcaagctgtccaattccaccagccctgccggtgctattgggtatcggccactgcatgcctctcactcaacactggcctctcctgcgcccaatttcagctgttgtatatccccgctagcccaactcttgtctcaaatcctgtcgctcatacattatatgatgaaacgcctcctcactatccaatgcaagtgctttaatttgtacaggatcactatttccaatctttcttatagttgcttccacatatcgggttggttttttatgaattggcacatatgtgtcctttcccacacaaccacctgatggctcaaggctaaaacaggcactaatggacatgactatatcaatgttgtttataagtattgatgaggcactcatcactatgggcatgtgtctgaacttttcaaatttaggtcaaagtgaccagtgctgagtctggctatggaccaatgctaataagcaccttatttgtgccgctgctaactaccaattggcactgaccatatttgtaccggttttagatatgagcataactttctcattcaatctcggattagaagaaactttatatgaaaattgtagctctctgtttgatcaactattttgttgttgacaacttattggttcaagttacttaaatgttcaaatccatgatttaaatatcacatataaatggtcaaaagacggaaaatatagccgctactataccgtgtatatcttttttccttcacatttaccactttttttttcatcaagtaacttggccatatattgcaatggttttcttcacttgttacgtgttttttcttcatctagtaacttgtccaaatattgcaacggcatagacccataaaacagaggatgggttgggagtgtaatactctgttggccatgtactgcttggtttttctcgatagggtggtgtttcgttctctgcacgaggctaggaggagtagacagaccactctgtttttaaggggataagtccattttacacccccaaactcctgtctttgtctaaaattcaccctaaattataaaactggctattcaacaccctctaactattaaaaccgttcaatttatccccatattgttgactaggcggtttttgcctacgtggcatggcagtccaatcaaaaatatatatgtaaaaaacatgaggcccacatgtcagataagctttctcctcttcctctcttcttctctcgatccatcctctgccttctctcaccggtgctgggggagttggagctcaaccttgccgatgcatgcagcaggaggcactcggggaggtggagggctgctagagctcgagctcgccggtccatgcaagggaggtggacggcagccagaggtcgagctcgccggcaacatgggctccagcgtcgcctgctcctccactatctccacctttgcctcaggcttgggctccgccaccgcccccatcgccgctcccgcctcctcttccgctgccactgacaaagataagagaggagagagacaggcagagagaaagggtccctcgacgcggcggcggcctcactgagttcaccttgcagctacggcggcagagcctagatggagcatggataggagcccgagctgcgtgcttggctccagcgatctccacgttgccgacacctcaacccttagatctagaccacgtcaagctcgataccgaaccgggcttcttcgagctcggccgagaggggctggctccgtcgtcctcgttagtacaagaaaggagagagcgtgaggaaagggacggcgcaacgatggaagtcggccggcagcgtaacggcaaaagggaccgagaactggggacaggtcgagtagcttgccaactgctccggctcctccaccgtgtttgtcgttgccagccgccccgtcatcgagtcatgcatcgtcgatgatgtccttgctacggcgctcatggagacggaagcgatgtgcttctatccagcttcttcccgggtatgatgaattggagaaagagaacagagagattgaagaggtggttctgacatatggggccatttttttacaatttttaacttctttttacacgcggcatcctacatggcatcaaaaccaggttacaaaccaccaagggatgtaatgtgcccggtattaatagctggagtgtgttaaatacccggctttaaagtttgagggtgtattttatacaaaatgaataattaagggggttaaaatagacttatcccttttttttaagtcataaggatttttatccaattatttttcttctttacatgtattgtccaattctttctctcttcatctgcttttaactttgttttctaaaaaaaaggatttaagcaattaacatttattttaaaccatacaagtttttaaattgtagaaaatagacaatattaataatttgccataatatattatctacagttgttttcgtttcatgtaaaaatatttgtcatttttactactaccagtaatactttgcttaagataaggctttgtaagtgtgccaattagccatcctaaaatttttgcctcaacgagtggcgcgcggcactagccttgttcacgagtggcagccatttgtcatggccattgtgagggaaatgacaattattacccaacatacctcttatatggtctatgtgtcgatttcgatggagctccttccatcaagatcgttggtcttcccttcttactctatgcgctctcatcaactactcagatgtacgaaggatgagagcacattagatgacggtaacaacaagacgtgcacaacaatagtgatgagcagcgtggcagcgatgagtagatggtgcaccatgtctgcattttccttttgcatattattcatatctggtatataatgtgtgaaccgacagagatcatgctatctctaatggttcttgagccgttacagacgactcacagggataaaggaactgtcacatgatttatacccttttcaaccgcaattgatgttgtattaatgtattgtgttatctgagactgaacttttcttacttccaaacatgaatatatacttccattgaaacattacacaaacatagagtacaacatacagttgactggaccatactaagatcccaaaaaataattaaaaaaaaactgagagaaagaattgattagtacgtcctcgtattattctgacatatataattagaagggcaaaaaaaaaaagctactccacgcattaagcttgaaaaattattcaa

SEQ ID NO: 82189 - DNA, 3878 bp, Oryza sativa
tccctcccgcccctgcaggatgcgggagatctccagcggatcttcttcgtccctgaggatcggtggtggttgccggtggtcgcctcgaggtggtgggtgccagatctggtctgcaggtggttcgggatcaccggatctggaacccccgggctcctaccactgcctccttcaccgtccgagctccttcaccggtcgcctccccccgtaaccttcttgacgccagatgcgccgcctccatccacgtacgagctcagatccattgccagcaagtcctctttcacccatgtattttgtcttgtgttgtttatattgttccaattgttgctactgtgattgatgattctgagtcctatggtgattgagattcttgtgattttgttttttgattgggacaactgcgatggaacaaagaagaattgtgatgaattttttgatttgtgaatgccaaatgcaatcggacgaaatgaatgtgatggtaacctaggaggatggtgtttctcttcttttttccccctttttttcacaccagtgacggtcccaattagttgggccgtttgaagtgactctcacctgtgacgggttttggttgggaccagtcagaggtgactctcacctgtgacgggttttagttgggggccgtttgaggtggctcttacttctgataggtcttcactcgtcacaggtgactcaagtcatcagtgatcactaatctctgaccgggagctaaacccgtcaaagttgagggtttgagcccgtcagtgctgacctgatccagtgtagtgttaccgtattatcccggtaattaccgtttatatattccggtaaattaccgtttttacaaacatcactggccggctggcccaagttatttttctttggcccattttctcggcccaacaaaaaccgtaaatccctaaccctagagctgcttggctgctctacccaatcccccagtcaacctgtcctaagtcgcaaccagcgtcgtcgtactcttacgcggtggcacggcggcgccagcacagtgacagctctggtccgttccccagcgatgattgcgctagccggctaagcttcctcacgacgtcgcctcctattgcggccgcccccaccacctcacggcagcaatgccctctagcatgccgtccgggagcttgccggccggctcagcaaatattgtagccggtgatgatacagttgtcgaagaaaatgatgaccatgatgagttgcatccggtccaacaatgttgctgttgctctgtggagtataagagaacttgctatgtgcctgtgtttatgtatctcgtattattatgctttatctttatgaacttggggaataattaccgtcagatttatagttatcgtcgaatacgatacatttataattatcgtcaaatatttataaccattctagattgctagctaaatatgtgttgttaattatcgacttccgatcgataccgatatatttccgattgaataattctattttagatttactgatatttccgatatcgtttccgttaccgggttatcgttatcgattccgtttccgaaaaataatatggttgcggtaatggtttagggtgtttcctgatcgtttccaacctttttcatccctagcgtttccaacctttttcacccctagggaggggtacaaggatttctctgcttttacaattatagatacatggattattctatgcacagtttactctaacataataaacggtatgtttttttcccaaaaacattcatattgatattttctagagaaatccattcgacttcatattatttagatctcgttcgtttgtgcccttaaacgttacttgataacatccgaagaccctactagttatcgatcgttgtctttaatttgcacacatgtaccatcctcaacctcgtgctggacaacagcagcatcccatccagcatgcagtctaagatagggttcaatattttagttttaaatttcggaaacttttcccagcagaaaactgatttcagggtccggacataaaattatttcttccgactatttcgtttcttttatgaatttaacaaaatttattcaaatggcacaatgccatcttgaccttgtctggacaggttgtggccttttaatttccagctcttctcgaaagctatacctgggtagcttccaaccttcatcacagcagacatcatatcttcatgggaggtcaatttttatcaagaaaattgtccattttactccgaaatttttcacaggagtacttaaccccctaaataatttctcagcttattttacacccgaatttttataaatggtttactttactccctaacgatatttttttccttttcatttctctctatattgatcatgttttcaaatttgggagattagtgtatgcattataattatctcttcattatttttttggaattttttaaacgttgtttacattgtttggaagcactgagatcaatttaaacatcaaggttttaaattttaagcaaatagtcatgaaaaattttgaaaagattttagaactttgataattctgtcactatggctcttcaaaatttaagattaaaatacgactcatataaagagaacaattttaatagtttacaaggtaaaaggagtcgaaaaaatagtttaagagttaagtgatccaatgaaatagtttaggagagtacattggattttcttaattccttttatcattgaacgatagaaatctggcctttatgtctgcatgtggatatatataaaaccaaaaccaaaacctgcagtgagcttactactccctaatctcgtcaatcaaatttaatttccatgacctgcattcacaattttttgttaggatttaatctttctattctccattttgttatcactgcaatactcaaaacttaatggttgagaaaatatctcaaataccaacacttagtcatttttgggcatccaaattaatcacttcacatggttgtagttcaacggtcttacaaattctatgataccacttattataacggatacagaaggtttgatggttttgataacctttttataatcatctgtgacgaagtagtatttacttaaaaggttcaaattggaaccatgaagaactgatgaatgactggatagaacctagaaggaacgcagagggagtaatttagtacaccatattacttctcagttttttcaaaaagatgataatccctccttttttaagtatatggtattgctaacttttatacataagtttggccatttgtcttacaaagaaaatttacataattattatttgttttgtcattacaggtagtctatctataagcatcacttatattttttcatatttgcacaaaacctttgaataacataaataataaaaacgtatgtccaaaatttagcggcgacaaatatgttaaaaatggagggagtattacctcccaagtcacaacttatgcaattacttttttaattaaactgatagcatactgatcaatccaatgtcctaaaacgtatactgcaaaacgtaataatttgatgaggtgttgcttcttcatcatcttgcacatgcacagtaccctatcacctaatttgctctttagcccatcaaatgtaggtagagaaatactccatccactaattttccgtcatttctgcagtttgtccacttgatattgtcgatcgtgcatgatcttttttccaatgagtagtgattacaatgccatgaacagcatcgcatactccaggcattgcctagaatacagcattgttaacctcctataaatatcataaaaatatcctgagtaatatacaaattaagacttggcgatatatatgcacttcaaattcgtaggtgtgtgattcttacatag

SEQ ID NO: 82190 - DNA, 955 bp, Oryza sativa
ttatccctgcataagtcaggctacaatagcacctggactacatgcagggattacaaaataggtggtaaccacatttaccgcgttaaccctatcaaattcaaataaattttaaaagtaatttgatttttttaataaattttgtatggtttctcaagctttattttgggtaccgtgcttactgccggaggcaatgggaaaccctcactagaagttgcacctgttcttgtctgtgcaccatatcatgttgaatcatgtgcgttgtgtcctttcggaagaaccgatttactacatgactcatcaattccactttacgtatcaaaaggtttgttatgggggcaatgcttttgtgaaattaaatttttattttgcgtcacgttgtatctagttaaacactacctacctaccattacaaaacctcattccacaaaacgatgcatctagataaaaaatatgacatgtaaagtgagtaatgactcatgtttattatcaaaaatcgataacaatcaaatgatataggtagtaaagtacctttgaaatggcatgtccaagtatgtgtagctccacctagcacaatatcccaagtgatcatcataaaaggcatacaaatacaagcagccgatgatgcacacaagaaacaacacaaattgcacaaaaccaaaagcaaccgatgccttgagcatagagatcatgctattcccactataaatacaaatgcaccatatcaagatgctcctcacccttactgaaaaatcacaaacatcaaaacgttataagagttctctagcatccatcacatagccatgaagatctttgtcatcctctctctcctcgccctcgcagcgagcagcgcctcggcacagtttgatgcttgcacctatgggcaatgccagcagcagccgtttatgcaaccgatcatgaacccgtgcaatgagttcgtgaggcaacagtgcagccc

SEQ ID NO: 82191 - DNA, 582 bp, Oryza sativa
attccatggcatggcagaaggccctcctgggctcctgttgatggtcgttaagtaccgattttgaccgtcaactaccaaaataaataatatttcttacacgtatattagtaataaataatgttgttccacttgtattagagaaatattatgcatgtagagattatacactaaagtgaagggaaaatgagccggcatgcaacaaaagcacaccaccgacgaatcacatgcgagcacacgaattgatcggcccacaagtcagctcgaaccgactaaaaatgaggccaatgaatcctcaaatgccttaggggcccacatggtagtccctggtgatggtcggtggcgagaaatggggcctaggggtcagccgaacccttggttcggccaaaccaagcatggcccctctcatcgccaccttacacatggacgctcctaatggactccaaatgacgactaccagcgcattgactttagtaaccaccatataactgtcactacaagtctataaatagatgatgccttctcacttcacaacacaaacctcaaggagcaattctcttattccatatattgtattctctctag

SEQ ID NO: 82192 - DNA, 12259 bp, Oryza sativa
aactaaaatgtggaatggttggcctgggttggcttgggacgagctgggacccagggtcgggttgccagttcggtctgaatcatcgtaggccttgggttaaggcaggttcgtgtgggttcacggccttgattaataatattggatagttctaggatcgtgtttacaaagtagctttgagcaactaaacgtctttaaatgctgtttactgcaaccctaaccctttatgttataattccttgtactcccttgcatttattctgcatttgtgggtgtgtcttgttgagtacggtggttgtactcagtcttgctcaattttccccaagcccagatgaggagttcctggaagatgaaggctttggtgtctagctcgtgcctgccgtcaagcgcctgtggtcgtcgccctagtcttccgctgtctttcgttgtctttgtgtgtgctgggccttcgttgcccgtgtaataattttatatacgcttccgcttgttaaactctgatttgtatcaacttttggtgtaccttgcctcctgggacaaggattaatgcacgcacgtcaggaaagcccgttgggttatttccggtcgtgacagcaggactccctccgccttcagcacgggaactgggaggcggagctgaagaaaaagctcgacgccgcccaggggtttcttgatgccgccgctgcccgagagcagcgagcgacggagaccgaagcggcgctccggcggcgtgaagaggcccttgaggcgcgcgccatggcgctggaggagcgcgcctgcgtcgcggagaaagtcctggcggaccgcgaggctgccgtcacctcccgggaggcaacgctggcggcgcacgagtctgcctgcgccgaagaggagtccgcactccgcctccgcgaagacgcgcttgccgagcgagagcgagctctcgaagaggccgaggccgaagcgcaacggttggcggactccctgtccctccgtgaggcagcactgacggagcaggcccgccgcaatttggaatccgtccgcgccgagagagccgcactggagcagcgggctgccgatctcgaggcgcgggaaaaagagctggacgcgagggcgtgcatcggcggggcggctgcgggcgaaagcgacttagccgcccgcctcgcagatgccgaacacaccgtcgcggacatgcagcgcgcgctagactcatccgccggggaagccgaggccctccgcttggtgggcgagatagggcccggcatgctccgggatgcagtctcccgtctggatcgcgctggtcggcaggcgggactctggaaagggcagacaataaagcctgccgccaacctgggaggccttgcccagcgcctgtcgaagatggccggggctctccagcagctccccgaggagctcgagaagaccatcaagtcatcctcgagagacctcgcccaaggagcagtggagctcgtcctggcgagctaccaggccagggaccccaacttctctccgtggatggcgctggacgagttcccacctgggactgaagacagcgcgcgcgcgcaggtccgggatgccgccgaccacatcgtccacagcttcgagggttcggcccctcggctcgcgttcgcccccaacccgacgaggagggcgatgtcagcggtgcagacgacgtggaagacgaggccggcgacccgggcgcatcggattgagcccccaggcccccgccaatcttcaattttcttctttttctttcttctaaggccctcgggcctgttttctgtataaatcaacttacaatctgcaatcaaaaatgatgaaaaaattctttgtgttaattttattttgctatgcgaatgagatgaggatgatctgtgccgtgatcctttttttgtgtcttagcttgatttaagggcccgtgcccaagtcccagtcctctaatggctcgggtcggggctagtgcctggggagatccgcatgtcgaggctggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgaccttatttcaagtcaaaattcttcaaaaggaaaaaacggcacagacacaacctttaggaaattgaaactgcttttattgaaatgctgaaataagagaagtaagaatgtgcatgcgtggtagcccccggctaaccctgcacacccgagggggttgcggggttggcccgagccaaaacctgacactcgacccccccctcaggggtagaagcgacgaaggtgttcgatattccacgggttaggcagctccgtgccgtcgcccgtggccagccgtatggagcccggccgggggacaccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtagcgcgcggctcggagggccgcgcgcctccttcgctcttccaagtagtcgaggtcatctctgcgaagctgatcttgatcagtttcgcagtacatggtggcccgaggagacctcagggtgagctcggatgggagaaccgcttctgcgccgtagacgaggaagaaaggcgtttccccggttgctcggcttggtgtggttcggtttgcccagagcaccgctggcaactcctcgatccacgaatcgccatgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagtgcagagtgcttatcgatcttgacgaccggataagcctcgggccacttagtgaacttgtcgatcgcgacatacagatactcaaacccgcccggggcccgcttaaacggtcccaggatatcgagcccccagacagcaaatggccacgaaagtggtatgatctgcagggcctgggccggctgatggatttgcttggcgtgaaactgacacgctctgcatcgccggaccagatcaactgcatcattgagagctgtcggccaatagaacccttgacgaaaggccttgccaaccaaggtgcgcgaggcggaatgggctccgcactcgccttcatggatgtcggcaagaagctcaacgccttgttcctgaggaatgcacttcaggaggattccattagccgcgcgccgatagagggtcccttctaccagcacgtagcgtttggaaatgcgttggacgcgttcactcccttcacggtcctcaggtagagtcttatctgtgaggtatgcttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaaccatgttatcccgtctgggtacatgccgaagctctatcccgtcaaaatggcgctccatacgccgcacttggcgtacgtaagcgtccatctgtgggtcagagcaccggtactccttacagacctggttaacgaccagctgggagtcgcctaacaccaagaggcggcggatccccagtccagctgccactctgagtccggcaaggagtccctcgtactctgccatattattagtcgctcgaaagtcgagacggaccaagtatctgaggacgtctccgttcggagaggtcaacgtgacccccgcaccggcgccctggagagacagagaaccgtcgaactgcatcacccagtgggcggtgtgaggcagctgagaggggtccgtgctggcatcggggattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgatcctcttcgctaggggccgcatccccggggcgttcttcgtccaagtggcctctcggggcgcactcgtcttctgtgccgatgacctcggggtcggaggatgacaggagcggccttcccacagtggcctcggggccgtcctgggggtcgggggctcctggcgtcgtcggacaagcgggcaaagggccaactctggtcgtcaggggccttaggcctccgttcggctcgggggcctcttctccctgctttctcccgggtcgagtcagcacagggttagcctcggggccaaacggcgataggtgcggccttcccgcagtggcctcggggccttcctgagggtcgggggcacccagcactgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaagagccctcaaattttagtggaattttcagagcacaaataataattgagaagaaataaacaaagttgaaaaggtttataaaaagaaaaatctctaaaagtcttcttttcccccccccttcctctcttgggccggctcggcccaactctccctctctctctcctctcccgcggcccatcggctccccgcgcgcgcgcgcgccgctgacaggcgggcccgcccgccactctcgctgacgggtggggcccacctgtcatcgccttcctcccgccgcgcccgccgccgcgcccgtgccctagcgccgccgccgccgcggattccgccgcatcccgccttccccgcgcgccttaatgaggggggaatcaatccccgcgattccctctcccgtttcccccgctttcccctctctctctccctcggattcgctcggatttaatcccgtaatcgtcgccggcgcatctatggaacccgagaactccgcggccggtttccttcctccccggccgccttctctcccttccgacgctataaaatcgtccctcgtgcttcgctcttccgtttccgccgctcgccgctcgctctcgccgtcggtttcgtgcccgcgccgtgctcctctctctccgccgtcgccgccgagctccgtttcgccgccgtcgtcgctccggtcctcctcccgactcggcgccacctccatcggcttcgccgagtggttgccgaccccgtccgccgctccgcttcgcccgccgaccgccggagcaccgtcgtcatcgtcatcccgaaccgcgccgccgctttcctccactccgaccgccgttctcgtcgtcgtcgttgtcccggggtgagccgaagaccgccgttcgctttcccccttctctccgctctctcgggcgccgctccaccgcgctgatggtcgccggcggtgaccatcggggcgcgggcgcgccgctcccgtcggccgtgccggcgaggccgccttcgggcgcgccctcgcggctgccaggtgggcccggccgtcagccgcccgcgcccgcgggacccacggcgccgaccgccgccagccgcgtgcgcccggtccaccgtggaccgagcggctgacgcgtgggcccccacccccgtggacccggtccgcgcgtcccctccctcggctgacgcaataaatgggattttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagtgaaaaagccttttcttttccgttggtcgtgtagacgctgcagcttcggaagatccgctcttcgtggaaattgaagccggcgtttgggaaagcgagcaaggcaagtcacatcatccttgagcatattgaatcccagtttacaaaattatttttttaatttaaattaatgcattatcgctttatttaaattcccgcgttatcactgttttatttagccatgcctatttacctttgttatgaccatactattattgttattgttattattaccttgttcaccctagaataaacaaaaccccaactagtggacactctatttatggttccactagtatgaatttaggtagatgcttcgctgattaatagaacaacattaggtggttttataactttagactttgggaaattctcatatcttttggacactatggaattgttggtttatggaagaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcgaatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgtgaggaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccgtgattaataatactgtatagctctaggatcgtctttataaaatggctttgggcaactaagtgacttttaaatgctgtttactgcaaaacttaacccctatattattatccccttgtacccccttgcattaatcatgcatctgtcggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaaccgcctttgtaataatgtaaatattatcgatataataaagatgagtcttttatatcatgtttgtgtggtgtaccccggctcttcctgggacggggattaatacactagcgttcgggaaaaggcaaattttcccggtcgcgacaagcaccgtctgacaagcgggcagagggccgactccggtcgtcaggggccttaggccaccgttcgactcgggggcttctcctccctgctcgctcccgggccaagtcagcacagggcgggggtgcgcgaaatgaggattgtcttcatcgcgctccacaaccaacgctgcactaactacttggggggtcgccgctaagtagagtagtaggggctcatttggccccggggcgactagaactgggggagagctgagatatgtcttcaactgagtgagggcactttcagcttcctccgtccaagtaaacggccccgagcgcttgaggagcttaaataagggtagcgccttctctcccagcctcgatatgaaacgacttagggcggcaatgcaaccggtgacgcattgcacatccctaagtttgctgggggggcgcatccgctctatagctcgtatcttctcggggttggcctcgatgcctcgggcagagaccaagaacccgagaagcttgcccgcaggtacaccaaacacgcatttatcggggttcagttttatgcgggcggagcggagattttcaaaagtttccgctagatctaagagtaaagtctcttggttgcgcgtctttacaaccaagtcatcgacataagcctcaacattacgccctatttggctacccaaagaaattcgagtagtacgttgaaaagtaggacctgcattctttaacccgaagggcattgatgtataacaataggttcctacgggggtaatgaacgcagtttttttctcatcctccctagccatgcgaatctgatggtaaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgcctttggaacgaccaccgggttcgccagccactccggatggatgacttcacggatgaatccggcctccagaagtcttgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccatccagaagaccaccgatccgtgtggtcttggatgggccgtcgcccagggcaacctccttgaccgggacctcggcgcatgtgacaatccgctgcctcggggcggtgggggcggaggtgccaagcctctcgtcaccaccctcgggcttggacgcagcagcgaggtggtccgcgcgctgctccatgcaagcgagcgcgactttcaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggctgatccaccaaaggtgaccggtaggtcgatgtgacccaacggccatgtgtgccccggcgtcacaccgataatcggttgggacggctggagcaccatccccggggccttgatggcatcaaaagccgcgggggaaatgatgttgagggccgctcccccatctatgaggacacgccccaacttcacgttgcagatggtgggggaaaccaccatcgcaatctgccctccccgggcgacgcacggtgggtggtcggtctggtcgaaagtgagggcaacctccgaccaccgcgcccggcgcgtcgcctcatgagtaggggccgcggccagaagctctcgcttcatggccttgaggctccggcgagagacgtgagcacacgctcccccatcgacagtggcaatggtggccccaggttcttggaaacctaggtcattatcgccatcatcgatgtcctcggcgggggccttctgcttggcctcacttcgccgacggccggaaggaaccgccggggacttaccttcccggcgctcctgcctcctctcctcctcccacttccttgtccgctcagccaagcttttgactgcgcgacagtccgcaaggtcatggagggaggtgttgtggacggtgcaccacttgccggtagggcgctccctgctgggaacgctggcctccttctttttgtcgctcgcaggcctcccctttcgggtggcccgtgaagcgccctcgacggcgaggacatgaccctcgtcgtcggaacggactgacctcttcttcctcctcctgtcacgccgccctgactgagcggcggatccgggggcggccgaagctgccactccggaaccggaggggttccaagtccaggcctcctccttgcgagccactcggtccgcgagctaaaaaagctctgcggtagtctggggctctttggaggcgatcttttcgagcatgcggttgtgccgcacaccccccctgaacgcgtagattactgcgtgtgcagggatgcatggtatggtattgcggacttgacaaaaccgctgaatgtacgatcgaagcgactcatcgtcccttcgctgtacagcgtgcaagtccgcttcctcaccggggcgcggatacgtgccttggaagttcatggtgaactgctggcacaaatcctcccaggagtggacagacgcgggtggcaagttcattagccaaccccgtgcttgccccttcagggccatgggaaagaaattcgccatgaccctgtcgtcacccccggcggcctcaatcccggttgtgtagacctggagaaactcggcggggttgacgctgccatcatatttttcggcgatggtgggccggaaccttgggggccaacggacattccgaagactcgccacgaaggctctacagccaacaccaccaaccgggggcacggagggctgattcccacgtccgtgtcgaggtgacactctggacgaggaagcgccttccattgcgtgggcagcacttcggtcattacgccggcgctcgaggctggcgcgggcgccctgctccctacgcagatcttctcgggtcgaaggagtcgatgagggagtggctaccgaacggcgaacagcggctgctgctcgtcgtgcccttcgtcttgacgacgcggagccagtggtagcagcaccagaggtcttggtggcggaggaccgcccaccagcatctaggcgctgccgcgccgtcatgaccaatttggccacgtcgtccagccatcgttgggctggagattccgggtcagggacgacaggcgggtggcgtaagagcacgcccgcagcttggagcgcgccctggggcgtgctgccgtcgccgtagacgaggaggcgacgctccccatctcgccgttctcctccatcgcccgcgatcggtgaagccgcggatctttcgaccctttcgagcgcctccccctgcttaggactttggcgaggaggaggtgggggagtacgagctcgacggcgtgggtttggctccccgtcgtcgccgctcacactcggagagaggtcgtgcacctttgcttgctcggccattaggctgaacaagaaaaacttggcgcacacggaggaggacgagagctcagaaaacacacgctgagccccctacctggcgcgccagatgacggagctcgtggctcctcaccgggagaccgcacaggcccccctttgccggttcggccgggggcttagggttcaatctcaagctctctcggtatgtggaaagatcgccagctaggaagaaacgcgagacacgggcgatgtatacaggttcgggccgctgagaagcgtaataccctactcctgtgttttggtggatctgtgtatgaatgagctacaaagtgtgagccgacctctccctcgttctaggctctgaatctggaaagcatccaaccctttctctatgggcaaggtcctccttttatacttcaaggggataccacatgcacccctccctttccaaactggacttttcttcttttcataaatagacggagatttgcacggtcgtcctccgaacatcctcctgacgggacggcacatacctacctccacttctgcctgaggcgggcacgtcgtgggaaggtggctgtgtgctgacgacatgagcagtgtcagaccggcacaaatcggtcattcttgtccacc

SEQ ID NO: 82193 - DNA, 549 bp, Oryza sativa
agctcggtacccgttctgtacctgaggctcttgttgagtctcctgtactggcacattatctgtctaaggctgttgcagctcctcctctggtgtggcaataatttatgttgaatcctgtagaacaggttcctcactttcattcattgttgccacaggaggggtaacaacaggtgctggtaccgcaacgtcatgcattgtaggcacaacatcaacaggtagagagaagaaaggctcctgagtcgacagagcgggtacagacccccgccactcctcaagatcaatttctcgaaataccgagctccccctaatcatttcgtcttccaggaagacggcgtgtctcgtttctacaaactttgtataactgtttggacagtagaaacgataaccatttgatctttcaggatagccaataaaatggcagctgattgtcttggggtctgttatcgaaaggacaacggcataagtcgaaagacgtggtcactcaacagtagttggaaaaaaagtaaagtgtataaaattgagaatttttcttcggatcccccattacat

SEQ ID NO: 82194 - DNA, 632 bp, Oryza sativa
atcaaccccgggggcgatctgggccgtcggtcccgtggaccggcggtggaccacccgcgtggtcccggtccacagtgaaccgttccccccttgagtcgctgccgagtgggcccgctcgccggcgcccctttcctccctctcccgagccgctgaccggtgggccccgcatgtcggcgccgcgcctcctccccctcccgtgctgacgccagccctgggatttattgcacaataaatgatttaaggactttttgttatagtaataaacacagtgaatcttctaaaattcatatctaattcatccgagctccgtttaagcccattcaggtctcagtaaatcaagaaaaatgtgtagaatccattaaaaatggttttgttctctgtttcagtagtcttatagcctgtttgcaatgtttgccttgtatgtcgctagattccggttcttccgacgctccggtgtagttcgaaatagtcgccgaggttcctctagcagcagagcaaggcaagtcatgcttgtcacttgaacatgttgatcctatattgcaaatgctctattgttttccttcaaatattgcattgttttataatgttactatggggtgtttacctattgtcatagccatgctattgttgta

SEQ ID NO: 82195 - DNA, 698 bp, Oryza sativa
attcctgcagcccctaccttcaagtttgacacggttagaagtaaatgatgttggattgaccacccttccaaggatatatgaccatcatgttaacaacatggattttgaaagcaaggaaaccaagctaatctcagttatcatcagcaactgctcaaatttaatttctctggaggaaagctttctactgcaggagcaccatatccgaagtcttcgtatcctaaggattgttgattgtgaaaagttgatccgagctcctttgttattttcagaaatggataatcttgcagaatttcatattggtaagtgttaccggttgagagtgagggaaaacgatgataatgtactactcccccgcacacttaaggaactctccatggtgcagtgtggtgacctccagcttccactgctggagtcactggttggtctgactaatcttacgtcattgagtctgtgtaactgcggcagggtgaggtcccttccacagtcagacgtgttccggagtctcaggtcactgcgagagatggctgtggctgattgtactagcttggcatccttgggtgggcttggagccctttcatatctcaattggctggaaatcacagagtgcccgaggcttcaggggtatgccagatatgatgaagtggatgaagatccggtgttggagttctccctggaggtctactctctctgatacatac

SEQ ID NO: 82196 - DNA, 8058 bp, Oryza sativa
aaaacgcgaggggtcggggcgcctcggccctcgggggcgaggctggagtggtccgaccccccccccctcgggaagaccaagaggtgggcgcgcacatcaccctcgggcccgacgtcccccgagggtgccaggccacgtgggcgattgtgtctgcctcaagcctcgagtcatgatactcccggtcccatgtcaccgacaaggacgatttccccttgccacggatcgaccaactcgtggattcgacagctggctgcgaactcatgagctttttggatgcctactccggctaccatcagatccacatgaatccggccaacatcctcaagacagccttcatcacaccattcggcaccttttgccacctcaggatgccattcggcctgaggaacaccggggcaaccttcgccaggctggtgtacaaggtcctttacaaacagttggggcgaaatgtggaggcttatgtcgacgatatcaccgtaaaaagccacaaggctttcgaccatgcgtccgacttgcaggagaccttcgacaacttacgcgcggcgggtatgaaactaaatcctaagaagtgtgtttttggtgttcacgtgggcaaattgttgggtttccttgtttccgaaaggggtatcgaggcgaaccccaagaaaatcgatgcctttcagcaaatgaagcccccgtcgagcgtacgcgaagtacgaaagctcgcaagcagaattgcggcactcaatcgattcctctcaaaggcagccaaaagaggcttgcccttcttcaagaccctccggggcgcgggaaagtttacctggacacctgaatgccaagcagtgttcgacgaactgaagtaatatctgcaaagcccaccagctttgatcagcccagcaccgagaagcgaactgctactttacctagcagcttcgtcggtggcggtcagtgcagccctcgtccaagagacagagtcaggcaagaaaccagtttatttcgtctccgaagccttgcatggagcaaagataagatacattgaaatggagaagcttgcttacgccctggtgatggcttcgcgcaagcttaaacattactttcaggcccacaaagtcacggtgccatcacagtaccctttgggcgaaatactccggggcaaggaagttactagccggctcagcaagtgggcggcggagctatctcccttcgacttacattttgtcgcccgcactaccatcaagtcccaagtcctagctgacttcgtggccgaatggacaccggcattcgccctcgagcccgagcctgtcgaacaactctgggtgatgtactccgacggctcgtagtcgcacaagggggcggacgctgcagcagtgctttcttcgctagggggcgtgccgattcggtacaccgcaagactgcagtttgacacaaccaacaacgcagcataatacgaagctattctgttgagcctaaaaaaggcgaaagcattgggggttcgacgcttgctcatccgaactgactccaaattggtggcaagtcatgttgacaaatccttggaggcaaaagaagaaggaatgaagaggtatctggaggctgttcgatctatggaaaaatgcttcgccagcataacggtcaaacacttacctagaggccagaacgaggaagcagacgccctggcgaaatctgctgcttgtgggccacattcgcctggcatcttctttgaggtcctatacacaccaagtgtgcccatagagagcctggacatcatggcaatcgaccagacagagctgggcgaagacccagaggactggcgaaccccgttcgtaaagtacctcaagaaaggctggctcctggaggacaaagcagaagaaaagcgcctacagctcagggccgcaaaatacaagcgggtctcgggacagctatatcggggtgctccaacccttgcttcgctgcatctcctttgccgaaggtgaggaaatggcgaaagaaatacaccaggggctctatggtgcacaccaggccgcaagaacagtcgcctccaaagtgtttcaacagggtgtatactagcccaccatgctgaaagtctgtgtcgagcaagtcaggaagtgtgaaagctgccagcgccatggccgaagccaaaccgcgccccaatacgagctgcagcctatcgcaccaatctggccattcgccagatgggggctggacatcatcggcccattccctgtggcgcgaaacgggtacaagttcgcaattgtggccattgaatacttctcccgatggatcgaggccaaaccacttgggtcgatcacttcaacggcagtacagaggttcgtatggaacaacattatttgtcgtttcggagtaccaaaagaattcatcactgacaacggcaagcaattcgactctaacagattcagagaaatgtgcgaagggctaaatctggaaatcaggttcgcttcagtcgcgcacccgcagtcgaatagggcagcaaaacgcacgaatggcaagattcttgaggcgctcaaaaaaaggcttgagggggcggcgaagggtaaatggccagacgaaatgctatctgttctctgggctcttctaatgacccccacaaggccaaccaagttcagcccgttcatgcttctctatggcgacgaagcaatgaccccaacagagctaggggctaataattcaccaagggtgatgttctctgggggcgaagaggggcgcgaggtgtcgctcgaactcttggagggggtgagagtcgaagcactagaacacatgcgcaagtacgccacaggcacttcggcaacttacaacaaaaaagatcgaccgacggagctgttgcctggccatctcgtcctaaggaagaaggcgaacccagtggtggtcggcaagcttgaatcgaagtgggaagggccgtacctcatcaagcacaagtccagaacaggctcctttcgcctagcgacactggaaggcgaagagttcgaccattcctggaacgcttcctcccttaagcgtttctatgtgtagaacgggtggcacccaaatcgccaacttgtaaaaatgtacatactgttatgtaagcctttcggcactatgtaagcccttcggcacaaaaatacaaaaaaaaagaaaaaagaaaaaagacaaaaaaaaactggatatagggctattatccatcccggaggcccgaaccagtataaagtcttcgtgtctttcgcctttttatttgtgtgaatgataatttgtggaaaaatcccaaggcaaacgcctcatcagtgaaaatgccaggggggcgaaacgaatcggccgaagcaccgctcaccgaatgttgaaatcgcaacagcttgtttcgggaaacaattaaccgaacaccgttaaattcgaccaatatgaaaacacaagcgctcctttcagcgcggaatacaacagatcgaaaacggaagccgaaagctgaaaagtcagcaaacctatttcgctaatatacgcaaaggggccgacacgttccgacctaacaaaagcacgaagagtgacaatgcgagaaatagcgaaaaggaagtaaagcacatctttattaacttcaaaaaaaaataatcgaagatcccaagtcttacaatatgatacaggcgaaggaagcaacggctttacagccgagcttaaagataaattataccttcgccaacacaacaatcctcaccccctaaggaatggtttggcgaatcgggtttgtcgtcactactgatatcgtaaacaaccctcaaaggggatggaggacaaacacaagctaaactataacggcgacgggcgatcgcctcttggcgaaccgatcttctaaagtttcgacaaaagctcaaactatcttcgcgacgtgatacacgatagcgaccgtaatcctctaaggttcggcctggatgcacgcgcatccatttagcaacgcttacaaccttatagttgttgccattaatcaacatctcacggtaaacaggccgaaatgggcacttaatcttcagcaggctttttattgccacgaaattctcgtttttgtttcgccatttttcagcgggaggtcaaacgcatacctttcggccacaagcctgctagcaaagcacaaagggaaaaggtgcaaaacggggggaaatatagacgagatcagttccactttcaaacggaacaattagatcagcgaaaggataatactttatcagtagaacagagttcatattgattacaaggcgaaagcagctcaaagccgaacatgcaaaaagcctatatacaaacctaggctaccaaaaagcccgaaaggactaaagaaaaaaaataaagcacacgagggcgaagggcctcacacctcaaggtggtcttggcctccgttgccttcgccctcgtgctcggtggcctgttccgacggcccgggatcccctccggtgttggcagcagcggcttcctcgtccctcgtgatcctttcaaggttctcacggagtcgagttttcacacaatcccgaccaccatcctcccaaaacccttttcgaaaggcccttaaggcagccccagaacactgcgtgttgctaggccattcttctttcacgaagtcgggaaaattcccgatgtggtcacagccgtgcgcatgcaaaaggctaaggacaaatcccgccgaaacacaagcgcagcagtccccgtaggcaccagccacttcaacgaccgagcccgctgcttcctgcgtccattcggagaagtcgaacgcggtcccgccttcgcctggagcaccttccgcccgcgccccaaggtcattgagggccggccggaaagtgtaacaggcctacttggcagactctgtggccgataccaaggtcgcggcagcagcttcggccgagacaagacgagcttcgagggatttgatcttctcttcggccaaagcaagttgttggtctcgttcggcatcccgcttgttcgccgcttcaaggtcagcacggagagacttgttgtcccccgaaaaaaccttgttttcagcattcgccttctttagagtctccgccacgacgcgtctttcatcttccttgtggcgaaggtcttcttcggtctttcgaaggcgaaggcggtacccgtctagcctctctaaggcagatttcttcgcacttaagtgcgcggcaaggccctggacaaggagaaacaaaaaacattacggcaggacactagcgaaaggacaaagttcggcacacagaaaattcatacccgcacaaataggctttccacggccacgcagctttcaccgaactcgtttagctcggtgaagagcccaaggccgtcggtcggtgcaatgacctggcacacaccgtccacgaacggagtgatctccggccgcgtggcaaaatcagcggggacgaaatgtggggcgatgagcgtcacgtccgaaatggccgcttcgaccgccagagcttttccctctcgttgacgggcaggcgaaggaatcgcctcaacccgttcgtcctcggaaacattcgccttagtggctggtgccaaggcactcccacctgtcgccgcttcagcatcgctggcaggtggcggagacatacgcctaccacgagaaggtgcgcgccgcaaaaccggcgaagtaggcgtcccatcggacccttcactgtccaaaaagccacggccgacttgcacaaccttccctttctttttcttcctcctagcagtcatcaccggtttcgctgctgtactggaaatcgccaggagggtgttcgccacaacgatatcttgcggccgcgtaggcgaaacatgagaacctacccgggatttcgcaagagtaggactgggggtgtagccatgggacccatcatcctcagaaccaacctccccatcttcttcttcctcctcctccccatcactttcgaccgcaaccttcgcgctgcggcgagttcgaacttggccacctttcacaaccgcacgcttgcgtttcttcgaagtgccaactttgtcatcctcagctctggaggggttcgatcgacttggcaattcgccaatatgaacccaattcacccggccgtcggtctggcgctggagcaagcgggcgaattcggccgtggttagagctcctatcatcttcgacgcctctatttcggcgtcttccaaagtccgtgctgcgaaaaaagtagaacaaaaatgagtgtttagcctaaagggcacttccataaaggaaatatgcggcttagagcaaaaaaaaatctcactttcgaccccagtggggagaacaaggtggggaagcccgagaacctcttcgccctcgttcatggaaacatcccaaacacgggcgagaggggaaatccaaaggaggcaaaactcctcacaaaggtcctgggtgcttagccgccgagcgaccttacgaaggagtataagccgggactcgagagtcccatcgatcttcatgttcggcttcacgatatggagacggcggaacgctcaaaaaggagccaattcgccttgacatcctcggcagggtaggggctggcgatgtagaaccatttttgcatccagttcctatcccacttggccattgacgtgggtaccggccaagcgtctgagcgctccggccgcagcatgaagttcacacagccgaaaacagttttcctcggaccggccggtgtctgcacgtctttggtcgaggcgcatgctgtaaacaaaatagcgaatagctcggcggtaggggcgaacccacaggttcgacacatccaagcgaaaaccgccagcttcgggaatgctgatgggctaagctggggaagactaacctcatacgtcgcgagcacagacgacaagaagtcgtcacatgggaggcgaagcccggcggcgaagtaggcagcgaagacaaccgttcgtccatcactaggcaaagggacaatggcttcgcccccacatgatccttggccctccacgagaacaccggaggataccaactcgcctaagtcggcctccttgacaagcgatttgccaaggaagcacgaccacccttcgccaaggctgccagggtcttcaccagttgacccggctttagtgggcttgcgaggagccatcaggctcacggccaaggaaaaagccgaaaggctaaagcacgacggtggcgaagaagctaaggggcgggcaaacgaagaaagcacagagcgcgtcaagcggtaaaaaagtgaagagtgcggggggtgagaaaacagcaggccggcttggggttatataaccccgtcgcgagaccgttcgcctgccaaccaattaaaccctgacacttgtccaggggcagacgaaacggtaaattcccatcgggccggagccgaacagtgaaaaggccgattgcgggaaaggagaggcccacggggcccattagtattcatagtaataaaagagacaagctaacccttttttacactttgtaacaaatgcgaggaagggattttctcaagaatcttttgtaagcatgaaaacaagttatttatttcgcaggactatatcacagatttcggcaggaacatcggccgaaagggggtgcctcgtggtataccatttgatctgcacggtctcagccgaagctccctactcacccttgcccgtgaggggcttgttggaggcttgccacggaaggccttcggccgaacctgccgaaaccaaaaagttcaagcagcaggctcacgccgaaggtggggggcgaagggcaagagtgaagccatacgggcgaaagccgtgactagggtaacaccaccttcgccgagtggagttctcgctagaaggcggcacgggcgaagatgatgtggcgaaagcctcggcacacaggcacgggcttcgccatagcaccaaaccccgttgacgggggaggcttggtgggccgctacgccctcgggggatttcgccagatagatgggccgagctatttaggcccagtaggggcccgtatgtgtaaaggacacagtgtgccctccataatatccctatcataagggtaaccatgtaaattcccatgtataacttaaaccctagtagtgggaacctgtaatggggctataaatagccccctagggccatgtaatagggggatctcaagaaaaaaat

SEQ ID NO: 82197 - DNA, 3406 bp, Oryza sativa
ttccacaacctcttctctctccccgctcattttcctcctctctccctcagcttctcttctaacgattgatgggcatggggcgcaggagcggagtagctgacgggcacatgacccgttgccgccgacgaaggagtgggggtgatgagccaaaaaaccctagctagatctgttggccatgggattggtcggggcagatccagtagtggcaggaggtggcgggcttgggtgatggcgggagcagtggtggtggcgtcaacgagggctatggtgggctcggcctcggaccgcgtggatctcgtcttctctcctccctctttccctcggcttctcctctcatgatggccaacggccgtgggattttccgccatccaccactactagaaaaacgatttttcatggtgtcaccctacgattttcgctggcttaagacgactaccagcaaaaatgaattatcgctggcggccgataatcgctagcgaagatcttgatcttcactggcctttactttgtggcggctccaaattccaccagcgaaaacccaaaatggccaccacggaagatggttttcgtagttgtgcacgaaggagtggggacggtgggatggagtgcaacggtgactggttagcaacggatctttctagggttccgattttagtagtttttttcaccgaaattattttcatgcggtcggtataggtgacgacatgtaaaaattctgtttttcgcatgcagatgtggtgcccgcatggaaaaatattgattttttcaaacacctgattgcaggtggttgctttgcctacatgcgaaaaaaagtttgcctgggtagcccgacgagttacccacttatttacctataggtgggttcacgggtctactccattgcagccttaatgtttgtgcatcaaaattaacggataagttcttgtcacaatgcgtaatgggctggatcgttgtgggccggacctttgtcatcacgcgattatacagcaaattagacgggcgcccgattaatcgctaatgatatgatttatgcgtaactgattaacgtaacagactgccagcctacccgtattaatggctgttaaaaccgttttccattttttaacataatggaacgtaacatcccggtttttctcaaaaagttacaaccaattattacagtctaaactctaaaagtgtgtagttcaaacaaaacatcaaaaacatccaccaaaaattaaagaaagaccaaacttagataaggtgaacacatttattgaaggctatttatgtggcaaagagttgcataatcgtcgtatcaagcttacgacatgcaacttttataaactcaccatcttcatcagatctttgtagttgaacccagagccggagccaatatgttgccttgaaaattacctacatatatgaaatagatggtcaaaaaccatatcattcctagcttcctgcacaaccacaaaacccaacatatagtagaaacttctacaagaataaacttgctctcttccttgtccaccctaaaagccaaccaccaaaaaccgttttccatagtatagaggtctcaaaaaccattcgaaattttgttcgaatctactttttgtcatgtcgaaacctccaatttttatgatttttttatcgatttttattgaaaacataaaccatgccctgtgttagccattttatgcaatatgttgattttacttgtttctactttaacatagagggtgtttagatctaggggtgtaaaattttggcgtgtcacatcggatattatatagggtgtcgcatggggtgttcggacactaataaaaaactaattacagaatccgtcagtaaaacacgagataaatttattaagcttaattaatccgtcattagcaaatatttactgtagcaccgaattgtcaaattatggagcaattaggtttaaaaaattcgtcttgcaaattagtcgccatatgtacaattagttatttttagcctatatttaatacttcatattggagtttaaacgtttgatgagactaggtgaaaaattttggggtgggagcggattattattgtgaattatccgcttggttatggggtaaggtaaaattgcataatccgatcagacttaattccttggcgggccataccagctagttgtccagcgtagttatgtctcgagctttttcttaaccaaagaatgatgttacttccagctgacagcaaacacacctttcactcgaccttattcgagaactagtttaacttggctgatatagtccactacaaatccatgtgaaaagaaaataggctgaatgacctactcacgtgtgcggagggatcaatttcggtctaacaatattaaggtgggtgagcttttataataaaatatgttatggggttgaatctcaaaataaaggtaatgattaggatggtttatataattttgtcataaataaaatattttaagcaatatcgttttggcggaaatgtatttttcaaagcgtttagcgaacaatctgaaatatttttatttttagaaaaagaacaagtccattgtcgtttcgtggaatttaattaaatttattttaaggattttcagcatatcacatatccgcatagctattttatacgggactacttagaaaaaaccgcaacaaattttttaaacaatttttcactatattatactataactaccatacaactttatgtaagtattaaataaaatacaatttcatactgagttatgtagagatacattgtcattatagttatgtagttataatgtaactataatataattatattttacaagttactagttataccacaaaacttaattatattgttacatataaaagttttctcaaaagtaacttcccattttatatacccaccctctctcacgacaacatcatcacttcattatcacatgacagaccaacatataatgatgattaagaaaaaaaataaaattgttaacagaatacggaaggaaaaaaaataaaaaaaaaaccggcttctccgcctatcgtgcccaggtgtgcgcggctctcttctcctccatcggcgacgagccactcctgcgatgagatgagattgcccgcatcgtcgtcgtcggcggcggggctgcaggagcgcatctgggacctccacgacaatctcagccacgccatcctctccctctccgcctccgcccaccgctgctgccgccgccgcgcccccgaagggcgcgtggtcgtcaaggggtggcggcggcagggaggatgtggggactgcggcctggagcaggaggcggctgcggcggccaccatggcggacgcgcggagccttcacgccgtccgcgccgcgctcgaggacctcgagggccacctccatttcctccacgtcagtatcctcctctcctccttaattcttg

SEQ ID NO: 82198 - DNA, 6630 bp, Oryza sativa
tgacctgctagatactagattatggagttctccagcaccatctaattaaattatccaaaaaataacatggtgcctattgtgtcaacaatacttgcagaacattcaattatgtcaggtggcagaacgagatgccgcgattgctaggctgcagcaaagtcgtattctgcttgctacaagattggctgaacataggtggaagaagcatgaagttattgaggaggccttagcttttgttgatgatgcgcttgacaagagtcgatttgtctcaccagaagatgtccgtgggacgcatacacacagccaatcagtagagaaccagtgccccaagatacatgattcaaacttcttggtgcgttttttatcctgtacattagctatagctaagaattctttaagatttgagaggattggtggtgcactcggtaataccgcgatgtttgcagtaagtatgcttgcattcttgcagctgcaacaagtggcctttggtaaacaaactccagcagtacaatgtagacgagtcaattattttcattctcagatgtctgtaaagaacactaaagaaaagcatctggtcgtattgttagctagaggatgaggaaatcatcattgtttgatgtatagataagttttgttctgttcacatttcttgaaagttttgttaggacactaatcatttcactcccttggattggctggtctacagcatatctttgataggaagttgtaccacatgagttgtaaatggttttagattggcaatagatgaactggcagggcttgtaagcttgtttctttttctgcagctgaacgacaaccaccatttatggacaacagatttcgtaattgccatgtttatgtgaaaccatggtatcagatttgatctttgggttgccatgttacatgaatttcttgtcaggggcttgtggatgttcatatacatcacaggctgaggcactacaccaaaatgaccccataaagacgtttttctctagatgctttgaaacacgtctctgaatatggtatgagatagaaaaaaaaaaagacgcttcgggagacatttttatgaatcgccacaaaatttctatggtaaagatgtctttttcagggatcttaatcaccaaaacagcgttcttgttatccttccgagcagctcaattccgacagtccaaagcccaactgttcgcggttgttcgtgattttgtccttctaattgtcccactatatatccatcccacaatataactgattttgtccttctaattgccccactatatgaggaattttggcatactacttatcatatataagtgactttattctacattctagtatgtgaaaaattcctgaatttgaattgatatatggatgctatgtgaatatgaaaaatgcttgcatgatgtgattattgttttttttctcttttttttgggctaaaaataattcttccatgcaagtgacttaagatgctgcctgcgaaaatacgcggtgctcttagtgcagccgtatgtgaaaacgatttttgtagatagtcaaaggtccgctgcaggtctttagtacaggtggagtatttggccgcctgaaaaacgtgttttggccacgacaaaaattgtttttctaatagtgatagttagtcagccatcaactccaattcaaatttctacatatttttaaccctcaactatccactcacccacaaacatatctcaccccaactatacattatttttttcatgattttatcttgcactagttattttttagaaattaactaagattaagtttacatataagttcctattgtaaaaatgtatttaggtgattgtaaaatttatattgaattgtactatgggtcggttattattgcccgagtttcattttagactaggttatatctaatgttttcactttggttcaggttttcttactttctgttgcacattggactattttttttgtgatttcattagcgagcttaccagcaacataataaaccaatcaatattccatctgaccttgatttcttttactccttgatttagctgcttgacttctaccattttccccttaaaaaaatcaagtgagcttagagcaaatcactgtattgagcttgcaagcgacactgcgacagctacaacaaccagctatcaccaggcttgattttgctggttcctcaagctcaggaacagagcagagagagaagggatcccagtgttttgattgatcatccacggcgcagctgcttaatagagaaaaggagggaagagaagagatggagaagaagggtggtccaatttgaaatttttgtaaatttatctagtccaaagtgataagataacttcaccccttgttcaaagtgaaacttaggtaaaaattcctagcccaaagtgcaattgactcttttctatatctctttgcgtaagactattatgtttcttttatatataaaactaggtgaaaccccacacattgctgtgtgagtttagtatgatagcactaagttaagtaatgtgtaagatagctagacaatataaacttatataagttaacatggttcatgatagtttaaatttaaatagtatatagaacgataatttaaatgtaaaagtaagttgttatagtcttatgagaaaagaaaaggagatagagagagtttggataatagaataatcatctaatggctaaaaacaattgagatgatatgacttaataaaagaaaaaaataagggagataatttggaccataggacaaaaacaattgatgtgatattgcttagtgagagaagagagagaacattaactaagttaggagttataataaactatatatgtatataagatgttataaaaaaagatgaagagacatttaaatattatatgaattatgtgtgatgatgatataatatgcttgcatttgaaaagctataaaatttaataaattataaaattatagataatataagcatgatgtttatatgtaatagagtaaataaagaacaaaaaagaaagagcactacaaaaatggtaaccaatcagcaactaattaaaaagctcacatcttgtccgttctctcccgatcggacggctgctacgccatcagagcagctccagaagccaccgcgccagtgcgccactgctaagtggccccctcccaactccgacgaccccgccgccgccaccgccgccgccgccgatgcagaaccccaacggcaccatcctccagctctaccacgccggcaggctcgccgccgccctccgcgccttcgagtcgctcccctcctcctcccccgcctccgccgccgccgccccagcccctctcaccgccgcgacctacgccgccctcgtctccgcgtgctcccgcctgcgctccctcccgcaaggccgccgcgtccaccgccacctcgtggcctcctcatcctcctcgccggatgcacagctcgctgggaacaccgtcctcggcaaccacctcatcaccatgtacgggcggtgcgccgccccggactccgcccgccaggtgttcgacgaaatgcccgccaggaaccccgtctcctgggcctccgtcatcgccgcgcacgtgcagaacggccgcgccggtgacgctctcgggttgttctcgtccatgctacggtcaggaactgccgcagaccagtttgccctcggcagtgccgtgcgtgcttgcacggagcttggggacgtcggcaccgggaggcaggtgcatgcgcatgcgttgaagtcagagagaggcagtgacctgattgtgcagaacgcactcgtcacaatgtactccaagaatggcttggttgacgatggattcatgctctttgagaggattaaagataaagacttaatttcctgggggtcaattatcgctgggtttgctcaacaaggttttgaaatggaggcactacaggttttcagggagatgattgttgagggctcgcatcatccgaacgagtttcattttggtagtgcctttcgtgcatgtggggctgtgggcagctgggagtatggagagcagattcatggcttatccatcaagtataggttggaccgtatttatatgtaggatgctcactgagcgacatgtatgcgcgatgcaagaatctggactctgcaagggtagcattttacaggattgaggcaccggatttagtttcttggaattccatagtaaatgcatactctgttgagggcctacttagtgaggccttggtcctgttctctgagatgagagactctggtttgaggcctgatggtattactgttaggggcctgttgtgtgcatgtgttggccgtgatgccctatatcatggtaggctgatccactcctacttggtcaaattgggtttagatggggatgtttcagtctgcaattctttactcagcatgtatgcaaggtgttcagatttatcctctgcgatggatgtttttcatgagataaaggatcaggacgttgtaacctggaacagcattcttactgcctgtgcccaacacaaccatccggaagaagtcctgaagttgtttagtctcttgaacaagtctgaaccgagtctggataggattagtttaaacaatgtactgagtgcttctgctgaattgggttactttgaaatggtgaaacaggttcatgcatatgctttcaaggcaggactagtggatgatagaatgcttagtaatactctaattgacacttatgctaaatgtgggagtttagatgatgccatgagactctttgaaataatgggaaacaatcgtgatgtgttctcttggagcagcttgattgttggatatgcccaatttggttatgcaaaggaagcatttgatttattttcgaggatgagaagcctaggaatcaggccaaaccatgtaacgtttatcggagttcttacagcatgcagccgagtcggttttgttaacgaaggctgctattactacagcattatggagcctgagtatggcattgttccaacacgagagcattgttcatgtatcgttgatttgttggctcgtgctgggaaactaactgaggcagcaaattttattgaccaaatgccatttgagcctgatattataatgtggaagaccctgctggctgctagcaaaatgcacaatgatatggagatgggaaagagggcagcagaaggtattctgaatattgatccttcccattcagcggcctatgtcttgctgtgcaacatatatgctgcttctggcaattggaatgagtttgcaagattgaagaaggcgatgagaactagcggcgttaagaaatcacctgggaagagttgggttaagctgaaaggggagctaaaagtctttatagtggaggacaggtcacatccagagtctgaggaaatatacgcaatgctggagttaattggaatggaaatgataaaagctggttatgttccaaagcattcatggaaacatgctattgttgatcatattgatagtgatttgttcaatgaagagatgctagctgaatatggttgagtgggagataaagaaaacagtaattgctgactctggggtattcgcatgtcttccttgttgtaagaaatacttgttaatcaccaagataattattaaagctttgtcagaattacaatgcaacatacagaagttgcataagcttggcatcatgcaccatttgagaacttaccagtatgttatagattatattttgcctaaataatttgaaagaagaagtaagtctgacctggatctttcctttccctcgcttcactgctcatttatttggctttcagatgtgaactgcctaacatgaggaaatatgttttgcaaggtgggttcgacaaatcatgcatagtcagcctgctgaaggagctaagctattcatgtaatcttgctaatgatatgcgaagcacaactggggcttatgtatttgtttgatctgtcacatatttctgccaagtaagatttaatccagtgagccatacacaaggtaagagtttgacctattctagaatctccaaattcctgtttctattaatctactctgagaagacctttttatctgtagccacttgtcaatatcgattttgtgaacagggggcattccttttcctcatccagcttgctactcctttctttggcttccagatatgaacttggctaacctgaggaaatgcgttttgcaaggttcgttgacagtgatcttgctatttgatacatgaaggcaggctgtatttgttttatcagccagatatttctgctatgtaggtttcagttcagtgcgctatacacaagatgagaacttgatctcttgcagaaaggtcaaaaacctgtcttttaatctagggttaattgtattcatgccattacaaatttgcccgttttgaaaattatcattacaaatctgttgaaatcggaaatatgtcactacttacgttctatatgcactgattcctttatggaccaaattacccttatgttctacctcagtcccctcctctatctctctctccctgtccaagtatcgtcaacgagactggcgtcggtggaaggtgggagcagcagcagcctgatggctggatccgccgcgtcacactgctcatcgacgaactcacctgtggggcttgaggatctggtgagtaggtcggctttgcgagc

SEQ ID NO: 82199 - DNA, 2416 bp, Oryza sativa
ctccgcccatgggagccagcgcagccattgccgtggacggtcccctgtcaagcaacgcaagtacataataatcacccggttagcagcctcggactgcccatccgactgtgggtggaatgccgtcgtcatgtgcagcttggtgcccatcagccgcatgagttcgcgccaaaacgtcgaggtgaagatggggtcgcggtccgacaccatggactgcggaacgccatgtagatgaacgatctcggcgaagaaggcttgagcgacggactcggcggagtacgggtgcgccagtgggatgaagtggcagtatttgctgaacctgtccaccaccgtcaggatgacggacttgccgcgcactcgtggtagcgcctcgatgaaatctagagcgatgtcggtccaaacgccctggggcaccggcaggggcagcaggaggccggccgggctcaagtgctcggacttgtagcgttggcacactgcgcaggagcgtacccagtcctggacgagctgcttcatgttggggatgtggaactcgcgccggaggcggtgcatggtgcgcttgacaccctcgtgcccgtcctcatgtgtagcctcgatgatctcccgagctaagggcgatgccgggggaatgtataaccagctgttgtactgcagcaggtcgtcgacgagcgcccaggggcccgtgcgcgtgccggcgctgacctcgtcgcggagggcagtgagcgccgggtcctggcgctgcgcgtcatgcagcttgctgatgaagtcaaagcgaggcgcagacagtgccaagatggcgccctcctccgtgtcgcgccttgacagggcgtccgcaacagtgtttgcagcgcccggcttgtattccacggcgaagtcgaatcccagcaacttgcccacccaatgatgctgaggaatggtggcgaggcgctggtccagcaggtacttgagggagtagtggtcggtcttgacgacgaagcgccggccccagaggtacggccgccagtgacgtacggcgtgcaccaggccgatcagctccctttcgtaggcagcgagggcacgatgacgcagcacgacggggcggctgaagaacgccacggggtgcccgtcctggaccagcacagcgccgaacccgtgggtggacgcgtcgccctcgacggtgaacggcttggcgaagtccggcatggcgaggacgggcgccgaagtcaccgctgccttaagggcgtcgaaggcagcggcggtgtcctccgtccaggagaacccgtctttcttggtgagggccgtcagcggggcagcgatggtgccgtagttgtggacgaacttccggtagtaaccggcgaggccgaggaagctgcgcaccgcccgtgccgaacggggaaccagccactcgtggatagcctgaaccttggccggatccatggcgacgcccgcctcggatatgacgtggccgaggtaggacaccgagggggagccgaaggtgcacttgctgcgcttgacgaagagccggtgctgacggagcacggataggacggtacgcaggtgccgcaggtggtcggtccaagtctcactgtaaatcaaaatgtcatcaaagaagacaagcacgaagcgtcgcagaaacggtcggagcacgtcgttcatcagcgcctggaacgttgccggggcgttgcacagcccgaacggcatgacgaggaactcgtagaggccgtcgtgtgtacggaaggcggtcttgtggacgtcctcgggcctcatccgcacttggtgataccccgatcgcagatcgagcttggtgaagaagcgggcgccgtggagctcgtcgacgacgggaatcgggaacgcgtccttgacggtgagggcgttgagggcgcggtaatcgacgcagaaacgccacgagccgtcggccttcttgacgagcaggaccggcgaggagaagggcgagtcgctgcggcggacgacgccctgctcgatcatcgcggcgcactggcgttccagctcgtccttgtgcgccgctgggtagcggtacggacggaccgccacgggagcggagctaggcttgaggacgatggcgtggtcgcggccacgtggaggtgggaggcccgtcggttcgccgaagacgtcctcataggcgaccaggagctcatccaggagcgtcccactggccgcggctagggtacgcaggtgcgttgttgaggtcgaggccacgcccttccaggcgaagcgttgcccgtctcgctggaacgccatcgaccgggaggtgaagtcccacacgatgggacccaacgtgccgagccaccgagtgccaagcaccacgtcgaaacctgcgaggggcatcacaaaaaagatcggtgtggaatgtggagccgttgatggtgaaccccgcgtccggatgacacaaggcaggccacgcgttcgcccgtggcgacgatgg

SEQ ID NO: 82200 - DNA, 2503 bp, Oryza sativa
ttccctccaaatcagaaacatgagatgtgggttaaatttggattataaggtgttggctgttcagaacgtaagtttcatcactgtattcagctgcaaacataagatgaaagctactttttttttttgacgcaaaaggtagagagactctaccttgtttccattgtattaatggtggtcataaaagtgacaaagccagtggctggcaagagattatacaggggggggaacagagaggaaggataaagagaaagaaagataaaaaaagaaggaaaggagaagaaaaggaagaagaaagaacaaaacacaggaataaaaataaaaataaaaatacaggaataaaaaggaaacctagctaagcttgtctgcccaagtgttgaggtgttcgcgaaggctaggctttaagcgatgaacccataattggagactttctctgattcgatgcaggatgtatgcaacgcttgtttccgtgagcttgaagatcagctggttgcgtgctttccagagaccgtgcgaacaagcagcaaagcatgcaggccatcccggtttctggtgttctggcaaggtgtccaggattgattccacaaaatcttgtatgttagagctgcgcacggctgtctcatataggttgagcttcttccagacttcccctgctaatttgcaacgaagaatgatgtgatttgatgtttcaatagctgggcaggtcatacagtgtgggttggaatcccattttttaagaaccctgtttgcattggtgttgagcctgtctcggaacgctaaccacaaaaagatcctgcaagtgttggggatagccttgttccagataagtgttgccggctgccaaaggatgccatgataagtcaacaagttgtagtttgctgatgttgtgatatctgtggaaccaagcagcagtgttcttttgtcggggacattctgttgtatgtgctgttccaacaatatatccatgagggactgtaactcggtttgagcccgggaagagagaaccgggtgtagaacaattgtccaggtaccgttagtgtgttgggaggagactgtacagttgatatttgttgcgtaggaagctagtgtcggatatatgaggttgaatcgtcctgctgctgtccagtggtctcgccaaaactgcactagctggccgttcccaatcgttaccttagtggaggcaataactggctcgataacggaacagactgtcttccaaatcggtgtttctgttggttttgctttaatagggatctcatttgccatgtgttgcgtgcgcaaccattgaaaacatggttctgatgagtctgataacaacttgcctcctatcctcataagtagagccatgttgtgagctctcaagtcacggatctacgctactactcttttcatatcagaatgtagcaatctaggatgtgacttgtcctaacataatgaatctggacatgcctcatattatgtttgacggaggtactagccaatatttgtgtttgaagtcattaaaagtttgattgtactatgtaatcatcagatatcagggatctaaaagtccacttttttttaattggatgtagtagcacctttcatgatgtagggggatcattctatcatctactactagggagtcgattctaatccctcgaggggatatcccctcgtatatctttttcttctaaattcaatgcaaatagttgtgaaaaattatgaaaaaaaattgacaatgtagagtataatgatacctattactccaccaaaagtcaagttcaaattcgatctacacatcaagaaacaaaaaagacaaatttagatataaacattacgctactatttatacgttgaatttgtcttttttatatctcgacgtgtgagttgagtctgaacttaagattttgtagagttgtatatatgtgttgcatgaatattgtcaaaatttttcagaatttttcataaccgtttaaatgatttttaagcaaacgagggaacatccctcaagggattagaatagtttccctctactactatcctctttttccattttccccccttcctttttccctcatttttcatgaatcatgttgcaatcagatggttgtagtactctcctactggtagtagccaggtccccctgacctaaacactgaacagtgaactcatgtggagcagagcctcagactgcttgctcctgtacttaactgtctcttcctttttacaaagcagagtagctcaacagttttgagcagccatgctcgtgaactgtcctgcctatatggaactcggatcagtatgccagttgtgtgtgtcatatgaagttggtccatcagtccatctggtttggcttttcaggtggctcagacatcagagcctgcctgactccaaacagtatgtgaaaattttcaagtgaatagcctgtttttttttcttttcattaatggttttcatgtgaatgatttagtggtaattatccaagggtgcacacaaatgtattgtaactatggggtgcaggaat

SEQ ID NO: 82201 - DNA, 613 bp, Oryza sativa
agaccgtgcaaacaatgtggtatggtatgtggcgccccctttcgaccgatgctcatgccgaaatttacattgttcctgcaaataaagtttattgtctatgtgacaggtattgttttcccgctcttcgcctcctgcggacgcgcgggcaggtgaagcttgcccctaggaagcgaagggttcttgcttcctccgattccgatgacgtgaacgacgtcgaagagtgtgatggcgaggaggaaggggagtaagaagaggaggcgaagcccatggctgaaaagcccgcggacgaggcggtcgaaaaccgcgtcgacacccctagctacactcctactccaagtccgggacataacgagactggggtggaatcgaacagctccccccttcaccgaaaggatttggagggggcgaaggcgctagttgccttctcggcaggcaaggcggtgttaatgaccaaatttggtaatatcatcatcggaagtgaagatgagatcgaagcgcaatcagagataaggattgctgtgggaacagagtaagaatcggctggagtccagatcggctacgaccagaatcggctaaatccgaatcagactgggttaggtgatgcagccgattc

SEQ ID NO: 82202 - DNA, 7936 bp, Oryza sativa
gggtacgcaggtgcgttgttgaggtcgaggccacgcccttccaggcgaagcgttgcccgtctcgctggaacgccatcgaccgggaggtgaagtcccacacgatgggacccaacgtgccgagccaccgagtgccaagcaccacgtcgaaacctgcgaggggcatcacaaagagatcggtgtggaatgtggagccgttgatggtgaacgccgcgtcccggatgacaccagggcaggccacgcgttcgccgttggcgacgatggccgtcatgcgcgggctggactggatcgggaggccggcgcgccttgccgcctcctcaccgatgaagctgtgcgtcgagcctccatccagcaaggcgaggagggaggcatcgccgacggtcacctggagctggatcgtgtccgcgatgggcacgccggcgacggcatgcagggagaacacgggcgcctccgtatccccggcggcggccgccgcgtcaccctcgattgcgacgtcgtcgatctccaccccgtcgacgaagaagaggcgacggcagaacctgttgtggccacgggtgaatttctcgttgcaattgaagcacagaccttggcggcagcgttcggccatctcttccggcgtcaggcgccgtgggttggccgcgtcgcgaccctgtggggcggccgctggtggggcaggcagcgccaactgctgcgcgggcgcgggtaacgcgagccgtggcgcaggcgcaggtagcagcccacgcggcggagcacgtagtggaggtggcgccggccgatcacgctccatcaactccacctggcgtgccaggctcatggcggcggcgagcgtctccggatggtggatgcggacggcgtggctgagaggcggcagaagaccgccggtgaagagctggacgcgctgggactcgtcgagccgacccgcgcgcggcaggagggcctggaagcggttggagtattcctccactgttcccgtgcgtcggcactcggaaagttcgaagagcggggccgaacgcaggggtggcccgaaacgcaggttcacgagttccttgaagcgcccccacgtcggggttccctcatcctcgagcagctgggtgtaccaagtctgcgtgacgtcgtccaggtggtaggacgccatgccgacgcgctcttcggccatggtacggtggtgacggaagtacgcctcgaatttgttgaggaagagcagcggatccgtggtgccgtcgtagcggggaaaatcccacttcttgggccggggaggcaggtcgaggtcgcgcaacccatcagggtggcgagtctcggtgcttgcggccgtcgaggccttgtccttcatggtcgccatatcggccttcagggaggtgagttcggcggacatgttcttgatctccttcaagaggtcggcgatggtgggctcggccatgtcggcggctgggttggctgcggaggcgggtgatgggactggggatggcggcgctggtggtgggctagtggcggcgtctggcgtggaagatgaaggtgcggcggctgctggggctgaggatcgagtggatcgtgataccaggttgtcaagagccttatgatctagggtaggcggccctcgactacggagttcgtaatctccggccgtggtcttccgatgcggaggttattcccctcactgccgatcgggcttgagagcgagaggtaggagagcaggtaattgatcttgcctccctaatcttttcggtttacagggaatatatggccatcggccctaaccaacggaggaaacaaactcctcgattcaaggaactaatcaaagatagcaaataatatcttaacaactaaaaatagctttccaacttcagccacttgcgctgatcgcttcatcctcggttgcatgcgccgtgcccgcgatcaccgcgcgttctgcgtccatgcgtgcgcccgcacgttctgctgcccggcgcacatctctggctcggtgtctcctggtgtaggtcttcccccacatgacactatcttaatttattattagaccatgttctgttagcactattaccacccaaattccatgtttctacatagttagctggaggatttgccttcaaaaattcaactgtttcttgctgcgacactgtattgttagcacaatatgtgaaactcagtcatcaatcctgttcgtgtcaaatgtgttgttttcaaattctgtgaattctagagctctgtatttagaccccagccaatgtgaattctagatctctgttcgaaaagtaggcgaaatctgaaatccaatttctcctgtagtttagtacatgctgtgcacattagcaaactgttatctacagtttcccaaagaattcacctacagtaagcacacatatgcgtttcaatttattttccttcagctgaaaataactgaaatgttatatgtgtttatgttctccttccaatgctctgcctgcacctgcaccatgcttccctttcaatcttttgtacaacagtgtgcttactgtttgtttgttaaaatgctcaccatgtatttgttgagatgctctataaatatttgctccaaacagccaccgcttcaccacctgcaatggacatcactattaggggctccccacaaatatcatcaacaagctcaggtaaattgtcttgctgctgatgtcaacaaagagaggttgtatttctgcctgttgcagcttttatcttacgataacatgacacattcctatacttttttgcatgtttgaacaaccattgcaatattactaatttgagcgcagatctattaaatagtgcagcatgcagttccttttcctttttttttttgtttcaattcaagtgatctgttctctgaaatctgaagtttcagagaaacttccaaggtgttggttttccatctctggggacatcaatatatttatcaattatacacgaatttcgagtcaggatggagaaaaacaattagtagcattcaccaaaagaggcacaagtattcattcaatgagtaaccactttttatagtgaattgtacctaccggatacatcaccaactggttagcctaatatatttgattatttgagatggttttctcacataatttgtagcacaaatgaacaccatcaaggcatcaactggacattatgttgatgtgtggctggcatcaagtaaattggttgtcagttatattgtgtttggcattttgaaaaaggttgataattggtgttatcagttatattcttcacatttacattatttcttcaatgttttatttctgtaagttcctttttagtgtccttggtttttctctagaattaaatcgacactgttcttttgtccattatgtattctggaggcttttaggtgggaaatagctagatactaagcaaaagcacaataaaggtattttcactaaggaattagaacatgcatttttattttaccctgttaagtatatttgttgtatatgcgcttaggcctttttatggtgactcccatcacgtatcttgctgataatagatactaagaatacatttattataatattgtaggcaatatggcagctttttcctctattctattttaacctgaaactcagggccggccctgacgggggtcgagcagtgcggctgcactgggcccccccaaacccaggggcccctcccaagatgccgaagagtaggcctactctgcttccgcgtatgatgatcgatccgtccagccctaacgattagcgacgtgctgatgccgacgttcctaatgccctagcgatccgcgagattagcagatcaattttcttctcgtccatggcaggcgacggcaaagcaggcgtccacacgtggacagccggcagcctcctctacagttccgctagcttcaaccgttgcagcaattctgcagttctacacgcctactacctgtctgccgatggcgtctgcaggtgaggtgaattccctgctggattaatccagatgtgggaactgaaaatatcatgcaaaaaaatctattaagcctacaaccagtagtctgtaggtggactggacaggcctgcatgaagtgctgtctcatcctgctagctgctgcaagcacacgctggctggccgaagaattgtaattagtaagtgttgtttgaattaatctaatatttttgtagtttgtatatttttgatatgctattttttctaattaatagatcgttcttgatatcatgttgtcgaaaaagtgtatgatttatgcactgagttgaaattgctagatgatattgaaattgatatcaacaccaatactttccctttacatatatccagagaaattttcatatatagatatctattgattataagatattatattaatggcccctactttttgtttcgccctaggccatcgaaacctcaggaccggccctgctgaaactcaaaactcatccgtatgaatccaagctctcctctgatgcttttctaacttacattacttttcagcctaacttgcaattattactataattcttaactaagagatcaaggcatcgagttctttgcttcatgtagatcaaagatgtttgatgatttgtatttttttccaagggatgatggcttgtattagtattggactgatgcagactagctaaatgtgttttgatccgcaaccttaaagtttaatgtgttgtgataatgaaacaagtaaaggtacatgtagcttggcagttggtgaccactgaccagccgtcgtgaggaactcccaagtatttaagctgttaatgatcaggaaaggcaatgttgacagtctacttagttctgttggttatttgtgagtaacaattaatagtgcaatgcatatgagtaaatcatgtgtacatgtattcctttgcaacctatatttgcttccatatcataggcatattatgataagcgcttgaggcataaattatcatttgtaaacaatagttgtgtgcgtgctttagcataggcaagttacggtggttgtgttttgcttgcatacttgaaatttatgaactaaaataactcaaacaaatttttattgattatctattttcttcaatttaattcttcaatatatgtcaacgtgccttggacgtgcacgctcactagttgttgtccaatgttgctgattaagagactgcatgaattgtaggaagtcgagtcattactacggaatccggacaccttctatgtgttggtttccaaaaaaactgacagatataaccccttcccgactttcacatgagggtaagattgaaaaccggcattgatatatctttatagatatcggtttattaaaatagccaacacatataatacatgtgccgattttcttttaaaaaaaactagctcctataactataaggatatatgggtgccgattttctataatctggcatctttgtaggaagctaagccgatggttttcctcctcgcattccacgcatctctcacccccccccccccgcccgcatccatttctctctcgttctcccctcctattccactgcccctctccctcatttccttcgctgcctgtgccaacctccccatcacttctgctgcccattgccctctcctccgacacccctcctccgccccacctcctctccccctcacctccaccgcagcaagcacgggggccagccggatctgctgccgcacactctaggatggccggatcagctgtcacacgcacggagaccaccggatcaacaacgaccgggtgaccgcaactctctcaaccaccaggcgctcgggagcagacggatccaccaccgcaaccattggggcagcctgctagatgataacagagattccctcaactacctcaaactgtcacgagcacgcggtgcacgtttgacgatgacggttgcttcctgaagtccctttctgtgttctctctgtgtgttcttaagtgttgttggatgttgacaggtggatattaattttgcaattcaatggtcatctacgactgtgtgcttgaaatgttagatcgatcttaggggtgatggggagctactcgattcatggctcgaccggcttcttttatattcgtgaaacctcaaaggttttgattcctaaagtggcacctttgattcctcctcattagctccctacggggtgccggttgggaaatccgacaccctatataagaggttttctgaaccaacaccaatcatatttttctatagaagtgagttcatcatttccaccagatgtaatatatttgattccatggcatggcagaaggccctcctgggctcctgttgatggtcgttaagtaccgattttgaccgtcaactaccaaaataaataatatttcttacacgtatattagtaataaataatgttgttccacttgtattagagaaatattatgcatgtagagattatacactaaagtgaagggaaaatgagccggcatgcaacaaaagcacaccaccgacgaatcacatgcgagcacacgaattgatcggcccacaagtcagctcgaaccgactaaaaatgaggccaatgaatcctcaaatgccttaggggcccacatggtagtccctggtgatggtcggtggcgagaaatggggcctaggggtcagccgaacccttggttcggccaaaccaagcatggcccctctcatcgccaccttacacatggacgctcctaatggactccaaatgacgactaccagcgcattgactttagtaaccaccatataactgtcactacaagtctataaatagatgatgccttctcacttcacaacacaaacctcaaggagcaattctcttattccatatattgtattctctctagtagtagtggagttttgcttactcttcagtcctatagtcttctcggaaattctgatatatgtttagtactttactcttcttgtaagactgtaaatgcaataagggaagtatcttctttattatattgtattcatagttcatatactactttattagttatgtgtgctatgaatagtttatacatcatttatatgcttcacatgattaggctagtcgatatatgctatagtaacggtccaataatcttaatgggttgcactagttctaaatcgtccatccgaaggtgaaagtctgaggggaattagtgacattatgtattaacataaacatggtgtttaggttagttaaatgtcgttccatgcaggtatgcttcccgaaaagtgaggtaggcgaaaggtaccctgtccatcttttgtattcctcgatgttcggatatgacgtaggagttcgtaaaatgccataaaaacgttggtagactagcagggagtggtctcttggtagtatacctaggtgcctaaaacaatatcctagtcttgtaagcatgtatgtgttaagtatatactaaacatttgtagtatataagtgcaaatgaaccttagctctttatagtttttctccacttccgagtgtatctttattagagatgaatctcctgtgtgtcacactacccatatatcatattatcaattaacccctctttagactatggtaaagtaattaaagctcgattaaggatataaaaactctatctttacatcatcactttccctgcagaaatataaatatgatattcttggaatactcctaggcgaaatacgacagcgatatccgtgcgcttgcagatttatctgtgatcataagaaataccaatatctcctaaccgtgactccttgatgttaaatattttctctccaacttttctttgatcgtcccttcagtaaggaatgttggagcacaatgcaaattcagagggacacacagctctggaactgaggtccatgcttcatgctgctaaccctacttttcactactagaaaacacattttcggtgtcgtaggggttccattttcgcaggcgggtatgttattcggagacaaaaccccgccggcgaagacgatacccggggtggagggggctgtcc

SEQ ID NO: 82203 - DNA, 2321 bp, Oryza sativa
aggtcctcatccactagacctcttaaaactactaatcttttttcctcgttttagccattcaagcattaatattccttcgtttctctctgcattaataaagggtatggtagtttttttagcctatatctttataactttctaaaacaacatattttttttggatagagggagtgcggaaatagtactccaccatttagtatcacgggaagtgtgccgatcaatggatttttctattgcttaagcaagtactataagtgtttagagcatgatcaacaatcgctcaatactattccaatcccaaagggtttttaagaaaaaaaaaagatccatcaaaactcctaatcagattaaaaaagtttgggatttcaatcctgtgatttacgttctccataagtggagaagacctctcgctcccaatccaccgatcgtgggcaattttcgcacgctatggagatgtccacactgcaccagtcctcacaagctcgtccgtcgccaatcccgactcgtgccgccgttgggcgtcatgtgttggtcatttgccagccatcgatttcataccattgccaacccgtcatgcaagagaatgagagaaggtgtagaggaggaagaaaagagggattaacatgtgggccccacctgtcgggttattatatatgagaaggggagcggttgcccttttttttttgaccgaagagtggttgcccgttggtagttttgtaggtgatcccatcttatattacatagaatcatgtgttacctaatctgttggagtggaggatattttagaatctcaaatcctagttaaaaatctccaaaaggttatttagggaggtgatttattgggtatctcttagtgatgctcttaaatgctaccaaaaatataacataggattaggtaatgagatggagaagtgagtggagagagaatgagttactcctcacgcaaagggtaacatctcaaaaaaaaaagcaaagagggtaagggcacatttgaatcaaatgatttatataggaatttcataggattcaaatcctataggaaatttcataggattgaagctttccaaatcctatgaaattcctatggaaatccacgttgcatgtggattttggaggaaatttagcaagagctccaacctcttggaaaatttcctctaagtctatctctctcatctaattcctacgtttttcctgcgctccaatcaatcgaccattcctatgtttttcctgtgttttgtaatcctctgttttacacttcaatttctgtcagaatcatgtgtttttcctatccctccattttttcaaccctacgattcaaaggggccctaagatagcgtgagagtgaattatcaaaagaaaactattgtggttgtgtgttagccgcaatatattatatattgtagatgaataggcaacacatttcctattaaacttgctcctatataccccttcgttccaaaatataaacatttataggtagtgagtttttttttaaaaaaaaacaaaatagaacgcagccgagatagccgtttgatccatatcggacggtcggaaataatcggttgaccttgtggccacggaacatgcagctggtctcgatcccggagcagagagagagaccaatcaaagttatcaaaccaaccgccagcgctgatccggctcggctgttgcagctcgcgcgcccccacccctcattcactctccaccgcaccgcaccgcaccgcgccctcgccaccacggcgcgtcgcgcccccgacgcgccaggtcgccgctcccgtgtcgcgccgcgccgcgcccccacggccccggtacgcgcgctcgctcgtgcgacacgccgaggccgaggagaggagacagagcaagcgacaaaacgcgcaggcgatcccagagcgcgccgcgccgcggccgtgtcgatcccatcgaacacctcctcctacaggagtctcgagggctacttgtacacacacccatactagagaaagaaacaacgagaggagatacagagattgggagaggttagcgagagaggttgggcagtagccatcatcatcatcaattcatcttctccaaaaaaaatcagagtagaatctcatcactcacgtacgtgcagcttctctctctttctccttcgcgcgcgtcgatcgctttctcgtccccatcataaagcaaatgattcgttcgcctcgccaccctgctttaattctcttcttctcctcctcctccgccgccgccgccgccgaatcttccggtagctagatcccctcgccggcgacgtgcttgcgtttcttggtgtcgtgacgatcggggcgatccattttgtt

SEQ ID NO: 82204 - DNA, 3886 bp, Oryza sativa
tttgtcagcaagtacaattgctactataccttcaccggtggaaaggcggttggataccggaatctatttgcaattccatggtcatcgttcatggctgatgacagcctcttcttcatcgagggggtactacacttgagagctgaattaaccataaaacaaccctagatagtggacggcgtttaactaacagcgtctctgttcttgctgtgtccaaattagtgtgaaaaatgttgtgtgattcggacttactgttgttttctacttgagcaacctaaatagacagtttggaaacggcaagtaaaatcccttttgtttttacatcaaaagaggatcatgacatgtaacgcattgttatcgaactgtgaaaagtgattcttctaatcaaagttatgctgaatggtccacatcgtcaatgacattaagtgatggaagccataatagtattttcaacacaaaataaatgtaataatacatttaatgttagatttagtgaaactaatttggtcttttagatgttattttttttcctatagatttagttaaattttaaaaagtttggttcttaaccaggaggctcaatgtcaatgaaatgcgtctggctgagcaagtctgactttgttgagctgcctgcgctactttgctaatctcgcgctcatttcgtaatctggagattagctttattattatatttgtagagtaatagataataatagtaatctgggtagttgaagtttctattgattttcatagcaatttcctgtctctattggacggggctgatttaaggttacgtgggtgtgcttgagaagaaggggattggggagattgtgaagatacgcaaaacgaggtgagctattagcacatgattaattgagtattaattattttaaacttcagaaatagattaatatgattttttaaaacaactttcttatagaaattttttacaaaaaacacaccgtttagtagttcggaaaacgtgcacgcggaaaatgaaacgatatttctctctttctcctgcgctcgaacgcacccttaaacgggctttaaggtagaaagtacacgtggactgcaagcttctatttagaaactgcaatgctgtgccttctccaaagatcgataaacaagagatatttaaccatttgccatatttagatgtggcaattaattttttatcactagacccatatgtcatagacacatgtggacccacatgtcattgagatatgggtggcaaatagttatttgccaaatctaaaagtggcaaataattaaaagccccgataaacaatgcttcctccgtttcacaatgtaagttattttagtatttttatattcatattgatattgatgttaatgaattcagttaatataaatgtggaaaatgttcgaatgacttacatcgtgaaatggagggagtatatcagtttatatagtcctgatcaatgttggcggttaaggataatacttaaggagggactaatttacttaagtcggtgcaaaaatggtcaacaattttgactggcttgcacaagtataacgtgagctgtgacgtgttggtcctagtcccaagtcggttaacttttgactataaaatgcacatctaacattcatctttcagcactactgtctcgcgagaaaacttctttcattgttttgtaactaagcggtgtcactcctcaaagctacacaagctagctcatcctgaaattctcagacaacctgagctcagctagcgctgagctgagctccatggcgtccaaggaccaaaccgcatcctcgtcggagacgacgacggcggtggcggatgatacctccagccaacaagacgcaccgccccacccgctgcaggtgacttcgccggattcttcgttgccgtcgccgtcgccgcggcaacgccggtgcgtggcggcgtacatggacctgacgcgggaggagtgcggccgcctcttcccgtcggggcggctccgctcgcagccgctccgcctcgccgggcggccgttctacctcacggcgcgctgcaacatggaccagcgggacaccttccgctgcttcggcctcttcctcgccatggaggtcgacgacgaggaggaggaagaggagggctcgccgtcgccggcggcgagcgtcaccgtggaatacgacttcgccgcgaggacgaggcagcagtcaggggatgagttcgtcagcatgtacaaggggcactacaccttcgccgccgggaagtcgtgtggataccggaatctgcttgggatgccatgggcgtcgttcatgggtgatggtggtggtgacagcgtgttcttcatcgatggggtgctgcacttgagggctgaattatgtgtcaaagaagatgcttaattagatcgatcgaattaatatggatatattgtacggcgttcgtgaattgagaatgcttcatagccttttgaaaatttgagcatgagagatcatagggcatatgataatggtgtttgacggagcgtggggctcctcaccgggagaccgcgcaggcccctctttgccggttcggccgggggcgctaagtgaggttcttcgccctcgatcgatctggggaatgttcgcgagagagcaaaacgcacgagacacgggcgatgtagacaggttcgggccgctgagaagcgtaataccctactcctgtgttctgggggaccggagctcggggaggagagaaaaagaggaaaagagtctctagagtttgaactctcttgctctccagctctttgtaactccttcacacacgccagatgacggagcgtggggctcctcaccgggagaccgcgcaggcccccctttgccagttcggccgggggcgctaagtgaggttcttcgtcctcgatcgatctggggaatgttcgcgagagagcaaaacgcacgagacacgggcgatgtagacaggttcgggccgctgagaagcgtaataccctactcctgtgttcaggtggatctgtgtgtgaaggagttacaaagagctggagagcaagagagttcaaactctagagactcttttcctctttttctctcctctccgagctccggtcccctcccttcggtgggcaaggtcctccttttatatctcaaggggataccacatgcaccacttctacctactcttcttttgggtggggacctaccctatcttgaccaaaacttggcttgccccttcgcctggaagctaaatcacaacttgtccttgagtgaggctcagcgccgtcactcgcgactaccctgtcatcccttcattaatgggcggagatttgcaatggccgctatccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaataacttccttgcaatggttgcgatgaagcctggaatgtatctggccggggctgacgtgccaactccaggagttcccacgccggctccggctagggacgagtgcctgaaggctctcatcattccgacgggacggggcgaggcgtgcgaaaggccgcctgttgccacctaacccgcgatctgaccggtctgtgaccggtcacacactgtgacctgtcacggaccgagtgtgctgcgctgcattaaatgcggcgtggggcgctcgtccaacccgcaataaacgcggttaggtgagcgccgctgtgctcacctaacccacacacgtggcgccaaacccacagggggtcggggcgccccaaccctcggggccgaaacgggagcggcccgacccctcagggagacagagggaggggcggccac

SEQ ID NO: 82205 - DNA, 709 bp, Oryza sativa
cattggaagtatttttaacaattcaaagatcatttcagtgattaatttaattgggaaagtaattaaaattcaccttttccttttcgggccgaattaggaaaagtcctctcattctcggcccagtctcctctcagcctgcagcccttttcctctctttcccgaagtctgctttgtgtccctctttcaatcgggccaagaagtagaagcccagccaaaagtctagtttgcatccctgctacagtggcatcttcaatctccagccggctggagacagagcccgagccagccgcacagtacctgtatagccgcggttttcccctccaaatccggccttttatctcgtgtatttccaaaattagttgaggggaaatactcctcttatcctcctctatctttacccccaaaaatcggagctaatcgttgagtatcttgcccgaatcgaactcgttttcgagtttatctccaaaacggagtttttgatttcccggatcgatttcttgcgggaggagtccgatctcttcaatccaaggaccccctagtcctcctctttcgtttgccccctctcccgagctctctcgtcaaccgtagagccgccgccacgacgtcttagccgccgccgtcgccggccgacgaacagccgcctcgcgccgtcgttttggccgtcgccgccgcctcctctcgccgccgtcgggtgcgcgtggaagagggg

SEQ ID NO: 82206 - DNA, 5778 bp, Oryza sativa
tcgttctggttccctcgctggttctagagacacaatccaaatatgatattgcttgcctttttcaatagccactcccttcctaggggaacaggcgaagggagagtgaaaagaaaaaaaagcacacgaacctacttggagtcgttcacgtgatggctgaagtctgaactctgaagaggatcgatgagccagcgcaccgagcaacatactgtacatatgccatatggtcctcttgtctgacgaatactctgaagagtttaggtaggcagtaggctgccgtgccgcttggaaaagcatgacgtgattatgcatatgatagtatgatactgtatgtcgtttacgcagtgcgacggagcgacctggatttttttcaaattttctttcccttgatgatatatatatatatatatatatatatatatatatataggaaaatgcttctgtactcccgggagtacgtactccctctcccatccaccgttcatcgccccaccaggatgatcatcctcccactcccgctaccgggtctaactatgggagtatcgatcggacccgttttaattcgaaaaaaacaatcccgtgaaatccgaagggagccctattatctctgagtaatcaaattatatatatatatatatatgttcaaacaaactccacagtgaatttcatcttaactagacatatatataacaataataaaattaaaatatacttcacccgttacaacgcacgggcattttttctagtaaatcatcatatttataaatagcaccaatatcaaggcaataaagtatcatttattatgaaatttaacctcattgataaggtgttgtgttagggatgcatgtagacaacgatgccatttaatcttgcacatataaatgaatagacatgtaataatggtatttactcatgcacaaataaatggatagacatgccatgatatcatttacttctgcacaaataaacgaatggccaccagttagataatgatcaatctaggaaaacctcaaaaatcttaggcgatttacttgtgcacaaataaacgaatggccaccagttagataatgatcaatctacgaaaacctcaaaaatcttaggcggtgatcaaattgggatagaggtagtatttatatcgaggaccctaggacagtaagatttatctgaatactaaagttacacgttcacattcttcacatatattgtgaatgagaaattgtattacaatgcattaaatacatatgcaaaatctaaatcaaattataactagctatatatacctactttcagctgattctacccattttaaaggcatatatgtacaagttgataatttatcataagttgttgtttttctttattttatggccccaccaatcacaagtgttgcccatgtttgtcacatttatctaaaaaaaaacatcatagccgtaggtacggtcttgttatcattatcttctgagtgagagcggtttgcatctcatatgtacatgaaatagacaacatattagcatcatagtcatttggattttggactcatattataaatatgtaagcacgttgcttttctccacttctatcattctatggaaagcacattgccagttaagtacgcaagcactatgcaatttagtgtggctgattccctcttccacctgatcaagtaatattcttggaagtttagattcctttgtttttgttatgtactcttcgacaatttagggtatgttcactttgatgctattttcaaccttaccaagttttgataaagttgccaaaaaagtggctacatttagtttgctgccaaattttggtaactatataagaaatcctaccaaaattttagcaagttaccaaaattttggcaactatgccaaaattttggtattgccaaaattttgtaagatttttttggcatcaaagtgaacagacccttagaatccgtcgtggttaacttcatccataagtatctactagaaaaacgatttttcccaacattacgattttatttttctaggcagactataaaatcaccatttacaaaaatagctcaagataccataaacctagtacctgcgaaaccattatttttcaagcggacctcattaaggttacgccagcgaaaaacgattttcacaggcggaaccttaggtcctctgcctgcaaaaatccaccgcccacaccaaccggcctcgtaatatccgtcacccaccccttatctctatccctcaccttttcactccctcactccttcctctcagattcactctcttcccctcacctcccccttcactccctcactcctccggcacggagggcggaggcagcggccacggctggcggcgtgcggcgacaaggaggggagccgtcagcacagaggcagcggtgcggagggtggaggtggcagccacagccggcgcggagggtggtggtgtgcggcgactagaagatccggcggtgtggagggagccggccagcggaggtggcagataaaggaggagagtcggcggcagtggtgacccggtcaccctcggcggtgacggtgaacggaggaggaagggccggatggggagggggaaggggaggagagccggcggccggagggaggggctggcaggggagggcggtagcgggtcggttttttttttaattcaatgaggtggttttcgcaggctggtggatgtagtgtgtgcgaagatcgatgtagaggctcgcctctgaaaatgattttcgtaggcggggctaatgtccgcatataaaaatcatctatttttgcaggccttcaagtacaggcggggtgaagctccgcttagaactttttggtctgtttgcaaaaatcgtttttctagtagtgagtaatattctagcctctttttttgagtgatttttaagttgtgaaatatagtagttgtgaaacatgccaggattgaaaattggcttttatgttgtgaaacatactagttgaaaactgagttaaaatgttgtgaatagttcaaaattgatattaaatgatgtcgaacataacattaactaggagctccataaagtaggagcaattaaaacatggcaggactgaaaaatggcttttatgttgtggaacataatagttgaaaactgagtttaaatgttgtgaatagttgaaaattgattttaaattatgtcgaacataacattaatcaggagttccatataataggagcaattgcactggttttacgtttgtaatataaaaagataactttattataaaatcgacgcctgagagattcgaactctcgcggggaaaccccatgtacttagcaggcacacgccttaaccactcggccaaagcgtcgcttggatgatagatgtgattactgatccaatttattgaactgtatataatctcttctgtaaatttggtcgttgactgctgtactttttttttttttgtatttcttgaaatttatgttcttttttttaagactcgcgacttatctctataagtgaatagtgaatcccaaaaatcaactaggatgagccacataatcaacaaaataatagccattggattcacatgaggacaaaatagcaagaagaaatatgagccattggattcattggattcactttatctagaagcttccttaacctattgagaaaaaatagtaaggttatggatataattttacaatgcacacttttaattaaaaaactattttgcaaacaggccctcttactctatctatgtaacttccctttgggaaaaaaacaaatagatcattgaattatattttaaaagatccaacagtgaattaaagagtaaagtgaggaaaagatagtaatgttgtgtatataattttacaattcgcacagtttaccaataaagctaatcttttaagaaagattaatatgatctaactaagctttatatcatttgaagttatatatattagtgatgagcatatatatatgtgtgatatactaatgtaataatcggctatgcacccgtctgttatgattaatcatcattgcaaatttaagcttattattaataccacaatctatagacacatttagaagagatagagtttatagttgcgcaaatgcgcaacttaatatactagtttcagtgatatggaatattagattaaaattatttacatcagtgataacaattcctctttgagattgagtctaaaaaaggacccatatttgggcagctatgcatgtaattagatatggaatttatgttcttttttaagactcgtgacttcttttaatgatatggaatattagattcaaagtatttaagtacatgagcttaaaaggccccatgtttgggcagctatgcatgtaactagcatgggaagatgagttataacaaatattgaagatggacggttactatctgaggatttcgcatggcttccctgcaaaattgtctcctatttcatttcttttccttgaaagaatgggaagatgagttataacaaatattgaagatggacggttactatctgacgatttctcatggcttccctgcaaaattgtctcctatttcatttcttttccttggaagaatccatttgatgttcagtcttcggctctgcaagagttgttatagcattgaaagcagaggtcttaaaactccaatgacctgcattttgtcccagttcattccgatgcaaagtacacacaattgttatattatcttaaaccccagttttcttctaataaataccagtgttatctaccaaggaaacaaactctatgaatattatcgcaaaatctaaatagagagcactctcgatttagtcataacaagtgaccccatcggcattatctagatatgtgttaacttgaagaatcttactttactttactatgtagtactagtccattaagtaagtatggaaaatattcatatcatctacgcttcaaataaaattctcttaaattactcatccgatttataatccgattacaccgttgtgttcataacaattaaatctttacaacaagatctcacatgattatattttgatgaaaaatcacaaattacttttatgatatgtccaaattacttttagatttcactaagttacttcttaaacatataaaagtaaattcagtaaaacctaaaagtaatttacatatattatagaagtaacttagaacaaaacgaaggtatattataaaagtaatttattatttttcatcaaaatataggtctaatcggattgtagatcggatgagtagtttatgagaaaattgtatttgaagtatagatggatagtgcctctcatagatgcagtggtagctggctaccactaactgtgtagtcacgtccaatatttatacagtagggacagatatttttttctcctcttgaaatttcacacgaaaggtcgctaaattcccttcctccggctagaagaaacctttactcaaaagttcctatgacgttatggaattacatgtttgtcctcaggtctttcctttgttttttttctccattttcttttatctctctctgtcacatattcatttttacaaattcagacccttgaatttacacgcagcccaaccacattccccatcacttccacccacccttcacacgcatgcaacgaccaggattcgtccacgtcatccctcctcagcatcaacggccgggattcgtccacgtttgagctccacatgcatcggcggcgaccgtgcgtcacggatcatcgctcctctccaccattgcaccgtgttcgtccgttcgtccgcgcggtcacgacgcgccgccgccgc

SEQ ID NO: 82207 - DNA, 2234 bp, Oryza sativa
  unsure (1)..(2234): unsure at all n locations
ggttaggattaaatggaagagggagaatgaatggttaggatttaaagatgggtgaaatcatttcccttttccatttgccaaacattgcccacgtctaagggcctgtgtagttctcaccctaaaattttacaccttatcacatcgaacatttgaacacatgcatgaagtatattaaatataggctaaaaaataattaattgtacagattacgactaatttacgagacgaatctattaagcctcattgctctatgatttgacaatatgatgctatagtaaacatttgctaatcacagattaattaggcttaataaattcgtctcgctgtttactgacggattctataattggtttttttattagcgccaaacactccgtgcgacaccttataaaatattcgatatgacacgttaaaactttacacccttatatttaaacaccccctaaccttttttttcttttgatttcgacagcgagataatgttacgattgtttgatgactgttcccttggtagactcagcatatttccacgcaccaaattccaaaataattatgcaaggatgcagaatgccgaagaagaaattaaggtgtaaattacagtgagtgctttgtatacagctagtggaacgtatggaaacacaggaaccgaagccaacagcaataattaaaaaaacatgtttcttccgctcgttttcagggcctttcaccctatcacatcgaccgtttgaacacctctataaaatattaaatatagacttaaaaaataattgcacagattgtgactaatttacgaggcgaatcttttaagcctaattacttcatgatttgacaatgtggtgctacattaaacatttgctaatgacggattaaataggcttaataaatttatctcacggtttattgacggattctgtaattagttttttattagtgcccgaacaccccatacaacaccctatatagtacccgacatgacacgccaaaactttacacccctaaatccaaacaccccctgaactctacctcaagcatttcgaacttcagtgccattgacctaggttcaaatatgaggaacatccattcccatatgaacggaagacctccaaacagtggaaccttcaatgccattcgacttctcattttttgaaagataatgtaaacttgattgaacttagccaataacattaaggtggtacaacagtactaagaacataatggatcaataaagcacaataaaaatgcacacaaccaaaacaccacttacataatagtttgaaaagaaggaaaaaaaacaaggacaattaagggccaacaatccgtagaatagatcaccacccatgttcctatataaaaaactcattgaccacttgctccaaatatcgacttgccactgcaataaagtctcatcaataacccatgaatggtgccagtggataagtaaggagataaccaacaaagaagaaatatttttcttgtcaaaaccgcatcattcatgcataaccatagggaccacacatggtggtcgctcatagcaggacttgaggtctcgtatgtttggaaactagcaacaaccaactcccaaataaacgtgaaacactatacggtggacactatattaataatagaccacactgaatgaacaaaacaacattggaagaataaatgtttaattgcctcctctttgtgacaaaaacaacatttcttacaatcttgctaatttttcttggctagattatcttttgttcagactacatcacgatgcaattaccaaaggaaaatcaaggaaaatccaacgaaaatcatcttgctcctatgttaacacaatattagcggcacggggtaacaagttgttccacgccactaatttttagccaatcaaacccttctctatgaaaagttgaatgggtatgtttggaagacatttgaaatggtagattgtttatgcctaactatattatatataggcagggatattgatccaacaaggccgcattacccaaccatttgtcttcccaaaatctgatttgagatccatccttaattatgaaggacccatatcgaagaaaatcatgtttggccttcataaagctacctagaaatgtgaattcncccagctttcaatagggggcttgtgataaatgctgaaatccaaatattgcgtatcatttcttgccacgtaccatttgttgtaagcaacttatgaagccatttactaactaaaacattattcttta

SEQ ID NO: 82208 - DNA, 6973 bp, Oryza sativa
aaagcattacaatttataatcagtcgtatacgaaaacgaagagagagtaggaggctctactccagacctccagtggtgtcctcttgcgtgctaatgtcaaaccgtgagatggcgatgcggtttgacgttgaaggcatcttgatctcttccctgattctggctctgttataggagtatgtttgagtgatcagctggtgtgcattgaatttgagccagaaattgctctggtcgaatttagtttcaaattttttcttcaaactttcaactttttcattatatcaaaacttttctacacacataaactttcaactttttcaattttaaccaaacttctaattttaacgccactgttcgaaaagttggtgcttctactaattaaaatggaatataatttcttcttctaaagttaaatcagttgtgccacgtgaaccatttggtttggggataagcagagaactttcagatggtcacgtcgacgggacaggtttacttgcccgtctaatcaccatgcgatcacacgccattacgagactagggaatatccatttgtagagcatttgtagagcagcagcattaatgcagctggagaaatgcaggatttaggaatagatttttcttttaaacatcattaaaccagcatgtagggatcatatgctcacgtaaggaacagatgataaatggcatactacttcttaatttttatgtacatagcttatgttcataagcttgtatagaactttatttattttaagatggagagggtaacattactgtcaaattattataaaaaagatagcactagcaatatggtggcatattttacccatataagaatcgttccggtgactatgtatattacccatatggccacatgtaaatgtactttcagtgaggccagtaatttctcactagtctccatctttctgtgtgttaacgaacgtatttgtatgtgggtacgtgtctcctctgtataattgagaaaaaaaaacctatgaaatttgacgttctttctagctgcgtcatcttcacctaaacgaaagaaagaaatgcctccatgatatatcgacaaggaaaataaccacatcttcttttgaaaaaagaaaaaaccatgaataagaaaggaagacaatcactatctactctaatttaataattttcgttcagaaaaaaactttaatttaataatgtgaaatgctctctatacaacaatacggtgcaagaattttctctatatgaaatgattcgcccatatgttaccgccaccaattgacgacgacggaacaaattaatcctctgactttggaaccaaaaagccagatacagaacagttattcaagtactggtgccataatgatgtgtgcagtatgaaccgtgcaggtactgtaccaaaagggctgtaagacactgttaccggaaattaatccatccatgttaaaataagagaacttttacgatataatatactaccagtatatactgacagtatataaaagggcatattaggaatttgatagaaaataaaacaacactttagtaatttttggttcaaattgaatttaattgagagtacctggtcctggatcttatcgtgcactagggaaagagcatcctgagcgccatttgatgacaaagcacgtgatgatagcacgatttgatgatagaataacgaagaaaagacaaaattaccctttcaaactttatactgcaatctaattaaataaaaaattaaatcaatctacaccgttagatcatatatacttgcagtatatactagcagcatatcgtatcgtaaaaatcctctaataaactagttcgaaaagcttaaagtttatcccaatacaaatcaattcttaccttcatgtatatcttcggtccacaaatcgagaagttatatctattgaatacctttgtctatatgtaatttcttattaactttcttattgacgaagagtagtttaatcttttatcatcactactaaatactttgtactaaatgtatctttgtaatgcaagagactgatttatttaggaaagaagaagtatacaactgagcaattgtattatttacgcgagcaagtttaatagtagattataaactaactataaacttatatagattttagagaactagaaaaataaatagtattggctcttataaaagagctaactcttcatatactattttaagatgaatggattaaattcataggtaagagaaaaatggagagaaaaatagagataacgttataactcatccactataaaatgttaaactctaatataaacataatagttagctctactattaaacttgatatgatactatagcaagttgacctcatccatcagctacctaaatcaaatgactccaaattccaaacccatgaagttatatcgatgttccccttgactttaacccactcaaattcagaggaccatttccacgacaacggccactctagaagatcacagaaaggctgagtgccctggttgagcggctgagcccgagagcaagtcaacaagtactatagacattcaagctcttgcttaaggtggcatgatgagatgaatgagagaagagaagagagatgatgagtcactgcttatgcaatgggtaatatccacacactcctagatagatgaaagaaagagaccaatagattaagtggaaataaataaagtaatactccccctacctacttttgatagtcatatttcatcttggcacacagaccaaggataagtaattctacttatcattcatttaaacatgctactagccattcctcgtaaacaagtgattcattaatatttacatttctcaatgcccatgtagccaatcatgtgtggaagaatagaaagtcacacattaaatccgagaaagtcattaagatgataggttgttggattgaaatatgactatcaaaaataaaatttttagatttggaaatatgactatcaaaaatagatggagggagtatattgggacaagtgctttagaggccatgtattgtatagattacctcgtaattagtgagtaaatgatttcaacaaaattaaatatgaccatcacctctactatagaactgtattcgttagttcaggttgagaacttgtcccaccaaaaaaaagaacatgattagtattagtaaaaaaaaacttgaaaaatagattcatatgattttctttcaagcgacttccctataaaaaaatttctaaaaaaacacaccatttaatagtccggaaaacatgtgcgtataaaataaggaagtagaagttgggaaagagaagaaatgaaaacagcctaaaatttgctatgagcaaacaccgtgtaaactatactccctcggtaaaaaaaaaaagatacagtaacgtttagggatgaatcttcactgttctaacaaaaagataatttttagggggttttaagaaaaatatgaagtgaaaccctgaaaattaccgtttgatcgaaaaataaacgtttgagattcgtccatgtcaccataagtaaatattttacttgggaatctcaaaagtctatttctaatccaataatagtttccactacatatttttccctttttcttaagggacacatgggtttttcctcccccctccctctactctgtttagataactacggatccgtcaaccccctccacccatctccatgcggcgaaaaacgcacaaaaaccctttttgggagcttccaactcctccaaacagtcagaattcttatccagattctgcaaaaatgtagctatagaatcgtgaaaataacctagaagttttcaaagactaactaccaaccaattactcaaccaaaatccccaaacagagctgaaatcccccgtgccacggcttccccagccgatccaacagtatccacccgttacttggttccccatgcggtgagagccggtgaggtgagacactgactggatttttcacatttttgtccttttaaaaaacttattctacaaataaactcctaaaaaatttattatagaaatggtccttttcgcagcgccaaaatcattggtgccatggtccaatatgatggtgccattgacgttggcgttgtcacattcacccccggtgaaagctaagttagtaatgtgaaaggggacggtgtcagcgtcattgcaccaaggacctatttgtaaatatttttatttacacgtgggttcattttaattacaaataggttctttccaaaaaaaatacaaattggtactcggcaccaatcacgttggcaccggcctccttcgcatttataacttagcttccactgggaggctagagggacggcaccaatatcattagcgctgttatgatgtactatgtgccaataatattggcgcagtaaaaaggattatttttagaataagattttttttcgacattatttatcgaataagttttggatgaaaaactgaaaaatccgggagacaccgagatccggaggccgaagaatgttgccgcccacgcgcaaacgctctccacacctgcctgcctgcgtaaaataatacacggcgtggcggcgccccgcgcgttgcgctggtggtggtggagtaaataaaacccgggcggtgatgcgctgagccatatggccgcttccgcctccgcagccgcaacgctccccaccactctcctgctccgccgcctcctcctcctctccctgcgccgccaccctaccacccccgccccccgccgattccgctcctgctgctgctcctcttcctcctcctcccccgccgccgcgccggctcacccccacccgcccgccggaggtgcgtgctccgctcgactccattccatccagctagctttagcttagctaccaaccatccacgatcccatctcgcgtcagttgccgactgcttcagaaaccgagagagaccctgctcgaactcgttcgtgtgcttccacccgccgcgattttttttttttttgaggaggatgatctcggtcgcgcccaccgacgttctccccctggatttacaatgctttctttcttcattctgcttctgcttctgcgctgccatgtaaacgcgaactgaaatcgctcggattatccgtacaactccgccaaaaaaaaaaaaagaaaaaaagtttgaggtggggaatggataaacgtggagaggctgggttcccagatgctggggttacaggatgtagaccgggaaaaagaaacaaagatggatgcaaggatgaaaaagatggtcaccatggtaaagaaaagaaaagagaggagataatcacgatggagacaattcagcggtggccactgggccgccttcgccatatgccgttcccatttgcatcttgactatctcttatctgtccatgggaatcgaaaaaattttcaatactgtgtttcaatcatttttagtgcacgtttgcttatgctgaagttctatatataacgaacatgtgcttcaggtaatggcagtccatgtgtgtttgatttgctcaagtgtggtaggtgcagggagaagactgagaggcgagctgcgcagcagagccatgtcaagttccacgaattcgacggttttggcggaatcggtagcgactgggagctcagtggatgttgagcttctaccctttgtgaatgacaaacatggtggtgtgatcgttgagatgacggccccgatggatccccaattgttttcagcttccttgaaagcatcattgtcaaaatggagggaacaggtaatttccggaacagtggggtatacacttataggcgtatgattttctttgggtgttagcatatgttctggatgattggttagtaatgtaaatatcctttaatattcatatttatatatgcaacttaataaattacaaacagttcaagtttgaatagtgtccagtttttcaagattcataatggcacctatgcactatacgtatttaagttaatattcaatacacttaagatttacacagaagtcaatggtgtgcaaaaaaaagacctgaatattgattgatatttggtatgtatcatttaaatgcatcccatgcaatgttctatgtacacatgtggctgcaatgaccactagaaggtttcagtgctatgcggaatggcaccctgagagatttaaatatttcagcaaggagaacggagtctaatttaaataatgtttatgagggttggggatccatcatgatacccaatgaatgccatagatcagcaaaacctattaatgttcatacctaagtgcacttttcatggcgacctgaaggagataatgttataacgcatagccttcatacagtttgttaattaaatataatttcctgtatgatattcccgttggtatctctgtaattgtttatcattttctttgcctgcccttgttgcagggaataagaggtgtctggataaaattgcccatcagccttgccaaccttattcaatatgcagtggaggtagctaaactcacatatttacatctctttagtagcaaaactagtttcatcctcccattctcaatttaatttgccacggtactattattttccaaattgagatactttagtagaattatgcatttttaagttggaaatagcaattattctagttttttatagtagttaatatgcatattaccatataaatctgtttggacatttttatggacgagacagtaagagattatcttactgtatgaatgaaatgcgacattgtacaggaagctgtttgattgatctccgaatcacttttacttcatcttcatgtaggaagggttctggtaccaccatgcagaggaaacttacttaatgcttgcatactggcttccagctacaacacatacattacctgtaaatgctactcaccgtgtgggtgttggagcatttgtaatgaatgacaaaagagaggtactgaatttgaatacaaaagcactatttcagggattcagaatttcagatagtcatggttctgttatatcttcccagcatcctt

SEQ ID NO: 82209 - DNA, 10523 bp, Oryza sativa
gtgttgcaaggagttgggaccaagataagaaaaggcacagagtgatggtcccaggaagataccacagaacccaaaggaggtaactatagtggtgcatgtgggtgtagaagcgaactaacttagaatgtgaacacgtgagctgttaggatgagtggtgcaaggtaaatcaatgcccccaacaaggtggcaatagcaacaagaaagtaggcttctttacacaggtaccagtgataggtcaaagctgaacgaaccactcactgagatgtttctccaccaagtcaatgtagtagcccctgcggtggatagggttagggtttgggtagggaagggctatttgatgcgatattggagtcaagattcttttccagcctatggctaatggtcatcatcatatatataaagcacgcatattctgtacagaacatcagagtggcattaagccaaaccaatatttcaggtgtatttactaagcgccgatcttttgagtggaatgtaccttaaaacccttacttttcatcgcttgataaaaatacattgtatgcacaagataatccagaatgtttgttctgtataagcccactacacttccatttcacacttccacacgtgcattactacatttgactattgtatttgtttcattttcactaagaaatttttgttaataacttttagctacaactattctatagttaagtagcccacatatgtttgctatcttatatatttccaatgttttctttttcaagctaccttctcatcatcttccatatcttgcatatattttccatatcttatatattgcatatcttgcatatatgaatctagatgacaaatgtctagattcattaacatttatatgaacgtgggtaatgctagaaagtcttataacctgaaacggaggtagtagtaaagatttgtccttttacaaataaatatttacctgcaaaaagaacacccacgataaagccagaccaatccgtaatttctttgcattggctccatttgctggaattgaaaaaacaaggaacattacactcaatgcacatgatcatggactattcatacacccaaactaatttgttcatatgtaaaatagtctgcatacttaggccaggtttggatccagggactaaactttagtccatgatttgacaatgtagtgctacagtaaatatgtgttaatcatggactaattaggcttaatagattcgtctcgcaaattagcctccatctgtgtaattagttttgtaagtagtctatgtttaatactccaaattagtgtccaagcatccgatgtgacagggactaaactaggatccaaacaccaccttaaactagcaatatttttataaagtgtgtcataggttatatagcaaaaaaaatctaagcatttcagaaaataaagaaagtaatgcttcgtctccagtattgggaatgctagttcccatacattatgaggcaagaacataaccaaaaggatcaatgtttgttttctatacaatactagttgagaatgacaaagctcaataacaggttgaataactatggttggattgacatttcagtaagcacataatgtaactggcacgtttaactttctgcctttcaagatgctctcatgatagtttcctttctgaaaaggaaaaatgttcatatgatcggatagcaaaaattggtatcatttgagtttggctacaaaaatgtaaacattcatgtatttaggtgtttttaatcatatgacaggattcagtttacctctgacaaatggtaaaatcaaatgcttctgtagaccatcatcaaatttctttccagaagtgctttgctttttcactcctttctttacctatcaatgcaatcatatataaataaaccggtaagaaacagttaggaaaaatgtaaatttcgcacacctgagcatctgggttaaccgcaagagcaagcaaggaaccaagcgcttccgcaaatgaatctctaactgctgacacattatcctccaagccctttagcatgtcattaatcaacgaacagtatcaggactatcagcttaaaaaaacatagcaacaactagctctcaacatgcattaagaatgagaaacaaggttagcaaataccttaacgcaacaagacatagaagtatcaatttcagccatccccaacccaggcccaccgatattagcgaaggccttcaagcatcgagcagccgctactctgacaatgaatgatttatcactcacacctcctcgcatgataatgcggaaagcctccaaataagctgcaccactaccaccaccaccagaaccttccaatgcattctcaagcaagaggagtgcatcttgtctcacaaagtcctgatgtttcatttaagagaactgtcaaaatccttttacaggtagaaatgaggcatgaccaacaaaaacaaaaaggctgacatcaatcacaatagtttttaagagttttatggttccactgggatacaaaaaaagaatgaaagaaaattttccacaagtaaatgcattgaagatttgtggtaagttccaccatattgtttcaatccttatttacagaaaagaaaaatcaaaaaagatacatgcatcgtaacagatctgctgtactgcaagagaaatccacaaaaagacttatggatagaaaacaaagttaagatagtttttctatagaagaatatgaagacaccaaaaaaaggatgaaaagacagtaaagaaagtgcaggagaagataacctcatggtacttcatgagttttgctacaatatttgatgtctcaattaagcctgcagtaatcttgtgtccaaataagcggtaaatttctcccagacattgcgctacacctgttaggaaatattgagttttttttagaaggagaaaaaaagtggatgtgcttacttagatttcaacattgtacatcattaaatgtgttgcttgcccaagattgtttagtccaggatttgcaataactttagcatgggatcaagggcctagctaagaagatatggcagtataccagtatgaaacctagcttgtactagtctaattcattgaagttcaagcagtagttttaggcttaatacaatggtagccattatgtcagtctattttaggattatatttttaatagtttttgtaaacatatagtttgaaaaggtaatgataaaacatgcgcatttgagatttggagactgtcaatgtccaaagcatcaactaaaaaataatggaattctagtttccgatgcaatttaaaagaagttaagaaaaaactagacaatatgaattacaattgctgacctgcataggccatgggatccgttctttttccatctaccaaccacccttggagggtactcgctcttgagtataccgatattgcatcacctctctcgattatcctccccattgctgacgatgccaatcgccgaacagggcgacgagccccaaggaaaagcaaggattggagagcatcctcacatttcctttgccaaagctgtatggtctcctgaatattataggatgtcaggaccgccaaaacacaaatttcaacaccggagttactaatccagtatttctgcatattactgctttttaggtaaacataatccgaaattaagcctgcagatgttgactcacgcagtagaaatttgctctaagttgacttaatgcgggcaggaaaggagagactggtttttctttcactaagttctgaatatttttgagacatgctccatggttttggttaatttagaacacaagcacccgagcatggtcacataaaattgtttgttcgatacttcaattgccatcttatgatgttagtacaactgcacaagcctggaatactacgacgcaaccgccagggcaactcacaagagatccatccaatccacgcggctccaagaacaagaaagctccgcatacgcaacgccattcgttgcgccaccgagagagagagagagagagagagcatgggcgggcgtgggatctggggcgctagcgctagggatataatagagggagggagaggtggtatggtaagaatgaccttgggggcctcgtcgagggcggaggagagctcggagaggaggtcgaagcagaggagcgcgtcggggggcttctgcctggccgacgccaccacggactccagctgcgccaccagcgcgccgaaccgcgacagcgggatgggctcgccggcggcgccaccgcgcttcgccatggtggggaggagagaggaggagggtggtggtaacgggagggctaccggttcgatcgagatctaggtgtgctggtgctgtgatctgggaatcgtcggggggttgggggccgttgggcgacggaccgtctgctcgtcgagctcatcggacggtccaaacggtttacggactgtttattttgagctctttttttttattttgaccatgctttttcacgaagtgctttttataaaaactgtactccgtaataaagtaaatcaatattttaatattacaaaattattagttaatatttgagtcgttatatgctaatgatcacctatagtgttttccgtaccagtgagtaattgattggtcaagcatctgatttagctagggcttaccggctatagactttgtgcgtcagtgtgctcattaattacccaattaattcaccaggacagtaaggatggagcggctcattttacgattgacaaagctagaacgctcccgaaaatgagtctattgattatctcccaattggttggatcgtaggggcgatgatttacttcacgggcaaggtctttggttcaagtccaggatggcccagctgcgccagggcgattaccacgaaaaccatgtggttaccgcaagatatactgtggttttaaaaattgagaagattactgcatgtgataacctgataatcacacggttttataaaccctggatttaactatatttaactagggttatttgtctttttactcccaaatttaacagttaaggttagtaagaattaacggaacaagagcaaacggtttgatttgtttcaaagccattgtttagttcccaactttttcttcaaacttttaacttttccatcacatcaaaacttttctacacacataaacttccaactttttttttcaaacttccaattttagtctttaaacttccaattttggcgtggaactaaacacaccgaaaaaaaagtaggggtaaaaacgaaagaataaaaaacaagggcaaacaatattggacatcaaagcaagggaaaaaacaaaattgccccttttagaaaactccgaaaaacaccagtacgcaattctaagaaaagagaaccacttcaacaaagacttttgagcacttttcttattcctagacatttatgcagcatccccttaatagtatggctttcctattgacccaagtaaatgaaaatttacaatttaccaatagattttgtgccgctttcatcaaaactccattcataagaatattgcatcgaacatcatctcatggggggctaatgttccttcagactttctcaattgtaagcatttgtcctcactaatctgattgccattgaccatcaaaataggaggctagatgcacttccagttgcacaagttttaacttgttcatccgaaaggtaggagtattgcgggaattagtgacattatttattaacataagcatggtgcttaggttagttaaatgtcgttagatgtgggtatgctccacgaaaagtgaggtagacatctggtggtgacaaccatgtccgtcccttgtattcctccacgctctggtatgacctaagagttcgtaaattaccataaccacgttggtagactaatagggagtgatcgaactaagtcctagcctagtttgttagtacttcctccgtttcacaatgtaagactttctagcattagcatctatatgaatgtgagcaatgctattatgtatagattcattagcatctatatgaatgtgagcaatgctagaaagtcttacattgtgaaacggagggagtatgtgttaaatgtaaactaaacattagcaatatacaagtacacacgaaccttagctttctatagttcattattagagatgaatctcctgtgtgtcacgctagtccacatgagtagattggatctatatcagtgtaggtgcaacgcggcgtgtgaatagaacatggcgcatattgtcgaatgatcaacccccattacggtttcctgttgccccttatataggtgcggaggccaccggctagagatggtgaggtatcccttataatctgggtacctatcatctatttacattggataagactgactgtctaatcttcaatctttcttaaaacaagtgaacccgacggacccaaagcatatagtccatcccatacgacaagctccaagaaccatcccgtggatactcaggcatcatgtacccaacagtaatttttgagtactaagtttgatgaagactccgaaattgatgaagtccgctagaagaagaggtgagactagctaagtacacatccccagcctagccgagtcaatctccctcagccgagtaattgtttccttggggaggtattgtaaactttatcaaaaagatcttttgggcggaatttcaccaatgcggttcggctgtcaataacgccatactccaaaccaggcttgaagaacacgatgttttcatgatgccacggcacaatattttggtgtgatcctacacaatatgcccgagaatcctgtctttaactcgaccgtagcctaagtaaaggctatggtcaaagccgccgtcgtccaacaccaagagatggcgccaaccgtcttcaacacagaagctgagtcgtcaagacaattattctgtggattccatggtgccatgtgccctacagggttggcaattttgctacggaatagctatatttatggtgttatatattttttttaaaaaagtcaacatgtatttacattgtaagtccctaaatcacgtatgtaattttattatttttttaatgtaagtcacaaaattacacatgtaaatagaaaatagagtgtaaagtagggtgtaagtaataaggtgtaaattagcaaaaaagaatgtaatacttgatttcctcggagaaggtagtaaagcaatttactgttaaacgctagtaacaaagcaaagaagattggatagtcacagtgtgtggagaaattgaacgaccgaaaagaggcacagccgaatacttgcggatcaatcggacggctagtaataccgaccgtaatcagctcagaaatctgtcgaaatcttgttagcaattccgtttccgttttgctacagttagttttgtgttgggttggattctagcaggcccgcgtgccagtgggtgtgcgctcgtcaaacccgagaggaagaagaaggcgaggccagataggcaggcaggcagattagaggcaaggcaggcaggcaggcagggctcgagctcccccttcccacacccatgtcctcctccgcctcctgcctcgcccctccccctcttcgtctcccgtgctcctcctcctcctccccctctcccgccgccgccgcgaggttcggttctcggaggagggcggtagccgcggctgctccggccaaggtacgccgcgcccgcccctcgattccggcttgatgcgtgcgtgccggggagtaatttgaggttctcttgtctctctctcagggatggaggctggtgcgcgtctcctgcttcaggcaggaggatgtcccgacgacgtctgacgacgggcccggcttcgagcacatctcgcggccggagagctcgcggggcgcggaggcgagtggggaggagggggaaggggaaggggaaggctcgagcgggcagcgtgagcgcggttccggggaaagggatgattggttcctcagagcgcaagaggttagccctgattgtttttttctagttgcaaagcattccattcgagctcctttttgtgttatgaggaatggtagtcaattcagatttagaaatgctatttactccctccgtttcatgttataagacgctttgattttctttcctagtcaaacttctttaggtttgattaagtttgtagaaaaaaaatagcaacatctacaacatcaaattagtttcattaaatctaacattgagtgtcaaaagtttcaatgcatgtttgttttgtcttaaaaatattactatatttttctataaacttggtcaaacttaaataagttaaactaggaaatgtcaaaatgtcttataatatgaaacgcacggagtagttagatgctagcaaatggactgtgcaaggtaccagctggctgaaccagtttctaactctcgtttcacgtcacgatgccgcaattgtgcaattaccattagaaacccatgaatccatagttgcattctctcagtggcttggatgttttattacagcggcacatagatcagtgttaaaacttaatctatttagttagatggagttggtccacatttacatatactgtccaattcttctaatgcataataactgaaatatggggtacacatgaaacacactcttatgttatcctctatatggtctgtaaaattttaattttctatctacttgccttaaaacacagaagcaagggaaagagcaccttttatacattcaaagggagaaaagttgtacatctgtctgcttaacctctaaaaatgagagatctgctggataggaaccttaacctatagagtagaaggatcatatgcaaccacaagagagaagttgctacacttcctgatgttgggagaattagcagtatcaccacccacttgcaactcatatttaagaacctctgacgaacattacaatcatgccaattcttgcatttcgacttctcttaaaggaaataagaatcttgaacttaccctatgtaaaatatttgtactttcacgagtttatggtactggtgatgttccacatcttagtccttcttaaccaagtagatctaggcttgtaggcttacttccgaaccaagcttaagccaaggactaaatactgtacctatcctcatgaaaaaagctgaagcctgttgtgggattatagctgcagcttgcttcacccagcattttgggattaactaagaaacttgtttattaatcttaacaccgagctgtataagttactttttatgatgagcacagtcaaagtgcaatcgaggctttagcaggcaatctttttccttgttatcaaaatgaacaaaaatctagatcactttatttttattttttttctcactagcaaccttttcctttacactttgcgttgtacctagagaaaataattaatatttttcattaaaaatcagcttttcatgactgccaacagaaggataaatgaaagcttaataaattagcaacaaatctcccaaaagaataacttaatcaataggtttagccctgaattgtgattctttttttttatgtatatatagtggacgtagcagaacattctaatcttcttgctaaaaaagttacttgtgcatactgtcccatcactagtttacaatgcaatttactcatacatacattgtcagctagtcttgatattgtattttcttgtcttcagtgtttgtctttgtcgactccttatcatcacgtaggctttgtttttatcttaattttataatttgtcttgcagataaagagaaatttacgagaaagaatattcagatttcagactcaacgatggactgtaccttggaccggaaaaaccattgctcaggttaattctttacttcttcaatccatgctctcggtgctcctttgtctattgcagtaatagacactagtagacagctagcttacaactgattttatcttaaatgtgcatcatctacttaaaatgggagtatgctataaagatgtattgcgcatctagtgttgatatggattgaaacatgctatctgttatgatcctaggatcatcaaagggtaaacatccatccagagggaggccggaagtagaacagcggtatgatggagggcctccaactggagaggaatagatctagaatagctggccatatgagaggccagaactgcaattagaggctagaaacatgttcagtcatctttccttgcttaatgaacatagatacaacctcatccttgtatagatggatgatttctctaaaaaatataaatagatctgatgattgacccttaagaaacttatctctaagatacaggaaatagatgattactcaatctaatcttaactctgaaataagatacctaaaattgctgtacaggaaatctgaggctgtgttcatgcacatgaaattttacacatgaattgtaattcctgtaagcgacacttaatgtgctgaatgaatggagatccaattcaagatttttattttagcattgtactgatttgtttacatatggcttcttagttgttaggttgtagatgatatcactatcttttatttaatatttatgcaaacaaactaacacttttttccttcaatgcatgttcca

SEQ ID NO: 82210 - DNA, 8642 bp, Oryza sativa
ccatagaattttcatgtgaaacacagatacaaggaactatgtttatagtaaggaaagtatattctggagagtttgaaatccttgcgttgttaatgccatgatcataatcagatctcttgacattgttagggtggctaatacctgctaattactgttgttataaagcaaaacacatgatcccctgtttgttaaattcgtgataagctagctgtttgtttgagttatgagtgaattaacatttccaacctacatttataacttgttattacctcgtgcagtggaatggtcgttagagatcgatctaagcgtaaaaaccgtgcggatgagatctttaaggaagctaagaggaagggagcaaagaaaggttcatttgaggctcgccggaaatcaaagagctttgctgggacaggcagacttctaacaggtgaatctgcagagcctgttgcgcctcagtcaccagaaagtattgtccacaacatctatttttggaccaatgggttcacagtaaatgatggtccacttagaagttttgatgatccagcaaatgcttcctttttaaaggtaaatactttgacctgtgcaaaatgtgtacctgttttatctgcttattatgtttgtctcatgtgccattatgtacttataccatttatttgttttggaatatcttaattcaccttgtttccgacctagagtggtagctgttgcaatattttgtcatcatgatgcaccctgttgtgcttaacgtaatggctagttaaaataaattcctcatgatgaaaacaaatcactggaatggtcttctttcattgagtgtatccattgatgttcttcagctggcttccatcatagtgtctcacaacctttatctcatttttgggctggtcctcatcaattgatgtagggcaagatgtgttttggtaggaagggtactggccaatccccccctccccccccccccccaaatttgccattgcaaaacagaaatctttctgaaaatttctggaccaagtaaaaatagttggatttcacatttcacaggtagcttgttcagtaaaactacccaaactaatctcaacattaaaaaaatgcactgaggcttttttttgttggtaaaattcggtttagtgttaccatttttcttttatggttattctgttgcttgatctattgtttattttgatcttattcttagcactttatgttcaggtcctctgtaacttgctatgcatgccatttcttttgttttgttacatgtttatgaatttgggttatgtcttctcttgctaaatggaatgtgaattaatcaatctattatttttcctttttcaattgcacagagcatcaagaattctgaatgcccatctgagcttgagccagctgataagaagtctcaggtgaatgtgaatcttgttcggaaagaggaaaagtgtcctgtaagttttgtcagcctttgctttactgtttcaattgttctagacgacgatcccggccttgacaatgtccattgctcgaatgatgtaggaacctgtcaagcgcgcagctccattccatggagcggcaaaaactctggggacgccttctgataataactccacacctccggaggctacttctgcagcagccgctgcttccagcacagagaccgcctccaagaccgtgacgatcacagtggatgattctttgccatcgacctctctgcagatcaggttcgtggacggcagccgcatggtcgcgcatttcaacacgagccacacgatcgcggatgtgcgggcgttcatcgacacaacaaggccaggagaagccggtgattacacgctccaggccgggttccccccaaagccgctcgatgacatgagcaagactatcgaggaagctggcgtcgccaactcggtaatcattcagacagcgtagcttcgacagaaaacagtttgttgaccccccctctcttcaacaaagcacactatcccatctgaagcgtgcaaatttcctcccctatcttttcatgccaagttttctttttctcttgaatctacccttttctgccttccatggcttcgaccaatagctgctccaggtatgaagagtgtaaaacagtgagatctgggtatctcgtccttattcatctatagtgctatacttttgctctacatgtctgtttcttgcccagtccacatcacgtttggtgcgtttaactgtgctcctttgttcttaatctaacgccctctttggtactagaatgttggtagtacttatggacaaagttagttgcaacgggtgctccttaattcctgtttttccaatgttcttacgctaattagaatctgagcccaaccgacgtgaattgaattgtttattactagaacagttcttgtttagccaaagcctcacttttttctagtacaatcttttccagcttttcgtcggatttccagtgttgaaaagcctaaagttatgctagcagatcagccacatacgtcaagaatgtctttagttggtagaagaaaacaaaaactttatgtaccggaattggatttcttctgtccttgggttgatgtcccactgtcacaggttcgtggccggagagatgtactgtatgcagtgacagatcctaacctggtgtcagaaaaatgacagagagtacgaggacacctttacagttatacgtgttgctttccaagatgaatggagagtacatcgtctggttggaaatgtttcgtcctcttcatcatcaccacggcctcattcctcgcttccttgtctctgtctcacctctctctctctcttttcagagattagctgttgcgacatggttttctttgctgtggcctaaacaaatggatctcgtctcctcttcctcatttaattgttctactacgagctcatcagctacttgtgttttttttcttaacagatgtgaataaaagggagcaagtgattgcaagacgatagagtacaatgtaaaatcacctgtcggtttggctaattggattggtcgatccaaccaacaactgacgacaagtaggtgagccctgatcagaaaaacccccaatgatttcgtccttttctccttcctcctcctcaccacctgtgtgctctgggaccgtggtgggctcactcaccatcgggggtccatcgcggcgacgtgacgggaacgagacgccgacaaaataccggacgcgcggtttcgagctgtaaaagtgcgtgagaactgaagaaacgccaacaattccccggctctatccggtggcgcgacgccgacgcggatgcggtgagcgattgctctcctcccgccgctgtagggaagcacgtaggtcaacccgcgaactcacttataaatcaaataaataagtagttctagagatctcatgtcgtgatccgacttaccgtatctctggcaaggtttaaaattgcagaaagaaattttcgaaattttggtcctatcggccgattttttttttgaatttggtagtattttgttcaaatttgatcaaaatttatttaaaattttggaccgaaatttctgaaatttcaaaaattttggtatatcggcactctccgatacaaacgccaaaaacgaaataccgaaatatgatctagggatacaagtgggacgatccgtgaacccatttatagattaaattagtaggtaatccgcgggttactaattttgtttataaatggattcgcgggttgattcacttactttcctacccgctggtgcatcggtgatctgatgatcatgggggttgtggcctgtgtggcctactggccacgagcgctgcctctcacaggttacgatttgtcacgggtgttgcctattggtgagatgctgtgatctgatggggttgattaatacggggagaaaccggattggtggcgagcatgagactgggagcttccaacttggttaaactaagaaagcttggggagtgtccaagattgattcgaattcaacctttattccgcaattcagcttctactattggcttaatcacgtgctcgttggaaacttattgaggtactgacgtactgattggagggggagggggatttttttttttggccgtcgcagctgctccaaaaatctacagctattctttagtagctgcgaaattaaaggtttgtttggaggaacttaaagcaatcacaataaaaatataaccttaagacaacaattacacttataaaataagtcatatacattgtggttatccttgagatctaccacaacacaagcaaatagaaagtaatttttttcactctcattcacttcatgaacgagagctgaaacatttttttttcatttgatgcaggctcattttgtggctaattctaatgatggtattgtgggaattactttaacgatgatctactattcatgtgtctcaccttaaggttacattacaccataaacattgaggttgccgtaagattctgagaagcaattggttggtatacaacttttgtgaatttcttagcttctagcttttagtttattttttctaaattctataactataacttttcagaatctagataaaaaatagacagtttgaaagagtttctgatttttgaagaaactacggcggctagaagcctaagatactcttaaaaaaaccccgcaataaaaaaaagatactcttaaaaaattactacatccgtcctaaaatatagcaatttttggattgtccagattcatagctaaaaatgattatattttagaacagagggagtacttttgcattgttgaaagcagaaagctctcccaaacaggtcccataagctctctcaaacggttcaagttacttgcatcatttatttcacatgaaaagtctaatttggttaagaataaaaggtaattcacatgtacttcgacaaataaggttagactaactattggtaattcacatgtacttcacataatggattatttacgtcgaaggttagaatgggacctcgtatgtctattggtttcgacctaaggagaagcattatgtctcttggtttcgacttaattgtgtgatgtttattccgttgtcataagtatctgtactagttctaagaagaacctttggctctggcctaattcaataaatgttgtaggacactgaaatacaatatgtactgatttctttccctttatatttccaaatggttggattagcttctcctgccaacattctgattagcaaggctctcagcctgtcaaacacatgtagccatccaccaaacagtttcctgtcctctcagctgtttaattagctaacaacactgtactcagtttggtcgaacgtcgcacagatttcgggtggtggtaatctggtatgtttgacgaatggttccctaatgactaatgctcctaactaatcaattcactaccgacattttgcagtaaatctattaaaacaacaactaacatgatgtgaaaactacaatatattctttgcttacaaaccttcggttcacactaccgaattttgatttctcctctttttttttattagaccctcgtttgtcaatagcaaaacatcatgccaactaatgagtgataataagtgtagacaatttgtacaactggccaccttaaacaatgtttagtagggacgaaaacgtggagtgtgtgtaactcaattggttagtccacttgcggtggaaacagtctatccatatgagttatagacttaacacaggtgttcgtatttacgattaattattcttttagtggtaggtgatgcacctgtcgataacaatgtgtctatagtgactccttcaatctcaagatataccagcttagttttatgaaggtgtcataggagaagggtgtaagtatgcgcatttataacagcgagtgtgcaaacattgtgagctcttggatttataccgtgttctcaaagaaaaagatagggataaaaagggtgatagaaatttccgaccaactgagcatagtttttttgtaaaaactgataccaaccgtttttattctaaccccatatatttgttttttttgtttcttttatcatcatattgtaatcatcactggttttcgtgaagatgctaccgttttcgaacatttttcatacctacttgtaaccgttaaaaaggtccctcttcatctgtagcaaaggtgcattcctgttacaacttacgacttgacactgccagtgattaattaaagctcacagtgaagtgttgggtagtgcagagagcgagtgagagagtagaagcacgtcaataatcgggtggaagagggtcacaatcggtgttgatcaatgaagccatcagcgtcttcttccaacagttgctccgctcccacatttatcatcttaaccccaaaagctcactcactcactgcagctgtactgccacacccccacctcactgcggactagcagcagcagcaagagagagagagagagtgggagagtggggagaagctaagaagaaatcaagaatttcaatctttgccgacaccacactggatttccttcctcaagcaaccatggcagcagcagcagcagcatcagcatccatcgagagcatatattagctatccgtggtgatcatgtgatgccaagattgctactataagcaaggagatagcgagggagatattcttctctttctttttcaggtgggggagaaggtgaaggtaggaaggagggagagaggccaagaatggcggccgccgctttggccggcgttctcctcctcgccctcgcggcggtggcgggagccgacaccgacggcggcgacggtaatatcaattgcagcattcaccccaagttcttggtttcttggaatgcgtgcgtactgtttgatgatatgtctgcacggatgatcagttgcttttggttcttgcagccgcggcgctggggaatctgtactcctcctggaatagcccggctcagctcaccggctggtcggccggcggcggcgacccttgcggtgccgcgtggatgggcgtctcctgcgttggctccgccgtcacctcgatgtaaataaaagatcttctgattaaactccccccaaaatgtttttgagtgatgaaaagatttcgcgtttgatgcctttcatgttcgtggaaagcaggagtcattttgctggttttcttttcactgcatttcgtaaaaaaagattgccgtggctttgtcttgacgtgtgggcattgaaagccgctgatgaaatcctgaagtgtgttggtttttcacattctctatctttcagtaaatttctgatagataattggaaattctcatcctttgcagtagttgattgattctactatcatgagataaaacgttgtccaaaaaattttcattggatgcctatgatattaagagatagaaagtttttttttcctccctgcatgatgtcaagtggtgttaatataattctactctactctctgcatcgattaatttgccagctcagagtttgggagactggatccagccatccaggcaaataatggtgctctgctggttttcagtgtctttttcagttgtaggaaaaagggctttttcgtatgcataaaaaaatatttgatatttgttctcgttcaaaatctgatgtctgggtaacatgcaacaagcagaatatatctattctggctaaaatatagattatacaaaagaggctggagagtgtatcttatctttaagaccataccttaattttgctattttcctctctttttttttttttgtatatgaaatcgcctcaaatggagatgctcgatgctgaaccattctgtttgttcccttgttctgcagcaagctttctggtatggggctgaatggcactcttggctaccaactatccaatctgctagcattgaagacaatgtatgagctactacttgagcacaagtatttattgtcttgttttcccctaatttatgtccttcatttcttaacttacagggacttgagtagcaacaacttgcatgattcaattccttatcagctgccaccaaatctcgcctatctgtaatgcttcctggcttgcacaagtttattcaagtagtttttgatgcctgcatcttcaataacagttgcgatgcaggaatttggcaggaaataacttttccggtaaccttccatactcgatatccaacatggtttcactcaactatctgtaagtgctggccattgcaaatgtgcaattcattaggtggagattgttattttggttgacatagtctaactgtaaaaaaacacatctacatgcagcaatctcagccacaacttactatttcaggaaattggtgaaatgtttggaaacctcactgcactttctgaactgtaagtcctacaggacctttctttgcaaggcttgttatctcgattgttgaaactcttggtttcatgacatgatcttgtacaatttgaaatctttacagagatgtatctttcaataacctgaatggcaacttgcctatttctttacgctctctgtcaaatatttctggcatgtaagttcttactaatcctcagttcaaacttccaaatttcgtatttcatttcatggttctgatagttcttttgacccattgtgtagttatctgcaaaataaccaactatcgggcacagtcaatgtactcagcaacctaagccttactacactgtgagtgattttgtaca

SEQ ID NO: 82211 - DNA, 2363 bp, Oryza sativa
cttctccgcgatcatggcctggcactccacgaacttgtcctgcgacgcgtcgaacaccgccgccgccgcgagctcggcggcaattaactcctcgcggaactccggcgacacccaccacaatcgctcgccgcccgtggctggcggcatggggaacctcctccgccgcagcgccaggatcttgtcgaccaacgtcttcgtcagcagcatcgtgccctccggtagtagaggccccgtgtagtagtcggcagagccgccgtcgtcacccccctccaggatgtcggcgatcacctcgtcgagatcgtcggagtcggattcggattcggactcgccggcggcggaacccgattcctcgtcttggctggcgacgttggtgcagggcggctccgtcgaatcgggcaacgccgccgcctcctcctccgccgtgatggcgcactgattgaactgggactccaaggcaggcatctcgccgtcgacggccatgggtggatgatttcgcggcggaatcttggattcgttttcaagatttagcagcaaggggtggcgccggttataaaggcggaggcagttcaggtacgagacggagtcgcgttcgcgtctaactgcgcaaccagcgacgagagatcgaattgggcccaactaggccggtacgatttttctttccgataagttcattggaggtcccttaagttgacaccgaatccgattttgatccttcgaatcgaaaaaccaaatagaatggtccccccaacttacagaaccagtgcaaactatgtccctcaacggaattgttcccggttttgaccgacatgacatctacgtggctaatttgactaggtcttcgtcccaacgtggcccttacatggcaatttgattgggaaaataataaaaaccgtagacccatatatcaattacaacaaaaacataattaaaaaaaggtgacccacgtaagtcccacatgtcattctcactcccctccctccttcctcctctctccccatctcccctctcttcatctctctcccctcacctctcttttctcctcgacggtgaggacgcccgacgaaaatggtgaaggggtggaggagcgacgcggcgaggtcggtgagggtggtccctctggtcgatggtggtggcggtcgagttaagcaacatcgaggatccatgcagaatactgaggtagtgaaaagatttattattgtagtactccatttgaccaacataaaaaattgaaagtagatttgtattgcattaatattcaaaggccgaagtaactgatgcatgcggcgttctttgggtcctcgaccacaagtccacaccatctctctgcctgcagtagcctcgagtcctcgacgcggccgcagctgctgtctcacagcgaaggcgccaatgcatgggcctatatgattactccctccggttccatattaattgacgctttgaataaggttgaggtcaaactttaataactttgaccatcaataactttataaatatttagtttaaaggaactagaacaacatatatagatttgtcttttaaagcactataataaaagtaaacatgcatttatttattatatatattataatagaaaaataaggttaaagatatatctcgtagaccgtatcattgtccaaaacgtcaattaaaatgaaaccggagggagtactgcttattgaaccatggaaggaatcaaaaggaagaggggaagaccaaggcaaaaatgtctttgtgatattatttggtactctcaaggtttttttttaattaggtagaattaatctttgttacatatagaaggagttttctctaaaaacaatttggcatgttcatcagcattttgggatgggtttgcaccacaaagccaaccccaactgacgacgattagttttagacggtttgggtcaccggatatgataggttagaccgcttagtctttcaaatcatttgacgggaacacaacaatcagagaaaagaagggagacaactatggatgggtagtttgcgataacccgcgcgataagccactgtaaccagggtcttcgacttcaaaagaaagagaaaattgcagggaatagaaaaccacaattaacctcatatttgacaacaatagaaataattatgatgtccacgacaacacgactacaaagattatacttatagtgtccataatgtaatgttcaagagcaccaaaccatgattttgaagcaacacagcctagtagttatgccaaaatatggagttaacttagcattttcataaatttatatcacgaggtatcattacaactcttgcactacttctagaattctttggggattttttttccttttttttctaaaatttaaatttaaacaagattt

SEQ ID NO: 82212 - DNA, 4602 bp, Oryza sativa
ttgagtccccgttttggcatcatcaccacgcagtccatcccgcgggcagtctttgttggtggctggctgaccacgcggctgaagcgttgaacggcgaaccgatgcgaggagacgtggacggaagcaaggaatccctcgacggcccgcatggactcgtgggctctcctgccgtgccgtggccgtgacccaaacaaacccagaccgcgtgcgcgcctggaagcttccagagcccaccaccaccttcgattcccccaacccaatctatttattcgcgccgtcgcccgccgctctccgcctccccacctcgcgttccctcccctctcccctccggccatggcgtccaagcggatcctcaaggagctcaaggacctgcagaaggatcccccaacctcctgcagcgctggtaggtatcctcctcttcttcttcttcgctgtcccccaattccagggttcacgggcgattttgtttcttgtcgattcatcgacttcttagcgtgccggctgctggatagtggaatcctctgttgactctttagctttcgaaaaaattttgaaccaagggaaggggaggagggggaggtcatactgtgcagtgctgcaattttgtgtttgtttatggttttgctaccaatttcgtgcatattattatcccctgagcgggtgtggagctgcgttttgttataattctggagctgttaattgttcttctttcgcaaatttaacgcttattacggctggctggatagaaggatagagagctcaagcagagacgctggatagagggatatacggttttagaggttattgttcgttcaacctgcttagttaggagtataccttcgttgttttagtaatttgtggaagcatggggtagcatatctaggacatggataagtctcgttggcaatgataccaggccacaatcgttgtttacaactcaacaatttgtgtaactggaactaattcttgtgtaccgatgaaataataataccctcaatatgtgtgtgatgataattgttcttgtctacatgctagtgtaccccaaacaagacatgtggatgttgtagaattgttttgatatttctaactgaatgtgacaacttgtgtggcgaatattggtttcatgatatgttctgttcaaatgcattgcaacaattgagattggattggagtacctttgtatgactaacacgcgaaatacgcctaacaggccctgtgggagaagatatgttccactggcaagctacgattatgggtccagcagatagtccatatgcaggtggcgtcttcttggtttctattcacttccctccagactatccgttcaaaccgcccaaggtatacattccttccacttctttttgtgttgttcaggaaactgtttgtttttaggacttgtggaagtttattataagagcatcacttgcttcaattttatataatcttaaggcccttgagtaactgattacaagatatttgctgttagggctctgctctaagcattcatagctagggataaaatgtcctgttaatttcagtctcaaagtggagttctaactgatcctttacaaagcataatatacctgtaaatgttagttttgtaaaggtcctgattcactttggcaaatgtgcgttaccaattcaacaaactatgaaaatgcttgtttcttccaccaccataaaaaaaaatgcttcacttgagttcaacggtcactgtagctttgttctgataacaatcatttttcaggttgcatttaagacaaaggttttccacccaaacatcaacagtaacggaagcatctgccttgatatcctgaaggaacagtggagccctgcattgacagtgtcaaaggtgaattgatcctctccctctccaactaagtcaagaaaccctttgagacagcttgtgcatgtgcaaaagcttagcttctttgaagttgtcacatagaaactacttacttgagaagttaggcactttggcaccatagaaatgttaggaagttggagctctcatagtctctagggcttaacaaatgcccaacaccgtatatcacctgcgtgctaatctggttggagtaacttttgttttccagttgcacgaattatctaacgtttgacacaattttcaggtactcctctcaatttgttctctactgacggacccaaacccagacgacccgctagttccggagattgcgcacatgtacaagactgatcgggccaaatatgaatcaactgcgaggggctggacccagaaatatgcaatgggctgaacgacgtaggccgatagtgttctctagcgatatatgttatcttgttgatctagtgttcatgtcctgctacatgcctacatggggtgtaatttcttctgtcactgaatttatgtcaaattctcgattgatggtagaagttattgagaaaaatttcaattacctgcaatattaattgcttccttatgagcttgttcggttaatttaattcccatcaggaatgaataagagaatcagaggggaatgaatatgagaatcagaggagattgaggggatcaatttcacaactagatgtgaaaaaattctcctctatcccttttgaagaggaactaaccgaacaagaacaagacctatcgtggttactgctttggtgtatgcaaatctggagcttcgtgtgatttattttggtttcaactgtaaatagaaattttgctgctgtatttcacttgttaggggttgtgggtggatcaaaatggcagatactcttcaagttacagaaacaatagttcttctcttgaaagttactactccgtaaaaaaaaaaaaaaagacaactcctagtaataaacctagactaaaaaaagataacccctagtaataaacttggacaagtgttcgtaggtaggattgggttttttcttatggagcgggtacataggcaaattttactttatctgttatttaaattgcacaactattttcttagtcaaatttgtttgattaagtttgtagataaattagcaatatttactaaatcaaattaattttactaaaattagtatttaatatattttgataatatatttattttgtgttgaaaatattattatatttttaagtttagcttaaaaaattaaaacgatttataatatgaaacaaacgggaagagtaccatttttttcataaattacataattacttgcatgatcattatgactttatgaggggctgtactgagaggccgtacttcggaaggcctttttacggccacaatttataaacctaaagacacatgattgaagcaaaataaaaataattataactatagggttggacttctgtacttctacggttgtaggtttaaaagttaaactaagattgaagttaactcatattgataggacatatataaaacattgtacttcatacacaggtattaagaaagtagctctaaataaaggaaagttgtgattagttaagaaaagaaagtagtgaaggaattaaatataaaataattatggttagttgagatgagaaggtaggtgaagagatggcttcgttttgggataagacaccgtgctagaaataactttattttagaacggaggtagtattatgtgaccggacaaagtactacattgtggtgtgttaccattttataacttattatgtgattgatgttagtaccaaaccaatctaccacggatttttttcgtcgcttggtttgcaaggctctgtacttatgttttttccaaaaaatatcaagaagacaaaataaaatgtcttttcaaaactattctaatccgtcgcttggtttgcaaggctctgtacttattttatttttttccaaaaaatatcaagaagacaaaataaaatgccttttcaaaactattcttaaatagtagtacaaaatatgaaaatccttgcataatcaaaaggtgagcaagcagcaacgatcagattcgagggctgcataacggaaactcttttatgaaatttaactattcataacaaggtttggaaattctccaaatagcttttagatttgtcattttccctcggaggagatggcttcttaattatttgtcatttttttctcagatgacaacccatgtttaaaaatagtgtgggtctactagtcactctccactccccttatctttccctctgctagttgaccaggcggtggcgccgcacggaaaggcagatcgatgactgcgcggccctcttcctggcgcgcgctcgtcagccttcatggcatcaatcaagttctgtgataacgaccgggtgctgatgtggaccaaggtgttaatcagggtgcttagtctgtctttccactccggcctcttcgccagcggcgaccctacaataggagcatgctcctcgtgatgacccacatcctggatagcagtgtgctgaccccgctgctcttccttgccacgaaccttttctgctaaacgagaatgccttgttgttcagctcgtgctcatggtcgtcgctgtctgagacctcgctaaccataccaaggcaggggcaggggtagtaaggagcagaggatgagaagtcaccgggctgcggcttagaggaggtggagaggttggggctgcaggaat

SEQ ID NO: 82213 - DNA, 2495 bp, Oryza sativa
acttgatcgatgccatgaaggcggacgggggcgtgatggggatagggctgtcacagccaccgacctccactccaggccccgcatgggcctctccgcatggcaccgccgcctagtcaactacggaagagcaaagactagcaaatgcgtaccacaccgtttttcactatatgtagccatgctttgatatgtcatgtgggtaaaagtgctaaatagtaaaatcatatctttagagaataaaataagagcaactctaataaggtatttgaattattgtcaaatctaatacagaaaaattgtggaacggtgtcccgtcaatacaggataaattaaatgagtggatcaatcttatcccttccctttctcttctctatccaaaccttcctcaccgccttcgcgttcgggcaagccagcgaggtagacttggtggcggcgatggtgctgcagcagcagtacgccgtggcgggggagcactggccgcggaaggcagcggaggtcaacacaagctgggactcgtgcatcagggagtaggtatccctagccaactcctcctcgccgaccatcctctcctcgacggccacaccgaagccgccgcattgttcgtcagcggcgcactggcgcagagcgccttgtactacagcggcagcgccggcgctgccttggagcccaagcaagaggtggacatggcagttgcgcccttctcctaggcacgcccggtcaagcggagctatcatgctcctcgccggagtgtgtgcaggtatatcgtgaaatgcaacctccacagtcgatacttgtaagtaccatgtccgatactggtatctttggtatcatggctgatacctaggtatcagaccccggtacttgtgggtatcatggcctcaaggttgtcatgcagacgacgctcgaagctatcgtgcttgccatcccatcgcttctgctcgctagtgttatgttcagatacggcacgactgatctggtacctcgagggtataatgcctagtacctaggtaccagctagtattcatggtaccaggtgcatggtatcagatactaggtacctataggtatcaggtggtacctgatacctgatacctatggtaccacaggtaccatgtcaaagatgtgggaaggggagcatgccgtcaccgcttggttgaccgccagccacatgtcattgcctcctcttttgttctcccttcctcagttcctctcctcaacgtatctctcctcttatttgttgttgatgtcggtgggggcaaaaaggtgaggggtcgccgctagcatgggaacaagaaaaacgggggaattagattcataatgtattccgttacaacaggatcctgttgtgtagttgccctcatctaatagtaataaaatagttaaatttcctaagatgaactgctcgagcgaatagtgaccatcacgttttctccatcttgctttggcccaaagtgacgagcaaacgaaggaaagaatgaagggaagcctctccagaagcagtaagtagtattagcatctcctgtaaagaccatttacggtagtattttgttcctattcaagtttcggcatagccgtaatactttgtttctagaagcagcagataattacaagttttctttcttatgtttcaaccatgttagaatgcatatatttcaactaaaaaataatttatttactattagagtcgcggaatttttctcgtgtcccaaatggacatgagattgcatgctccctccattttcaagtagctatcaattctgactttaccatgaatttaactaattactctaaaatggttagactaaattaatggagtaatacaatttaagaatttatcatcctttcaagacttcgcaaatatttcgtaaaaatgatgagttgtcaaatttcgaactgaataattatttaaaaagagaagggactacaaagatcggcccttaatctaaaatcaaattttgttcgtttcaatgataacctctttatagtgagcttattgaaacagtgtagcaaaatttacaaaaaggagagagtgaggccgaagtttcaccaaacaacaatttgcagaaatcaaaatgtaatggagctgctctgctcttgtcatcaccgggtgtacgtgcagctgtggttgggccattgccgttgcttgcattgccgggaagcctttgatgcttttacaaccacctatcccctccttccaagcttgtgccccaagtgacaaaagcaaggcagacaaaattttttatgcaaaattatattatatattgtgtattattattacaacatgttttggtgatcctttttagcttggcttgatttaatttgttgattagatgtgatgttatgtccctttgttaggtcgatgcaacagccaacagctctccggcatatgatgcatctgacaacaggttgatgtgttgcacttgtacagtgtgcctcggctgattggtcatcttgagtttcttttttggggctgccttgtatttgttttcccttttttg

SEQ ID NO: 82214 - DNA, 1391 bp, Oryza sativa
tcagcagcgagaggagttctggcgttcccgaggtctttagagagaactggttgagagacccccgtcatcccaaccaggttttcacaatacacacacagcgcgcaataatcaatatatttacctgcgcctcggtaaatattacaatcgccctgctcggcgtaaatttgcctcctacgcgaggacttaaagaagaaccattgtacagaggtaccacctttgctagataacttactttgcaaggtctgtccccattctagaattgcggtcatactcgttcgttcttcacatgtacttggcaatcttatgtcggttggaacagtactagccacccggaaatcaaccatttctaccgtactgttccaatctaagttcattatgttttatgcaatctaactaggcatgactaagcaaaatctagcatatatctggtttgctatgttcaggttatgcatttaaaatcatgtatgactaatgcatagaatagagatatagaatatagggcatttatgctcaaaggagaggaataataacttgccttgctccaacgcaaacaaatccgagataggcaacctgattatccgatcctcgaaacatcacaggttgccatccaaaagataatagactctactaagaaagacgaagaactaaattcaataaaagccataaaataacaagaaaacgataaatggttaggagggatagggtttggttgtgtgctagtcgatgctagagcataacgactaggtttggtatcttctctagctggtgtcaacagacaacataacggctagagggataggaggtttgtatgggtttagtggggcggaagtgttactctgacaaccgtgagtggcggcggagcggctaggatcacacagagcccgagagctaactgtgcggcgtgctgtggatgtcgagggaatagtgaagctccgaccgttgtacgcatcaaggcgtggggtgccaggagcagcacttcgaccttgggtttgggctttgccgggctttataaccaacggttcgacgttggggatagaaaaccacgaacgtccccatggaaggcataaagttccaaccggcggctttttagtggctaaaagggtaatttgggacaaaagaaaatatttgaaaaggcaatataaattcaaacgatatttgaataaattcaaataaaattataaaatagcaaatttggtgtcaaaagatagggtttgaatttagataaatttaggtccaagttttatcggaatcggatctatggtttggaaatatgggcttctaaagattgggttttgaattaaatctagaaaatatgaaaatgtactgttcatggacccacatgtcagtacctgctcttttccttttctctctctccttctcgtcttcttctt

SEQ ID NO: 82215 - DNA, 8103 bp, Oryza sativa
agccagtccttttcttgcgctgaaatatcaggaagggcctggtcgtaagaaagactaggaaccagaagggagtgcaaaacattttttttctgaacaaaatgcatcaaagtggtttgggaggaaaaaacgatagggaacacaatccaacattctacaccagaattttccagtctttcaaaaaaaaagggggcatgtcttcacatgaattacaatccaacgaaaaaaggaaacaaaattcagaggggcctgggcctgaatgggaagttttatattcgtgctgcgtctaaattggaaatttaagactatgactatccattttagcacaactcaataaattataaagtaaatatttcttacaaataaacagagccgtcctagctcagtggtagagcgcgtggcttttaaccacgtggtcgtgggttcgatccccacggacggcgattcagaattttttgaaattattttgtagttctaattggaatggaatgtttgcaaacagtaaaatatggataacccagaggcaacaataattctcaaaagttccaaaacttaacagttgcagacaggctaccaaatgaaaattatctacttcaacattgactgaatttttgccccacaacagaggcgcaaataataaaaaagtcgctatccgagacaggaaaataattcttacagccttacactacaattacaggcaaacaaaagaaaacgatcaacctgaacattgaccgaaaaatttttttggcccacagcagagatcagccatgacaggggtgggacaaagcaaccacatggttggtagcttatacagcatgcaaactacaagaaccccaatctactccatatcacaagcacatggcaagtagcacaaagcaggtgggatacacacatataatagccagaacaggggcagaagcaaatcacaatcgaatggcagaatcattcccagccaatgaaatcaccaccaaacatgttgataaccattatgtcacgcgtacaaaaaaaaaatcagagcactcctcaacctcacctaaattctgtttatcctcacatagctagctctactggtacaaggattagaggattgtaggtgcttaaaatagcttgtatggagataaggcgtccagcggatggatgaggtaggtgagcacaagggccaccagcatcagcacatatgcaattccctggtcaattgatgtgcctgcgtgaatatattattagcagcaggtatttgcagggttagcctgatggctcgagaaaacaaaagaaaaactggccacgaaaggacaaaacagaaatgtaagaagtttggatcattgactgtcagtttagaaattcactaatttagacacgtggaaatgagctcaacatttgaaatcgggcgccttgaagagacatgcactctagatgttctgggtgaaaaataacttttaggactaaaataattcaggctgcttgaaaatttctgcatagcatccctaaggtttgaatgtcctgtaccaagtcatccaaataataattcaagttccaacaagacgtcactaatccgaaattgtcgtgatgagtagcatgaccgatagcaattgttttttgaggcaaaccaagagcatttttttctgtaacacgttgcaagagaactaatcctaaaagaaaacgaatcaaatgttttgcatatggtaaaacaggaaaacctatcggatttagagacatttaacttctggagaacctgaagtcacttttaggcaaacaaaattcccggcatccttcaaatacaagagtgtaaacgagcagatgctaggtatcatgcattcagtggaagctactcaatgaagagcgaatactaccaatgaaaatgaagcgcaaactaacccaacaagtacagcagaacaaaatacaagattcttgagaggtggacagcaagcacccttctagtgtgatctatcacagcatttgtgctcactgctcatcgatgaatagcactttcacatatggacacacaatgtgaggattctcctagctgttcctttcaatcagtattgcccataatatgtaccagaatacgtacaatgaacacgcacaaaacatttggcaagaacaaaacttaagtgaaaaacttgacagagacacattcagggattccatgtatatcacaaaaactgaactttctcaggaaattacagcagaggccatattcattttgtgcaaataatgaatcaattattacattagtaaaaaacagtgttttagcggcaacattatttgatcccataaaaacagttgcttgtgaaatttgacacgctaaaaatactgaggtgttcaccatcataaaaatattcgtaaacagtcgcgacccatctaggccttccgaatcaacgtgtacgagtcagagatgtcaagcatcataagatcatagaagatcttctatataccaccaaaagctgcagccttaaaggtctaatgtaattaatttatcaaataattccgaagaattcattagaattccacgttaacttttacacgaaacatggaaaatttcaatactctgtagttccatggaaatccttatcaagcttttatcggatgcgcggacaaaacatgctcccaaacaacaaactaccttgtaaattactacatccatcctaaaataaattcatttgtcactcacctcacatatatcaatacgaaccaaaaatactataatacccctgttttatcaaatcccaatgcaactatttattactttatctacttctaatataattattttttttattttcacaagctccgatgcaatgattactctagaaataagtttattttggaacgaatggaacgatctaaaaatgaacttattacaggagggagaaaatctttgatcgtgcaacattagtttttttttaagaacaagtataataatgagctataagtctactgtaagcttatgtggaggagagaggtaacaaaaaattatcattttgaaacttactccatgtcgtttcgaaaaacgaaacctactcctacatcaacaacgagaaggtcctaagaagcagaattaaactacgtttttttataaaaaaaaaagtttcatcgcactccggatgcatcctttagtaccttcgtttcgcgagtctcagatgatttttttttctttcgtggacgagaatcgaattatggcgtggggcccacgcgccagccacatacacaaatgaggaacagggggtggattgaaactgccgagggagttctcaccgtcgctggagggcgcgggggcgggcggctgcgcgggggcggcggcggaggcggaggctggcattgcgattcccaccaccaccacggccaccgccgctagccccagcgaggtccacgccgctgccattccccctcctcctcctcctcttcctcctcctcctctccgcggcacgcacgcacgctcgcgctcacgcaagggcggcgcggcgaaccggaccggacacaccgtccaccaccggaggagagcagcggcggcggcgcggcgcctttccccctctctctctctctgtctcctctccgcccagaatttcagaacttgtacgaatttgctatctgctcccctgaaatctcgggctcgggaacgccaccaacgtgcgcgccgcgcctcgcctcgcctcgtctttataggcggcggcatcagtagcagacgacccaatgacatgtgggcccaggaggcggtcggcactgtccccacccaatgacacgcgggaccaccctgccagcgaatcagtgaccgacgggtggggggcctctgccagcgaatcagcgattgacgggtgggggcggcatgacacgacgcgagtcacgcgtaggggtggcaatggggccccggtacccgacggggaattcctctattagggggagttaatggggtgaaatcctcccccacggggtaaagaacggccaaatttaggccccatcgggtggggcgggggtaggagcgctccactgctcccaggccccgtatccccatgggggcccaagccatatcagcccatgagcaaattccttaggtgtcagtccattttagaaaataatagcccaactctaggtccaatgagagaccatatatatatggagaaaccctaatcccgtccccactcccactcccactcccggccgctcgtcacagagaattttcagaatatgccatcgaattcgcactactttcagaatatgccatccaattcatgctactttcaaaatacgccatcggagcacgaatttcctttgttccgtgccactccgtctcttccgtccgtagcaccgtcgtcttctccgcccggcaccgccatcgtcagtccgccaccgcccgcgccgacgccagtccgtcgccggcatcgtccatcctcgttggtgtccatcctcgttggcgtccatcgtcgtcgtccacggcatggcgtgggcgcggagggaggcgagcgcgacgcgagtgctagcagcggggcgagcgcggccgcgagtgctagcagcggctgcggcagcgggcaaagctgactgtctgcgtctgtgtctactaccgcccgggactggacctcgtgtgcgcgccttgtgaattttgagagtagagggcggccggtaaaaactccctgtatgttgttgctgctgcacgtacttggtccagatgatgagtgtgaattggcaaggacggaagggaacggaatgggtaggtagtagttggatacttggattgttcagaggaggacgtcggacttggcggggagtcgcttgtagaagttgaaggggacggatggcgagcgcggccgcgagtgctagcaacggctgcggcggcgggcgaagcggcggctgcggctgcgggcgaagcggctgcggctgcagaatggggcggctgcggcggcggggaaggggtgggggagaagccccttgtggatggtggggcgaggcggaatgcggcggctgtgtacaatggggggcggcgtccgtggtggtggggaggaagttgaggaggacgagggcagggcaccctcgccgacatgctccagccggaggacgcgatgcgcgggcggtggaggacgacgatggcggtgacggcgaacagacaacgctgtggctgacacgggcgcgcgcggcgcgggcggtggacaacgacgatgccgacgactgacgccggcgcgggcggtggcggactccttccctccgcgcccaccgagccgtggacgacgacgacggacgtcgacgaggatggacgatgccggtgacggacggacgccggcgcggctgacacgggcaccggcgcgggcggagaagacgacggagctatggacggaagagacggagtggcacggaacgaaggaaatttgtgctccgatggcgtattctgaaagtagcacgaattgggtggcatatcctgaaagtagtgcgaattcgatgacatattctgaaaattctcctggtcacaaaacacaggcgcacagagaagaacacatcgcgtttttctttctatccactgatccccaattcccccattcctctctttctctgaacaagtccgatcggccagggcgagggaggccgccaggacgccagcgaggcagcgacgtgcctccaggctgcgcgcccgcccccacgccatcgccgcctcaaagctccgtcgtcgtcaccgaggagtgacgccttcaggctcccgcgccgcgccctgaccctctgccgttgtgcgccttgctcatcggccgagtcgccgcctgccaatgcaacgcacagcgtgagagctgcacaacagccacatgcaatcttttgatttggttctaccgcttgatcttgggaattggaatgaatcatgtaactgctctcttttgatttatggatctgatgtatgtctttattaaaacaaaaagacaatagatttgtcatctgtgtgtgcatgtgtaagcattttattctcaattcgtacgggacttctgtgtatccattatctctaattctctacttccaaattcctaaaattttctcaatttgtattcgtgtctcccttctctctattcccaaattgatgcacagtgctgccccgtgtttcctctcctcgggtgtgcgcccccgtcggagccccgcaaccccggtgggggcggggatgggggaaagattgcccccgatgacggggatggggacagggggcgggggatttccaactgcccggggacggggacgggtggtcacaatccgtcgtgccatccctagtcacgcgacacgagtcacacacgagaggcatatcaccccgcgcgccgcggccccatttgcccgggctccagctcgatattaatctcgagccaatcttatggcagtcctaacctaactccacaacactacttgtttaatacaaacaccatttttatatacttaaattcaatgctacttgctcacatgatgtcttggatgttgtgtataaaccatgtcccatgtaagatttgatttccttctctttcctcatttactcacttgatacatcattttttattttaggtgacagcttatttaatattttctccattccaaattgatctacatatagttttttttaggttattcctaaatgattaatatatttatgttcattcattaagtttattcgttatttgtgcattgaagtaaatagacattgatgcatgcatctatgcacacaagtattttattacccacatgcaatatcttgatttgctgttggctaggaaatagtggggatggtgcatgcattgagtttattgttagaataaatatagtatgagagagttattagcttttcttggtcttagtgtacctataaaatatgtagatcaatttggaatggagggagtactatgaacaccatctagttattgggttgggaatagtttaattattacactttcaggcttttaagctactccctccgttttctaatgtaagactttctagcattaatcacattcatatagatgctaacggcacccgcaatggttatctataagctctctacaagagatccatgtcaccatattttcctacttgaaagagattaaatgaagagagagagcaaagctatctactaacctggagatagtctatagagaaaaacgaggcaatggattagagagctatagatacccatgtagacatactattgaggtggtttactattaatctattctattgctgagatgtacatattttatagagagcaccttactttaccattgcgggtgctctaatgaatctagacacatatatatgtctaatgcatctagattcattagcatctatatgaatgtgggcaatgccagaatgacttgcattatgaaatggaggaagtagcttggttcgaggtcaagctcaacataagcaatataatatacttcctccgtttcacaatataagactttctagcattgtccatattcatacatatgttaataaatctagacgcatatttgtgtttaaatttattaatatatatatgaatatgggtaatgctagaaagtcttatattgtgaaacggagagagtatatattaatgataatctcttgataaatataattattttttatttgatcacactaataaaaaaatagaagaaagactaagataaatctattatgctaacacatgctaatttattgtgtaaataaatattaatagatacttagaaaaaaggcccatgcattgcaacgagaaaaacagcgccaacggctaggtcaacagttgtcagctacgagagtgtcgtacggaagacccgacgaaggtgggtccattggagcagtagagctacgggctggcagagactattcgggtgatgaagctctgggatggtgatggcaggtacgagagagggtgctataggcttagttcagggttccgtgagccaacaactacaatggctctgggcaccatgaaccccccttgcggtgttgtcgagtggctgcctccttcttggcatgactctcctagtgaaaacccagttcggatggacggatgacggtggcgctaaaggcatcatgaccttcttggagatgttgtataatgtataggaggtccttgttccctgtctttgccgccttccctcggttttgttgctagtggtt

SEQ ID NO: 82216 - DNA, 8930 bp, Oryza sativa
ataaaaaaaaatcttttgtcgtgatatgatcattattcatctatatcttgctcggatcaaattccacaacaaaaaaacaaactgtatcacgttttttcactaactcagaagccatttgcctctccaaataattgagacgctttgtgttggaataaagtgtgcgtgatcaaagatttccagagcttgattactagcagcatcttttcagttgggttcttcttgagtacatgtgggacatgaggaaaaggggttgatatgtttgttggaatagttggttggggcaggaattgtcaagcccttcccttcccccttgtggctcattgattttgactattggggtgtcgcatcctgaaaacgtcactgggacagacaatgcagaggattggctggtccagcctaagccatgtgtccattctaattctaaactctcatgctggtccaagttggcaggtgctagtttcacatcactccaaatggcacattgcaaatttgcaattctcctttttttgccaaagaacaaacaaccttttttacacactgttgtttagtttaaccttttttttttaaaaaaaaaaactcattggtgcatgaaaggagcttcatgggttcaacacccagtcagtatatattaaggtagttaggtggcaatagtttactattgagttaaataaactaattgggtgaagacatcaatggattgattcttctctgtgcccacagctttagcaagaagtcaaaattcacatggatggagcagaagtttaccggttaccactgtttcctctgatcttcctcttggagatcttcctcttctctttttatttaaccctttttgtagataaaagtgttgaggtggggtcagggagaagtgcattcctcctgcaagtgcaatttgtaaatggccaaattgaatctgactctgttttgcatttgattgttgggggggccctgttgtggtctgaatggaattcttgtgtgaccttttcacctccaatcatattgctgttttgttttatcttatccttgcagccattgttgttatcaaaaaggtagttgtgttccccccattgtaagtacagagagtgaccatcaacagtttcagtgcaatggtctagagtaaaggccccatttgcatctcagaatatctgtacaaattgaactgtttcctatgaaatttctgtgtttcaaacatgacattgagaacgagcgcctggttcaaatgcgaattgaactgtttcgtgctaaattcttacatttcaaacatggcattgacaatgtgagacattttgaatgaaagggattcactgcaaattggaacaatttctctagtttcttttttcatgaaattcctatgtactgaaaatttgcaagatttggcatctaggaaaatccgcgcaaattgaactgtttctcgtgaaattcttctgtttcaaatataacactgataaataagggcccgtctcgaatgcaagaaggaacaatttctccaagttttttttatctctaagggttgtattttctcctgctctattcaatgaaaacactctagtgctgtttttcgttcaaaaaaaaattctccaagttttttgtgaaattcctatttctgaaaaatttacagtgtttatctgaaaatttacactgttttggtgaagggtttgcaggtacctgccgttgccggagggggcgctgtgcctggtggcgtcgacggcgttcatggcggagctcctcctcttctacttccactccaccacccaccagggcctcgagggctactaccactacctcctcgtcgtcgtcgtcgcgctctgcgtcgccaccaccgtgctcggcgccctcctccccgcgagcttccccgtcgacatcgccagcggcgccgccatcgcgctccagggcctctggttctaccagacggcgttcacgctctacgggccctcgctgccggcgggctgccgccgcgacgccgacggccacatcgactgccacacccacgccgcccaggagcgcgccgagcagctcgccaacttccagctgttcggcctcgtcttcctcgtctgcgcctacgcgctcgggtgcttcgccgtcgccgcggcgaggcacgggcaccccgacctggccacgatgcacgccaagcacgtcgccgccatggaggcgcagctcgccggcgccggcgccggcgagggggacaggttcgtcggctctgcgctgccgctggaggacaccgcgatctaagtgagcgggctcgccggcgacgtcgctgtccgtcgtcgccgccgtcttcttggatttgggtataggaagaggaagtagagtgcatgtgacacgtggcaggggcagttcagagttcagaattcggaattttcagatcatgaaacgatcgaagagtaggaggctgcagattaattgggattaaccacaataggggatacaaaattcatggaaactttgatttgatcagttgcttgattgatcctttttgttgtgattacgtgagggtttatatttggattacgatttttcctctgatcggtgcagaggttttgtcttgtacatcaaattggttactgggttatgcatacgacagcattatggatgaacagcatataattagaaactgtttttagacatgttttttgtactttgatgtgatcatacggtttgtttggttggagggagttagtgatgaggaatgggagtttatgatatctaggagtttaaatctgtagtttggttgaaagacttgggaattcgagagggtttgggatagggaattaagaggtccaattcccatcaatctcttgcctgggggaggcctgttaattcgtgagacttgtagggaattcgatgtgaaaccaaacaagagatggggactaaaaatgtaactcccatgaccaatcccaccatcaactccctccttaaaactcccattcctcttctcttctcttgccaaacaggccaataggtccattcagattggcaacccgtcttgctcctgtgcaatgtataattgtacattggcttgtttaatttgttgctgaaattaaccttatctgacacactttggagtttccaaactttagcaatgttggatgtgtgtagtttgtagcctaaccaaaatttagtagtgtttgtatgagaagatacttttgaaaataccaaaattttggtaaagtgacaatgacaaaagtttgcttagtttgttaccctaacaattcttggttattacgaaagaattggtaggactgaaagtggtggtaaagtgaaattggtagagttgtggtttatttcgaatttagaactttacattcggaatcaatttagggccaacttttgtcactttgctttgccttttaaactgtccgagtagaagtacaaaaattcgtcttcagatccgtgtaatttcgggacattttattgtcactttcttcacttagctttcccttttagactgttagagaagtataaaaacttgggaaaaaaaggaataagttcccttgaggtcccttaactcgacgagttcaatttgcatcctagaaccataataccagatacaacggatccctcaactgtcaaaaccggtataatataggtcacatgacggtttagacggtggttttgatttcgtgacacctacgtggctaatttgactcggttttcatctgacgcagcatatgaaacaaaatttaacaattttaaaaataaaacaaaatatatggacccacatgtcagtcaaataataagataaaaaatagtggagcccacatatgggcctcatgtcctccccctcatcctctctcttctctatctctcccattctccttttccctcttccccttctccttccccggatgcagccggcacaccaacgagcgagagtggaggcacggcggaggcgtggggatgccaaatcgacggggaagaggtgggcactacctccactgttgagcatgtgggcgtcatggtccaccgacgagtgtgcaaagaggaggacgaggcggggaggccagcgagggaggggggtaggtgggcagggaggtggcggcgaggccggcaagctcctcctaagtccaaatccatcatcgctgacaccacctccaacgcgcgaagagggaggaggcggggaggctggagtgggggcggggatggagcatcatctggcctgcacggcctaccgcaccccggccatggtaggaaaccatgtctgtcgtcgccgccaccatcatcgggatctggatgcgccacccgtcggccaggttgccacgtcacatcttccacccctactccaaccgggtcaccgctggcatcgtcctccacagctttggcccccccaactacgccgctccactaccacgctgtcctctctagatcttggttgctgacgctactccgggggacccacgtcgatatgcttcgcccatcgctctcgccaccccctctacctcgcctcgtcgcccaccgagccactagcctcgtcccctttgccgtacctccgcattctgcatgggtcctcaacgttgctggacccgaccgtcgccaccatcgaccagagggaccaccttcaccgacctcgccgcgttgttcctccaccccttcaccattttcgtcgggcgtcctcaccgtcgaggagaagagataggtgaggggagagagatgaagagatgggagatggggagagaggaggaaagagatgaggggagtgagaatgacaagcggaacccacgtgggtcccaccttttttaattatgtttttgttgcaactgacatgtgggtctatggtttttattattttccaaatcaaattgccatgtaagctctacgtcaataccaagtgggatgaagacctagtcaaattagccacgtagatgtcatgtcagctaaaaccaggaacaatatcgccgagggatctagtttgcgctgcgttttgtaagttgggggaccgttatatatggtttttttgtttcaaatgaccaaaatcggattaggtgtcaagttaagaaacctcaaatgaacttatttcaaagaaaaattgtaccggcctagttaggcccaattcgatagggggtgtggcaggtaacagtgtggctagcagcatagccatgatcactgaccccttgtcgccccgctgattgtcctccgcgccaatcgtctctccgtcggcgcggttgttgcatctcgcgatggcagcccttgtccttgtacaaggtcttttctcctctctcacccagaagtccattttaccttcctccttttaattaattttaaaatattaaaccttcgaatcaaattttaacatactaaatgaacttatgtgaaaacgttgtaaaaaacaattaaagttgtataacttattgagatctaccaatcttatttttgttatttctccatctgagtttgattgatctatacaaaatttgaatttcaaattatgacaacttcaaataacattttaaatactaaatgatttcaattaaaaaagttatcaacaacaaagttgtataacgcatcaatatctataacttttgttttgttcattttgctatatgactttgttataataatttgaatttgaatttcaaattatggcaacttcaaacaatattttcaaatactaaatgatttcaactgaaaaagtcatcaacaacaaagttttggttaatctttgttatctatatagaagtcatcatcaacaaaagattttagaactaatctttgttatctatatacaaattttggttaaactcataaaggaactttactatagtgtaaacactttagtgaccaaaattcttagataactttgttatctacatacacattttggtcaaactcgtaaatgaactctactatagtataaactctttagtgataactcttgttaggtccatatagtgacttttaaaattaatatacgagcaattgtcaattcttatattgcaagtatactggtaactagcattagtaacacatattatgtgctacgacagttcttcctataatactgtactgtttcacattagatgtagtatgtgttacagcctttcgtgtaacgcatgctttgtgctactgtggtattctcatgtaacatatatctttatgtgctacaagtttatgttataatagccctgtcctgtagtagcgaagttggtgaaatagaaattcagaatcaaagttcagacgcaacatgaatacatgatggcctggaaaactacccaacccaacccaaccaatcgaccttgcagtgcacaacattgaaatttggaaactaccgccacatcaaattcaaattgcaattcaaacttactagcatgacacgcaaagcaggcgcagacgacagcatgcaccatcatgcatggttaccattgcaagaatccttcatatacttatctgttgttttccataccagaacatattttatgaaacacataattaacactcaagtttctcagatcaagtccaccgaacttttaacatcaggtcaatatatatgtaaacctcgtaattccgaatgcaacagccagcaaaaaatcaacgagatggatgcacctccataatactagtaataactctaaaagaattgttggccattgttgcttgtctccatcttaacctacacatctggtcagcaatttctgaagcatatgaccaaaccccaaacacatcatcctcagacctgtaacaaactaaaaatagctcagacaaccgttcacgaaactagactgcaactaatacaaggcttataatgcaagattggcatggctgcaacaattacagacatcatgcaaataattaagctcaaagtaatgagctttgtagtaaacacacaagaaaaaccatctgtccctgtacacaaatcaaaggaacatgcaacaggaaaataccttctagttttcaggcagtacctcttaagccaaatcttcacatgaaaaaaaatatgccaacctgaatgaattggagtatattaaaacagtaatgaatacatatgccaaaacctaacaatctatcaaattgatgaatcatgctcaacagggcatcttcataaccgccaaagaaaaacaataaatagaccacacaactggggaggatcaatgatcaacacaatataaaagcaaatatagatacactaatccatgtacatggatcatagtcgtattaaagagtgttacattgaccaagcccaattaacttaattagctgcatacacattgcaccttgcaccttgcattggagatgaagtttcaattttcacataagttagaatcccaattagaatcattattggatgaagtttcaatttgcacatcagttacagttacaatcatagcccacccataggtgaggtcggtccatgtcggccgacacacaggtgagccatgtttaccaggagtaacaagttcttaaagccttaaactacaaaaatgcttcaacccggtcgtccgatcttgagaaaaaaaatcggacgcctcttactgtgattttgctgcatgcagcctttgtcagatcctctctctgttacatatacttcctttgtgggtattaatatgcatgaaagagagatgacacgaggttacttgcatgtacataacacacttttagcaaacttgaaaatgatttttcttctaaattactcatccaatttacaatccgattacaccattgtattcgttacaattaaatctttacaacaagatctcacatgaccatattataataaaaaaatacacatgtttcaaccaattaaacttaatgtttcacatatgaaaattagatgtttcagctgaaattctattatgttgcacaaatttatttagtgtcacgatgtatatatctttctttaatgtatctcatagtgctatttgtatgtttcagtaagtagtttattgtgtttcactggtttatttgtaaatgttgcatatatgttggttgagtgtttcaataagtatccactagtgtactcacaatgttccactaaaaatgttttacctagtatactcacaatgtttatgtatagatctaatattgcagtgaattgaaaaaatcttttgcaacaaataacccacatattatggaaatcatctattaagagaattcattttattttttgttccacaaaaaatatttcactttatataaatcaaatgttgcagtgacttgaaacattctttcgctatttagtgaaacattgtttttatataaggtgaaacaacgtccggtttaaacgattgaaacattttcgatttatctagtgaaacaattccgatatacttggtggaacaacgtgcaacatttaaaaataatttaataataagctaattttttttcaccagaatatatccatgtgtggtcttgttttaaagatttaattgcaatgaaattaatggtgcaatcggatcatgatttggataaataatttaagaaaaaaaagtagtttaaaatatttttgcatgcatgcatgcttgatgatgttggatggctgatggcgtgcgcgtgaatcggacggctcttggatgcgttctcccttaaactagcgtaagtcggagcttgtcttgctccggcctgaggagttgtacaatatgtcaaccttcatgcaaattgagattagtaaagctagcttcatcctgtccaagatgcaattttcacatatacttttggacattaaactaacataaaagaaattctacaccttcagtccttcctaaaaagtactgtagaatcgtaacaaaacaaaaatgcgattttctatatatatatatatatatatatataaaaggatagataccaatggacagtcaactaacataagagaaaatatatgcctctaatcctccctagaactcatagaaccgaaacaaagaaggaaaatattttatcatctcaaacgatatatcatcctttgacagcaactttcatccttctcctcctccttctcatccaca

SEQ ID NO: 82217 - DNA, 9807 bp, Oryza sativa
ccgtccccgccgcggcgcacttcctcctcgcgttccgggcgtcccgcaggccgttctccgccgtcgtgcaggtctcgctatcggcggcgtccgcggcggggttcctctgcctctcctcctccttccgccgcatcggcctccgccgcctcctctacctcgacaagctccgcaccaagagcgaccgcgtcaggctcaactacaccgcgcgcctctccttctccttccgcctcctcgcctccctcgtcgcgccgtgcttcgccgcggaggccgcctacaaggtgtggtggtacgccacctccggcgaccgcgtccccttcttcggcaacgacgtgctcagcaacgcggtcgcctgctccgtcgagatggcggcgtggatgtaccgcagcgccatctacctcctcacctgcgtcctcttccgcctcatctgccaccttcaggggctccgcctcgaggacttcgccgggacgctgctcgtcgaggtggaggaagggagggccggcgtcgagcgcgtgctccgggagcacctcgacatccgcaagcagctcaaggtcatcagccaccgcttccgcaagttcatcgtcgcctccctcctcatcgccaccgccagccagttcgcctccctcctcctcaccacccgccacgactccgtcgacgatctcctcaacaccagcgagctcgcggtgagtccccgatcacggccaaattctttgatcagcaacactcgatttggttcccaaagttcgattccatcccatgtatagcaatcaatcatccccaatcatggacgaaacgaaacttccagacaatcttgtcttaatttacacggaaccaacatttcttgatgcttaaattaagcacaaattgacctgtaaagttacaactattaaacaatttgggtggacaccttgctaattcagtgctactacttgtactaactccgaaatggaaaatctccctgcattctgcgaattaaatccttgctcctaaaaagtaacaacgttttctggttcgattttgtgcagctgtgttcagtggtgctcatgtcagggctgatcataatcctgagcagcgcggcgaagatcacgcaccaggcgcaggcgctgaccgggcagacgacgaaatggcacgcctgctgtaccatcgagccggtgccggacgaggaggcggagcccgggtcgaaccacagctcgatgctcgaggtggagcccgtcagcgacagcgacggcgagtccagcgaggagaccggcgacgaggacctgctcgagaacaccaagatcatgctgccccaagcacacgtcatctccttccagaaaagacaggctctaggtaaataccgttacagcagtaacaatttcatgatccatccagttacttcgataataatcgttgatatgatagctaaggtggtgttcgaacatgagaaatgcatataaaacgagaaaaccattagcacataattaattgaattttcattattatgaacataaaaataaatttatttgttgtattttggagtaactcctatagagaaagttttcatatgaaacatattgtttagcagtttgaaaaacatgataatggaaaccaaggtaaaatttacattttaattagaaaagaattggacctaagtgaattgggaaattattttcatccctcgaggggatatctcatcgttgtttgcatgtcactcaaatggttatgaaaaaatttaaaaaagattgaggagacgtgttaacatatgatatatcactctacaaacatgtaagttcaaattcaacttctacatctcacaacgtaaaaagtgaattgtacattgttgcatcagcctaaacttttttggatgaatttatcggtgtatgcaacttgacaataatgaaataaaatgttcactcatgtttggtgcagtgacctatctggagaacaacagagcggggatcacggtgttcgggttcacgctggacaggtcctacctgcacacgatattcatgctcgagtggacgctcttcctgtggctgctgggcaagacgatcggtttctcgtgaaagcgaggtaaaaaaaaaagttttcctgcatacaacaagttcaggttgttctggaacacatgtatgtttggttggttggtgggttgcaattttgcggatgcgtggctgtgcagttggatcctcgtgagtggagtcatttttgggtgctcacgatagtagcgtgcgcatgtatgtgtatacgcatgtatgtgtatacgtacgtatgtattgatgtttgtataaaaactggtgttagcggtgtacagattttgagtccattgcttcgttcgcgctaacaccaccttagtaaatgagcgatatatgtagagcgttaggacttgtatgtacttttgctgctttagtttgcggttgtgcacgcgtgcggcttcctgttgctaacgtgcaggctttatcatccggttttgtaatttgtatagccgatgaaagttgcagagcaaattttatttacagttcagtttcaaatttcccatgttttggagaagaatttatcgttctgtatttctttttctttttgttgaattgagatgcgtcatacatgaatgtagcagattttttttttatgaaaggaaatgtacctttttattttattgtgatgtgagtgaactcagattaaacccacttaaggccttgtttggacggaccagtttaaggaaaaagtaaatcgaaggtccctgaacttgtcatcgagttaaaaaacatcctcaaactgtaaaaccagatatctgacgttccttaactaatcaaaaccggttacaatagatccctaagcggttttgatacaggttttgtcctgtgtggcggttgaatcagcgtggagcccacgtggaccccacatgtcagcatgccacgtcagcctcttctctatttcctctcttctctcacttcctcctctctctctctcactcctctgtggggctctggacggccggcggtggggaggaggtcgccggggcatggaggtccgacggccggccggcgatgagggggcggcgacccagaagggaagggcggcgggcggcgggagcacggaggagcaacaccagcgtcttgtgccgcgtccacaacggcgtgccagcgccggcggccggcgaggtcgcgttggcggtgccggacattgctgctgctgctgctgcctcccggaactcgatcgagacacatcaagggatccaccagctgggatttatctacagccatcgcagccattaaatcgggaatcaaagcttgcaaatttggcatccagcagaaacaggcaagaaattaatttcgtgctacaaatgccatctcgtcatactcatctcttcttatctcatccaactaagaggccatagaaaatcagtgtcattctactggcaaatcacaattaggcaaaaaaaatgcaagaagttaatctagtacagctaccgcagctcgcagaagggcaccggcgaggagctcgccggagcgccactgccgccgctttgcctcagggcccttatcaagggcttggtcgccgaccacggcgaggccgcgccggccgtgtacgcacacacggccaagctcggcctcgaccaccgcctcgccgtccgcgatgggctcgtcgagctctacctcgcgcgcgtcgagctcgcctccgcgtgggcgctcttcgacggattccccgccggctggccgggacgtcgtttcttgtacggccatggcggatgatagcggcgtgtgcatcgacaccgtcgccgccgccgcggcgttctcggcgtgcgcgcaaatcggggaccttgcgctgggtcgggagctttaggaggatgcccgtgaagaagaacgtcctcgtcccggccgccgccgccacgtcgcgccggccgtcggacctcctcgccccggcaacgaccaccccaccgccggccggcctgcccaatccagagagaagagtgggagagagagaagggaggaaaggagaggaagggagaggctggtcgctgacgtggcatcctgacgtatggggcccacatgggtcctacgctgactcagccgccacattagacaaaccggggtcaaatccgctgaggacctagtttacactgttttttaagttaggggatacgttgtatccagttttatggttgggggatgattttgtaactcgaggacaagttgagggaacttcggtgtactttttccccagtttaaacacatcaaagtagatggaccggaaaatttgacctaaaactaaaaggcttaaaatccatccacatccaagccatatgttaaagggggaatgttactgaagagcaattctacggttcttgatgaggtaacatgagataataaaaatttagtgtaaaatttgatacttaatggtatctcataatacctaggtatcaagaggtataaatttacaatataaaaagtagtaccttgtatattttctgaccgtaaaatagctcgttaatgaatggtgtcccgttcgaatagtacaataccatttggatatcacatcttatgtcacactggcacagactaatacccaacggtactagatttggtatctcatcgatacccgatgataccctacggaatcagacatgatacctaagcaccaacctagctaatacttgtatatgccgatagtccatcagacatcggtactagagagaaaacgaggccagaagtgaaagttgaaaaataatgatgtgctctaagtctaaagagcatagaagaacacataagaagctcattttaaattttttaaaaaactatcatagacgaacgtgttggttaattacaaaactatcgtgaagatggggctcatccatccaaccgtatccagtgttacggacaagaatgcggcgcatcgtctgcgagtggatccaagtgagcgaggggaggagtgactgagggatgaggatgtttcatgttaggcctctaaaatagtaaaagttttactgttttagagcactttttgttaaaataaatctaaacactagtagcaaaagttggcaatttgacatttgttatttgggagtcttatagagtagcaaattttgcaaaaaagtgcgttggaacttggaagccatgctttctctgtctttactagtaaaatggtaaagctttaccatgcatctaaataccatctagcaaaactttaataccaaatcttttaccaccaaaacttttaaaaaaaattaccacagcaaattgatctaaacggctcttagtgatgatatgagctcgtcggctccaattaggatcaggtccacctccatagagcacgacctcgtcggctgcaaaatgaacaagatagatggagttgtgtttagactgctccacaacttcactcaaatcccaactcttgaaactaaatttagaaggaataagtttattttagatcccttaacttgacaacgagttcaatttttgtcctgacacgaaataccaaaaacaatggatcattcaatcgtctaaaccgatgcaaataaggtcccaaggtggtttggatggtagttccgactgacgtaacgcctacgtgctggtttgacttggtccttattctacgtggtggtgacgtggcattagaaacaaaataaaaaataaaactaaaataaaaatatgggacccatgtgtcagtcagacaaaatataaaaaagaaatagtgggctatctccaaggacgtcggtgtgtcagtggctcagcgccgccttctcccctctctctcccagccatcctcatccctccgcaagtttcctcgccgatcggctaccgccgctgccaccttcctgcagccgccgcaatcaacaaccacggagaccaacagaagagaggacttttggagctctaccaaacgggtcctatatgggctaaatcaccagctattaccaagacatgggctgaaatgtggcccatgtaaaatgcggctcatagagtgcggacccacaaacctctgggcttctgcagagtaaagaccgaaatttctcaaggcaggcctaaccgtttcggcacaaaccttcttctccatgaatccctcccagtccaccaggagcccaaaataaaatccccaataaataggaataagttcatctaaggtctcttaacttgtcaaagaatccgattttcgtcatcaaccgcaaaaccaatacaacgggtccctcaactatcaaaacaggtgcaaactaggtcccttggcggtttcgatggcagttttggctcacgtggcgcatacgtggctaatttgactcagtatcgatctgacgtggcgcttacgtggcaatttgatccgaaaaataataaaattcggggactcacatgtcagtttcacagaaaaaataaaaaaaatggtgggacccacgtgggccccacatgtcaatctcaccctcccttcttcctcctctctctcctcgtctccttctcttcatctctatcccctttcctctctcttctctgtccagcaacaccaccaccgactccgccgccgctcccgccaccgccacatccctcgccgccgcttcgcctcctagctcccttcttgcctctcagcggtcgtctccgccgtgggaggccgtggcgggtggcagcgggagcgggaggccgtctccgccgcagccacctcgacaccgaggatctccgggcggcacgccggggctgcacggcctgcctatggagatgacgacgggggagatggaggccgccatcgtcgccctccctgcgaagaaggaggcgctgcgggaggccccttcctcttcccctcgccggttgccgctgcaggcgctgccgccgttgagccgactcgattaattatacttccattccaatattctatggaagcaagcttaatttgcaaaagtgaagtgaagctgagcatagcatagcagagcatccagctcgctcagatggccttgaggaggtcggcggcggcggcgatgtcctggccgtcagcaagggtgacgatgttgggggactctatggccacgacgtcctccgtggtaaacccgtcctcgtcgcagaggagctcttcgctgccggcggcgaccatccccggcaggatcaccgtcctgtgcagccccgggaggaggcgctccctgtcggtatcgcccttctcgccgacgagcaccgccaccttggataggtcgatgccccactgtatcgacaggtacctgaaagattaatgcgtcgaacggttagagacgacgagatggtgatgaggtggtggtggtggtggactggtggtgatggtggcgtcgctggcggcggcgtctcacctgatcgcgcatggccgggagagagggatgatgttgaggcacatgcacgcgcgcgtgtagacgaggtttctttggaagccgcgcatccgcagcacctgcttgatccaatcgatttcttcaagaagtgttgtcatcaaatggtgttcgtggcaacggtggtgctctgcttaacttggatgtgtccttggcgacgtaggcgtggcagtgcacggagcaggcggcggcgtcgacggcgaggtccgcctcctgtgcgccatcggccttcccgagcctcggcacggcggacctcacgtggtcctctccccccggagagacagagagaggatagagatgagaggggagaaagaggatgacatatggggcccacatgggtcccaccattattattattatttttgtgtgtgaaactgacatgtgggtcccactggttttattatttttctggagcaaattgccacgtaagcgcacgtcagatcgagaccgagtcaaattagccacataggcgccacgtcagccaaaaccgctataaaaactgccgagagacgtaatctgcaccggttttgatagttgagggatccgttgtatctggttttgcggttgaaggacgaaaatcggattcgttgacaagttaagggaccttagatgaacttattcccaataaatatcaacgcgcctttcggcccaaatcttcttctccaagacacagcgcgagccattatcttacgtcacggcccaaacgccgaggcggtggtggtcaagtcgcaagggggccgaaggggagaggaggatccaaaccccaaaccccccccgatccccacgacgcgccgccgccccgcaccgagatggccgccggggacgccgccagggcgccaccggccgcggaggcgcagtcgctggtggagtccttctgcggcgtcacctccgcgacgccccaggaggccgccttcttcctcgagagccacaactgggccctcgagtccgccgtccgctccttctacgactccgccgacggcgacgcctccgccgccgccgccgacgcggccgatccgcccccccgccagcccccgcctcccccgcccgccagcgatggcgccgactccgacgacgaggactacgtcgtcggcggcggcgacgaggatcaggacgacgaggactacgtcggggatggggatggggacggggagggggacgatgatgacgacgaggacgccgccctcgccgcggaggaggctgcggcgtcggacgagcggaggaggccgctgaagaggctgaagaggggccaaaacgcgcgtggcgggagcggcagcgggaaggggaatgtgcggacgctctccgatctcggcggtggcaaggacagcgcggggtccgaggactcggaggacgacgagtataagccgccgcaggaattatacaccggaggcgaaaagaggtgagctctactcgccttgtatcttagggttcttcgatttcatttctagctagattgttttttggatgaacgcatttgtagggttttaggttgttttgcttagggtttggctagaatttgtaagatacttgttggtttgcattgaacgaggtcaggggtgctggattggatgcaacaattgtcaaatgtgttcaaaatgatgggagctatcatgcttcctgagtatgaaccgtgctaagtctgcattatatgcctagatgttggccctttagagtacctgatttttccctattaataataatagccacagattgttgatccatgtaatccttgtgataataatagtctttgtgtagactaggatttatgatgttgtgttgcaacttatgcttggcagctctgcacttttagagacacatgagttggttgtgagtttagccacgtgtaaggttctgtgatgttcatttcatttctagctagattattttgggtgaacaaatttgtagggttttaggttgctttacttaggcctttgctaaattttgtaagattggcttgcccgctgaaggaggacaggggtgctggattggatgcaacaattatcaaatgtgttttaaatgattgaacctttcaatatggagagtgctaagtctgcattatatgcccagatgttggcccttgtagtccctgattttcccctttgcattattagccacaaattgttgatctatgttgcagtccttgtgataatgatatggtgtccttgtgtagaccaggatttatatgttatgttacaatttatgctttgcaagttggcatttctggagcacatgagttgattgtgaactgtgagagaagtggttcattaatgacctgtatcttgagtttgtagtttgtactcacatgtgttgaaaattttgagactatagctcattcaatgcagcatcaaaatgcagtgcttcaccttagctactagtataggatattcacatggcaaaggattagttaaatctgatggcatccaacttaaatgtgacaattgcagttttctggtttctagttgtagttccaaatcaaatcacgccttctcttgttactctctccattgggg

SEQ ID NO: 82218 - DNA, 6706 bp, Oryza sativa
aagttttaaatagaatctaacatgaggtagaaacttatgaaaactttcctttgatattttatctctcctctaattcttatgttttttctgcggttcaattaaacgattattcttgtgttttttctatgtttgtaaatttttattttacgcttatattcctgttaaaatcatttttatatctattcctaggtttttttttcaaacatacaattcaaagaggccttgagcctctagaagcaatgattggactacaggggctttattgtagagtattggtaactacgagaggtgaagtgataaaagtgggttttcgggggagagcacgggtggtacagtggaagggcgcggtgttggtggaccagagctgacgtggcgattcggtgggacgtgattgggccaggatgcaggttggtggcccacttgtcagtgaggggatagggctgggtggcgatggcctcggcgttggtggacgaggtgtatgggccgggggcgtgtggagtggatagggttggagtacggcccacagatctggtgcttgtcagagtccgtgtggcccatgctgtggtcgcttggctggaggcaggcagaggatgggcactgggcatggattctttgcaggctagcagagagagatgctttgctctagggagatagagccagcttttcccaatctcggtgaaaatgcaaagccttgtttaattctaacttttttttctttcaaacttttaattttcccgtcacatcgaacttttccacacatgcaaactttcaacttttccatcacatcgttctaatttattcaaactttcaattttaaggtggaactaaacacagcccaagatgaaatttcatggattttaaacgaaacttttatatacgttggaactaaggctccattgtttcacttattgatggaataagcgatataaaataatttgtgaataaaacttgtatatacgtgttcttattgatctaaaagtaaaggctgaaaaataaactacgatgaaaaaatcccaaaatcaattccaaattttaggttgaaaattcaaattttggcttataagcataagcataagccaaaatataggcatttaatgatacttttcgggatctaacagtaaagttggaggagaaaactgagaggtttgatggaactctctgaattccggtcgatgaaattataggtgcgacgagcacattagaaacggtacgtgtatttgagtcaaattttgagccttgcttagcacccctaggatgttttatactcctcccatccaaaaaaatataagggattttggttaatacttttttctaataacaaatgacactatcggtaatcactcttcattcgctccttccccttgcatcaatttgacccaatgacaacggttattgtgttttccttacagacttcttactaacaagaatcattagtaatctcgacagtatggttgaataactaaaagtcataaaaagtcaaaattcaaccacaatgtgacacctagcgtttgtaggaagtttgtaaaaaaaaagtatgtgtatcatttcgctattgtgttatcatgcctaatcaataaacagatcctatggtttgccatggtttttagctaactatggcatactaatagttgtttttttttttccgatgccctacaaatatgctggtactttccttcagcaagtataagcgccctcgagagttacactgactcatctagtattgatttggtaggttttggttatagtccaaatatttacaatgtactattcaaatggctagaaaattaagtaggataaattttggcttcaacccaaaacgggctaatgagtccaagcagacactcaacgtgcataagagtttgcttactgttcatccattattcctattacaaattgatgtcagtcactggaagttgaacaagataccaggaaggtgcactatgatccaactcgaacacaaatccaacatctgacatgagtcccgttgatgtaagtatccatagcaatattatgacagtggtaggctttcattgtctgcttgttggtttattaccaaatattgaattttgaagcttaattttagagttgatcttgggttatttttctactatagtcattttttcaatattgacttttaaaccatgaattataaatacataaacagctttatcgatagattagcttttttttttcacttcgcttagtttttatacggcttagctctatggatcagagcgttgatagatcaaagaaaacgttggacgtgtttggatggtgctttggcttgagtactcttgcccagacatgtgcatctaaacacatgctactaaaatcggacgcttcttgaggcgtaaaccaaacaggcccgttgtctagatgggcctcaacatcgatccatccatgtagctatggcctagactacatctaaaattccggtccatgcatgtatatagatcaggattgaggccacctaaaccagggcggaattgtacataggttgaccgatatgtgctgaccgcttgatggacaaactgaggccgtgtttagttccaaaataattcttcaaactttcaacttttccatcacatcaaaactttcctacatacacaaacttccaacttttccatcacattgttccaatttcaactaaacttctaattttggtgtgaactaaacacagcctgaaactaactgtgggtgtcaagtctctgccactccacgacggcgcctcacgtcatcgtgaacacatacccgtgtacatgcatgcatggtgttcaacgtatggctcacctgtcacaccactcatcagttcacccgagcaccaacccatgcatggtgacgtcgccgctataaatatcggcaggtgcagtagctataggtacctatcctctgatatagacaaagaaaacatcgatgatgatgatgatgacgacgacgtcgtcaatgtcgttgttggtgtactccgccacgatgcgtcgtcgtggtgatggcggcggtggttggcgtcgacgtggtggaggcggcggtggtggttggcgttggtgtggtagaggcggcggcggtggcatcgccaaggtgcaacccaacgctgctgacaccctgcgcgggggcagcactgttcggggtgccggtaccgctggcatgttgcgcgtagctgagggcgtaggcggcgtgcctgtgcgcgtacgcgcggagccccaactacggcagatacatctgaagccccaagaccaggtgcctctttgttgtctgtggtctccctgtgccgtgctgcccctagacctcaattagcttgcatcggtcatgcccatggccatggctttggaactctagctagatcatggatggatgcacagtttaaattattgtgacatgaataaaatggttgtcatgttcagttcagtgatttatgatagcggtttcacaaaaccgacctgccggttcctactggttagcactagttgtttgcaataatttttatagctaactatgacacactgtttttttttggtcctactaaaatgttgatagcttttcttcaacaatgactcatctatagatttggtatgtgttggctacagtccaaacgttttacaatgtactgttcaggtgccccaaaaatttaggtaggacaaatttttgttttgaccgaagacagcctaatgagtccaagcagccactcaacatgcatacgagttcgcttagtatatatctaatccattatacctgttagtcactattgtcactcgttgaaggttgaataatatatcagcaaatcgcactatgatccaattgtagcatgacatgggtcttcatcgtttgctcgttggcttatcacccataaccaaaaaatgaatttagaaatttaattttgaagttgatttggataattttttttcacctattattttttagcattgacttttaaagcatgaataataaataggagtatataagacgttgtattaaattctttttgacttggcttggttttactacttctcattagccttatctccacgggtcagaacattgatagatcaaggaaaaccttgtctggatggacctcaaccttgatccatccatgtatctgggactacaagacaacagaaatcccagcccatacatgtagataggccggattggcgccatctaaatagagaaaactaccgcccggagattgcatctccgatgcaatgtaaggatgcatgcatttattttccaaactatttatccaattgtcattctaattatatcgttatattcattataattatttttttacaacagtatctcacacgattatattttaattgaaaaattacatatgtttcaaacattaagttttgatgtttcacgtgtgagaggtaaatgttttagctagaattcgaatatgtggcacattttaagttttttatactatgcatattgttttagtgctgcacacgaaatcaataaatatattgtgatgtttcattactttatttgtgaatgttgcgcatagtgttatttagatgtttcagcaagtataatatgtgcaatatttaccaagaactagtgaaacattagaaaaatatttattgaaacatgtgtaacactaagaagagttagaaaaaagtcatcagaatatactcatatagtcacgtgagatcttgttacgaagatttaattgtaatgaatctaacaacataatttgttcatagtttggataaaattataggagagaaaatgaccatttgaattttcaatcaatatgaacaattttactaaatctgactttatatacctaccatacacccacccctactattttctaggctaggaagcgtgcgatcttttcctttcacccggacaactcatgagaagcaattttccatctaaatcgggccgaaatggtacacagtctggccatgcaccgcttaatggaaaagtttgaaacgaattgaatggctcctcgtgtcatcgtggacacgtaccctcgtgcatgcgcgcatggtgttcaacgcctagctcagctcaccgctctgttcgcgtaccactataaataccggcagctaggtagcaagctattgatagagagaaacacaaaggcatcaatgatgatggggaagtcgtcaccatcaacgtcgccggtgtacgccgttgccgccgcgctgctgcttgtgtacttgatggtggccatgggcgccggcgtggtggaggcggcggtggtgccaccgtcgaggtgcaacccgacgctgctgacgccgtgcgcggggccggcgctgtttggggggccggtgccgccggcatgctgtgcacagctgcgggcacaggcggcgtgcctatgcgcgtacgcacggagccccaattatggtagctacattaggagccccaacgctaggcgtctcttcgccgtctgcggccttcccatgccgcagtgctcttagatcttaattagcttgcttcgatcacacccatggctatggctttggagctctagcatcatgtgcacagtgtaaaatgttgtggcatgaataaaatggttgtcatgtttagttcagtgattccatgatatcaatcccaaggtacagtagttaattactttgctaatcaatttgtttgtcatgatgtgatgatcgaacggtggaggattattcttgcatacagtgcgcggggttttctttcgtttgtttgcgtcgttgttctttcatggtttcttctccctctgattttgttgtagaaaggcgagctctttagtacactagagatcatccctaataacggcaaactttcacgtgaaacggtttttcagggaaacaatttttcgtttttgaaaatgaagtcaatgtcacgcaaaccggaataggtgattagcttgcaaagtgcaatcagttaagtagtattaactattttataaacataaaaaagaatatagattttttttccacaaaatacaccgagtagcggtttaggaagcatgctaaaaataaacaagaaaaaagccaaacacaaaatctgataagaagacaccatttaaccgtcatcgcacaaaacaatgtttattatagaggaaaacacaacacagttatttttggatggtaattaattgtctgctttctttttttctttcaaatttcaaaaattaattgtcttctgttttgtcatgtatgaattacaatgatgtgtttgatgtatattttatagaactctagttttttttgtagcatttagtttccttctatgaatataatgttttgcataaccgttttgttttggaaaaaacaactgaaagtgatatgttgattatataattccatattgattttatagttaggcaaattgttgtagtgtgcatcccacatataagcctagttgccagatatgagctcagcaatgctctaaagcagttgttttctcttctttttctttttataaaaaaatggttgtttggatgttacgcagaaaaaaagagagttttggacatatgaagagaaaaccataagataaaagctaatgtttgttttcctccaaaatcctgaaggaatggttcattcaataggattttcaaaggtatctttagggttaattcttttgcatcaaatccttagaatttaaatcctccaaaagtcctaaaaagagccccttagaattcaaatcctccaaagtcctaagaagagcccttgattgagtcaacatcttgttatatattaatatatatattcta

SEQ ID NO: 82219 - DNA, 5725 bp, Oryza sativa
aggactatatgagcactggtgctctaccaatccattggtcaaagttagagttgcaatatatatttcctgttcatagaatgctgcacctgtacttttaattcatacaataatctgaagcctcatcacttttttttattagctttagtatattcatgtacttggaagtactaaaagtttgtcccttgtcatttgccaagcagttctttccaaagatcctacatattgtaaaagtgctccaaggatctaccattgcttgggatagaagattttgagtatcttgggcattcagcattctgccctacgtcgccctgtcgatgcatggaacgatggagaagaggcaaagtctagtggccaactagaaaggtttccggtgaccaatgccagaaccttgggtttcacctccctttgatctaaagtatgccattggtaacccccacatgtaccttaaaccatattgatgcatcagactcccaggtgataataaactaaaaattacatgtggtgtggggtgaatcagacgccctcggtacacaagagcgtacccgtgtaccatgttctacccctgttgtcggtagcaccaagggaggcttcggctttgatgcacggtgaatgcattttccagtgaattggttgaaatttgatctattttcagagaacacattattcaagcatagactaacttgagggttcctcttttcaggtgtgatcacggcaggtgactcgtaaagcatgggcaggatgccagcttgagctttggtgctgctgctggagggcattggccctagaacccctgctcctggtgtgcggattcttgctgtacctggaatgtactaatctcagacagtcagctcggtcttccggattcaagctgtaccagctgcgtgcccgctcttgccttcacaactcacgttgcgcgaaaaggtttggagagctgaactgtttctcttgcgtctgtaagtctgttcacctgaagtctattagttcatatgcactagtcaaattggtagctgtttttaaacatcaaggtcatgaggtcgtttgaaaacataagcagatttgaacttcccactaatagaatttttgtatcgttatgatgcagttgtgtgtgttggatttcgatgctgaagatagcaagttggcaatttcatcgtcaacttgatgctgtttcacatgttttggtgcaaacagttgcgggctgtttcgcacaccacattcatgcgacacagtacaagcacagggtatgcgcccaaatgcccaatacaatctgggaattttgtcggtggattataactttctagtggcgaggacaatcgtacaaacatctgttgtctataatttttcacaatttatttacataatgttgtacacttgtgtagtactagcttggctactcgtcgctttctgttaacacgcttttcaaacggttaaatggtgcattttacatgaaaactttatatatataagttgtttaaaaaagtataataaatgtattcatcaaatttttatatattaatacttaatcctatgttaattaatcatgtttctcgttttacgtacggctaattagctgtttcaatcatctaaaaagaacgcagcctaaacgcccatgcgttgcaaccggaattaaaaaaagaaccttactgtacactttaaagcctcaaaaattaaagtaaaactattttcattgtaatatatatatcatcatttttatttcactttaaaataggtttttcttatttgatgacttgacactgggaagagacaaaagttcacctagctcattgtttggaggaccaacatgatagtggtggtggcagattcaccccctcaccactaccaatcaaggttgtcaggatcggaatactagatagtatcgttttgctcaaagtaatatcgtatcataggatcatatcgtagtatcgggatactataagattttctttttttaagtttaattaatatttatattaattatatatagccattctatataaaaaaacatagtaaagatatatgtcatgcaaatagagacatttatcaagagaaacctcgttggttttgatatatttaactgatttttatataaatttgagcatatttatttacattattttcaaaccatattattttatataatatttatagtatcgtagggatcgtagaatcgggatacacctaagattttgtaggatcgtgtagtaatgaatagtaggatcgggatactatgacaattaggatactaggtgggatcagtatcgttttggcttggtatgatcataatatcgtaagatactaagatacaaatcgggatactgataaccttgctaccaatagggtgttttaaagaggtgttggggaaattttggttcgtaacacagttgggacttcgaatttgtaaaataccataaaaacttccccgctttgctggatacgataagacatggtaatttctctagaaaaatatgtaccactatcgtctcaactcttagtctttcggcctactgaaaaaacggtaatttgttggtataatggtattattctgtgacttttagtcatatttaaatttaaatttgtagtaataggatgagttacatctcatattaggtttatttattttgaaatattttttcctatgcctataaagcttttagccttctagttcaatatataatccctttccagtctttctatctcaaacatcacaaagataaaaaccgagaaataccaagacgataataacaatcttcaaggctgtgtagtctacacgctgtgctgaaaaatcaggtaggagagcgtcttgtacgtgcgtgcggccgcgcgagtgtgcgtgcgacacgcgcgcgtcgcgcttttggacttcgatgaggaccacgcgacgcgacgggtccgtggcggtggcgaggccgtcgcgctgcggttcccgatttcgggggggacccagcgagctctcgctctctctcgcgcatgggacggggcgctgggcgaacgtgcgcagcggcctcgggctccggcgaccgcatcatttggtaggccggggagcacgagggccgcccccgcaccccggcgtgccatccaaccccgcgagcgcgacacattttctgccttgaatcaccttccaaagcactactactcctagtaacgaccctctcgcatatcgcactaccagtaccacatgtgttccctacacacgccaaagatgcaagtgacattgggcccttggaacatacaagttcacgactattctactgggaacaagactattttgtatttcgaatcgcatccctagctcaactgcaaaaccggatataacgcctctcctaacttcaaaaattggtgcaaatatactacaaaggcaggattgggcccggttatggctcacaagacatccgacgcggcgtattgattgggtcttcatcccatgtcagtgaaaagaataaaaaacggtaggccccacatgtcagggactatctccttcctctggcctctcccctctccttgttatctcaaggcggcaaccagcaaggagatgggcgacgacgtctcctctctatgagcagtgcaggcgggggtgcctcgtcgggaggcaacgacccgatctggagtagttcctgactgctcctacccccgttcccccgtgagctcgatgaggcccacaccgtctgctgcgcctgcaacctcaagctcgagatccatagtcgtcgtcgcatcttcgagctcaatgacaccgtcgatgcttgcgccgctcgagagggaggacacggcacaccacccacgccactcccttccatctttgttgcgggagcccaagctccatctacaccaccgcaaagctcgaaggccacgaggttgttgcagtcaccgctcgggtaagaggacaccacggccagcgtgaccccaagctctcctattctcttgctctagctcccctccatctctgttgcaggaacctgagctccgtctgtgccaccacgagctcgtcggccactgggctgctacggccaccgctcgggagagaggagaccacggccggcgggaccccgagctctctcgtcgcgaaagagggccaagcctagcggcgacagtcctcttgctccagttcctcgtcatctttgtcgtgggagcctgagcattgtctgtgccacgacaagctcatcagccactgggctgttatggccaccgctcgggagagagaagaccatgaccgacaggaccccaagctctcccgtcacgaaggagggccaagcctagcggcagtagtcctcttgctccagctccttgccatctccatcgcaggagcccaagctctgtctgcgtcaccgcgagctcgccgaccattaggctactgtggccactacaccaaccctcgacgtcgcctcaacgacctgtcgtctctctgtctcagtttctcttctagatctaatgccgtcgttgcctagggtttgttcggttgaccaaccggattcacctcctagcctcgcctccgaccttcgactccttccacatcatcgttgacttctgcatcccatcgttggccaccgggtccccgccactcctgatagcggcccagactcgtgccaattcaccacaactggtcatgtcctatggcctcttgcctccatggttgcatatgaggagagaggaagaggtggaggaaggataaaagaaatgtaactcgcatatgggcccactatatatattttgccatatttcactgacatttaaggtcatgcgctaactcagcgagtctaaccgcagtcaacctaccacgtcagcaggaactgctttccaaaccatcgaaggagcatatttgcaccggtttttgaaattgggagaggtgttaatatatagttttgtggttgagggatgcgattcgatcaagggttagagatgcaaaatagacttattccattctactgaatgcatacagccggccgtggcgagaggccttggtttgaacctgggctatcactataaatcacattcaggcctcaatcctcagctttgcccttttcccttcctagtttcctagtctaggcctcaatcatacggaacccggtctagcagtcctggaccctggtcagatttgggccgaaaaacagttataacagcaccacgagtgtatgaaaatgtattaaccgattaccatccattacccataactcacgagtgctaatggttactcacaaataagtactaatatttgcatatcctttcttactataaaattataacccactaattctaaaactcaacatgcaaacatgccacctcatcatccactaacaataattacatgcaaaactaatacaagcatgcaacatcatctataattcattgaatttacatatcaacatctaatcatcctccttcacattatttttcacagtatttttaacatgtatatatccaatatttttataatccttaacatatattcatgcatataatcaaagtgcgggatatcatgtatatttcatctacaatctcatacatagtctattaaatgtatttatctcagaacatagtctgtcaaactaattttatttgttgttaataactaatataatttttatttttatctcgattattaaaaatttttaaaagttacttaggaatttccgcagcaaagcgtggggaatcacatagttcaccagattgtaagtacttaacacggctacgcagaaactgaatagtattaaaagggcttcactgaagaaaggtgatg

SEQ ID NO: 82220 - DNA, 5306 bp, Oryza sativa
ggatttattgcgctagatgaatttggttgtaggtcagatgcaattaaatgcaaaaatttgtgccggatattaatacttgacttagcggcataataatcaaacatctaattgaatttttttctcaggcacaagtgacaaccaaacaagcacaggctcaggctgcctgaccaggcaacctacattataaacttgaatgctactcaagcttacaaatttctcaggcacggaggtgagggcaccaaccaaacaggctcctaatccccttgggctatttttaccgtggtttttgcacacgtggatgacatgtcggatgccacatcagcccttcgcctgagcttgatgaaattcaagttcatttgctagaacctgtctgagtgttgcttaaatcaatttaatacaaattttagacagatttcacagaaaatttacacatatcaaattcctgaacctgtctcaatgttgcttagaccagccaaatacatgttgacagacatatcaattgagtacacaacgaaagtttattgccatcacatacataacatagatatagattgcacccataaggatctaccattgtatctaaaaagttgaaggaaaccataagcagatttgtccactaagagtgtgtttggttcctggtcaagattggatgggatacggcggtccatattttgctggatatggcggtccagttttttgtttggttgtgtgaatatgacgatccaattttttgtttggttgtagggacaaaggtagatttggtgatccaattttttgtttggttggaggaagtatggtggatttgtaggtgtggtcacctctcacttgagatggtgaatataccccatcaaattaatacataatacacattccattataaatacacactccattataaatacatattccattataaatacacatagaaaaaataaaaaagaaaaagaaaaaagaaaaaaaaaagcagcgccggatctgggctcgccgacgccgttggcagcctcctcccgtcggcttcctcccgccgccggccacctcctcccaccgccgcggctcgcctcctcccgccgctgccttcctctctcgtcacccacgccggccgccgagctcgtcgcctctctcgccggccgccgagctcgtcgcccttctcgccggccgccgtgctcgtcgcctcgctcgcgtcgtggtggtgaggggtgacgcgagtcacgcaactcgcttgcccggctcgcccgagcctcgggcggttgcatccggccaaatcagccagatccctctatccagcatctagagggaatattcccctctgggccgccctatcccactctcgcccagcatccaaacaccctccaaaaagcggcggccatgtcctatctgggtatatcctaccaaccaaacacaccataagccacaatgcaactatcaacaatactaatccagcaataattgacaacagaaattcccttccctcttctaattcaatacattaagtttacaagctgaatcatctttctccttgagttttcttgtccaatcagccacatctctattgcacacaccattgtgcacaacctttagctcatctcttgcactgacaagacatgctctcatctctgagttctccttcaaaccatgaacaacattgtgcaaatcatttaacacctaccttaaataaggtgtagtttctggctcataccatctccagaatgcacagcaaccattccgctcaaatagaagaaaaatcgtacaatattatatccatttaaacaacaaatgcattatattaatattttaccaactcacgcgagctctcgcacatgtcagatacctcctagatggattattcccactcaagaaatccatctgaccgtcattgtacccacacttgcatagaatagccggagaataatcaaattgcccctccctttgtcgaattggaggtggattgctcccgccttgactggatttgctgtcatttccagaactagtcatgtccttcgatctgcttgttccaccggctgcagattccacctgctcatcgtcgcttcttccttgatcagccatctctatagcgtgtgtggcttccatcggcaaccgtcaccgctcgtgagaaggttaggccaaaacaacccagcaaatcctacgcgctgacgtagtgaagggctgatgtggcatttgacatgtcatccatgtgtgcaaaaaccacggtaaaaaacagctcgaagggttaagtgcccggtatcgacagttggaggatgaattatacccggttccgtagttcgtggttgcatttagataaccataaaagttcgagggtgtaaaatggacttctcccctgtaagcctaacccatacagaaagcttaattcaagcttcaaattaaaggggttaaagaatacaaaaccaaaaggagtttttctggcttttttgcaacctgatccagcgtaacacccgaaaaattgcctactcgtcgacggactctcacgacccgcgcgcgccacgcaagaatcaaagatccccctccagcttcaaacacgctagccgacgccgccgccgccgcggcgacggcgcgagcgacgcctcgtcgcccttggagaggcctcgacagcgcgcggcgcgggcgcgccacaagctccgctcggcttagccgtcgccgccgcgaagcgaaggccgggggccctcgccgcgctctcctcggcattccgcgcacgccacctgttcgacccaatgcgcagctagaccggctagagattaaggttgcgcgatcccatgtccttcctggcgcccggacgcggccgcctcctccgggtgctccccacaaggcggcaccgtcttccgcctccccaaggtacgccaccttctctcaccaacgcgtcggttccccgtcacggcctcacggggtaagaatgccactaacgatggtgttctgttgttgtttctgttcctggagggtcaggaggctacgcggcgtgcttccggcggtgcaaggcgcacttcttgctcgatggagtcgaggatgcggtggagggagccgccgagccgcagcagccaccggtgtcacttgcgaagagcctggcctctctcaccgaggagtcggccgtggccgctcagaggcagaggaagcccctgctgcggatggagcggaagaggctggctgagctcaggatcaagaagagggtcaaggcgcagtatttgaacggcaagtttcatgatctcatggctaacgtggtggctagcactgatactttggaggatgcttatgacattgttcggctcaattcaaatattgacatgtcatcggtgagggatgatgtttgctttgctacattggcggagctgctcaggactggtgagttcgatgtcagagcgaatgtttatgcggtggttgcaaagaggcgagatggagggaggcttgttctcccacggttgaacttgagaattattcaggaagcagtaagggtggtgcttgaggttgtttacagaccccatttctcaaagatatcacatggctgtcggagcggccgagggcatcagtcggctctgaggttcatttccaatgaaattgggattccagattggtgctttactatccccatgcataaagaagtagatagaaatgttctctctaagattatctgtctaatacaggaaaagatcgatgacaatcagttagttacattcatgcaacacatgtttgatgcagaggtgatcaatttggtatttggaggatttcctaaaggccatgggcttcctcaagaaggagtacttgcgccaatcctaatgaacatatacctcgacagttttgaccacgaggtgttcaggatttgcatgaggcatgaaggccttggttcagaggcagcagatgtttcagacaaccaggagtcaaatttgcgccactggtttcgaagtcaaatttcaggcttgaaggatagggaggaaaacagtgacaatcaaacagactatccactaaaaacaaaactatatgcttgtagatacatggacgagatctttgttgcagttgttggatccagagatattgcagaagatataaaatcggaaatgattacttacttaagaaaaacactattcttggaagttgatgacaggttgtatcttatgccggtcagaagtaattcccggggcttacagtttgctggctctatggtaagagttacaacaaaggaaagtgctgcactgaaagctgtgcataagctgaaggaaaaggttcatttatttgcttctcagaagcaagagatatgggatgctatgaatcttaggttaggaaagaagtggttggcatatggtttgagaagagtaaaggagtctgagatcaagtcacttggtcttagcacgcctttgttggatcacattgcacagtttaggaaagactgtatgaagacagatcattggttcaaaactttactcaaggtatggatgcaggatatcaatgctaaacgcgaagctgatgagagcatactcctgtcaaaatacattgctgaaccatcacttccgcaggacctcaaagacgcgttcaacaactttcagaagcaagccaaagattacatctcatcagaaactgctgccacagaagcattattgtccagcttaaagaataaagaatcagctattacctgcactgatggtgctgtcattaagatccatgctcctattagctatatccataagtgccttaatcgttatggtctaattaatcttgaaggtttccctaagcacgtttcagcccttgttttgcaagacgatgagctaatcataagttggtttgcaggaataattcaacgttggatgagatggttctcagaggttgacaattttaaagaacttaagcttatgttggttgaatgtgtcaggaaatcctgcatcaggacattatcggcaaagtaccgaatgtatgagaaaataacagaaaagcgatttgaacttgatgattatggtattccaatggccgaggactttgaggcaataatggcacctttagaatctagttcgtcggtttgcactgatgaagctctgatgtatggcatttctagtagtggattgtttgtgctcaccctctcaagagttagagttccttctcggcaatttgactgttttgtcatgggatgccaatctgcatcgctgagtatgtatgttcttcatgtcaaagagagacagcggtttccaggatttaggacaggtttctcatcatcaattcatggcagtttggatggtagacgggttgggttgtgcactcaacatgttaaggatttaaatctaggacacatctcccttcagtcgggctgcaggaat

SEQ ID NO: 82221 - DNA, 919 bp, Oryza sativa
ttgtattgaatatttataggcttacaaataatgaaaaacatttgttggacacttggacttcactagaattttctcttttttgtactacttttatcttttgttttgagcgtgtttcatcggaggaaatctgaaatacatagagcgtaacctttgccccctcctctatccccattcttctcttatgtttcatgaaactcttacggttgtttgaaataaacctctgaactacaaaaccgggtataatacacccccaactatcaatactgaacatctagagcttgtttggttgctgccctgacagcaagttgctggaagttcccagcaagttctctggccggagacatgcctggcagcaagttgctggaagttcccagcaagttccctggccggagacatgcctgagattaatttgtgagtgtttggttgctaacctgaggctccttccacctcgcctggcctgatgtaactcaggcgcggaattagcctgagccaggcgaccgatgggctccaggcgcagcagcgtgctacacattagcaccataatcccctcatccccgccgtgataactccacacgaagccgccgaggccgccgccgttgccgtcgcgcgaagccatcgcagccacacgaagacccctccggagtgctgcgtcatgcttcacatgcagatgctcttctatgatggatgcatggattttgcaattctattctgatggatgcgacatggatctggggatctctttgctcctgttcttctctcttttttctcttcttgatgatttccttgttgatcctggtgtctacgcaaagcagcgccgccgccgtgcggaggcatcgtgtcgccaggcaaggatttcttccgcccgtggttgagtaagcagatcgactttgcaatctgggtgcaatcgggctgcaggaat

SEQ ID NO: 82222 - DNA, 2723 bp, Oryza sativa
attcctgcagccctatatcctctctctctgtatatatatattccacttcgatatgatccatatgtcagtggcacagtaacccttatattctaatcctaactacacttatctgagaatgccacttatttatgataggaaagagttacagtaattttttcttttgaagcttaatccctcttttaatcaacatcattaaccttttaatgactaattatactatgccacccctctgctgccgttctcgccgtctcccttttcttctccgatcgccgcagcttccgcgaagaatccgccattaaaaaaaaaaacccgagctctcctcgccccggcgaacgcagcaccatctccagcgagcagcagcagcagcgcgctcttcctccctgcactgcccgtgcccggcggcgaggagggagggggggagggagggatgggggcggtggcgtcgacggtggcggcgcgcttcgccttcttcccgccggccccgccgtcgtacggcgtggagccgccgccgtcgccgtcgccggcggccgcggcggaggacggggcggtggtggagctcagcggggtgccgcggcgggccggggtggaggcgcggcggctgccgacggggcggggcacggaggtggtggccatgtacgtgcgccagcccggggcgcgcctcacgctgctctactcccacggcaacgccgccgacctcggccagatgtacgagctcttcgtcgagctcagctcccacctcaacgtcaacctcatggggtattacgccacgtcactctctctctctctctctctctctctctctctctctctctctctctctcggattggattgctttggaacgtgaccctcttctttatcatttgcgttatgatgcatactagttgcttaattcaggcgaaagtgtggatctctgaagtatagtttgtaggaagttcatgatcatttgattgtgcgtgtttaggatcttgtgatggatgggtagcaatgttttggtctccactactgttctcagttttgcatttcagtttaggagttatatttcaggtatagtgccattggccttattttagttcgagggaaaaatgtgttatgcggtgctctttactttttactaatttgatttgagtgcctggcgaatttgatggaatcatggaagatttcataatgttcaaggccgtgattgcgattggttttgtattcgcagaaggtggcgattgctactgttgctattcatagttgtctcgaagtgtattgggttatgaagtgtggtggaagattcatgtgttgttgcatcagtgggaatgtctgacacggcagttgttatccggctgtgtggctcaagaaaagtgaggctattgtggtgaataattgatagatttgattgaagttgatgattagtttatgtactaagctttagagctgactggaaagtttggaggttactgtgctgtcctagcaataggtggggatgtttgcgtcatatcactagtactaggctgttagtaccctgtgatctggtgttaaatggcaatgggtgttatggaactggtagattagatatttagatatagtggaacccaatgtagttgccacatttgataaaaataacacctcattggcttatatcaaaggattggtaagatgacgagttgtttttatattctgatattttttgagaattgtttattgatgtatgtgccttgtggtgtatttggtgatgtgcatatttgtatatgatttttattggacaccgatactgtataccattctgttttttttatacagaagttaatcgcctaaataaattaagtttaaattatggatcttatcgtattgcaagttgtgtgccaacgttggtcataaatcaggacattttaagactatttgcacccatttagagggagggtagaacatagtttgattcttaactcttctatttaccagtttttcgatagaaatacatgttctatgagagggttctttgatgaacgttctgttggcctgcttccattaaatctgttgccctttggctcttctcaattaaagtctgggtttttatttctggtttaggtgtagtagtgaataaaaaatactggaaatattgtctatagctcccttccatacttacattttaatacagtactaggtttttagtgaaggaagtaggcattgatcccatgactacgttcaatggataggctggcagatgatctgtttgttggatagtcattgggtggttacctggatctaacacagatacgttatagccaatttctgatcttatcatgttgatcgattgctgtgttctgcattcccattcaactactcatattggtcatttgtttttagtaatatgaaaagtttatcaccaagtttttttgttatcctggtagggacctggttgtggtctattatgcttttactttgacatgatggcaattacagtttgttgattttgatgatcattcagtatccgcatagcttgcttaaatcactgaatcatgattatgatataagcttcatttgatatttctctagtcatgattgtttcaatgtgataagcctcactgatatcttaacataaagtaacttcatatttatatttttacagttacgattattccggttatgggcaatcatcagggaaggtataaaatcatcctttcttaggaaagtgtttttccttccttttttacccatttcgttttccttttagtgaatt

SEQ ID NO: 82223 - DNA, 6887 bp, Oryza sativa
cgcgacatacgtatttttgtagttataatataaccacgtctcacttatctttatgttacatggaagttacagtataagtacattacaattagactataatcatatttaaaagtttctacacttaaaaggaacttgtaatgtttggttagatggtccctcaaatgggatgccccataattatcaaaatttttagtgttagactgcttaaaatgtcagaagcacttatcacctcctcgccaccaatttttacaaaagaaacctctacgacagaattcagatcgaagcaacggcaaatcagacaaggaaaaataatcctatttgtgaaactaaaatggtttagacccggtataagtgaagtggtttcttcggggttttgaaatgaggtttctacgtcactgtcatgcgtttcttctaccactgaatcccacccatcttaaccgctacacctttcgtcccataaaaacccaacccttctagacatatatgtgtattcagatttataactatgattagattttttttagacggatagagtattgtaataaatttcccttccatcaacattggccttccaccttttcccacagcaaggcatcaccacagccacctcaccgcccccgccgagcatagcttttttttttcgttttgtcccaaaaatccatcgatgcccaggattttcgttttcaaatctccctaaaaaatcgtgtgatattattccttaaagtgttcccgaattgtctctagtaaaattagaattagtagctccctccatatcgccaatttctggtcctgtccagagttcaagtttactcacatagtcatgtttgttttcccggttttctttttcgagaatatgcataaggctttcgtatcttcatattaagaagggggtaaagagtgcatcatgacaattacaaaggtatcaaatgaaaaaaaaacacacaaaaaaaaggacattggggcttttatctcgtgtcattagttatgtgacccgatagtcagtcttgggctagtggagcaacccggcttcctgccagagagctgtctcatcccccttcattgttgccaactcggtctaggaatgtctcgttgttgaatacgctgctgttgcgttcctttcaaatggaccaagctattatttcaagtggcaccaccagctgacaaagggaacttgcgtagtcgggactcgggagcacgtcgggtaagctgtggtaggcaaagtatgtgcaaccatgcgacactctgcttttcccggttttaggggctatttggttctagccacactttaccattactccctccattctaaaatataaggcataactacccttaaccaaaaaaccaagaaaataattattatcatcttatagtaataatttaatggagaagggatcataactaattgcctacatgcatacataccttatattatggaacatctaaaaaagtggttgtaccttatattatggaattgagggagtatttgccaataaaagttaccacttgtctaaggtgagataatcaaattgttagctacaacttactaagcctaagagcaaagtcaataatatagcctgctgtgagctccaaaacataggcatatcatctatagtaaacagtataggtaatgtgtaaaataaaaatactatagcactaatattttattattttagtgggagccatcatcttctctaatctctctctttctccctcccctccccatccttttagtgggcccgttttcttggagcacgtgggtagcccggcgcttattagtcgctctctctctctctcttccgagccgacgtggagtttttatcgccggtgctagagctctattgtacctgcaaatcctgccacacttttttaaatcattgacacgtgggacccaatatgttagaagggaatcttgtcacaactgtggctataaccaaatagctatcaaaatttgcccaactttaaccgtggcaaactgtggtaaattatgactggcaaccaaagaaactcttaatttttgctcttcattcatttatgaattgccaataacccatggcctcgtcggctcccgtgcggtgcacaccaccggcgcttcgtgtgctacgccaccacgcagccgccgccaccgccgcctcggctcgcgcgccgccgcgaccaccgctccaatcactcacgccgccgtggccgtgcatcacaataaatacggaactccaacctctcctgtctcctaacttggttccaagatggcgggctcctccccgtcggctgcggcaagcggcggcggctgcgaagcggtgccgagcacgtcgaccatcgtggccgagatggcgacgggctcgcacgtgctcaccgtcgacggctactccggcaccaaggggctcgccgtcggcgtgcacgtcaagtccggcacgttcgtcgccggcggccacagctggcacatcaagtacttccccaacggcgccaccgacgagacctccgagtgggtctccgtcttcgtctgcctcaccggcaagtactccgacccgcgaagacgaagggcgccgccgcgaccgtcaaggcgcggtgcaagctcaccctgctcctcgacggccgcgacgggagggcggcattgccgccgccgccgccgttcaccaagagctgcgagctccggaccttctcctccggcaagggcggctccgatcagtggggccacaagaagttcgtgcggcggaaggagctcgaggacccgtcgaagcgtctcctccgccatgaccgcttcagcgtccggtgtgacgtcaccgtcgccgtggggatccgcaccgacgacaccaccgcgaagctcccgccaccgtccgacctgcaccgccacctcggccgcctcctcaagacgaatgcgggcgccgacgtcacgttcgacgtcgccggccacaagttcgccgcgcaccggtgcgtcctcgccgcgcggtcgccggtgttcatggcggagctcctcggcccgatgaaggaggaggacaccgagagccacgtcgtggccatccgcgacatggacgcgagggcgttcaaggccatgctccacttcatctacaccgactcgctgcccaatgtcgacgacggcggcgaggcggcggccatggcgcagcatctgctcgcggcggcggacaggtacgacatcgagaggctaaagctgatctgcgaggacaagctaagcggcggcgtcgacgcgaccacggcggcgacgacgctggcgctggcggagcagcacggctgctgccggctgaaggaggcgtgcctcaggttcatggcgtctccggccaacctcaaggcggccatggcgagcgatggcttcgagcatctggctaagctgcccttctctcctcaaagaattagttgctaatctcgctgtttaattatgcagtagaaacttcatttctccctgattatgatcaatgtggcgtagctgttatgatcgaaatttgatggtttttttccgatttgatcataatttaaaaagtttggatgtaattaggaaaaccatcactgacagaatcggattatgccaaatagtgctctaatgtctaatcataatcaaatcggaaatcggttggtataaacactaaacaaaataaatataaattctatcacgatgtgcactacgcttggctttgcaaattcgtcactgatcgagcgctcgacatgtccggatcatccgcgtccgccggcgacgcgccgccgccgacgacgtcggtgaccgcgtcgaccatcgtcgccgaggtcgtgtccggatcgcacgtgctcaagatcgacggcttctcgcagaccatcggcgcaagcgacggcggcagctacgttaaatccggcaggttcgtcgtcggaggccatggctggcgcgtcgggtaccgcgccaacggcgacggagacgacgacggcgccgacgccggctggatctccatcgctcttcacctcgacgaccccaatgtcgatggtgttagaagtataatatgttagttagatataagagttaaatacaaattatagagataagataaatcgtagagatagaatcctaaagataagatagagtcctaaagatagaattctagagataaatctactcttatttgtattatactctaagtctgtatcccttatgtacttctatatataccccataagaggatcgatgtaatagatgagaaaataccaaaatacaacatattaaatttttccacatggtatcagagccgaagaccaacgtcgcttgatccaccttccgctcgcgccgccctggggagatgagataatcgccatattctccctggggcgccgcatctaccagctatcaaaattatttgtagattaattagatccataaactcgcattagatcaatttatcctagctagccacataaaagcctatgcattaattcatgatcctcggagcgtttgccatggctaaccgagcgaagcagcagatcaagatggccacttggccagggatcttcgacacgcccgcatcgacgagagcggacgccagtccgccacggactactgcaggagtacatcgcggcaaggatgcgcgcttcaggcgcgtgcgcacgggtgctacttcggaaacctggcaccgccagcgacggggaccgtacgtgcagcaagaggacactatcgactccaagagtccaagttcgtcaagctgcagcccatcaagccgctcatcaacagcatcaagaaattgtcaccacaaataatgcagccatgcatccacgtgcaacgacttaaatatcaagaagtccgtcgtcactaccgcagccacagcaatgcacgccgccatctgctacctcctttacatcatcaccacgatggtcttctccgacacaacatcaccgatggtcttcatcaacatgggaacacgccgccgccgactcgtccacatagatggacacctcgcgtcctctgacagattaatctgtaagacgcttcttcgacgacatcgaccgtgtcctctatgacggcaacgaccgcatcaccgacgatgacatcgatcacgtcatctacgacgaccaaccaaagtggtggcctcattgccaacgacgtcccctgacatttgcaagacgtccccaatggcatcctctgacatctacaagatgcaagatgctaacaattgcagtttttgtcttcacaccatggcgtaattttttttttcgccttcggctatttgcggctacatcaactaccacgaccacggctacttcatgatcagctacgtcgacgaacgtctacaacaaaaatcattgacggaaactccagtcaaaaacgtccgtgtcatcgctatcgtccatgacactcccgctatgactgcgggagggaatagagaaaagtcaagggacgacacagaaggggacgcaggcaccaggtggaggaccgttcatcagaaatgcaatcgatgatggtgagtcaaatgagatgaagaaatagaaaatttcaaatccagtcgcaatcgttcgcttcgctcccgttacgactgagggggaatgttagaagtataatatgttagttagatataagagttaaatacaaattatagagataagataaatcctagagatagaatcctagagataagatagagtcctaaagatagaatcctagagataaatctactcttatcatattgtactctaagtctctatcccttatgtacttctatatataccccataagagagtcgatgtaatagatgagaaaataccaaaatacaacatattagattacaacatattagattttttcacagatggcgtcagagcgaggttcaagatcagcctcctcgccgccgcccacgacggtagtcatccgccgcccccgcgcagcgaccagagcacagcgaccaggtcgttccctcggttcatcacggcgaaggcgctggaggagtcgggatacctcgtcggcgacagcttcagcctccggtgcgacgtcgccgtcgtgaaggatatccgcacggaggacgacgccaccacggtcaagaagctcgtcggcgtgccgctgccgtccgacatcggcgcgcacctcggccgcctcctcgccgccgggcacggcgcggacgtggcgatccacgttggcggcgagacgttcgcggcgcaccggtgcgtgctcgccgcgcggtcgccggtgttcatggcggagctcttcggcccgatggcgatgagccgtcacaacaacgaggagacaatccgtgtccacgacatggagccgagggtgttcgaggccatgctccacttcatctacaacgactcgttgccggaggtagacgacgacgacgacggcgaggtggcggccatggcgcagcatctgctcgtcgcggcggacaggtacgacatggggaggctgaagctgatctgcgaggacacgctgtgcagccacgtcgacgccagcacggcggcgacggcgttgacgctggccgagcagcatcactgtgagaggctcaaggaggcttgcttcaaattcatggagaatccgagtaatcttaaggctgtcatggcgagtgatgattttctacatctgacaaggagctgctcctctcttcttaagaagctggctaagctggctgcctaaattgggaacaacgtataggaagtggattttaaactctcgaagggatatccttttattatttgcatgtcacttagttacgatacaaataaaaaaatagaatttctaaagttccatcaacagaaaatccaacctcaaatcttgtaaattttggatcactggatgtgcttcacgattcgtgctcttcttctccaactccggtgaccactcttcttctccggcgccggcgaacccaaactccagtagagggccgacgaattagggccccgaggtggggtggggtgggggggaggggggagaggga

SEQ ID NO: 82224 - DNA, 1618 bp, Oryza sativa
atgtagataatgcatcaattataaatttactttttatgcttgaatagaaaactacagtttttatttttgctggtttaattaaatccgtagtttttctttttggcaaagtagcatgtaaatatcttggtgaaactaataaaagctcaaaatagagttgcttcgacgaaccggtagatacttaactaaatgaacaataagtaaatttatagagaaaactcattgtttctccataagaagtgtgcttactatatcctcattttgccgggaaaggtaatctacctccggtgaaggaagttttctttctgtatcctcagtttgccggggaaggtactctacatccggtgaaggaattattctttctgaatcctcagtttctcggggaaggtctacctcaggtggaggaattatttcgtcctgcgattaatcatagctaagcattcttactatgtatatcatggtttgaacttttctagctaggctcttgaggaggtacggagagcaacctgaaagttgttgaggttccctctatttctaagagcacgtaccatcgccatccctgccgccaagaatacccctctcatctccatcagattttcttggtaggtgcaaccgatcgggatcgattttgatttaagagaaacaagcccgtcgaaaaaaaagaaattttagagaagctaggcttgtatttttggatagcacgaggtatagatctgtagatggacaaaaaagaagaaggaaaggtattgtttggtcgtcctgactaacacacattcaacacgccaaccgcttgcaaattgcacttaacatttaagcaacaaaatgtaatttaatgcaaatggttttaaaaaataaaatgggctcaatagtattgaaagtttgcgttatcagttttataattctaaagttttcaaatggacttttacattttagccctttcaaaagttattttataaacagaccctaggaaacttatgagaacgtatcatatgcacacattgtgcacaccaattaaaaaatatcataaaaattctaaaaaaatgtacatatacttttaatacaattatgtgtaaagttttatttttaaattcatcatatatagggaacaccaaaaggacaaattctgacagatttatacccacaaaattgtcaaatttttatctattttgttatgcctaaaatataatgaatttgagtttaaaactttacatataggtgtaatactaaagtacttgtgcattttttttctagatatttttggtgaaatttgttagttggtgtgtacgatgtgtacacgagaaaccttgtgtgcgcatgatatttttcatgaaacttttagtataaatttacctgggcatatgcactagagtataacaccgaggttacaatcaactatgcggattaaacataaactagaaaaaacacagaccaggctcgaccgctcgagcttaaatttgcatagctgtatatactgaacctcagctaacatattgcgaagttttacagagtacatgctggttcagaaaatttttaaaaaaagtatacatgatacctaaagaattttatctatttggttcttggcaattacattatttagaaaaaataatttcataccacaata

SEQ ID NO: 82225 - DNA, 2408 bp, Oryza sativa
gacctaaatcattctgtagttagtatgagctgtgtccttcataagaagcaaacttagtaaaaaagaagtactgtacagaacagttgacagattagaaatgggacctcactgaacagactagtatcagtgcactgaatgtggtaataggcagtttctgcttaattggacatgcagatgcagatgattcaaccgaatgatacactcatctgcattcagcaagacaataatcaattataagtttgtttagttctttgggtgtaaagtttttgaagtatatggacgaacatttgaagtattaaacatagactaataacaaaacaaattacagattccgcctgtaaactgcttgacgaattcattaagcctaattaatccgtcattagcaaatgtttactgtagcatcacattgtcaaatcatggcgtaattaggctcaaaagatccgtctcgcaatttacatgcaaactgtgcaattggtttttttcctcacatttaatgctccataaatgtgtccaaacatttgatgtgatgtttttggctaatttttttttatctaaacaaacaaggcttgtttaccgggacaagatttttgcccatgtatcctttcgtttcatggattaagacacaattattgcctcttgagaaagtgggtcactgcttagcagtgttgctgccagttgaggtgtactacttcagttaagaagtaacttagttccccaaatttttttcttaaaaacattatatcgaatctttggatatatgcataaagcattaaatatagataaatgaaaaaactaattgcacagttaggaaggaaatcacgagacgaatcttttgagtctaattagtccatgattagccataagtgctacagtaacccacatgtgctaatgacgggttaattaggctcaaaagattcgtctcgctgtttccaggtgatttatgaaattagtttttttattcgtgtccaaaaaacccttccgacatccggtcaaacattcgatgtgacatccaaaaattttcttttcgtgaactaaacaaccccttacattcactttggagaaacaagtgacatctccaacttgtctgtactactgttaccttgactgatagggaatttctgtctagtagtaccagatgtaaactgatcctaattactctatacatttatgtgttgacaagaaccatcattgtacttccataaatttacatcaatagatcaactggaattggactgtactactcccttcgtacttaaaaaaaataaacctagaacaggattgtatttttttataaaacaaagaaccttatcttttttcttatgcttatcaaccaaaatttaaattttcaactctaaatttggagttgattttaggggtttttcattgtaatttatttttcagcctttgtttttagatcatttagaatatgtttataaatattttattcacaaattattttttatttgcaaatatgttgtttggcttattccaccaaacaaccaaacgatggggttgaaagggagtacacattttcaagtgcaatcatccctcgtttgcgctgtcactaacatgtgaatttgaagtctcattccaaggaacagaagttgaagtctaaggggatgtttggttgatgcctaaccttgccatacctaagtttagactagttgtagcatggtggtacaaatgtgacttagaaatagttggtcacaagtgtggcatgcttagctctaaatttgagagcatgacatgtgggtcccaaagttaagaaagtatggcataacacaattgcggcagcgaaccaaacacatgcctaaaaaaactgtggcatgactaaagtgtggcgtggcaaagtgtggcaaccaactaaacagcccctaaattctttttagattatttactggatggttgaaacgggatatttgttttatgcttagttatttaccggtttctttagcttcacacattaggccaggtttcactgctctaatcaaggcttccgattgaagtttagtaggagtatagtgtagtgttagtgtacactgtctttaagatcacattaagaactaatagacctgtaaaccctttcatctagcaggatgatgctttgggtgatgagctggttgttgagatgtgaagttgtttgccattaaaaatgctcctgaatatatctccaacgagagacgcgtggcagtaacatgcatccccgtggcttatgcttcacattacacatttgtttatacctaaacctaaagcttaattactgcattagcttccagatcgacgctttcagttccaggatgagatgcctacgtaacatgcgaatctcgttaccggatctcgttgccagttaaagcgtaaacaagtctccttaaaacctgactgtttcttaactgaattctttatatggg

SEQ ID NO: 82226 - DNA, 3008 bp, Oryza sativa
aatggttctaagaattgggccaatttggttaaaaagccccagggggccttcgcttccaaataagtgatattactggttcatacatgtattgccttctaaagctgagaacttggtggcaataacactcctctcttgatctcataggacaaaggtatatgcttacatttaccatggtacattgtttattcgtgttgcatatgtatacaactgacatgtttgaggattcagtcattaatgtgatctctacgttaaccatggtctgttgttcctgttatctgagcttacaacatcttgataggtctgcattattctcgttccccagtacttaccatgtgacactacactctaatcaatgttttttttaatgtaaatgtgatggcaccagcaatgcacgatttccattttatatcatctagttgtgcaataccaggtatgcgtaaatggaaattatctcagcttcacaatatttcactttaaagaaacaaaatcccatgagcataaacagtaggtgataaaataataaagcccatgtcattatgtttttgtatctactacttttccctgaatttatataggatcgatcatagctaatgaaatccatctgctttagatgggctgttataatgcaattatgcaaagtggtgctacatcaactcattggttatatgttaatttcactactcatatacgtgggagggaaaaattgaattcctaactggaaatagacagttttgattatgtatgtcaacatgtaggtggagagctggtcttatccaccaagagaatttcatacaaggacagaacagcgttctcatgttcacatgaggcaatagcaggcaactcatggactttggcaaggtttggttttctacggtaaaccattgttttcagcttgcatattctctatttggttgtcacgtaaaccagcgatggccttctgtttaaactcatgtcacatttgatctcttgatggggctgactgttccacttcctctctgatgcctatgattcaaaatttgaactgctttaaataatctgtgaggcatcaagttaagtggcccaattgttttattccttatgatacattacaaagcaaaacatcatacagttatagtgagacaccaccagacattagtttgggccataatacatgactcaggcttgagtgccttgccctttcttagttatgaactggtggcctcctatgggggttggcatggtaatccttgttaagcaatctgagaacttcatctctggactccagcattttctccttccagtcttcattagttctatatgagttgcagcaaatactcgaacctttttgttcttttttggagcccaaactcagatgcctgtaataaggcttgaatggcagtattatgatatgttggggatttggtatgttcagtgtctgctcagatgtgcttccttctagttttatgttgtccacggatggtcttgccttcatcgtcgagctgctactatcctgagagattttgctaggaaatcagtagcggcatatattcctatagtccattagttactcaataagggtaagaaacatagggaatccgcaatatggttgggcatgactttcttaggcatgttttctattggaaagcattaaacatagtcatagagtgggtttgcacgtgtgtgtgactgttttcttgaatttataaggttgacagtaggctttagcaccaagtacattttgcactgtgttgtttgacaatattgcataaagttttgacctacctaacacctagacattttttttgtcttacatgtgcatgtccatatattgctggcaaataacattctcataccagcaaatgtagatgtaggaattttcagttctgtctctagtctatgtcactatgataaaatgtaaaatatgccaacctttgacaaagataaaacatggagtgtgtccatgaaggaagaaaagatcacctttaagcttgaaggtacacgtgagttggatgagtagttgctaatctctcctgcatcaagaccaagaatatattcaattcgaacataatttgttagtgtactaaacagtaagtttcctttaggacttccttttctttatggatatttctttcccttttggtgaactcaagcttgtaagaactaaagaagtatgattgaattagtatatactgaatgcacttggagcataagaaatagtctttttgaaggagcattaacagtactattatgacacagtgaaaacagaacagattactattatatcatgattattaaacacctatatctaacaagagggaaggccataaattgacaaatacaatggccaatcaaaacagaaaacagaaagggtaagcgaaacatgctagttctagatacttggatgtaccctatatacttctagttgttcttgggcgggtggtgccggggtgtacggtaatcagctgtgaagggtatgtggccatcaaagttaacccctggaggaaattttctacttctaaaataacagttcatactcaaatcctttcttcctccatgcccacattttccaacagaatgttttgcacctgagcttggtttgcttctagcatcctttgggtggttctccatgactgcaactccaaaagccatcttccgtcctgcaaatattttgcttttgatctcctcatatgttctggtttcatctacaccatgatcctacaatcagagtatctgtagttagaaatgagtttggatattaaatttcattgagtaaaaaaagtagaatttacataagcaatgctttgagtaattctagtcctaccagcttgttttctgggcctttctcactgtaagttgccatcatcagttctgaaaacaggtaatatgtaacgtcagttctcacacatgctatttacacggaggaggaaataaacttgaaaagaaaaggaaatgaatcagcttgtacctctatgtgcaatggtgacaaagggtccaaatgttaccgataggatggccagcccaagcaggaa

SEQ ID NO: 82227 - DNA, 690 bp, Oryza sativa
gctgttcagtgtgctcaggaaatgcttaaagattgtcactcatattgcgaacaagaagcttatgaaagaggagcagaaagctcttgttccaggcacacatgatgatgatgtaaatctgagtggaaacatattgtaacaaggcgctttactggcgaatgcactcatcaagagagggcaagcatgtctctgggagatcctagctgaggtgtggggtcacttgattgtgcacattgctcccagttccaatgtagaagctcacgccaaggatctcaagtctgatactgagttcataaccctcatttgggctttgttttgtcattgtggcatcgagaaaagcgaattatggcaggagaagaagggtgcaaagtctgggaacgacactcctggactggttaaccagagcagtcctgcttctggcatgtcctgaaacctgaattgctgatggctaatgctctgctcccctcatgttttcagttttcagtaaagtgtgcatctcatcataacgttcgaacatttgtatttgtttctggagattgtaacatgtgtggatgttttatggattgtgattgtaacaggggaatgcccttggtgcaatattatgtgttatgcttttttttttagagaatcatattattgtctggattgtgatcgtattactcggaaataaattggggtacgttctgattgtgg

SEQ ID NO: 82228 - DNA, 24218 bp, Oryza sativa
taaaagtttaagctaaaacatgactatatcacgcagcaagtcacctgcggccaccaacctctcggggcacgcttccacgacgcagcccggtgcatcttcacgtctgtgcagctgtatgagcgccgtggatgctgcttccggtggcaacagacacactctgaggttagagctagcagagttctgcatgattttctgtcagttcatcagttttagaaatggttttgggtagggttgtgaatagtgtatgtatatggcggtgatgcactgaggtttctcattgattttacttgcaatttgcagacacggacggcgaatttctacatctctgacaggaacactggaaagaggttctacgtgagagctggcgagggtggcaagatcacctggatgattaagcagaagacggacagcttagatggcgagaggaagggagcatcaaggaacctcaaaagctggatggcaagcaatgatttatcgtgtgatggcactgtgcatgtcaaagaagggtaaggtgctgatgctttagagaatgacaatgaaaaaaacccgtcaatttgaacatcataaacctattttataggttgaatttttgaaattttcaaataaaattctacaccatagtaaggttttatttacagtatgtagtttttgaaaattgaaaaatacctcaaacgtaaattaaatcattgtaatcaacatcaggatataaaatatatgatagtgacggtttgaactgaaaaaaaagagaagaatcataggtgactcgaacggtcgtggttaaaatacatgatagttacggttggaactgaaaaaacgaagaaaaaaatcataaggggtctatcaacggcggtggttagaggtatttctatattctatcaagaatttgtttgtttgatttccttaaatatctgagcatacaaatctcaacatgccattcatctccggtgttaacagattatctctatgtttgaaaacaactgatactattccatattatatataactcaacggtaaattactgactaaggtcgtgagatttcatccgcataacactattcctgtgctgcatgtaaagttcagatcacaaaaaagctgtgcccgcaaacttgcattgacatttgcatcacacaattttttcattggggatcacaacaaattcttcaggttcatcagggaaggggacactgctagtgtgattggagtcctgaagaagcaccacgcctacgacatcgtcgacgcgccgtccggcgtggtaaccaccggctgccagttcacgaggtgtatgtttccagtccacgtcgagggtctcatacttgtaggagacgaagacccagatgatgaagtttatatggtctgacgaactctgaacatacaaatattcctctgctgctttgcacaaatcgcatgcaaaaaactggactcccatggctccaacaacccactttgcatttcggttcacaatgtgatttggatcttgtgtggttgtgctatatactcttattcgtttttcagaggtttattgtagactgtagtgaatgaggatgttttagtacctcgaattttagttacagttgtgtaaattaaattgacacttacaggcttgccagttgccagtaggacaatttgaaacatgattttatttgataacttagtgaggagggacacaagaattgcagatattccatacaaaggtttacttttgagtagcatactcagaagtcatgtaacaattgagcatatttcactatccgattagacttaatttcatatagaaagcttcctgtttatgtttggagatggaagagggtttccgtaccatttgaaaaacagtgaacatgttataaatgttgcaaaaacaccaacaaagattacaaaattttactgttcgagaaatatatgttcctgtcaatcccattggtacctctagtaccctacaaaattctctagcagcggcacacctgggaattgggagagtttccctggaaactgatgcggcaatggttaaacaagtagtaatatctacagactacgatctcttcattcgcggtggcttggcccttgaacaactgttggtaacaaattttgtcaatattcaagttagacttatgcctagaatgtaacagagtagctcatgtgttagctcagcttgggactgtttgcctggctcagtctgaactagtactggttgatattccagatgatatctcggatcatgagtaatgaaatgtctaaaaaaactgcaaaataatactagtaataacagaatagcccaccaaacttctcttggagttttctctgcattcatttcactgccctgctgttgtaatgcattctagttggctactacatatcattacaggcttaatagttttatagacaatgataagctggaaaaagtatttggtaaaaatcacatcttgggtaaaacttttttataagttctaaaaaatctcaaaaaaaatcatacatgtaggtaatatgtaaataaataaccatacgaaactatttcacgactaaactcaacttcattaatgaagtatgaaattaattaataacactattcctgttgttgttttcttttttttttatgtttctcaattttatatctcacaaatgaagttgagtttaacctcgatactactatctgcagatattaccatatactatccaacacagatgttagaataggtgttgaatatactagttctattttggttatagttagacttggggttgtaataggtggtagggggtggagttagagttggactctgtaactcgacatctctcttaaatggagaggaggtggtgaccatggcgactacaatgtagcgtagacacgcagggagatgatggccgcgtggccattgatttgtagtggctaggagatatattgattggggaggagcgcccataatcaaagcctcggagatgtaggctttggctgaacttcgttaacaaatatcgtgtgttcctgtgtcgtcatccggtgtgtcttgggtgatcaatgactgaagcgatcaagaaggttagtcgtcgttttgctatatcgactaacttttataatgacagatggtcgcctgacgtgctcttactctacatgtgactttgttgacaaagagatggcaccgagtgtaagtgtcgtcatcctgcaggtcatagttagctaacttatctgtatgtgattgattatgcaggatatccgaagctgaatgcctaaaaattttccttgagagcatggaattattgttttagacataaggtttttaacgaggcaacaacatacaatgtatgagcgacactatgtacttttcctcctcgtctttttctcaactattgggttttggtaggagtttcgacgagtcattcgttgatcacggttagatcatggaagagtgctgtaaaacaaatctataggagatatgtttcttgtggtctcgtgggcatatccaaaacaaagtatagatagatttatcttctttcatataaacgtgtaggggtggggtgagacctgagacgtttgggtaattgtatccgagaccagatttaataaaaagatttcatcctaatgtgtccatcatctacttatgttagatggatattctcccccaggatggatattctcctctaatgttggggcaggatgcatattaatgttgtggagtgtaaaggattgatttattaattgtctaatagcccgcgaccggattatggaaatcatggaaaaaagtcacatcaacatcttcgagtgatacttgattagtaataaggataggggacaattccttctattgtgcaaaacttttatttgaattctcattatctggtacaaattctgtcacattatgcacaatagattctatgatcttttatttgtttgttaggtcgtttatggatactaatggtgttatttatggattatgtctgagtcggtaacgcgggagcacatcctgtttataaaagcaaatataaaattcattcatcaaaacctggttcctacaccatcaccattatttttagttagattttgcgatgggtaaagtaagtaaacatatatgttgctttgctcaaacatctcactttttttcctctaccatcattgcattaccatattctattcatctcagcaaccatgttgtttaatttatagtgctgatcaatcagcgagaggtcactcgtttggcatgatgcatacaaagcaataaatgagtatgatattgtaaggaaccgtgctttctttcttcttttaactcaattggttttgctcaatggtgtctgtctttcttcttttaactgccaaaccgtattagcaattggttttgctcaatggcgcctgagcagagtaggcaaatcatcgcagagctgtagagggaaggcggatagtaaaagccaccacatgtacaccggccatgtgattcctctcgcagcaccattctgtgcaccccattcgggcgattgatcgggtaggatatctaagttaaatacttttttttctatgggttctaccaacctacaaatgctggttagagaaaagtaaaatgtcttggaatttattttttagaacatgtgggaatttaatttgagaacctatatatataccacaatacacgttagcaaatatataccatttatttataatgtttatttttattaaacacaaaacaactttattggtgctataatatattacaaattatataaaaaatatatctaacatatccataatatcaaacaatcgatttacagggacaatcatgtatggaaataataatattggtgatatggaaaaaacacaaatatcattaacgcgggaaccatccgtaatatataacgactgcgctgtcgttattacaatatctaactacataaatctttgcgatcattaaattggtttcctcaaatatttcaaactcactagcttccataaagctattgtttctcgtgcatttatgaacttgtactaatttttcttggtatgatggttcctacgcttcgtttgattgacagtccacttaatatagcaaagcacggtctatgttaaagctggtaaagcatgaaggcaacgagcctgatactgtgttgagtcatgccgtttgccttttttgtcttgccaattcctcactgatgctgcatggtatgcgtggcatttgcgcgccaatgtgcaattgtagttgtagcatgggggacagacaggccacggcgtggtgaaagtggatctgcaacagttggctgcgccttgaaacagggctctctactttgggatgtgttcagttcatgccaaaaataaaagtttggttgaaattgaaacgatgtgacgaaaaagttaaaagtttgtgtgtgtagaaaagttttaatgtgataaaaaagttagaaatttgaaaaaaaagtttggaactaaactcggccttggtctagaaggagaaaccagagtccagagacaaggggcaacaaggggtacttcgtcttcgctttcagcacaatatatgcatgtttcagcacaatatatggcagaattgtcagtttagagagcaaataataaaattaaacaagacaagaaaccagaaggttggtcgtacctagcagtaggaatcggctccaaaaccagcaatatcgtttcctttatacttattacaagcgaaatgactttattaatgattaaaaataattcatggtaaaacttttaagcaagctctgaaaaatgaacaaaatactcagaatcaacttaaaattgagatttaaaattcaaattttcgcttatagttataagctgaaggttaaattaatgatgggtctgcatgtctccatcttaaatctccaaattcaaattcccgtacacgccatgtctaagaattttttttattttctgaacctttttaatttttaattttaaaactaaaccatttcaaaacatattttcaaaatctgaatcttttggccacgccagcccatctagcgtgacaaaacaacactagcacgccacctgcagcgggcgtgatagttttgtcctaccatgctagcgagcgtggccaaataacttgtcatgccaatgggagcggcctgacaatattattttgccacgccagcatggttggcatgatcaaaaggttcaaatcttgaaaataaattttagatgggtttatttttaaaattaaaaattaaaagattaaaaaataaaaaatattccctaagaatacgatattttctactatcattatttcaatggttacaataattagatataaatcgttggatgaagaatgatagtgaaggtcttgatcagtttatgctagtaatagagagtaccgtaaatacactctaggttaaaccatagaagacagcatggtttgataggttgatgagttataccttttgtcttatcaattgatttttcgaccgcatgctactagcaaatgtattttttggataatagcaactaataagcttcatactaatttattttctttacgtgatgcttatgttgcttctgctttagtgcatgttttttttatttcatctcatgaccctcatagagcttgcctagacgtgtatacagatgtagtttttttagtgcgtactactcctgtttttttagacgtaacaggagtagttggtaacttggtatgggatggtacaatattttatgagtgacacgggacggtaaataacttttttttaccataaagagtgagaaaagggggaaagacaggaaaacgtggaccggaggtggggactgggaacactatgtgaggcactgttttatggggcttttaactatttgccacttttagatttgacaaataattatttaccacccctatctcaatgacacgtgggttcacatgtgtctataacatgtgggtccagtggcaaaaaattaattaccacatctaaatgtggcaaatggttaaatatctcctgttttataaacaacggttggttactgtttcataaaataagtgtgatttaatgtcatcttaaattaaacttctctaacatagataagtttataaagaaatacattagcatctaaaaagaaataaatgcaccagcaaaatatatttcatggtggatttatgaacttatttgatgtttttggcgttgatgtacttttcaataaatttggtttaagctaaattatgaagtttaacttaggagttaggaccaaactaaagcatttacattatggaacaaagattatagttcaggcttcatgttttagaattttgcatagtagaaagtgagcatttaaatgaactgagtttggctaagctatagaagtcatgttgtattattgggtattaagaactcaacgaataatgcgaatgaaaatgttctggttttattaaaatttatgtattaatatgcgaaatcatctcatatatatagaatatgatagttattaacataaacacgctatacaaagaaggacgttacaaaaccatttatattatttttggagctattgatatccaataatatatcagggaagtagctcaaaaaaaattattgcgcgttagtacaagtatgcagtccttctgatatataagatgggactattcgatccagtggtctaactttacatgtaaacctataaacctttttctcctccataatcataggtagatgggacagtattttgtatatttcaataggtgttgtcaacaatcataaaatgtgaatcggttcccacaaatatctcatagtgtgcttggcttgttttgcaaactgtcatgcccaatccgactgtctatccacactcaccagattgatttatagtactgaacgagctttgtttgttatcccagattgatttatagtactgaacgagctttgtttgttacctgattgatttatatagtgctgaacgagctctgtttgttaaggtggtaaaaccatgagagaatatactggttcatagtcatgcactaattactcaatttgacggccaattgcgcatggataggcaacgaacgactaagagcaggtacaattgtgggtggtagatggtccatttttttatgagctggaggagagaggggaagacagagaggagaagcgggcaactaattagccgccaggctatacgctcggcctgaggtcacggggcccaccagcagagacgggttcaccatccgcgtcgtccaccaccgttgccatcgctctccattatattgccatcattgtctcgtgctccaccaagtcaccggcctcgtccgtcatcaccgccgcgcgcggccaacctcgttcgtcgtcgtcgccgccgccgccgccagccgcccgtcgcactccattgagtcgctgccctcgtccgtcactaccgctgccaccggcctactccgccatggccgccgtagcactccactgggtcgctgtcctcgtctgtcgccacctctgctgccctcgtccgcatggctgccgacaaactccaccctcatcctttgtcgccgccgccgcgccctcgtccaccatggccgtcgtcttcttcacactccgagtctccgtcctcgcccgccatagccgtcattgccgtcgtcatcacctacatcctccgtagccgccgctgcctagtcccttgctgttgccatcaccctcttccgccgccgccactgtgccctcgtccgccatggccgtcgtcttcatcgcgctacgggtcaccgccctcgtctgccatagccgtcgtcgctgtcgccgtcgcctacatcatccgtggccgctgccgcctagtcccttgccgtcaccatcactctcttccgccaccgctgcgttcctcgtccaccccggccgcctatgtccgcctcggccgtggccctcatccactgcggacgctgccggcgtgttcttccaccgcagcttgtccaccgcaggctgctgtcgtcctcttccaccgcatctgctgtccaccgccgcagctgccatcatcgttgttcactgcgtcctcttctgcatcaaaagagaagaggtgagaggaaggagagagagggaggagagagaggaagagacatagggagatggtggatcccataaaaaaataaaatatttttgttatagtattttctattgtatagacattagctgcaacgtttattataaatgacatggctattttttttaagccaacagttggctgtgttattgaccttgctctaattgatgggcacaaccggcgcagcagtcacgccacagcttttgccgactcaaagcagccgcacgcaacacgcagtctggtctcgcggttagctgccgtgttcgagactgactgcaggctcaagctggttccacttcccaactccctactcttatttttcgcacgtacgcttttcaaacttctaagcgaagcgtttttcaaaaaagttttctatacgaaagtttctataaaaaaatcatatttttctatttttttaaaaaatagtaaatatttaattaatcacatgttaatggatctttttgttttacgtgtgtacgggggaaccggctgaaacgaacacagcgtgttttcgtgaactccaaggcgcccagggaagggagtcgtggtggccttgtgggacgggcagtcggggatcggtggagcgactcgcgttttgacaacgcgtgatttcagtgggctggataatatcgggagtggatactaatccgaggatgttccctcatgtatttttttttcattttttttcaaatttgagataaatagttatgaagtagtagagttcagtgatatccattgatccttagaaaatcaaattcaaatttgacctatacatcgataaacaaaaataataaattcagatgtaaacagtatgctactatcatatgttgaatttaactattttatatcttgacgtatgagttaagtttagacttaagattttatagagttgtatagatatgttatatgagtgtatttttttagaattctttttatagctatttagatagtttttaatcaaacgagagaaaatgtccttaagtgataaaataatttctcgataatatcccatcacaggtgtcaagcaagctgctgcgtgggtgtaacgccccgattttcgttcgggattaaaaaaatcattaaataaatgcattttctagaaattaaataaaagttaaatcaatttaatcaagtaaaataatgggagaatttgaaattttcccttaaaaatcaatggccgggaatattttgtaatattctttgtgccctaatgtactctccggaattttccgtgaattttcggagctcgagaaatagttttaatagcacaaagatcattgcatcaattaaaataaaaagaaaacaaataaaaacctccctcctctctttgggcccctttcggcccaacccctcctttctctccctctcgggcccggccgccctccttttcccctcctcccttctctttgggccgtcggcccggcttgccccctcctcgcgcaagtccgcttcgcctccctcatcctccctcctctccccgagccgccgacaggtgggccccacctgtcggggtcacccccaacctccagcccgggccagcaaccgccatggccgcccgagccgtccaacgtcgccgccgtttccgcccacctcctccaccccgcgcgcgcgcgtttgtccgtgggacttcgccgcccacgtccgcgccgtttccccccactctccccgcaaaatccggccacgtcgccgcctcccgcgtctctctctcccccacgacgccgccccccttcccctcaaaatccgccgctccccggccctctcctcgcccctttgagctataaaatcaatccccgtgctccccttgtccgtttccccatttttcccgagcccggcatactctccctcgctctccccacgccgcacccacgcgctgccacactccggcgagctccggtcgccgtttcccgccgccacagccgtcgccgcgccgagccaccgccaccgccagcttcgccaccgcaaagggaagtccggccgcctcttatttccccctctccacccctcgagcaccactcccaccgcacacccgaggccgccgccccttttcaccgcctccagccgcgtcgcgccgccgcttcggtcgacgtcgactcgcgccgttgcctccctcagctccgccaggacgaggaggaccttggccgccgcccctcttcgccggaaacccaccggaacggggtatctctcggtcgccggtgagccccaccatttctctcctctctggcgtggtattctcgccgctccggtcgcctatttccctccctaaccgctccaataatttccctaggtcttgccggccctcggccgcggctccgccatggtcgggcgtcgtcggaccgccgttcccgtcgcctcccgtgtcggccgccaccatctctttccgccgccagccgcctccctgtggtcgtctcgccgtcgccgtcctcggtgagaatccccaccgtcccttctcctttttttttcctcctccgccgctccccgtgcccgctgccgcgatgcgccgctgtcgccggcggtcgtctggccgcacgccgtcgcgcgctatcgctcggccgagccggtttcatgccgtgcccgtgccctagccgcgccgcctcgtggccgtccgatcggcttcgggccgatctgggccatccacgtggtggacgcgcacccgaggccacgtgtggacttggtccaccatgcgccgcccctttgtgccgctgacgtgcggggcccgcctgtcggcgccggctgccccttgctgacgtcagcgagatccttttcctttgtaaaaataattaataattgcgcaataaatcgagtttaattatagaaattcatttaaatggctcaaaacttctaaaattcatatctaattcattcgaactccgaattgagccattcaacttgcaaaattcatctaaaattgagctctacatgtttgtttagtttttatgtactgtttccttggtttctattagagtttttcctcgttttgcgtgccagcgtgtagtttccgtcgtttcggaagtccgcggtcgcgaggaaaagagttcggaagatcaaagtggagaagcaaggcaagtcacacattccccttgagcatgttgatcctaatttacaaatgttttactgtttgcaaataaatatgcatgttttgctaattacacgggatcagggtttacctatctgctcgcttgtgccatgtttacttgatatctgtcctttgtcaaccttgggtgataaatcgactagcttgtgttacttatgtgacatagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtgaagggtctcgtcacaatcactcgacatggtgacgtgtgcatcatgggcacatgatgacgcggtgacatatcggtgggttgtgtcttgtgggtacagttgtgcacctctggccagagtaaaactattcgaatagccgtgcccgcggttatgggcgatcgaccagattcaccgtgattagtctcactcttaataaatcgacccaatgcactgtagttcaggtgggttggttgggcctgttcaacgtggtgtagcgttgatcagtggagattcaatattactttaattactcaaccgtttacggttttctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgccgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacagtgggtgactggcggacgggttgcaagcctgcaaatgtgtaaatgcgcgagtctaagatgggcgtcatgtaacaccagtgcatatgaagtactccctccgttccagctaactgtaattttgcacggttcatatttaacgtttgaccgttcgtcttatttaaattttttttattaatatttttattattattagataataaaacataaatattactttatatgtgactaactatttaaaaaaatttcataaaattttcaaataaaacgggcggtgaatgtagtagttgctaaatactaaccccgccaaaaaaaaaaatccccattcaacctttttggaattttctcaactcagccagccatagtacccgaaaaaagaagagcgaatgtactactagtagcatcctaccacaataaccctgcacacgaagaaaatggagagggaaaatgatagacaacaccgttcacaatcccagcctattaatgtgcacgatatacggacctagatcgatcaacgtcacatacatgagaggcgatttttttacatttttattaaaatatttagaaaataatttttcatttcaaaaatttattatctagacgcctcacgatctctagtgggatgtttttttttaaaaaatcgtccttccaagagcgtcaagggaccaatgtaataatttttatttgtatttaaatcattttcaccagttttaattcgacacttcaaataattttaaatggaaaaaatataaagtcttttatataaatcttatttctatctgatatcgtttgaaatgtggatctaagatttcgttaaaataggttctaatcttataacgaatgtttgaacatctaagcgatcttaaatgaaaaaattgttaactaaaagttgtcgttctcctcgagaattttcatataaagttgatttcatccaactttatatgatatattttttaatttctaaatcatagagttaacaatttatactaaaagaatatatttaagccccttaacatgctttggatgggcgttttaaaaaacgccctccaaaagagcgtgaggtatccagatttgcaaattgttgataaaaaaatatttttgtaaatgttataatgaaaaagtaaaaaaaaaacgagaatcgtcatcgtcctcagcctcttgtggttggttggaagtacacggacaaattttcagcataatcaaaacggaattttcagcttagaaagccggaaaacacacggcctagctagctagctaggcagcgaactgctgtggtgcaaagcaaatggtccctgtaatgcttacgccggccaccccgtgcggccgtgcccctggccgcctcccgtttccgttccacttgacgttctcgaactgcagtactgccccgtatatgaaccccggcgccgctgccgccgccgagctgttttgctcatagatctttttttcacgaacacatgaaaagaactgcacgttaatatattagaagaaaactgctcgtccatcacacatgcagacacagccgatggcctgcgtcggttcagcatgtcaccacggcaaacacgtaaaaggactgcatattaatatattataagtgaactgctcatcgatcacacatgcagacacagccgatggcctcagcatgtcaccacggcagcacgtaagtcatgactcataagtccaggcgtgtgcacaatactaagcacatgtctgtagtgaattatgctccattatagtgttgataatggagacaacaacataaccaaataaccaaatttaagtgggagtgaaaatgaagataagttgtgtgattatatatgaggaaaaagaaccttaagaaaacaatataggtatacatatgaaatcataaatactgctacggcaatcgcctccttacaacgaactactcctactcctcctcaaagtcagcatggatgcatgatcaatcttcacttcatcccgaacttctcttcctcaatgtcagcgtgatcaatcttcacttaatcttcacttgtgttgacgtttttccttatcttctcattttccctctatcatttaattcgtttttattgtcacagtttcttgataataaatttattatcacctggaagactaccccatacactattaccgttaataggtggaacactttctatccggtcttgaaacgagtgtatttcattaatcatttctttgtaaatacttaactatttaactatgattaggtaagtaaaaacttaaattggatttcaccagtatctcatatccagcctttattcctaagtggcatagcttatgcatagcatccactccacccgttcatctcactggtccatgatggatttatagtgttgaagaagatagagctcatcctctcgtaccatttttaaaccatccagtcaaataaaaggtgatagtcatgcgctcataccttccacctcgtcaattgggcaaatgcgcatgaatagccaacagataggctctttggtacttgggctgcaagcctgaaaatatgtactccccctatttcatattataagttatttggctttttttttttatcaaagttctttagatttgatcaaattcatagaaacaattaacaatatttataataacaaattaattttattaaatttaacattgaatatattttgataatatgttttctatatattgaaaatgttactatatttttctacaaacttaattaaatttaaataaatttaagaaaaaaatcaaacgacttgtactatggaacagaaggagtagctgtgatctggcttgcctgcaggctctgcttttgttcatgaaagtagagtaggggatgtgaatcacatcatagaccaacacgcttatattacacttaggctgtgtttagtttacaccaaaattgaaagtttggttgaaattaaaacgatgtgatggaaaagttggaagtatgtgtgtatagaaaagttttgatatgatagaaaagttgaaagtttgaagaaaaactttagaactaaacacagcgttatacggatagctcgcagcatgttctacgtgcatggctactgacaaagagacggcgctggaatgagttataccgaaggtgccaatggggtgggcagaaaaagaccgagatcgaaaagaccgaaactgataaatttggtccaggcagtgaaataccgaattttgttcggtcaattcacttagtctccttggttaaccgaattgacaaaaagaccaaattaacaaaaaaatatatctaaatgcaacctacaatccactaagtttaataggattaaactctaattttcacatccctacttcttctagtcatgcaacctaataagagtctttactcatacgtgcttacgaattttttttatgattattgtgttaaaaatttttattatttctttgcatatatgaaaattttgttaaatttcggtcagggtcaggactgagaccgaaaccgaatgtctgtcctaaaatttttggttgaaattcggtcttcatttttcattttttaaagactaaaatgaccgaaagatcaaagaccgagactgaaatttccagtcagaccaaatctccaccccgcgccatcatcatgcaggtcatagctagctcatacatactcttccgtacctaaatatatttgacgccattgacttttttaaacatgtttgaccgttcgtcttattcaaaaaattttgtgaaatatgtaaaactatatgtatacataaaagcatatttaacaataaatcaaatgataagaaaagaattaataattacttaaattttgtgaataagacgaacgctcaagcatgtttaaaaaagttaacggcgttaaatatttagagatgaagggagtatatacgtaggtgatttgtctgattaactgtggataactcgaagctaaattttcctttttttcgcgtccacatgttgagtgcaagattaaatatgggagagggaatgaatataactatattttttagcgctcacaggtctaatgtcatagggtttttggtacagtatatcttcagaagcaacatacagtactcctcttggagtggttagtattctatatagatttttgtagagtaccctaattattccatgaatatgagccattcatctggcttaatcccatggataatattcagttctactacacctggtaatttagcactagaagttgtggaggggcaaatttagaaagatgtattttgttttaattcctaatcttaatcgatccataacccatacacacgtacagatccaaaattttggctaatcgcttgattatgtgcggcttagtcggagagaataacatgttctaattattccatgcacgcacgtacgtataacctatctaagcgagataactgcgaggggatcaatgcaacggcgagccacacgagggaaggggaatagatagggagggggatagtgagtatgacaagtggttcatagttgttttttttttctagtcacttacatacgggcccacttctactttgtgattgggttgccatgtttagcaatagggttgaccaagttaataagctatatcagtgaaaattgctctcaaaaccgctgagggagtaaaattacaccggtctcaatagttagaaggccaatatatcttatattacggttaagggatacgaattagattggagtagtatttagggactcaaagagaacttattccttgcgagggatatatagcccagcaagggtggtacgcaggctgctgctgcgttggtgaccatggactgggtgacttctatctctttcttcaccaaaaggagaagagacacaagtgaaaactaaagaagcacacatgatagatcaataatgtactcacttatacatcccatgtaacatatatatgtgcatgcagttgctagataataacaattatatatatatatatatatatatatatatatatatatatatatatatatatatatatagctcccactcaaccttttgtaattttctcaagtcaaaaaccaatccagtgaaagaacatagaagaaagaccaacatcccaagaccaccacacagaaaaagaaaggggagataatgatcaagacctagctaggtcaaggtcacatacgttgatacatgtacaggatcggatcagagaaacatcgccgttcgtcctcattctcttgtggttggttggaagcacccgaacatctgcatgtttcagcacagcacaagcataattttcagcacagaaagccatagaacactcgggaagattagtcatgcctagctaatactctcttcattccaaaatatagcaattatagcagaattgaacatatcttaatattatgagactagacagtcatggtttgaaatttcggcccccaccgacaaggtcaaaatctccccgaaatttttggcttttgccaaacatttttaaatttggtaaaaatatgttaaaaaataaaaaaaatcgtccaaaaaattccgaaaattcagttctttcggtcaccagcggcaaaaacacaagtttcgaaattgcaaaccctgattacaatatattcaagagtaaaatgcaccagcggttcttaaacttgtcaggaggtttcacttaggtccacgaacttacaaagcgcacatcgaggtctctaaacttggtttattatatcatcctggtctaaacccgcgtttgaccgtggtcttgtttacgtggcatgccacgtgtacgatgacatggattctctgagattaaaaaatccctccctcctttttttttcttttatgaaaagacgatgacatggacgacgtgtacaaggcattttcgtcttttcgacaaggaagaaaagaaaaaaagaattaagaagggagaaaaaaataaaaaaattccatgtcatcatccacgtggcgtgcaagatcacggttaaacgcggctttggaccgggatgatacaataaaccaagtttagggatctcgatgtgcgctttacaagttcgtggacctaagtgaaacctcctgacaagtttaaggaccgccggtgcattttactctatattcaatctgatccttattgctatattttaggacggagaaaggcagtgacctgctgcaatgcaaacaacgtgtaccttggacatgagggagtgatcccgagagtgcctcatgttggcggcgcttatctcctgcggcggcgagcgcgggacgacgccggccgcgccggcgccccgggccgcggctcggctccgcttcacgttgtcgaacatcaccgtgaacccctgcgccgccgcctcgccgttctgctcgtcccacaccccgaacttgggcaccgccgatgccctctggcggccgtatatgttgtgctgcggcgaggcggacgcggaccgcgccttgggcgccacctgctggtggtggcggccgtggtggtgccgcctcgacgccgcgtgcatctgcggcgacggcgacggcgcgcggcgcccaccgccgccgcagttgtacccggcatggggtgggtggtgtccgtggccatggcggtggtcggagctgtggtgatcgtattggaaggggcttgggcttgggcggaactgcggcggcggcgcgaacttgctctggaagtcgcccgggtccgacgccacgctgccggagcgccggtggtgctggtgggagcccggcggctgctgatgatgcctctgcgattcgcggtggccgctcgacgtcgccggcctggaggacggcgcgccggcgaggttgtcggcggcgcggatcacgccggggttttcggcggggtcgttatggttgtacggatggcggagcggcggcgcggtggcgcccttgttctcgcggatcttgtcgaagtagagcgtgtacccgacattgtcggcctcccaggtgccgaacttgggcacgctgggccgtttctgcaagtgcacaaaatcacacactcatcagaccatgtcctcgtgggcatttaaaaaacgtgacaaaatcatatacaagaattatttttagataatgggaataattaatgttttacactctcggcttcagtcataatacacacaaacataaatttgttaaaaaaaagtgatgagataaattcctaactctctcttgttattagcaagaacttatttagaaaataattttctggttgatgtgatggtatatgatgtgatctattgtggtcactgagatggtgggagcaccctttgtttctcactttttctgtcttatttttgggtgatttctcacagtgttatgatatataataaggcaaagaacttattattttatacattaatcaatacagttttgaaaatattaatacaaaaataaccacaaatttctactgtaacatagagtatttgttaagatcctacaaaattgcacacagtactacctaaaactgatttacaagagaaatctacataaattattttgtgtatgcaatctaattatttaaaatactttgatgtataaggtcttgaaagtgtgacttgatttgtgtctatataaaatgacatgtagttacctgtaggttactttctccattacagtacgtgctagcaaatgtcaccaaaaattagcttaattacatggtcaatggcacatccattttctaaataaaggtaagtcaatagcagataatacataacttagacataaatgtttaactcccatgtcaggaacctaagatatacacgaccaaacaattaagttcagggggatatgatgcagtttactctttaaaaaatcaactggatttgtaaacaaatgcaaaattaaattattagcactgtattagtcataatctagctgttttgagattgacaaaaaaaaaatcatcacagtcaaatggggccaaacagcaaagtggcattcataaagaaaaatggaaaagcaaaatcaaagtgggtacgtgtcatgcatttcatgttttttttaaagaattgtcccatgtttatttttctaatctcagtgaaccaagagctgaagatcatcagatatggatactgtatttctggtcaactttgtatctgctatactattggattgctatatggctcctgtcagagtcgtgcgaaccgcctcctgtatttgaaagctacgtgcttccaagtagctataaattaaacaaaaccgcgtttcttttgcctttctaatcatactgtattctggatgtgtggtttgaatgggtaaacaagattaagaaaacagcaatataattaacttccaaccaagatgatcgctcggacagtacttatataaaaaggatatataatcttattgcggcgcgtcaagatattcaatgacgtactcgttctcatcaattaattaatgtattaatgtgtgcacagatcttcaaattgaagcaaattgatctatatgaacgcgtctcctagatcatcttcttaatcgtgcatgtcaacaacaagaagcttggagcgacaggaacctttctctaccatttcttcttgctctaattccgctagagatcaattcatttcagcgagatggtttaatttccggcatgcatatgtgctaactcgtcctctccgattcatgatcctatttgttgccaacgtaattaagcctagaaatgatctttatgaaggtaagtaattaattagcaacatgatcaacggcatgcttggtcgtcagagaaaacaggtgaaacaacagtttatgcatgcaaggaataacaaagcagaaagaacattgattaattaagcaaagcaagaagccagcaagaacacaattttgatatgcaagaattaaattagttgaagcagggcaattaattaagcaacgaagaattgaagcactcacggccatatatacgcctgaagagggttcgaccggaagacggcggcgacgacgacgacgacgaatcgatcgacggcggcgatcgacgacgacggcgagctctagctacttctctccccttccccttgagagaggagagagagaaagcagacaagcaggccaacctcaaacacgtaccgcccccaaaaaacgcctctctatatatgcaatatgcttgtgtttatcaggagcttaattatccagcctctcctaataaaagcaaattaatcgagcaaaatcaagctgcgaaatggtggcaccctagtacgttgagaagatggcgacaataactaagatcgagcagcaaagaaagctagctagcaaacggctggctttggctgaatatatataggaaaaagggagaaggaaacagcagaaaaacttcctacctactaccaaccgtgtccatcttgcagatatgtatgtagtcgtcgtctctttcgttgtttgacattgcctacactgacatcgtcttcagataatcgtaccggccccattgtttcgtttatcgggggaataagctaaataacatatatatttgcaaacaaaaattaatttgtgaaaaaaatatatacatgttcttaacgatttaaaagtagagactgaaaaataaacttcgatgaaaaaaaaaatcctaaaattaactttaaatttatagttgaaaatttaaatttcggctgataattaagtataagtataagcataagcgaaaatatgaggcgtagtcgtctttgcccgtacgtgcggatgtatgcgtgtgtggtgatctatttttaattggtcaatttgaacatgcacacggcatgcatggctggtgtgctaaagctgcaagtttcttatttaatttaatttgttgctactgatttgcctttgtctcagttaattgaaactctgatttaccagctggtgaatatatatattttcagatgctcgtatactaccagtctaccacagaaaggacatattcatatactagctactagatagtattagtaccttaatttggttgtgaattctgatgccatacacaacgacacgaccagtatttcctgtcaccttatgtatgaccatccaaaggctatatatatctctacttattatttttcagaccaagttcatcaataagaaaatctacatttcagttggacctactgcaacttctctgaaagagattaagacaacttcttttagctatatattattttgtaacataaaactcggatgcttctcttaatgtgttttgagtccagctagctagctatagctaggacgcacgcatgcaacaaatcaagttgccacaaagaccgcgttttttcttctcatagaaccacaaaatcaataataccattaaaagaacaacaaaatctataataagagtactctacacaccgcttttttcccccttaattaagtatgtatctcagagacgtttaatcaaatactacctccttgcacaaatgtatgggacgttggttagttcaattttgagctaaccaattcaaacaaaaaaaaaatggagggagtattaaagaagtgcgcaatatattagttcttgattctcacagcaagtaatcatgcatgtatgcataatgaaatagcattataccaggattagttatactatacgccttcacatgtttgaaattaaaacattcaatttcaatttattttcttcttacattcttatctaggtatccataatatgtttttcctctccaagatcatcttaattatatatagcagattaattagcagtatactgtttgacttcttatcttgtatataatatataaatatatactgaacattttccaaaactatacataatatatatataccgatgttctataacctcaataatccactgcatctgctagcactatttgattatatatgcacgggaatcatatggtcaatttatatatatgaacaaaccatgttc

SEQ ID NO: 82229 - DNA, 3102 bp, Oryza sativa
agacaaaatacttgtatccttccatagtatctgggttgcaacttccagggttaaagctgctctcattaccattggcacccatgtactcctgaagaagttttgaactccggccgttccacaaggacctggatgctacatgacgtgccagaatcctgtagaaacactttagtgccagaagactccaaaataaccagaatgggacatgccagaacttagacccatgtgttatattaaggtatgccacagctaaaagcttcaatgcatttctcagctcaaaatatgttccgtaactagagaggcaattgatgctagagcggaagctgaccagcataagggcccagactgggaagagctgattcttgaaaggtgcagcttgcatggccccaataacatacaccaggatggcatcagacaaagcatctagcaagctcaaaatggttcttttcgtagagaagaagaaaatgcccgacaagaagaacatcaccatgtagaggaatatgaggaatcccattataactcggattcgaagaaagacgtaggtctcctgattccatttgatgagaaaatatgcaataaaagcaccaggactcattttggttttcccacagaaaagcgtgtacaatcctgggccctgatcaaataaagtttacaaaagacaactttaaaaatagctaccagaaaacatggcaaatgtattgaagggtcatgctgataatgctatagtggaccatgtcaccatggcaacaagatttacattcttcatgaaagcatacttcacaggcccctgtatgggacaggatgggtggagagggtggtggtgctaacaactgatctgtatttgatactagtgaacttaaagctattattgattaatgaaatagatcacatatagtgagtgtttccacgagcttcccttaaaacatgaaattatttgtggaagactttatttgaaaatatttctttagaaaggctcatagaaacactttcttgctttctcgaatgatttttaactataaggaggtgaaagctaaaactgaaaaaaaatgaaaaaaagaaaaaagccataagcggcaccacatagaaagctacttcctccgtccaaaaatatagcaaccttgtactggatgggacacatcctagtacaacgaatctggacagacctccagtacaaggttgctatattttggaacggagggagtaggaagtaggaaggtgaaggcgtgaaattgatttttgtatgaggagttttgaagctttggacaaggtacttttagaggtgcacaagtaacatgtgcggcttctggcttgcgcacttcatgcactatatggtttgatccttttcttggtcagtactcaggaacagtaaaccataattaattggatggaatggacagcctagcaggctagcataagacacaatatatctatcattttctcaccaactagccaataagtagagtgaacgaagggtgtacctgcttcagcttgtgctccgcaaccttgctgccgtctgcagcaatgcttatcctattagggccttgttattgtttcatgacaattgtgtgtcagtttaaatgaagctggtaatggatgctctgcttttgacctgtaacaaactacgaccactaacttagtatggctcctcaccatgcagctactatttcaaatcagaattgtgattgcacaaatttagacggtgaaaactaaacatgtaatattttttatgcaatgcactacttgcggctagaagaaaaatcacagggcagggatgattcaaacatgcaatgcaaatacatcagaaactgagctaggatggcgaaaagcagctgattcttacccaggtgcaggattcagtagctgctcatgatggatggatctgcagcctgggaagatagagacaactctaggcaaaaccttcagccaagaagagcaccgagatctggaaactgggctgttgtcataggctgagttcctccttgacctcactcctaactcctaagatatagtgatcataaactaaggaccacatatcccgcggtcttgttaagtccttatttttaacacacttcctaaaatatggcatttacagtggcgcgcaatagataattctggcacttgctgtcttgctgtactcttcatttatggtaagtagtactgtagtaatacttcaacggtgttggcaaactacataaaagaaaatttgaactgtgtagtagctttcacatgtgcggacttgttcatccaactggattccccagaaaactgttgagtaaaaaaataagaaacaatcattgacttgcacaaaactactgatcccttaccgtgatttctcttaggaccttccatgatttgttcgtccatttatacaaccattcgataatcccatagcatttactcctactttcctatcacatgatttgacgagaaatgcaccgcgattaaaaaaaaagaggagatcggacggagctgcaaaaaaatttaccgtgagagaaacagagagctccatagacaacactgtagagccccatcggacgatgccgatgccatggccgaccaagaaagcatcccccaattgagcgccagccaccctcgccgccggccgcggccgctgtaccacctccgatgttgatccccccacccctaccgctgaaaccgccgccattcacctcctccgcacctccctccccgccggcgagcggcggcaacagcggaagcaaatgggagaccgaacggagggagagagagagagagagaagcagccgcggtgccactcggcccagtaagcgtcagcctccggtagggaggcaccggctgccggagcggctcgtcgatggcggctgacgaggaagacggtgccggagccatcaacttccgccgccgccgccgccgccgttcgctggaactgcgccgcctcgtgcctctaaccctctcttacacattgcggcccagtaaagctaatgaaatggacagcccatcagtaccactggatcggcccgcctccgccttctggcctacaggcccagatagaaacagacggtatcgggcccacacggcccgtacatctgggccttgactgcacacgctgacacgcaccaccactac

SEQ ID NO: 82230 - DNA, 10920 bp, Oryza sativa
ggttaaagcaagttcgtgagggttcacagccttgaataataaatattgtgtagctctaggatcgtctttataaaataactttgggcaactaagtgacttttaaatgctgtttactgcaaaacctaacccctattattatccccttgtacccccctgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattgatacactagcgttcgggaaaaggcaattttcccggtcgcgacaagctggtatcagagccatctcgactgtaggataagccaagtggataaaacctaaggacatattatataaataaaaactatttgcgaaagttcctttttttctccttcccttaatgctatttgcaaaaggtttactcccttcttccttcttcggatttcaattagtactagttggtcagctttgtgaagaagatgtcgtcagttgtttgccgaagctccggaagactgcaggatccgctagtgaagtgaaggaagcagtgaagccagctgtgaaggagtgaagatcttggagaacccgtcgcagaacctaagccaccctctagtgtttcgttagtcgtgtgctcctttgcttgtgtgtgtagcgcgtggtttgcgtcggtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtgacactagtccaacacctgattaaccagaaccgattgcttatagagatactacagcagcaccagacgccaattctgaacttgagtcaaatacaacctcaagtacagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtccccagcagaaaagaaaagcaccactgcgaaccgaagatgaagtccgtaagatgatcattaccagcacagaatggcctccaccaggaatgacaaaacatcagagaagaaattccttccgaggtgcacaatagttgacagagcatcttttagctaatggaggtagagtgtctgatagtgaagattcagatcaagtctcctcagatgatgaaaataaaatagaacttaaggcatgctctcgttgtggagaaatcggtcatgttgccagctcgtgtgcctttacatgcgttcgttgtgaggaagaccatccacccgataggtgccctatgagcaggatcacttgtttcttgtgtgaaggaactgatcatgtaccaaaagattgtcaactcagttttctgctgacgaagaagatggccgaccaacacgcccattctaatggagagaagcatcaaggaagcacaaatcctcgccaagattacagtttcagcctaactccagtgccaggacagaggaaacaaaatgagaaaagaaaatgccgagtccgggaagatatccgttgcttcaattgtcaaggaatgggtcatttcgccgacaagtgcccaaaaccgagaaacatagctgccggcacgtcagtccacgcaactccctgcaatcagcagcttgctcctcaacgaattgtcatccatgcatcccgaagcagtcctttagcccgcgttgcaacaactccaattccaatgagtgcactaccacaaggtgtcaatgctcaatttcacccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcaggacccatagcagaaacaatgcaccaatgctcctcctgctgcacctgactcggcaataaatcttagcaaccattctctgcatcgacagcctcagcaaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcattatgcagtcctatcacatcatcacagaaccaatcgaggatgcagtcactggaacaatgccagctatatctctccagaatcaaaatgagcagccatgtttgtggttttcagtccgctacttatcatggtgtaatcgaaagtttgcagcaatcatgtaatacctaaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgtataattgttgactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggaggaaacccctaagggtacccgccatgcctctacattgataagttcggatatacctgcaaacagttacaaagatccaggagacatcaatatttgagaacataatagtcgatggttggtaattagtctatcaggtatcagaaaaggaacaaaggtgatatggcagaagaacaatttgaatgctccccacctcgaggaagcactaaagatgatcatcggcaattaaaccctagtggcgtagatacaaatagcaagcaatgtatttcccttaaggtttcactgaaaggcagcaagccaaaggacctcatcgtccccagaagcgtccgcaatccacattaaagaataccacctgttagagataagccgaaagatgattgaaaaaagagattggcaaagatgttctctagcataaaagaagtaggccgaaaggtgattgataaacagaaacatgctctgcatcgctcacggaagacccctgattgtaattgccccgcaacagtcaccttgtcattaagtaagcaagatgacctaggtaaaagtgtttctatgaaggcaaagagtgaaatcttccactcggtatcagatgctacacggagtgaaaaatgcatgcaccggttaccaggcaacgccatgtcctgggagatgatccaacgggaaagaactcatcaaggttaaaggtgtaaaggaatacgttgagtgctaactgatgacaacatgaagagaatagcggaaagtaaactgaatgtaaagaaagtgaatccgagttgcttgttcgtgagggctattcccagttatgaaccaagtgatatgttcgaagataatctacagaggtcagattaaaagcacatctaacaacgaagcctcagatttgacagggtaatgattagacaataacaaatccagcaataaagccattggagaagacgtcaaagtatgtcaagtgggataaattggttctcttgggaagcataacttatagttagagtggttgacccttgcatcgaatagcagaagtacctagcaccggagaccaggaaagctaatatgaggcagttggtggcaagttagaagtgaatgacaggcatgatattcttatgatgacaaacctggtaccctagtaatgacaagctagtgttgacgcatgacataaagtggtgacttgtatgaggttgactccgaagatatgaatcatgagaagttcgggaacggaagcatcattgaactaccgcaacctagtctgagtcagccaaaaggtgcaccctggtccaagtcaggtgaagagaagattccatccgcaacaggaggtcaagccaagcagttccgagtggtgaagttttgctggaagtttgtcaagacgcaacggaagaagacagacaagaagagaagaccgcccaacctaacttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaacattaaaatacgtacaagaaaaattcaaatgtgacccggagaatttctgttaaattctccttggtctaaaaggagccctcaaattttagtggaattttcagagcacaaataataattgagaagaaataaacaaagttaaaaaggttttataaaaagaaaatctctaaaaagtctgtttccccccccttcccctcttgggccggctcggcccagtccctccctctctctctctcttcccccgcggcccatcggcctcccccgtgcgcgcgccgctgacaggcgggcccgcccgccactctcgctgacgggtggggcccacctgtcatcgccttcctcccgccgcgcccgccgctcgcccgtgccctagcgccgccgccgccccgaatcccgccgcctcccgccgtccccgcgcgccataatgagggggaaattattccccgcgattccctctcccatttcccccgttttcccctctctctctccctcggattcgtccggattcatcccgcaatcgtcgccggcgtcttcaatggcggccgagatctccgcgccggtttccttcctctccggccgcgctctccccctctcggcgctatatatttgctccccgtgcttcgctcttccgtttccgccgctcgccgctcgctctccccgtcggattcgtgctcgcgccgtcttcctctctctccgccgtcgccgacgagctccggttcgccgccgacgtcgctccgcgcttcctcccgactcggcgccacctccgtcggcttcgccgcgtcgccgccgaccccgtccgccccttcgcttcgcccgccgaccgccggagctccgtcgccctcgtcatcccgaaccgcgccgccgcgttcctccgctccgttcgtcgtctccgccgtcctcgtgtctcggggtgagccgtggaccgtcccattcgcttcccccttccctcctctctctcgggtgccgctccgccgcgccggtggtcgccggcggtgaccatcggggcgcgggcgcgtcccccccctcccgtcggccgtgccggcgaggccgccttcgggcgcgccctcgcggctgccaagtgggcccggccgtcagccgcccgcgcccgcgggtgcggctgacgcgagggacccacggcgccgaccgccgccagccgcgtgctcccggtccaccgtggaccgagaggctgacgcgtgggccccactcccgtggacccggtccgcgcgccctctccctcggctgacgcaataaatgagtttttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgcttgttgtgtggagtttagtagagtaaaagccttttcttttccgttggtcgtgtagacgctgcagcttcggaagatccgcccttcgtggaagttgaagccagcgtttgggaaagtgagcaaggcaagtcacatcatccttgagcatattgaatcccagtttataaaattattttgatttaaattattgcattatcgctttgtttaaattcccgcgttatcactgttttatttagccatgcctatttacctttgttatgacattattattgctattgttattattaccttgttcaccctagaataaacaaaaccccaactagtgggtactctattcctggttccactagtatgaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctatttgaatagccgagccctcggatatgggcaagccgagcaatgtaccaaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagctctaggatcgtctttataaaataactttgggcaactaagtgacttttaaatgctgtttactgcaaaacctaacccctattattatccccttgtacccccctgcattaattatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattgatacactagcgttcgggaaaaggcaattttcccggtcgcgacaggccccacctgtcagcggctgacagagagagaggagagcggcggctcggcggactgggccggctgggccgagggaaagagagaaaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttaacaaattaaaattagatcttctcttataagcttttaaaatcatttctaataattccttttaaacaacaatttataatttaaggatttttaaacaagaaaagctcttaacaattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacattttacttcacttgtaaattaaagaacatttaatataaattctattaataatttattaaataatttataaatcctgaaacgaaaatcaggatgtgacacctcccgagcggcttcctcggcttggcgggcccgggcggcctcctcccgagcggtatcctcagcctggcgagcccgggcggcttcccgggcggcttcttcagcttcccgtaggcggtctgcggcctctcgccggtcagattcccgcctccgtgcctctgcggccgccggatcttcggcctcggactggccggacttgggatggtgggaggaacgcgatgggatatcactgaagcaaaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgttggcgcggccccctccgggcgcctgctgctggcacgcaccgccccgccccctcggggaggagatgggggaggtgttcctcccagtttcctcttcccccgggcgtcggtagggcggttgctccccgagcccccgacgcggggcccagaagcacgaccccctccgggggtagattgatccccccggcggctcccacctgcgccgtcatggcccttaggagcctgctcctctgaggccccgaccgccgtcataatggtcaagatggaggcacgatctgggtcgctgcagagggggagaataccgtgggggatgagggacgcctccacggagttgagatttagcacccgttggaccagtatcttgaagtcctcgggggcccaatcccatctgactccctggtgggtccgcatgtagtcttcggacccggtgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcgccgggggctggctcggaaggcggaggcgcgcttcgtcggcgaggggggtgtagaaccagtcgctcttccagtcatcccacttcttgcggaggacgcaggggatgtagcggttcaacaccggcccccgcggcaggaaatagcagccgccgaccaccgacggtggcgataccgactgcacggtaaagaaccaccggaacagccggagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcgaaggggagaaagaagacggaccgccccgggtagtctggcgccgggcgtccctcacccagcattactatctcacgaccggtggcagattccggcatgaagcggcgcggcaacccggcctgcttctcgctcacaatgcgagaaggcggcagcacgctaccatcaagcagtgcggagccccgtgccatggcgccggacgaagagaagatgaagagcgagcgcgtgtggcgaaagaagggcgcagggaagaaggagttaggacgcaagcggcgaaggcaagggaaatgatggcgaaaggaaggagacaaatcccatcctccgtgcctttatacccttgccaacgctgtgcccggctcctcgtttctcgcgcccattatttcgccccctcgtttttcgcgcccacgcttccactaatcccattcgcccgcttgcggcgcgtgagatggatatgcagttgcggcagtcgagatagatcatatcgtgcgcgcgttaattacgctcgccaaccgaagcgacattaccgtatctccaggcgaggcaaatcggctcgcccagattcgtgcgccgctcaggtgatgtggcagtctcgaagagaccgcccattattgacagccaaattaccattaccaatatgcgtgatttgagaccgttgggtttctgcccaaccatggagaccggtcccacctgtcaccaagctttaggagtggcgtcacgcccgaccgcttcccttgagaagggcgatcgccctggcataacgccgggggctactgtcggtgatatgggaccgggagtatcgtgactagaggcttgaggcagacacaaccgcccacgtggcctggcaccttcggggacgtcgggcccgagggtgaggtgaccgccctcctcctgatttccccgagggggggtcgggtgactc

SEQ ID NO: 82231 - DNA, 6023 bp, Oryza sativa
caccttaaattcgtcgtgattaaatctttacaaagagatctcacatgattatattttattgtaaaaaaaatctttttcaaccgaaacattaagttacaactgctgaaacatcacacaataatagctgaaacattacaaaaatatctactgaaacattcacagagcactgtgtgcaacatttcaaatgatctaatgaaacatcaattaaattatcacaaaatatctgctgaaacattcaaatagcactatgtgcaacattccaaatgacatagtgaaacataattattgcaacatttaaaagagcattatgacaaaaaaacattaaaatattttttatccaaatataatcatatgagatcttattacgaagacttaattacaacgaatacaacggtgtaatcggatcattgattggatgcatagtttaaaagaagaaaaatatttaaagttttgctattaagttagtgcatgaagagtgagattgaggagagaggtaggagggtgtgtcagatctagtgtccccgaggagcggtaagcaactagaaccaatgaattgcttggagaagctagagagatggagacagagaatgtgccagcagccaacacactaaattataggggtggataattagttggctcggctcgtttgagcttgttatcttaacgagccagcttggctcagctagttagcattaacgagctataatgctagcttagctctgcttggctcatgaataggatcgttaagctcgatgacgagctctatctcatttttaccatattaataattttaaatttagcattttgtcatatattaacataataataaaaactaactaataaagaactcaataaatacgaatagtttgtaactaaaagactaagcactaattaagaagcaccgatatcttatactaatgagctaaacaagcggatcgtgagctagttcgttaaactctcgagctagaaggctaactcagctcaactccgagttcgaggtgatccaagtcgaattcgctacataactttattttttttcacccttacatgtatcaatggctgggaaaatattaggtatttttttagcgttgtagtttactccctctgtcctacgtaaaacaaatataagactagatgtaacatattctactacgacgaatctagatagaagtatacggatggagtacataagagcgatagtactctttggtggaacttcgaacaaagatgtcaggacctgcccgaggttccgaaaagcaacaagagccttttcgcaaaagagcggctcgtccgtggcccgaacatacctggggctcaaatccaggggaggaccgggacgggaggcccgcgcgtcaatagcgaaaatcggtgtgtgggactcggaaaacaatggtcggtgattcctcgggtggtgaactggtgatgatactccggccaaggtctctgctgaccttgaccgtttctaattaatggcgtttgaagcggccatggaggagatcgatggtacggtagctatccacgacaccaacggagaaagtgagaaacgatgggcaacctcgttcgttttttaggttattcttcggcctcggccggcgtcagtactgccgctgcctgcagctagcacgtcgtcccacaatggatttgcacgtgtcctcggtgcctgatcccaagccacaagccacatgctcccttcgtcttaaaaaaacttaattctaagcttaaatctatatacattatatttagatttaaatctagaattatattaaggagtatagatatgccatatagtgctcccacatgattagtttatcatcaaaccgtacaaaaatatcctaacagattctcgttctcccttttttttaattgacagttagaatctcacgtttcaacactgacgtatggaacagattttaaagttgtcatactaatccgactattaattgaacgattttgctatatctcactcgaaagattttttcttatctctcactcaattttctcactcaaatttacagtgcattttcttgtaagttacagtgtaatttatgaaacttacactgtaacttttataagttacactgtaatttttgaatcttcacatgtaaattttaaattttgtattggatttggtctttttcttgaggatatggtaatttaatgttcattatggtgtttcttaattgctttttgctttttattatatctatcggattttaatataaagattaaaaatctgtgtgatacgattataaaaatctttcgaaagatgtataggtactcccttaattgaatgaagttgtaaaagagacttaattatctgctgtttatactagtagtatttccgaagtatacgttgccatttgccacagacgttgagcagcgcacattttcttctgcttggttaattaactgattgtggctactctcaagcagggtttacaattttggaaaagaccgaaattttgggttaaaaattttcatattttgagttaacagtttaaaattttaaaatccaagttaaaagtattcaaatttgagttgattttaaaaaaataaaattgagttgaaagctttcaaatctaagttaaaagttttcaaaatcttgacttgaaattttttaatctaagttgaaagtttttaaatttgagttgaatgttttaaatttggggtataaagttttaaatttcggtagatttttttagaatttaatttgaaagctttaattatatttaaagaaacaaccaaacattaattacggcctaattacaaaaaaaaccccgaacactaattacggagaaaaacatcgaattaatcgtgctaatcggcactaaaatacagtgctactcatgtttctttatgttttcgattttatcctaagctagcaaaacgtggacgcccgccggtaactcatcttgtgcaaacgtgctaattagtcttctcggtaatcagctaggcgtaccggtgaactcagagatgtcgtagccgcaaagaataaaattttaaaatatacaatttttacgtttttatgattgctaggaaaaaaaatacccgttgcaaaacatatgtttttagtgatacaacaacttatataggagccgagaaataaataaaaacagtagtatcgctatatattataattgaaaaaaataatgaatatcttttcttgattttggaccaaagcctatttcttccttacgttttcagcttacctctctccgctcagcctatctcttttcggcccagcccacaagtagagccgcaggctgctcacatagccaactcgtgtccttaacctccggaaaacagtcctttacccatatgacgtggaagcctatgttctcaccatatgacgtggaagcctcatcaaatttgatcgaatgtttctcgatctcctaaaattggttgagggttttcaaccactcgatcttctctttccgatcaatgtttctcgatctcccaaaattagttgagggttttcatccactcgatcttctctttccgtttttcataaaatcggacaaaaagtctgagaagctcgacgataggccatcatcaatggagtaacgaattgaagacgaattgaaagagtaaattatggggaaaataaatgagggaggaacgtcagagcctatcttcccatcaaatttggtcgaatgtttctcgatctcccaaaaattggttgagggttttcatacggaaggtagatcgactgagatcagacaaaaaaaagaaccgagaactaaaaaaaaccaaaaggccgaaaaaaaaaggaattccacatgcgtaaaaatactaatcggactagaaaaaccggccaaaaaaaagaagacggacaaaaaaccaggaagctattaggtatagatatagataaattagagataaaaataaatattagaaaaccaactggaacacatatgacatatcaaaattttaacggaaacatattcaatttttataatagtagagatatacataattttaaaagatttgtgaaaatatacacgtacatgagagatgtgcggccggttattttgcgtggcacggaggtagcgagaccaatagccggaataatcctgcgacatcggtgcacagtaccacattggttctgcgggccagtcacgcggcaccgcatatgtgcgtatactgcatgcatatgcgtaacttggctgttcagtcgtgcgccccgcgtcgcggattgttccggacgttggtctcgcactcccgcgccttcatgctgtgtaaaataatctgtcatttttgaactgcggaatgcgtatatttcgataaatcgttcaaaaccttttataatcgtacgtaaaaaataatgtatatttttaaattttattctagccgcaaatgctccgccgccacgccaccgcgcggtcattcgcccgcctctagtcctctctctcctcctctctatagtaagtagtacatgtataattgtatatacgtatgtgtgtactatacgtatgtataaactttttatatgtatatatatattacaattttttatatgtatacacttttactataaaaaaatacatgtatataaaatttatatacgtatttttataaagtttgtatatgcccatataaaaaagaataatacacgtatataaacacatatacaaaatttgtaacgtattaaaaaaccaaaaagtgggaaagaaaccggagaaaatatcaactttgtatttatatttgtatatatacatataagaaaatacacgtatataaagtttgtatatgtgtatacaaactttgtaaacatgtatatacacgtaatcacgtatgtaaactttgtaaagtaacaaaaaaccgagaaagaaaaccggaaaaatggaaagagaaacggagcgaaaaatagggaagcgcgcggcgtccgccgcccctctttgcgcgcgacacgtgttcgcgcgtgggggtgtgtgtggtgggccatatgtggtatgccgtgtgcccctgtcgtttcgaagataacaaattaacggcaaatataggggctcctacgtctttccagccacaatcaccaccgtgtaagatcgatccaacggcgcatggagaagaggccgcgagatcgctaaaattttccccatttcccgtcgccgccgccgccgccgccgccgctcgccggagctgcgccgcctcccgatcttcccggtccctctcctcccttccagaagcggccaagaccaacggcctcgcccccgctacgtgagatcgctggtgccctcgtagctccgatccagcctcgcccccaagccaaggagcgaattcaggtattgcttcttcttttttctccccagattgctgtgcacggatttgccgtaagatgggggaagtaatttttttggagcttccagtaaagggtctgattgcctgacccttcccttgccatatcaagaacgcggcatcagcatgttctagtattcgtacagattctagcctgaagctgacttttgatgatggatgattcctgcaaagttgcttgatgtttttagtgactgagttcacactatcatattgggtaattaacttgggtaaacttcatcgtcggtcataatgtatcatcctctgtttagttacatcactgatggtcttgatttcgcagtgtgttagttgttagttttgagttcaagtatgaagacgtgttgttagtgctttatactagtagtatttggtaagctcatgctcacctaacaacattttgtttcttcagattttctatggagatttagctttcatcaaaacaaaaacaacaatatgcattatgcacgaattaaaatggcgtgtactatagtaatttgtctcagacaattggtaaagattgtggtttttacctatactgtctattgttttctatgtctctccctggatcgccagtggtagctgaaattggggcattcagcatgaggtacaaaaattataatacattgtgatgtaatagtagagggcaatatgtaaggcagtcagagtcacaagcacaattaaaatgtaaaacctgttatttctgatatatg

SEQ ID NO: 82232 - DNA, 7773 bp, Oryza sativa
  unsure (1)..(7773): unsure at all n locations
acgtaaacccaacccgcatctttgaagactgggccggcaaatctagcagattgacgaagtcgtggcgcccatcttcgaagactaggttgacaaatcctggagattgacgaatttgtggcgcctcgctgtcgacggggtacatcgcctaccactgaaagcacaaagccgttaaattctggaaaattcgctctcatagggagttgaacttaggacctaagatactacttagactcttgtaaccactaggctactggccttttcgcgctgtagattccagttctgattatgcattgttcagagatcaagtgcagataacccaatcactacctttctgaatgaaatctaatccaaatagtgaaagctaaatctgttatgtctgaacagttctgaaaagctggaccagtcgaagagcttcattgatagccatagatacagctctgatctgagagcatttagccagcttaagcttgatcatttgcttctccgggaccaaattgattgacaggctgaattagtcccggtcccaagcatggcagatgcatttgtccgtggcatctgaatctcctggagccgacatggaggttgcctttgtagcagagatcatctcagtcaccagctagatgatttgtcgtggattattattggcttcacgtttcaaaataatatgatttctcaaaaagttttttttttctgttgtattgtttatttctttagatcactgggtcactggataagatatttaattttgtttggtaagataagatatttagctgtttaccactcctgcatgtggcaattaactatttgtcacttggatctacatatcttatacgtataaaggtccacgcgtcattgagatataagtgataaataattaaactccagtggcaaacagttaaatgcccaagataagatgctactactatgcaattggtttttcaagacaacatggagctaggattaattcggcatgatgcttactagttctatgcaattggtttttcaagacaacatggagctaggattaattcaggagcacccgcgatagtttggtagcttgttgatgagtaggaaacggagtcccaagtcatttgggctgaaaacctgagcaataaaaatgttgatcatgcattacccatccccttttacatgttcatctatttatggtgctttaccaaacatgctgccaggctaagctctttttatttatgttttctttgcccttgtttcaaagtactaagcaacaggtcaaatgaagcaactaaataggtgtaattttcataaagttccactatttccttaaatctccttcatcaggaaggagccagtattattattggacgtccacagtttnttgggnggttnttggggggnaaaggtggttaacccaacccggggaaaaaattttaagcataaaacccttgccagtgatctcattatttcaaaacctagcttgttgtttatggggaaaaactatggaaaaacagtgcctggttatacttatattctgcagagggtaactcagttaatttctatttggtcactcctgtccacttcaattaggtaatttagtggaaattccttgtatacctctgaaatcgacatctttgcagagtttagaatgcatcgcaaactgttcctgtaatttgaattcatgctactgtattccatttatacattcagtaagatctgatgtaagttgcggctcttctcatttgccccttttggctactgttccttgttttctggtaactaatcttggttaaatattatctacatttccataggcgtttggctgggcatatgtgaacaatcgccacaacacatgggagcaattctacgtctactggatatgcccttttgttggtgctgttcttgctgcctgggtcttcagggccgtgttcccaccaccggcccctaaacctaaggccaagaaagcatgatgaaatcaagcacaaacttcaactcaggagttggtacaatgttggatttgaagagcccaacactattagtagtatgacataaatccacgatgattacacatacatactggttaccattcagtttaactgctaggcttagtcattaaaataaggtctggtagtgacaaaataagctctgatggttaacctaaacacatttgaccttacatctcacagtcacaggatgtaagctaaaaaaagcgatatgttatgtgcatgataaatagcagaaatatactacatatcattcagtagtactccatctgcttgcgcttccccttggcgcttgctcctaccttgcctgcttcttcagctctctaccaaaacaaaaataaagatgactgtcaaaacagtatggtttaaatctgatcccgttgttgtatatgccccaaattaagcttgaacaataaactttgaacatttaaaaagagggaaagtgtgcactcagcagtacttcaaggcatgtagctaatgaggttagtggccatggcatcaatgtagttaaaggtaaatgtacaaaggttgctactgttgccagcatcagttaagattcacgttgcacttcagcatgctgcatcttttagaatcaacttaggcttgtaccaataatgtattcggtaattgttttcaagaactccctatattcattcattaggcaatataattcactcaggtttatattggagaaaaagactctcaaactaatacccaagcttaggctctgcataaatttgtgcctcttcgaataaacttagctcataccaattcttaatttgaaaattactactatcaaagttcaacatgagccaggtaattttcagtggttaagacaagagaaggaagtttgtattggataagtgaaaccaactatgaaaaaattctacactaaagagaacacaacatcaaccatgtgtcaacaaatcattcggaaattgatttcaaaacctctacaatcattaattaagtaattaattagacaattcactcaggtttgtattgaagaagtgaaacttagcaagcattccgcaaactggatatcttaagcttgtcccatataggaatagtacattgaaagcatcatagcgtatggctataaagtaagaaaaaatcgattaaaataagtattgtggcaaaacagtaagccataaatgcaaatgtgagaattaataagggtattgtactttttgtcgacataacaacaaaatgctacggaagttgctgatttttttaaaatttcagtttaaatttgagcctctgcatagtgcacactctactaaatcattgaatagacttaggctgataccgattcttaatttgaaaattactactagcaaagttcaacatgagccttgtactgctcattggttcctgatgagaagaccggaagagggaagctggcacacatatgacacactaaactgtgttcaatacctcaacataaatggctggccaaattaagatgtcaatattttttaattagttgtgcaagtgaaactaacttgatgtgacaaatataagcgtccacatatcacttacgtctaaaacaaacaagtatagaacagtaaaacagttaggatatgaagctagaagtacactgggtggcgctgagggtaagtagcatgcagtagcaagtaaactaagtacctggtggtcctgtaggtatgcagtgaagtcagtggcaatgagattgggtataagccactgcaattcaccatgttgagatatctttgtggaggacaggaccttgtttcgccgaatgtcgaagcggatcatataattggcaatgggcaccaggtcatcatcgacaacgacgatcccaaattcatcaacttgtgcaggtacctgctcgatgacattcagaatggtatacattaccccatcttgggtcaggctgaggacaggggaaactggtacaacacatggcaaccccatttgcttgaagctctcacttgcccacatctcttccacagataaggacctgctatcctccttccactccttgaaatcaggggacagaacccatgtcttgagcatcacctcattgggggggcaatgaatatcttccaagccaaccaaggcgacaaacttgacggcgccagagacgcaggccatggaacgccgggctagtggcatcatctgatggcggagcctgtgatggacatcgatgcaatacccagtgggcaacggaatgaaccccaacttggggccatccggtgccaagatgcggtcgcagaacaagatgccctgtaggagatcaacccagcagatgcggccgctgtccagggagaaggcgaggtcgatctggaacaagtgttttggaccacatagatgtgcagggagagggaggcggggaatggaggacttgacccactcgccgccgctcttcttcatggtcagcgatgaccatgcgaagatggtggcttcggggaggcccaggccggagttggtgacgatatcggcgaggatgtaatcatcggcagagcgggaggcgtcgacgaggacggcggtgcggccgaggtgtagcaaggtggggaagcgaggcgagtcgggcagcggggggatggcggtgagggcgttggtgggggcgtcgtagaggaggtagcatcccccgaggtcatcggagcagcctggtcggtagaagccggcgtagatgacgacgatgcccttgtgggtgctggcgatgtcgccgtcgcggatggatcccagctgctgcgcgtgcgcgggcgtcggcgacatcatccgcagggagctcacttgcggaggatcggcgaggaagggatggggttccatcgcctccatcgcctctcgccgactcagcagccgcgctctgctccatccgatgactatgcctgcggcatctttccatgtgccgtcgggtaactcgcgtcctccgaaaaacactactctctccagcaacacatagggaggcctagggtttgccatggttgctgctgctagctagggtttggtccaacaagaagaagattgccaccagcggcaatggactggtgggagaacggggaaaaccctctctcggtctcggccaagagacacagacggacggacggagatctgactgagtcggagacgcggatcgcgccgttgctggggctggacggttagatgtgctactcctctgctcccaacaaaagacacgcaaaaaggtcttccttcgtggaccaggtgcagcgtgaaccgacctcctccttatttttcttctctagttcaacaatttatttatttattattattattattactcattaactaaaaatgcatgttcaggtaaaggctattttaatcaattattgttagatttttttaatctaaaaagtatatgggatttttattttgatactattgatatataattttggactcttattgggatgatggccatatttagaaaaacctatggcttgccatctctgggattgaggataaatactcgccattccatgctccactagatcaatatggcgtggagttcaccggtgcaagcaaggcctgattaacactagtagggtctaactcttcacgatacataccgatagctgggtctactaagtttttcttaaaaataatacgatggtttaggccagtgatcttgttccatccaagctttgccccagggaaaaatgtatctgtggggtagttaaagctcttccaaaaaaacttctaaagagcttgaggggtttgttaggatgagatttccactatttaagagcataacaatggtgttgtttgtggtgatgttagcttgggtagtccaaaggacggcactggttgagcggtttaagatggcaagatttccattacggaagattgttagctccaatgatgcgggatcatcaatcggcttatccctatttgcaacccatgcagaagttttttggcaacctgattgaaccatattccttaggctgtgtttagttcagcgcgaagtttggattttggttgaaattgaagatgatgtgactgaaaagttgtgtgtgtatgacaggttgatatgatgaaaaaggactaaagtttggatccaaactttggatccaaactttggaactaaacacagctttagtaccacttgttagtttttccagacgcttttgtacctgtgttgaagaagccgagtgcgtaccttgcattttttgagacaagcttgtcatcgttggccaacgtttggccagctgagatggtgtccgtcgtggcagaacgtatccaaagattcgatctgatttgaacttgctgcgatgctacgaaaatgaggagagccatggtgaaactgtaggataggtggtcactgctcttcacttcttcttgcatttttatagaaggtaaatgaggcccatagggaataacaagttaacaacgaataggccttgtttagttggctaaaagaaaatttttggatgtcacatcggacgtttaaccggatatcggaaagagttttcgggcacgaataaaaataactaattttataactcatcaggaaaccgcgagatgaatcttttgagcctaattaatctatcattaacacatgtgggttactatagcactttttggctaatcatgaactaattagtctcaaaagattcgtctcgcgattttcctcctaactgtgcaattagtttttatttttatctatatttaatgctccatgcacgtatccaacgatttgatctgattttttggaaaacattttagggaacgggccttactaatgttggagggcaaaatggtacagtgatgtccatcagtgtcagtcactgatcaggcagccaatccacacgatgccccaccaatcaatacgcctgcaccattttatgaccaggaataaatgggacctgaccagggttcaacttaccgttcataaccgcaccgcacggttaccgcggttaccgatcttaccgcgaggtacaaccgcacggttactgtggttaccggccttaccgcgaggtacagtaatagaaaaaccgcggtaacctccttaaattcatataaatttaaaaaataattcaaatttttgataaattttacacggtttcatacggttttcacgattaccgcgcagtaaccgtgcttatcgccggggcgcggtaaccccgtcctctgcggtttgggaaacgctggacctgaccgcatgccgtggaaactgaaaacagacttctaccattctacctactctcaacacgcaaaacgagaagttttatccctttaataccctttacctatctatcactcttactatttttttcaataattaagggtttttttagtcattcttactctctactaattccacctcaggatgctaggaatgaatttttttttggacggagggagtagtaaggggtgtgtttggttgggaggttttgggtgaacgggagatggcggcccattttttttttgcctgtttggttggtgggcggaagtgggattgggcggcccaaagaggaatatacctcgcagatgccggatgcaaccgcccgagcggccgggcgagcagggcgagcgcccgaggtcgggtcgcttcaccgcgcatcagcgacagccacaggtcaagaggcgagagcgcggcgacggaaggcgaggtcggcggcggcggctgcagcggcggaaggcggggatgagcgaggtcggcggcggcgcgagatgcgggcggaggcggcggaaggcgaggttgcagcggcggcggggagggccgaggtcggcggcggttgcggcggcggaaggcgaggtcggcggcggctgccgcggggaggggcgaggtcaacggcggcgcgagatgcgg

SEQ ID NO: 82233 - DNA, 16917 bp, Oryza sativa
cctggagatactcgttggagctctcactataagacactgaagagtttggttcaattgttccctacaactgttaaagttctagagtatgtggaagagaatgacagggatgacaaaaatagtaggcaagcagctggcctccttgtttattttcagttatttcagtttgtgttttatttgcagcttatgttgaatatcttggcaatcacaaacaccttttccgtaactttacaaagaaaggatcaagacattgtcaatgctgttaattgtgtaaaatcaactagaaatcacttggatgagtttaggaggagtggttgggaatctattttagctgaggtgcataacttttgtgagaagtatgacatttcagaattggagatggaggatgcatacataaatccaaagaggccacgccaaaaaactgggattacaaacaagcatcattttgaagttgattgttttaacgaaattgttgattggttgcttcaagaattggacaatcgctttaatgagaaaacatctcagttactcatatgtgcagctgccttaagtcctaggcaatcatttcatgatttcaatttagagcatttgatgagtttagcaaaactttatccaaaggattttgatgatggggaactaatggatcttagacatcatctttctctttatatcgctgatgtgcgtggagatgatagattcgctaacattgaaactatatgtcagctttcccaaaaaatggtggacacaagaaaacatatttgctatccattggtttaccggcttttaaagctagcattggttttgcctgttgccactgctacagttgaaagatgtttttcagccatgaaaattgtgaagacgtatttgcgcaatcgcattagtgatgaacacttgagtgattgtgttatttgctatgttgagaaacaagaattgatgaaagttaccaacagtgcagtaattcaccgatttgagaccttaaaggcacgtttacatgatgtttttactaagtgatctcttctcttttctaggcaaaacaatatgtggttttggaggtttttatccttttttgctcgttttgtgatggtggatcaatatttcagtaagcacttcattcctatgactttataactctgtgtggcacttaattatattactctatgtgtcatattggttattaatattgtgtgttgtctagagctatgatatgcataggaccccgggtcatttttgttctgggttcaccactgatcctcgcctttggccatgtagcgatgcctgccttgggacgaaggcgaggcatatcatcacctactcgacatgatttttgatgagcaggaagtaatcgagctatacagctatacacatcctcttgcttgcttgccttctcctatgctgctacattggtgtgtttgttgtactgctgctcgactctgccgaggctgacccgtggagcattgtgggggttggccggattgccgggctgggttcgtggattgcatcctcggagaccgccgccatcacgcatgcggatacgccgaggtcgaggtcgatggcgatggggactgccgcgtcagccatcgccgccgccgccgctccggctcccgcttgccgtcgccgcccttgcctgcagattacgctacgagagagaaggtgaagagaaaggggggagataaagagagagaacggggagagagggagggggaaggagagagaatgacatgtaggcccacatgtcagtggggcccacaatactttttatgtgtgaatcacatgtgggtccatagttttttttaattctaatgccacgtaagcgccacgtgggacgaaaattaggtcaacattgccacgtcaacgtcacatcagcaaaaccaccctccaaaaccaaattgcactggtttcaatagtttagggagtcattctatccggttttgcggttgagggtcacatattagattcgggttacttttaagggagtcaaagtggacttattccttaaccgaaggcacaatttcgcatgggccgggattgtttcctcgccaggatgatccacggggattgggccccgatcccggccattcccggcccaaccgaacaaggtctaatgagtattgggctacaaacgttcttatttgttcatatctttcacggtacggaaggacgaagtactagcggatagttttaatcaaccaagtatacatggtgacacgctttttaaatggctaaatggtgtgcttcgtgtgaaaacttattatatgaaagttgttctaaaatatcagattaatccatttttcaagtttgtaataattaaaactcaattaaccatacgttattaacacctcattttacgtgaaacacttaatcttcatcttcagtacattcaaacaccaccatagtatcagcagaataaagatatgatcagtttacaacagtggaaaaccaaatcctagataaaactcttcctcacccttttgtctacggatcaggagcaaaggaggaggaaccaatgaggaaccgagagccaacctggcgatgatcaccgattcaccgctctcaccagtccacgttcgtcttgataacggccgcagagatctttggaaaaccatggataggagcgccatcctttgcttcgcggctacggctagctgccctaggtgaaacacgaaaaaacaccatggatgggagcgccatcctttgctcactcatatctatttatgagtgagttgagtattgaatacgagaactcggacttgaaatcatacacccattgccattgcactatactaatcgagcactttctattagctttattgtgttaataaaaaatatctaacctttgattaaaagttgtgtggtcttttgaagcctaaccgatcttgcgtacatttgggctatcttttttcgaacgcgcaaaagaattgcacgtcaatatattagaagaagagagcagagtttgattacacaacgcacacagtcaaaaggccgttgacaggggtcaaggaaaaaaaagaaaaaaaaacaaatataaggaagataagctactaagaaagaaacaaaaactcctatcacaaggaagggtggggtagggggtcccactacactccggcctgcaccggaggcagggagctggagaagagcgaagacagggccatggcgtgatccgagggaggggctgcacgcatgaggtcgagtcattcggggccgcaatcctcttgctacgcttcggcactacccccacggtggcaacaacaggcgccggaggcaggggtagcggggccagacttggaggcatagacctggagcatttggcaaggaaggtgcgcaacgtggcattctcgacgaccgaaaacgggagctgcgccatcggccgaccatcatgatctagggcgaccatcggaacgtcgaacagaaccgtatcccccgtgaccaagggaatagtcggtggcaagggcaaggttgacggtggccgagagtagccgaccagtgggacctggcttgagagaggaggtgaccccgccacggccagcgccccgtggcggctacccgtcttgacggtgccttcaggcagggatggggtggggagagccgagcagccggtgctgtccctactactggcacaatcaaatcgtcggcgtccaatggggagggtgaaactgcgaccgcctccaccaacctcgatgatgggagcagggttttaaatttcaaaatcagcagttctgccgcagctgagcgatagaaccaaaatttcggaaaaaattttgtatgattttttttgaatttttgacggattttgaataaatttgaataaaaattgaccaaattcacaaaaaattgcaaaaaaccaaaattttcgggcgagatgttagcatttcggtgggggtggggggggcgaaatttccgaagaacagaaatttcaaacactggatgggagagatcgcggcggcatgggcgatgacacgcatcctggcgaggacagggccggcaaaggcgagggcgcacagattgcagcagtcggcggagacaggggcgcacataccgcagcggctaccactggcctcgacaaggagagggctagtggcatcggctacggaggagagcgaggcggcggcggcggcaagaccacgtcaagcgccaccaccgacctcggtgatgggagagatcgtggcggcggcggcgacgtgcaaggcgcacagatagaccaaggcgaggagaggcccggccacgccagcggcggcagcaacatgcacggcgcatagaccgcagcggccaccaccaccggcctagacgaggctggaggcgttggagagcacaacggtagtggtgatgcgcggggtagcacaggaggtggcccactgcggagcttggccggcggcgaagtctcgggtggcaacaaggggcctaatgacggccgaggtggcaaagacaacggcggtgcgccgctggtggcgtcactatcttgccggtggagcagacggccgcggcgatcgataagcttgtctgtgagccagtagtggtggccgacgagccagcggcggcgacgaacgagccggtggtgaaagggacagtggcggccaacgagcccacggtgagggaaggcatcgtgtcaccaacgcggcttgtcggaccggagagaggagacgacctagagaggggggcagcccatgggagagaggggacggccacgggggagaggccctcgaaccgaagcatccagaaggaaggggtagatggggaaaattaatatgtgttcgtttggctggggcacgggttgggttctgcactgtgggctgtgttacctcatcagtaacttgatccagttaaaccacacaaccaggggtgcttgcactatgggatgggtgtctttgggccaagtttttggactaggggtacgggctccatggcttacactgtgagtgccctcaaccgcttcctgctgatcatgcaccatctatcgctgcgtggcatctatctacccgcacgacacgacgcataaaagcatagctccacgtaaccatagtaaaaaaccggactgaatgggcggttgaaccggaaaaaaccagaaccggccaccttgacggttcggttcaactaaaagaccgcccctgcaatcgatccggtaaaaaaccggccggtttttgcttgaaccggtgaaccggtggcgggttttaagtatcgaacccgtttttatttttcctattgcagtatgacgtgatgaatatattatgttaccacaccatatttattttttttatgttgtgaccatgtaataaaagatatactggtttatttatgcatattttcaccaatttgtgatggttctatattaaaaataatacaaatcaaatatctctactacttaaaaaatgatgtttcctccgtccgtcaaaacaaaaaaagtagcgaaaaaaagtccgactcctaccgattccctattagaaatggaaaaaaaagtccgactctagatccgattcacccttaaaaacgaaaaataaaattgatgtgccggattgaagatctgtttgcaaaaacggaacctaccggttgagagcattccatttttatatgattttaatttttggatctatacttttgcatttgagtccctgtaatttttatatttacatttaagtccctataatcttgcaataagatacttgaggtcgtttttggttaaaaataataaaagggaaagaacaaaggcagaaagctgcataaaaagaaaaagaaaaaccgaacaaaaaagaaaataaagaaaaagaaaaaaaaacaacaacaacaaaactccgtttctcctaagtggcgaaaaaaccgtagatctgatcctataaaaaacaaaagaaaagtgaaaaaaatgctagatctgattcatttagaaacagaaaaaagtctaattcctataaaggcgaaaaaaattcaaaaaaacatctaaaaagttcgaccggttctctaggaagaaaaaaatggtttgcataaaataaaaatacgcgtgaggaaaaaatggaaggggtgaaacaacttccgatttctaaccaatatatatctcttcgctatgtataatctaatctaactatttaaaaggataaaatgcacgacaaaataaaaacggttcaaagaaacgtgtgagaaaaatcagaaaaaagcgcaaaaaaatcacgctaaaaaggttttccatcttccataaaaaataaaaaaacacgcgagaaaaaatatttccatcatcggtaaattttttttagaaaaacatgtgaggaaaaactatcagaaaaaacgcgtcatttctaaaaaatggtttgaaaaaatcgtgtaaaaacatcatctattaaaaaaaacaaatcggtccgaaaaaactgtcagaaaaaacgctaaattgatggacacttgagccagatatgatccatcgattttttatcatctactacacggcttttatttcgttatatattctcctgtattggaaaaagcaaaaaagaacattcgaaaaaacaagcaaaaaacgcgcgagaaaataattgtcagaaaaaacatgcaaaaaacacacgagaaaagaaaagaaaaaaaaagagaaaaatatggttttcatcgtcagtaaaaaaagcaaatgaatatgctaggaaaaaagtgttagaaagaaatgcgccatgtttgaaaaatggtttgagaaaatcgcgcaagagaaaaaaacattgtttataaaaaaacatgttgcttattaaaatacaaacattgtcattgacatgattatgcatgtaaaacgtatattatcattagaatttttttcacccgttgcaatgcacagacatttttgctagtaatattaataaataaaaaaccggcggttcgactggtgacccggcggtcagagcgggtcgaccccggtccggtttttttaccatgcacgtaacacgccaccgcacctccttcatggtcatgggctccaccaacaccgggttgggttgacgacccggcgcctttggcatgcagccgccctggttgggttgacgtacaggagcacgaacgagatttgcgtggagggtggcttcaggctgcagattgacacgagtgtaacccccggatcggacagcaaagcttatactactccctccgtattttaatgtatgaatgatgccgttgagttttttaccaacgtttgaccattcgttttatttaaaatttttataaaaatatgaaaatatttatgtcatttttaaagaatatttgatgattaatcaagtcacaataaaataaaataaatgataattttataaattttttaaataaaacaaatgatcaagcattggacgaaaagtcaacggcgtcatacattaaaattggagctagtaatatacaagtcgaccattagcttcaaaaattaaaattagttgtacacaataattaatatttaatctatctcacataatttatttatcggagtctaatccagtgctacatctggctactaacctgtttttttttctctcatctcattcttcctctacataagcacaaatacgatgtgacaacttgtataatccgttcatttcattctattgcagtcgctctaatacacatagcacagaggatttttttaggaaaacttagattatattaatgctagaaatagagaacatatttaattgcacggttgttggaagtgaagtcactggaaccgagattttgggcaccacgatttccttttaatttttggactggtatagggttagggtatcttggagcacaaatctactaaagaaaaaagaaaagagagagcacgcgctgggggagccattttgttctggagctaaaatatgcgctattaaattgttggtgctttaaaactagtatttaactaggtgaaaccccacgcattgctgcaggaatttagtatgataaaaaaagataacgtataatatagctagataacatcagattaagtaaactgatgtggtttatgataatttaaattcaaatagtatgtagaatgatgattcaaacgtaaaaagtaagctggtatgactttacagaagaagaaaagtagggagatagtttggaccgtagattaatcatctaaaggctaaaaacaattgatgtgatatgacttagttagaggaaaaaatgagaaaaataatttgaaccatagattaatcatttaagcactaactaagtgaggatgaactatataataaagatatacattaaaacattatgtgaattatgttggatgataatttaacatgtttgtatttgaaaagctcttaaattataataactataaagatatagcatgtttgcatgatgtttaaatgtgatgattgttagtggatgatgatgtggtatcttgttaattagtggattagtggatgatgatgtggcatcttgttagtggatgatgatgtggcatcttgttagtggatgatgatgtgacatctttgcatgtcaagcttaaggagttagtgggggatgactttatagtaagataggatttgctaccaaaatataccaacaacacatataaattgtgaaagaaattaattgacactaccaaagcttgcttaggattttgtacttgtcaaaatttagcattgaagaaaaccaaatatagcctagctatagtggccaactggccagtgggtgagattgaggaggttgaagatggtaaacaatatcagggtggtgtttggtgctttgattagttgattcacgtgcgctagtatatggggtggcgcgtcgtcttcggctaggacacggcggtgttgactcctcccggcttagaggcggcggatccggcgccgcccccgccagatctggccggagagcgtagatggaggggtggccggcggctgtggacgctggcgctcgcggaggtgcggccgcggcggtggaggccggctctcgcggaggcgcggccacggcggtggaggccggcgctcgcggaggcacggccggcagcgggggaggccgtgtttcgcggaggcgcggctgcggttgtggacgccggcgctcgcggaggtgccagggtcatcagcttcaagtgattgagctgatatactgcatactgagattctgcggactaaagatagtatattctttcatcatacaatttatcgagcttcatttatttggctaatatttcttatggaacacacgccgccgcatcctcgctggaaatcctccctgcgtggactgccgccgccggagtcgctgattcttccccgccatcggagccaccgcggccggttccgacctcggccccatctgctggccgattccgacctcggccccatccgccggcgccggcgccgaggtccaccgccgcggccggagctgactttccgcctctgtgacttgcactttgaaagtacatatttccccccaattcctaactttccatcacatcacatcacattcaaaactttcctacatacataaattttcaacttttttttccaaactatcaactttccccaaacttctccccaatttcagaaactaaacacagccatattcttgtgaagagaactataaatgattgtgcgccaccctcttaggtaggtaaaaagttattatgcaacagacaacagaagtatggttacgcgcttctgattgggaatttttattattttttgaactttttaaaatattaaatttaaaaataaaccatctcgatacttatttctaaaccttaaccttcttgtccactccgcctcgcctcacttggctatacaatagtcacaccatacacacttgcgcgtggcaaaaatggttcatattcgaaattaagttttgggaaggtttatttttaaaactaaaaatgaaaaggttcaaaaaattaaaataatatatctctgattggtcatatattacatttttatctgttggacctcatatttctaacgagcacagaacctttcagtatgattagatcaattccctgttatactaccttggagttgtatgcttgtgtcatgctcaaacagctcgactattcagcccatccaattttcaaatgatcataacgacttattgtcgcagggtagagacatacaaagaacaaaaaataattttgtttttaaaatagctcaaaagaatatttagtgaaattttatcggggtgaatatgttgggatcatgagttcccaatcacaaattctctggccgcaccaagtgtgccccttttcgatcaatcactggttctgtgtgttttacgtgacattgcaggaaaatgcaatgatattttagtacttttatatgtcgaaaacgtatattacacgtgcacgattactagtagaagaaaaagaaaaggaaaggccggtagcggccagctaagaccaagaggaggaggagtggaggccgccgaggaagagggtggcctcggagcggacgggcatccggcggctgcgagcttgcggccggcatatccagcgagggaggcgattgcgacgaatcgggaggcgcctgatatggtggggcttcctgttccttcgtcaccgcagatggtcggccgagctcgggacgactcgaccgctatgccgagagacatggtcgacagccatgcatgccgagatatgcatgcagctcatgcaagcaagcagatcgctcacgctcaggcagggcctcttatctctggctcggttgagctgagcaagcggctaccaattcaaacagaaaccaaaccaaaacaatccaaaaagacaggcatacaaacatgtagtaatgataatagtagtactcctgcagcacaacaagttactagtactactaaattaagagcgaatgcagtgatgttcatacggtacaacaactatggttgtttttctttgtattccagcatgccgccatcccgccatgctgcaacacatacaacaccggtccaaagaaacaaagaagatacatgcctccatgaggcgagcaagatacgactcattcgcagcacctccagattgctgcttcctacatatcaacataacaatgcaatgatggtctgaagaatataatgataagtcaattttgatcaatttgtcttacttacatctatgaatctagtttcctgtcacgaaatctctccaacctagtttcctgacgatttatctgcgtttttgttcgaaagcctgcaaaaaagaaataacaatccactttctaaattcacgtgcaaaagaatttgtatttgaaatcaattaatacatgctaaagactacacgacttacacgtcaactagatactgccggccttgggggttatgttgagcaaggcgcgctatcgcttttaatacatggggtagatattcctccaggcaatttgaaaatgcagcctcaacttcatgtaacatgaactatataggacaggaaaatattaacttcatgtaagatggttaaaattttgaacagtagaaatggagtagtactgaactcactctgttttgtgcatgtttcaagaagttgtttgcaaagtgaaggcatccttttggatcattagtatacaaaggatttagattatgccacactccatttaccaaatatgctcttccattgggaccataaataaaagcacgacgtaattctgggacctgacgactttgtcttgccaagaaaatgttcccagagcagatatatttgttgtagaatgtccaggatgtctaggataaatgttatcaagatgctctaattgtgacatcctctctaaataagattggagacaggggtgattgataataaatgccacaatagcctcatcattggaattctctccatttggacaattcctcaagtactcaagcagatcattaaagtacaatggaataccatgtggtgtaaattttgcaatgaatatggaataaagctttgcaaaatcttttgcacatgtcacaccattaaattgtactgtaagaacaccctggatggtaacagcaccattgtgaaatatgatgttgtcgctattgaaagcgccattgtagctcaggttttcccagtgcattgcagtgatgtggttcaaaaccttttggatgttgtatgatgcaaagtccgagaagtatcttactgataaccatggtagaaccggcggatttgtacgagtttgacgttgaagtgcaggtactaaatcaaccgtgtagaaccatgtgttcgcatggatatcatcaaacttctcatcaaatgtcatgggcctacaaaaaagacacacaatgttacaatgttagagacatgtataaatataggaaattaacatcacttaaaaacaaaaaacactcactggccggctcttcctcgaaaacggatttcaatcgttgaattccgatataaaggatagtctgacagtgacttattgacttattgtactctaaaatctttccacataatactgcatatgtgtccttaacatttactctcatcttttgacaagcagagttgattagataatcaacttttgtgttagataaatccacttgtacagatatattaaccccacatgccttgacaaataatgattgtaacccctgcaaataagaatcagcaaaaagagcatataaacatcaacatatgacaacaaaaacaaatgcgagattgattaaaacttgttagtaagatgaagtgcagcaatgcattaaaaaaatggcgcacacattacttaatgtatacagattgatctctaagctaaaaatgaggttatcacattgttgctctgacttaaaatggcatgggtagcgatgaggacttggggatggtatgcactgcgatgatgacttgggtgatggcatgcactacgatgatgacttgggcgatggtacgcactgcaatgaggaatcagatgctgatacatgcaggaacgttgactccgataatgacaacaataggtttactgacctaggtggtgacaacatattcaacatagattgtgataataatttcagtgatctggatggtgactatgaagatagcgaatgaaaattgctgcgaacgaaagctacacaagagcaacattgatcagttccatcgagaccatttggtatggttgaaactaaatagataggagcctaacattttgcttggtgatgtgtttggtatttgggatgcagtatgttgttttattaccttgtgcccatgtggtgctaaggtaatgtagcttataagtgcagacctgtaatggattgatggatgttttattaattaaatggttcaactattgaactgttggatgtttagtaattttgattggcaggtggaatgggtcatgttcaatttgattagcggagctgtgaaatagtggttgcagttaaaattttatttgctttgtctggcggttccaacttatttccttgacggctacaataactcaaaaatggataaacctgtcaggtttccaccctcaccaaattgcataataaatcttgtggtttaacaccgtaatgaaaatgattaaacctgggggggggggggtgaacaccgacacgaaaataaattaaactggcggtttcatccaaatctctagcggtgcacgaaattatatatgcgacaattagagggtgttaccgaggaattgggcaagaaagaagatggtggaggagcatcttgcttcacatggacgacctccttcacctcgtccagcgtgttgtcctgcagtcaagacaacccaaagaaaagattataagcaagggcagatagcaagaaagagattgctcgcatcttgtcaagcgcacctgatttttctttttctgatttttcaaaccattttttagatgtgttttacaacagttgaacatgctgcggtgctcaggctagctaggagcagtacctctcatcctttctcgatcgatagtgtggtgtatggagtacgtgatgcgtttgaggtttagggtgtgatggggaaagatgaagtgagaatgcaagatctaagggctcacgcagtcacgctcacacgcacacgacagaacgaaaaaacaccagcgtaaaagaaaagttttattcggatcatcaccttcttcttgcacagcgtagagtcgccggagaactgtctttgcgcccgtcgccgccgcgtccatgcagcccttggcagcttggtccccgtcgccgccgccgccgcgctcgtacggccctttgctcccgcggcgacggcgacggcggcggcggcggccgcggccgccggagtgaatcatggtctctgtgggagtcactgaggtggagaaagaactgagggaggaagaagaactgaggggaactgaggggagctgctacccgcccggccctccgctctccatgctgcttctctctctaagcgagcgaacaagaaaggcagggcagagagggagagatcgatagcctatgccttcctctggggctctgggcgctaaccctaggcgctagctagctacccctagcttgtacagtagttgcacctcacaggcacacattactgcaggacacacacacccagcgagccacacgcaaccagctgtccagctgcttttacttttgcttttgcctgcaacagggaagcaattcaattcaaggatacgcgggtgatatggtgattggtggagatttttacctgtgcgcgttaaaaaagatgacccctgccttctgtcactaaaaagttcaagcctccctttataccatcgtcgaactttatcgcgccctccacactattccatctgtttttagtcctaacagtgtcaaacagcgcagtcaaatgactttgttgtccttagggttgagagagaagagagagagagccgggacggagggcaccaccgacgaagagcactggacggcggcggtggcggccgcggacgccgcggcctcctcggcggcccccatggcggcgaggatccagcgcatccccgacgacgaccccgctactcacctgcgtcgacggcggcggtggcaaggtcgccggcgtggagcttgccagattccgatgggcgtggcgagggtgcggcgtcacctacgtcgacggcggcggtggcagggtcgagcacggcgatgcggcgcaggagcgagccagcgaggagaaggccgagcgccgcttggccgccttgctgccgcgccaccgagcaccgcctcggctggccaccggcgccgcttggctgccttgccaccttgacgccgcggctgttgcggcggcggcagttgcgatgacgacgaagatgggaacggcgttgcgacgacgacgacgggggcagcgctgcgacgacgacgacgagggcggcgctgcgacgacgacgacggggtggtgctgtgcgacgacgacaacctatatcgcaccccttccctccgccatgtgactcgatggagcgcgacgtccctctccctccgagcctccctcccatctccccggcgtgtgggcctcgccgccgccagtttggatggtgctaggaggtggcgcgtcgagacgacgatgacgcgcgcgcgggcggccgcgagggctggggcttcgggggaaggggccgatggtgaggttgaggttgagggtgcctcctcggtcgccgccgccatgggtcgcccgtcaccggctgccggccaccgctgctcacgagagaaagatgaagaggagaagaggggaaatagagaggtgagagaatgacaggtggggcccgtaactgaaagggcaatagcgatatttttcttacccgagcccacatgtcagagctatcaaacggttagatcctaacagaatagcgatggaatggtgtggagggtgcgataaagttcgacgatagcatagagggaggctcgaacttgaccaaacttttaaaattttttgagtatcaattttgtattttagtacgtttgtaaatttcgtatacgatatgagcagtacttttaaatgaaaacctacgcatattttctttcttattttaaactaggcattgacttggtcagatatttgaagctttagcaatcaaatttgatcaaatcttgtcaaatatttatgatcggagtatgcaaagggtgttctagatccgtactactagtaggatagaaggcatcatgcctcggggatatttcagggtggcatcgtactttttggtaaagtctgaagatcttgcatcacaattggacatgttttctgctcagttaattcgacggatgtgcttgacttaaacaccacgcacaataaaaaaaagggacaggaggattttgttcgatctgattccattcacaccactttctaattccgttaccctttgcatttcctctctccaaccaaacgcctccaatagtcatctctaataagatcttttgttatgctttgcaaaacatccaaggcatggagactgtgtggaattacggtggcttgactgggaaaatgaccctggggatagtgatgcaaagatcgtgatggtctagacaaaaataaaaatcaatatgcacaagttaccacagaatctagaactgatcttcagcgttattgcaagctagcagtgctgtagcggcaacggcacgaacgagaacctggtgtgaaatcttgggtgtgtttggtttacgatcaaggctggatgggatatggcggtccatattttgttagatatggcgatccagttttttggttgggtgaatatggtgatacaattttttgtttggttgtagggataaaggtggatttggcgattcaattttttatttggttggagggagtagggtggatgagcaggtgtagtcacctctcactttgagaggtgagtatacccccatcaaattcatatatactacaaatcacaaattcccaaacaaatcacaaattatatatatatatatatatatatatatatatatatatatatatatatatatatactacaaatacacatatagagaaaaaaaaagaaaatgagaaaaaagaaaaagaaaaaaaatgcctcgcatccgccgccgtggctctgcctctccgacgttgcagacctcgcccctcctcgccgccgccgccaacctcatccctc

SEQ ID NO: 82234 - DNA, 10645 bp, Oryza sativa
cgcccgccggggtcgcgcccggtggagggctgtggcgcccggcggggtcgcgcccggcggagggcggcggcgccgcgcgcggcggcgggcagcggggcttcgggcggcggcggccggtggggccgcgcccagactgcgcccgttgttcgtggcgatcggcggcggcagcggcttctttttttttttaatttgtgatgattcactgtgatgtatttgactgagaagttagaaatttgtgattcattgtttggatctgtgatgtatttgagaaatttcttaggatattatgatgtatttgatttgtgtgcataagtaactttatgattgtgatgtggatttggtgatgtgaatttgggatgttagttagatttgcggattgatttggggatttgcctacttgattcgggagaaaataaaaatgaaaaaagaaaaagaaaaaggaaccatctgcactgccgctattgtctctttagtcctggttgggtaacagatccctttagtcaaccgggaataaagatgtatctttagtcccggttattttaaccgggactaaagatggacatctttagtcccggatccttactcccggttggaaaatcggggttaaagggggttctcaaccgggagtaaagatcgtttctccatccgtgatagtacataacccttataattaatcatcaatatcctaattaagcaaactagttacatatgtctatcttgggtacgtagatatagacaggattacattacattagtgttccatttaagaggtgtagacggcaaagggaccagacataacaaaagccatctcaggaccagctttgcaaacactttacccttttgagatccaatgactagcactttagaaaaaggtaactgtgtaggagtagaaaggttgggatagacttggctctggttgcctagttgcgaccaaagcgcactgagccagaaatgtttcataaacttagtgggggtaaatatgtgatgcaaaccccaaacctagatgaaaactcatgtaaagatcgataaaaaaaattgtataaacatattaaaaaccacacatgtagataatacgatgctacacaaccatatataaaatcttgtctaaacttgtcttcgtttgtgagatataaaaataataaagtttgaacaagaaaaatgtcttgatgatttgtccaaaaaaaatgttatttttatatatgataaacaaagtgtgtaacatcacctcatctacatgtgtgattttttttttgaatatagacaactttttagtcagagtttacatgagttttcacctaatttgtggtttaattacaccgcatatttgcccaatttagtgagtatagtgagtttctgtagagaagctcatcttagaattattcatgtattccactactaaattactgagtgcaaagtaaaacctatacagttaaattacggtcgacctatatacggataaatattggatggcaaggggaatatatttatttaactagaacaaatgtccgtgcgttacaacaggtgaagtctattttaatcttattactgttatgttatatggtttagttaagatgaaatttactgtgggagttcgtttggatatatatttttaaaaaaaatcatgagctgcagttaagtccgattatcttaagttagcatgtgagtttttttaaatagacttcttgtatgatttcttatgtattaccaaaagtgaacgatattaaaaaccgattcaaatacggatatatatttccaaaaacaaacgaacttaaaaaccgactcatacatgtatgacgtaccaaaataacggcaaaaacatcttaaatttttataatagtagagttaggatcggagtgtatatttttggacagtgaaatcttcccaaacaatcgatatagcacaataatacacaacaaaccagacgactgttttgacattaattaactactcctaattaatgtaattttatgcaagttaatcatgaataatttcattgtttgatctgatctgcgctcgttaattgttttgcagcaaatcaatttatgttattaatccttgtctttccattgcagcaaaaaaacattctccttacatattttggttccatcttttttttatcactttcctggtcttgctttaatattttattgagggattcataaacaacacatgtattttacagcatggatatagctactagctccttcctcaaaacatatgcgcattagctgcaatatgcaatgcatatatataaattattatggacttggttaggttgctagactaaaaaaagcaatatatacgtgaataaatgttatcatcattcggaatcatgttaatttgtacatacgtgcaagtttgaatttggtgataagacataaagatacgatacatagggcctgttttaaatccactggcaaaatttttcatactgtcccatcaaatgtttgaacacatgcatagagtattaaatatgaacgaaaaaataagtaagtacatagtttgcgtgtaaattgtgagacgaatcttttaagcctaattgcttcatgatttgacaatgtggtgctgagtaaacatctgctaatgatggattaattaggcttaataaatttgtctcgcggtttacaagcggaatctgtaacttgttttattatcgtctacgtttaatacttcaaatgtgtatccgtatatccgatgtgacacggcaaaacttttcacccatggatctaaacacggccatattatatatgggttctgagctctgaaacagttcatgcatgttagtaattcaccctcaagtacagctagaagtagagaatgacgaccttaattcacttgtctaatacctcgaacaatgatggaaggagaattcttggctttaattagttccactccattatttttcccttaaagtatcacacatgataaaaaaaatgaattcaaatttaatttcacagggaactatcagaaacaaaatcaactacaaaaccgcggaattcggaattaatatttattttgtcatatataaattaacatactcagtttggagttcataagttcattacgaacaatctgaagataaatgagatactatatatatacgggagattcacacatagagtgactgtcgtatatatatatatatatatatatatatatatatatatatatatatatatatatatatatatatatatgctatacacgttagaactctcctggcaaagcataccataattaaggagcttatgattcttagcatatactccctccatcccagaatgtttgacgccgttgactttttaaaatatgtttgaccgtttgtcttattcaaaaaatttaagtaattattaattcctttcctattatttgatttattgttaaatatacttttatgtatacatatagttttatatatttcataaaagtttttaaataagacgaacggtcaaacatgtttaaaaaagtcaacggtgtcaaacatttagggaaggaggtagtatttttctacgaggaaccattgattattggctagctatctagcaaaagtgtcacacaccatgcatgggaagaatggcagttcaaaagccctagccagtgagatatataaaaccaattaagctatttattatttctcaatccaaaagtttagaacattatgatgggggaaaaactttggaggtagaagtatttacagaagctctagctgaagccttaattcctcacaaaacacgtcaggcaaacgatcatgcaacatccatatgcatttttatttgcgataaattggagttaatcaatcaattcgcacatgagatcttcaccctctcttcctaaatcctgaagacttgactagagttggactttgtgttggttgtaagggtcgagtttaagacgatctcggctgtgtgccattgttggcttagtggcggtctgtcacgcttagtggcggccggtccgatgctagccttctcctggttttatgtgttggtgttgccggtgtgtgggtggtggtatatattttttatttttcctgattacgatattacagggttgtaatcttataattttttagtgctctatcaatagaacctcataccgtctagaccagagtcgttgaaaaaaaatcttcacacgtataaatgtctgattcagatgtaattaagcatgcatgttgtgattgattttgattcataatgcaaaacgatcaatatgtgtagagatgttagttagttagtttaccttgggtgctgggtgttcttgacgaccttctggccgtacttgcgccacttgtagccgtcgtcgagcacgtccacgtcgctcatcgtcttgaagcagaatctcggctcccgcaccttccgccgcgccttccctcctcctcctcctcctcccccaaccttcttcatcctcaccgcgccaacccccagatgatgctgcgccgccgccgccgccgccgtgttgttgccggcgtcgttgatccccatggcgcccatcgccgccgccgcctcgcccttattccccatctgcggcctccctcgatgatcgccttcctcgcaagacctagcacggcaataacgtcgtcgacatgggagaaaaggggggagagagagagagagagagagatcgattggttgttacggttacttaattactcgtaattaccatggatgcggcggcgacgatctcggaggaggcgcggcggcgtggaggccgccgccgtggtggtggtggagggtgggaggagagggcgcgtgcgaggaggcggcggcggtggttgggtggtggtggtcgaggacgagggggctgtaacctaggacgccatggtggtggtggtggtgagacggcgtgggcgtgggatgctggaaggagaaggcgacggtggtggtggccgtggccggggcggcggcggcggaggtcgtcgacgaggaggccgccgccgccatggtggtcggcggttggcgggcggcgccgtggtggcctagcgccatcaccgccctccctggtgatgggaacatctctccctcttctctctctccagtttctctctctgattattttcgctgtcttgtttgcttttttgtgaggtgtgagtgtgaatgtgtgtgatatccggatgtttatagggtgtgggagagacaagggattgcattattatatatcatcgaggaaattaagacaaaacaaaaacaaagtcttctcgaacttttacatcacacgcattctgaacaaaattatcaacaccttatagttactccatcatgattataatcggtcatgaaaattgatacatacatacatacatatacatatacatatacatatacatacatacatacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttccacacaaaccgggactaaagatcatctttagtcccggttcgaatgctgtcaggacctgtcaggcccccccgggatctttagtcccggttggtaacaccaaccgggactaaagatcttaactttagtcccggttggtaatcccggtgatctttagccccggttggtgctaccaaccgggactaaagatcttaactttagtcccggttggtaataccaaccgggactaatgatcccggtgatctttagccccggttggtgctattaaccgggactaaagtcccacccctatatatatgtcttcttcctcctccagctgcccgagcaagcttcaaaatttcttcaaaaaagaggggaggtcatgccaaaatttctattaaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttaatttgctaaacaaggttttataaaatagttgagaaggaaaactctagtgaaagttaatcttaaataatagaaaacaaactaaaatgaaaattaaaagaagtaaaacaaattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgctagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcattaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcttgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacgatttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgcaataaggggtatccttccagacaatgtccgtgcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcatccagaggcaagcgtcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcacgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtattgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaagagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgcaaattataattgactggagaatttttaaaagtattaaatttaatatatttttaaaactatcattcatatattagagtttttcacaatttaatttactatctttcatatgctacttatatatgacgcatcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattatagacaaaaatactttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagggcctaaagatatcaagatatcttt

SEQ ID NO: 82235 - DNA, 53304 bp, Oryza sativa
  unsure (1)..(53304): unsure at all n locations
cccacgccgccacctacaccaacaccgccaccctcgccacctcctacaccgacaccgccaccactgatggtggctgtactatgtttgtcgccgcagccctcgccccccaccatgctctgcctccatacccacgccaccgcagggtcatgccgagcgtcgacgacgacgccggccacccacacggcggccatgagcaagagcaccagcaccggccgccggttggccatgatcagaatccccgatgagcttagctacagctagcctatccactatcttcgtgctcgactattgctgcgtgtgtgttgtgtgcagcggaagcgggagaaaggagaggtatttaagctgcagaatccacgggtggagatggctgcttcttctgcttttggttgatctggtggtgggtgactggggagcaggggaaggttgactagtgtgtgtgtttgtttgttacggattaattgcgcagccttttgacaattttaaggtggattccccatgcatctaggtgagcttggcttagctgggcgtgtgcttttgcttggtttgattggtttttggttggatagctctcgcttcttttgtcatgtgaactctctcactcgtgcatgcaatggcaatggcaatggcatgcgtgtgtatgcggccgtgcatattgatggcgagctcgtggtgttgggattgggaagaagaaagcaggcgatcgatgtgggtgagcgcctgagcggtgggaggagcagagcaacagcttattacagctcggaatgcgtttggatgctatgcttgatgcagcagaacaagtccattcctctgccctttgtgttgcatttcagtctgaattgtacattgaatggaaggtttgaaactgagatgctcgttaatttcttcgtcccagcatgcttcatcagtactcgatttcaggagaaatcccatcgtgcatgtatgatgtatgatgtatccattaacacattgtaaacccctgcctaaaatagcttctgaagggtgttgttttaataaaccttataatctattgttccctcggtttcaaattatttatcctaacccatgtttatgtttgaccattaattttaaaaaatccatatagtttaacagcatatgattattatgaaagcatttctcataatgttagattatataattataattaatgataaaatatacatgtttgacttagtacgaagcagacaataaataatgtgaaataggggagtagatcattctgagcttcagtcaaacaggccagattactatagctctgattgagtatacgacatactgtatatatacagaactagagccatcaattaaaaacccctgattacccataataaaagataacaccggacacgcaaaagatggcacttacatggatataaacattgataattagtgatggttagtgctgaccgctcaacgctcacctccgtttcctgaagtgagccttcagctcatggaagacgcagaacagcgtgtccatggtgtcctcgtccaggtgcgcgtccttcacgccgccgatcgccacgatcgtcctcacccactcctcatggagggtcgagaactccgcacgctcctcgctcgacctgaagttcccggcgatcttcgacctcatcatctcgccggcggccgacgccctctccacgatcgacctcgggagccctgccatggtggcgacctgcaggccgtagctctccgggcaggcgcccgaggtgagccggtagaggaaggtgagctccttctcgccgccgtcgccgccgtttcttggcttcagcatgcaggccatgtgctgaagggtgacgtgggggtgagaggcgaactccttggtgagaggatggtagtgagttgcgaagagcagacggcatcggaccgcttcgacaaggtgtcggaatacctggacgatgataaatgtgaaatcaacgaatcaaggggaaaaaagtagttagtgttatccatctataagagcagaccaactccacatatctcgttagtaccttaatcgataggtgtaataaggtcataaatcccattagctaaagcaatagagaagcagagcataaattcatagctttcacgagagatcattatctagcctacccatactgtagcctattgagcaacaaaatcacataacatgtctagagcaaaaaaaaaaaaaaaaaagcaattggtgtcacaaagaccatgcatgtgaaaaccagtattgatttgcgcattagcccagattagttcataccatgcgctgcaggaactttaggccatagtaataacatctacttccatggaagtgcatggtgctcaaacagtgtaagcagaagaattttgggcggtagaggtaagatgggcagttggtcagatatactcactgcatatgcaattgcatatccatcaaatgtgctagttcctctgccaagctcatcaagcaagacgagagaatcctcggttgcattctcaagaatagatgcagtctcagtgcattcgacaagaaaggtacctgcggcaacaattcaagttagaccactgtcacctcatatctgcattgtgctcaaatataagagacaaagtacataacacaatgtaaaggaattgagaaatttgactctgcagactcatggttcatcaaacagctcaaataaattggaaaagtgctttctactgaaaatctatagatttacacagcatatttcatatgccaaaaaaactggcatgtacttgatgccaagtatttcttgattgtacaaacaacatttcaataaatttgatgtgaatatcaattctattataagatagtatttggttcggacgtcaatgtatgtacatgtattatttagtcatgaaaattatgactaatgtcagacgattcagatcgagtgaaagttaactcatttaaaatgcatgctctttcaactaaattttggactcaaagcaataggtcaataggacatgcaagaattatcaaatctgttcggtaatgcatccttactttctccagacataatccgatccattgcaccaatccgtgtaaatatggcatctgcaagtgtcaactcgcatgactgacagggaacataacagccgagctgcagatcagaagcaacttcaattatacactcgaatagggaagcctataagtagccaagtataggagcataatttaatgatgttatacaaacctgggcaagcacaatagctaggcaggtggcacgcattattgtagatttcccgcccatatttggaccagtcaacaacaatgcaaagcgattttggccagataaattctgaccaagagatagatcatttggtaccaacccatttacactttctgcaaaagcataaggatgccataaacccttcatctgaagtacaggcgcttttcctttcagcagaatgttcggtctgcacgttgtgccaaatgacgacaatgccatggctgcaaaggacctaagcacatcgatagtgctcagagcattgatcactagagaccattcagaagcttttccaactaaaagatccactagcatagccaaagtgtttgcatcatcgtctttgacactatgatcctaccaaagctcacatgatcaaacaataagagaaatcaggagttcaggactaaaggtgataagctgataagaataaataacagaaaaaaagctaccactgcttcgttgatagataatgcacattgcaccatatttatacctggtatcttggaaaatcatcatctattgcctcttcaaaatgatgaattaattcaccaagggagctcaatgttggaatatccacagcctttgacaatgctgagatgccatgatcttgtctttgtaggatgtctagtaagtcaattccaacacggaggcccttgacaagcatgccaaacgtttttatctggaaatattgcaaaattttgcatttcagcagtcagcaggataggtagaacacaaaagaataaggcagacatcatactttgtaaaaaaaaaaaagaatggcacaaatcaaactcaatctgtaagataagagtgaaaagctaccaactaacccttctttttaatatcttttctccaacaaagggcaacagaaccgcagatgataaaccaacagtggattttactcgtcctagtaacctctcgagatcagggactttacgtagatgctctagtgtaacagatcctagcccacaattttgaatgaagccctcaacaatgtcgagcctttcattgatagcatcaatatcttttagtgggtggcaaatccatcttcttagaagccgcttaccgcatggagttatgcagtgattgaggtgcttatataaggtacctgccataaagtgaagagtacagaaagattatttttgctatatatgatttgacaaaattaagtggaatggaacataggtcaaagccacatcccttacctgatgaaccaccatcaaagttgttgctgaaaatctcaaggttcacaagagtctgaccatccattcttagacatgttctgtatacatggtaggctaagacctccccgtttttcagagcatcctctagctgttttcagattgtagctataagaatttggaacagaattcatgctttgtgacagataatctattgataaccataaaagttatagtatggctcatgggagttttttttttttacatgaacattgatttgaaacagaagtcctctgcacatatatagttatagttgacacatttaaactattgcaaacttgtgctggaagactacataaacaaaaggaaaatactgatgagaaatgacactattctaaactgacattgtgtaagcgaaatggcagttagtaaaaagaaatgacacaactgactggcatgacatgaagattagcaagaaaatataatcaaggaaaggattgaagataagtataccataagtctagttaaatggctcacaagtccaccgagtgcacaaataactgcatctttattcactgaagaattcaatgcagataaccatgaacttgttgacgctttaaagtatcctctagaatctattaacgtttgaatttctgaaacgtcagagaaatataacccatatagtggggtcagctgcattttcacagaacctgcaatttaaagaaaagtagttttcagttaatttcaaactcctctagttcacctgcagatttaccttttttaggtaataaggcaggagagtccctacattatatattaacggataggccagatacatgtttgaaaaaaaaagaagaatgaaagattatgaacttacctgctgaagcatatttcttaattaatctatgagtttcttttgaaaggcctgaaaaaatgggaacatgtaagtgaagattgaagattccttatatatgaaagttgaagattaagtatgttctgacctgaggtttcatagattatttctttcggagagacctgaaaaggtatattagtgatcattgcttctaatctgttgaactaatggaaagagatcacaaagcctacctgcaccagcagagcccccaaagctgcaaatgtatcatcatcatggactgaacccacccaaattttaagtgcagcataatctaaaaatgcaaatccatagacccgggaaccatttgaagctagtgtaatctgaaagttcaaaaaaagggcattagatcaagagcgccgataaagaatgctaacacagaccaattccattttattcagaatgagaccaaataagatcaataaaaaaactgaaacagaagaacacaaggcgccatcacaacttgaccattagaccactatcaacctattatatataaatttctgacgtaaaagtactgttataccattagaccacatgaaaaaaaaaatcatgctaacaatctaaataaactgcaagaataaaactaaatcttggtataacactaggattttattgaatgtttcggggaaagatggtatcaaaacgccattttaatgtagctacaagttgttccagtaaatatcttgtacacctgctgatttcacatgtccatgtggtacagtactacagcagtcaaccaggttgtagattcaatataattctcttcagcaaatttatttggttataatgtcataacaccatgcttttgctgactttgggaacatgataatgttatgcaatgattaggtttgggatttttattttaacctttttaaacaaaaaaaaataaccataaacccttcagggtcttattttcttaattgttaaccatttttggaagcaaactttgctatgcccgagtgataaagccatggagcaaaaacctgctttctgcaccattgtggtagcgtgacaagataattctgccaccacccacaatggcatggcgaggagaagcctgtcatggttagtggcgtggcaaccatgctaaaaattaaaagtactaatggttggtggtactgttgtgtacttctcatatgacttgaatatactttgaaagcattacagcaaatcatatagcctaaatccaacacaatgctttgttaatatggaagcatacctctttgagtgaaagaaggtgaacagcatcagccccaatgttgctgtcccctactgttgatggtgtggatacatgaaccaattttcttagaataacctagcaaaagaaaaacaatgttgtatggcatcagtctctcactcttaacttcaaaaggaaagtttaccttactctttaaacaagagtaaagggtattagagtgtgaaagcctcaatccttaagttgcataaaacattgcaactaaacactccatccaaaatgatagctagattaaaaaaaaagcttatcatgaataaaaggatgaacataaaccatgcgggagaaatgttctagagtttataccgaggtacagacaattttggacatcctgagagagcaaaagaactctcccagagagagagagagagagagagagagatcggtcaaaaattttaaaagataagcattggaattgcataaatagcacacttttgccactagctatttagatgaaaaagaaatcagtacaatgtccagaaagaataaatttggggttgatgacaataaggaaagcttaccgaatttgatcctctagatttggcttggtctgcagattccatttgttcaattctgccaactttatacctgaaagaaatgctggatttatgagcaattcattcaccaaaagatacagaaaagggaagaggaaaatggatgccacaactcaagaatcatataaattacattcaaaagataaataagtacattgtaaaaactaatggttgaacaggactatttttttctggaaatcaatgatgacaaagtgctaaacaataaagtgtttatcttgcaagtacgtgcatattatcatatcattagggtgtggtggtaaagtcgtgagtgaatgactcacccatcaagattcaaatcttggtgtccaattaaattgttgtgtgcatccctagttggtacaaaggtcaatatcccttccatattaacttctattatctaaaaaaaaattaataggaatggagatgtacataaactaacaaaagacctcctataaccaacataaggaataataagcaggaacctgctgaagttcgagatatgatgtaccattttacaaagtgactcttattattaatatgctgaaaatgaccaaacataagggggatacggaatttaccctcgagctaaaagcttttcaacggcaacatctatcccactttctgaaatgccaacctttacataagataagaaaaaggttactatcatgtaccataaggtggcactgatgctagatagtttgtaagtcgggtaaaacagattaaaagaacatggaaaatgctaagatgacaaatgaaatatggaaagcacaaagtgaccagaattaaatcaaaataaataaagaaaaaaaatgaagaactgtattgctataatcctgatttatttagtatttacacagttgttttggtcatgccaggagaaaggttagagggatgttttgattaaatactatagagtactcacaagtgaataagtgtgcattacttcactcaacacaataaacgagttgtaaatgacatcatttagacttggtggcaacagtatagcagactttcagaactaaaccattcaatgataaaaacaatactctagacagtactagcattcatacctgccggcactttcccaccccactgatagtcattttccagtcaagttccttttggccaatctcagcatccacctcatagagctcatagaattttccctagcaataagggaacaatcattgccataggttatacttatacaatcccaggtgctaaaaaatgttggtatttggtcgatgtatgtaactttgggaaagatttaagacagtaatagaaattctgacgtgtcggcaatctgggaggatgaacaaataaaaggccttaaataaggcaaatcattttggtactaggacagacagtctataattctagtttctgttgcatatctatcagtatgcatcaagtaatgaagctcaaattatggccagcaaacaaaaaaataaggggaactcctatgacaaaaaaacatctcctatttatggagttaggcaataactcagtatgacaccaaggcatgagagatgcatattatccacagcagtaatttctgaacttcagttttagatcatttgcccaataggcactgatgagacatcaaaaatgaaacttacagaaacatcagccttcagtgtcaatcaaagcagtcagggtaaacattgaaacttaccactttgaaaaacaaaacaacatccatatacttgcacttaatattccaatattgcttttgagatgtagacatctttctcaatgcatcaggtggaataaaaagagttgtcttatcataaagtgggtctgccagccgccttctatttgcatctctgatattcgaaggattcagccactcaaacttgctgcgtgcactttcagccatttcatcatggaccttattctcaactggagaacactgagctggtttcaccttcttgtttggaccccagaaaggagagcatgagtcgttggtagtcacacgttgatcttcttgaacccgcttcagacgaggaattactgctcgcatcactggtgtttctggtttcaggggactcggatcaaattccgaaaatagttcagcacctgctccaatgcgtttgtcattcttaggcactgaggataactttttcagatggttctgtgatggtgttccatttgaatcaaattctgtaaataattttgttgctttaatgtatggaaggtctgaaggcccagaactaagcttctctgaggattctcgtctaggagtataattggaatcaagtgcaaacagtgtagcgccccggacatattcaccattaggagatacaaatgagaactttgatggatgctgcaaaggagtttgatctgaatcagattctgttaaaggtgtatcagctccacgagaagatctccagaagactgtttttgaagtatcctgaggagtttgtacgtcaaactcttcaaatgatgaattagctccaatgcagttattattggaagactcaaagggtaacttctttggacaatgcggtggaagattttgatataaaccaagttccggggacagtgtgcttgctctaacaaagtcatctttggaaggccataaggacttcaggggctcctgcaaaggagtcatattcgaaccttcttctgcaatcaacatggctgctttgttatctccagcattgcaagattctaagaacaatgcacttgagcactcatttgaagtagtttgatttttcacaggtaaggctctctgctccacatgtctagcctgggaagcatcctggtctctgaaacaagcacaaggaaaatgtcatgataacgcaacaagacacgactattttgaaggccctagcaagtgcctggttttgtccatagcagttagcaaacaaataactttggtacatggaaaagaacaccctgaaatgaaataaaccaagagaaacaaagacggccgatttaagtaatcagtacaacaatccaaacctgcaaggctgcaactaagattaaggatggactacttcactaaaatataattctgaaccagaaatctgatatccattgaggctaatcacaatgaagattaataaagataaaatatgtgcaaattatcaattttgtagttgatgccgttttgtgctagaccaatccaaactcgaacttgattttggtttcaaaaaatgaagctctgtggatgggtcctccttccttgcctgaagaagcaaattaatcgcaaaagtacaatcaaaaccacagatcgcattaacatactatctgaaaacccagacacaaacttgaaacaaacttagatgagacagaccgatcaaacatgactaggaccacgcattgcaggccaaaactaccatacatcgcacaccgcagcaatcaaaaccattaaacctcccattatgagtcaatccacagataagccaaggggacgaaagtaggatccatggcatattcacatcaatgtcacccttattggatacagacctacagtggcagtaagtactaaataccaccaatataagtcggcgcgcgatagcaactagaataatccgaatggcgcacattggaaccaacccaatagtacatcgattgaatccttcccgtctagtattaactagtgatacgaacgcgcttgaaaccctaaacccgaccaaaagctttgccgcaacccgactgggaaggcccccaaaccaccacccccaaaaccctagccgcctcccgccattcacagtacgacggctgcgttacatagaagcagccagcgatcggcgcgccgtacctcccctgctgctgctgccgcggcggccgcacgagcctctccatgatccccgcgaccgacgcggcgggaggccgcgggggcctctcgggcgtcgcgccctcctcccccgccgccgccgccggcttcttctggaggaaggagaggatcgactgctgctgctgctgccgccgccgcggctgcatcgtcgccggcgagggtcgggcggggggaaggcggagggtgcgagtttgagaatgggagagagaggggaatggagtggaggcgacgaggcggggggaggaaatgggatttttcgggggggaatttgcgagcgggaaatgcttgcggagcaacgaaggcgcgcgatgacgcgggcggtaagattgtttcccgcttccgcttttgggacacgggtttcgatagaggaagaagaagaagaggcggatgcctggacaaacatacaagggatcaaccataccgaattttgacttattttggtactgttggttttaccaaattttggtagagttttaaggaaggaagttttttagaaatgctaaaatttagtaagtagtactccatccgtttcacaatgtaagactttctagtattttccatatacatacagatgttaatgaatctaaacacatatcattaacatacatacatacatacatacatatatatataggcaatgctagaaagtcttacattgtgaaacggaggaagtagtaatagttgaagtgtgtgttgtttgttgcgtaaggttgtaagcagcaacaaactgagaagatccttaaacttaacttttaatgcaaaatttgatcatatatatactcctttagaattatgaaactttaacttttaatgcaaaatttgatcatatatatactcctgtagaattgtgaaactgaggattaagggtttgactagcaaaccatataaaaaattaacgatgcaaaaaaataatttagggtataacttctgctactattttgatgattttaaggtcaatgttaaaaaaatgaaacgaaaaacacctagaataattttaaattaagtttcaaaacttaaattttggtagccgctgtacttagcgtgatcttgttgaccccaatttctgtgtgacccaaatgtcggtgacacaagatgaataattcctctcaatgtttacctgaagtagtactagtaatatgatcaaatcccagctgatccacttctgacaccatcaaaaacagcagaaattcaactccctccaacgcccaaagtacaggcacaaaatatttcacagcaagcagcgacatcgtgataaacagaagttctcataaactagacctaagtggtgacgcgcgcagttgacgcatatgtacaatcaccacagcaactgggtggtaagtagtggctggtgctgcctgctttcccctacctgatacaattggaagctggtgagaggactgaactactgaattcacaagcttccaacaaacaaaatgcaaaagggggcataagtttatctaaggtgagccggactcctcctcagagtctgcaactatcatttcacgatcatcttccgagcctgatagagaaaactgctttgagatagatgttggcctctgcctcattgttttctttgtcatggatcgaggagtaagctgtcctgggcgcatgacgtcttcgtcgtttttcatatttctccgactccggcggagcccttgcggaggcttgtcaaaccgacgggaggcaagacgagtcctcttacgtgggacaaatacttcctcctcttcagtatcacccttgttgggatcataagcatcattttctccatcactgccaacatcattttctccatcgctgcctgacgagtcatcatccttaccattgtagtctctgtcttcatcctcatcagaactcaggtcatcaagggactcgacatcctcctgtccgccatctttgtcctgctccggattgacgtcagaccctccagcatcctcctgtccatcttccttctgctctggaccaatgtcagaccctccattggctcctttattgccctgatgtgaggcacgcttctcttttttgcctgcctcctgtggatcagattcttttgatttcctgcattcaagcacgtgaattcttttcaagaagaatgattttgcatttggattacttgagcaacaattcctaaaagctcagtgctaaataagcatggagaatgtgatccatacttcaagtttgctgtttctaaattctagtaaatctgacatgtcaattcctggaaccaacaagtctcaaacctgttaccagttatcccccccccccccctctccttctaatttgcttatactatcagatgctgctaatgttagtaatgagggactatgctgtaccacaagaaatcgaaggtatttaattgcttatattgttgcagtgttccaaatgttaactgccaacgaactagggggaaaacaggaagggaaagaatggttttaacttacgctgcagcttttattgcctcctttatagaacgatcgtaatcagctgcacacaaagcaaatcaagggtatcaatgccaagacatagcaattggtcacaaaacataaatactttgatcagttttactgagtatttaaaaatagaattagaatatgagcctgttgaatgctgaaaacatctgtattaacctatagcatttgctgcaattcttagagcttgtgttattagtgagagctgtcaacaatcatcattttccactaggcttacagttatatggattggaaacggtaaatgggtaaagtatctacacttctactaaatgagggactggcagaagaaatgagagatgcaacatgaaattcaatgtacccagcaagctgttggttatgcatccagactactattcgtaaaatatgatgaacagtctcaagttgtcatgcaccttgtgtactcaaggatgctaaacagaaagccccttacagtaattgtagctgacaggcctacgttcacgcaatgaacgggtttggaaacttgtagcataagctaaaagttcatccttcttctgctgacgttttaaatcccgctccttcttctgcaaattaaacagacaaaaatgtggtcataaatcataaaagtagagtatgagcttcatatcttgctgccaagcataaatcctgattccaaagtagaatataaatgcattcatgtattggacacccctggggaaatatagacgcaacagagtagaaagcacgtgagctgaaagctaccttttgaagcttctccacatctggaataatttctgtcttaagatgctcgccgatggcagattccggtcgacctttactgcatagtttctcctgttgataccatatgtcaaatatgggaacaaaacacaagctgcacaagaaaatgaacagccaatacacttaccgatatctcaacgaactcatcaaggttagtcgcaactgtttcccactgaatattgataactggctttgtcaaacgaccattctttcccttcaagttgcgcttgaaatcaagtgttacatactcactatacaatctatggccaatagttgagtcaccatcatacctaacaagcagaaatatttcaatggacagtgtcagcaggaaaaaaagaggacgcaaaggcatgctaacagtgactcattgattgcaaatgataacatgaaagtgaacagaaactctcttaccagtatatagttccgttactactacttcctaacttttcttttcggaaattggaaatatcaactcctcttttcatctcgtcattaacataccataccgcgtcattttgctgcaggatagataatgtctatcagaataatgtgcatttaaaagctgaaggacttgggggtatttgactaattagattattaaacctgaaaggaaactgcaattacaacaaggtgaactcatagaatcgttacctctgaacgaacttcacagagtgctttaagtatcaacaagcgtttaatcggatcttgctgtttatacgtgtcaatttccttcctgggtaaacaaataagtcgcgatatgaagttacctaagagtcatagtcaaaaagcttatttacaatgcattatcctgcataccctggattaattttgaacgggtttgcaccttcagcaacctgaaaccaaaatgatgttaatgtctgggactgctctagttatatttacactagtaaaaattttatgcaaactaaaacatacccatgtccaccaatctgataatttcttggcagttgccgttatccatccatcatcgaccttcagatttttgatagttggtggtattccctgatacacgtgactattacaacttagcaaacatcatttcagacaaacatggcaaaacagtaacataaacaggcttattcgtcattacatcaacaacaaaaaaaaatgaaacttagagaaaagaaaaggtatcataatatttggtctccctaatacagggtagtaatgcagtataagaataactgatgcaaacatcttgttactagtacacaatagctcaataaggaaagatgcctcccacagcaacgcagatgatgcaagcttgttttatttgtatgtcacgtgatttagaaatctcaaacaggcatgtccataacagttaatgaagttaatcagtcactatgtcactgttttttaacaagattaaaaaatgattgattgaacttattcagtactttcaaaagaaaaaaaaagagaattacatatagataaagttttttaaaagataactatggagaaacaggttatggtttttgacaagcctagctgattacataacctgcaacttactcggtgattgcaaacaaaaaggacaaggacaaagaaatgaagttttttccctttttgcagaaaacctgtcatggtttgtgacaaggttaaagattacatagaccaacgcaagtgtgtattcagttcaaaccctccctgcagatacacaatgcctctagtgcaaagcaagcacgaacaaacctacaggcagagtatctgctgccttaaacaaatcagatcaccaaactgtctacaatgcaggcattctgcaatccaaagcctacacgatccaaccataactacagaagtcaggagtgcataggtgcagcctgaaaaaacaaactacacctttataagcgcaatatggatgcgggcaaggtcgtggttattggcgatgagcgcggtctcgatctcctccgctgatagccccaggttcccctcgatcaccggctcaaacacctgaaaaccaaaaaaaatccccaaaccgaaaccccgtaagcccaacacgccaataccaatccaacccaacccttgaagcaggagagggacaaaaaaaaaagaaaaagaaaaaaaaaggaagccctagccgaaacggctcacccggagaaagtggagcaccgacgcgagctcccagctgcggcggaggaggacgcaggggtcctccggcgccggcggcgacgcgggggggtccaccggggacgaggccgggggcctcgcgcgcttcgccggcgaggccatcgtgcggggactggaggagacaggcgggaaagtgggggaaattttggtggtgggaggcgggagggaggggaggaaagtggagaggcgggggaggaggaggagacggcgctgcggctcgtggggcggtggcggtttatggatggtgcgggactgggagagtgtgggtgtgggcctgtggggtggtcgagtgggcttggctaccatttgggctttctgtgatgggccaaaatctgaaatgctgtattcgcatgtgtccggcccaaatctgatgttaggtaagggttatacattcatccaaaataaattaatctagaactgaatgtggtatatttattacgaatctgaaaatatgcatgtctagataatctatcatatgccaccgagtttaccttatttcaactgtttgctatcgactttatctccttttgtaaatatataccactgaccttgttgttttctacaataattttcaagaattgcctaaaatgctctttgagacatactacaggtgttgacaattgttcgatccactataatttaaaacaaatataaaaaattgtatttagccttagaagcttgtgtgtgagattttctttcatgctttttgaaaaaaaatgtgtagcatatgaaagagaaatcacatacatagaatatagccgcattagaaaaaaaattatagcatgtcaatgatgatgtacagcagtacagaaaagaacattaacacgagagtactatattaacaaacataaattacattttgtttaagttcatacatgtaaaatgaaaatcttgaaatatacacacacttctatattatgtagaaggctacataaaaaaattcatattttattgaaacttctagtaaatcaattaattgtaacatatattttcttgaaacttctagtagatcaattaattgtaacctcttataagccttgaaggtattattttgaaaagtattcaccccaataacatattatagaaaaaatgacaaagccagtgccatttataaagagagacaaagtcgatggcaaattgttaaaacggagtaaactcggtgtcatatagtggattctctcaaaatgttaactatcgctccctgtaccaataaaacttacaaaaacttagccaacagtatcgctgtaaaacaatcacaggacaacgttgtggagaaattagattgtatgaagattataatcataccaagtaaaatctctgatcaaagagcaggtagtacttagtaagccatgtcttgatatatatatatttaagtgtaactacacatccactcaaacaatgtgtatgaagcgagataggtacacgaggaaggaccgccagggtgaggtgtggcatggtgctccgggcacagccaacaccgggctaagccaacacgaggcttcgcgactcccgagccgaagaacggagagaaataatttcctctacaagcatcgtccgaccttgtggtaccacgcgcttgattgccaactcagttcggctccgatgtggaggctttagaccactggatagagtggaacattaggcttggccttattgatgttactacttatccatcaagaggatgtacggtttggaaccttatagcttgttggtctataatgttgttattggatttaactttttttaatgggataggacataaacaggaatggcgaaaagctgatagccatatatgaatgggttacagatgggatagtagagggatgagtaccatgaggaaagtgaaagacatgttaagtgttaacgatagatttgcacagaagaaagatagcttatgtcacgtctcaaatctaactttccagttgcattttattttcttttctgccacttcatgttatatgatgctatgaccaggacccatggtttctgtcgattataattaaaaaatgctattgtttaactaaggaggtgtttgacggtgctatattatccgtagcagctgcagttgccaccggaaaatcctcttttgctttttagcgtataaaattttgatttatacgtattactccctccatttcaggatataagatgttttgataaagtcaaactactacaagtttgactaagtttatagagaaaatagtacttcctccatctacatttgatagtcgtatttcatcttagcacacagaccaaggataagtaattttacttatcatccatttaaacatgctactagtcattcctcgtaaacaagcgattcattaatatttacatttctcaatgcccatgtagccaatcatgtgtgaaagaatggagagtcatgcgagaaagtcattaagatgatagtttgttgaattgaaatatgactatcaaaaataaatttttcagatttagaaatataactatcaaaagtagatggagggagtaatattttcgacccgagataaatttataaatattattttttttataaacttggttaaacttgaagcagcttaactttgaccaaaatcaaaacaacttataacctaaaacgaaggtagtatatacttatatttatatgtataaactttgtaactaaatatatacacatatgcttatatacacatctatacaaaattatacattatacatataaactttgtattcgtacatataaaattacacattctttagacatataaaaagtttatacatatacgcacaaactttatgcatatacaatttgtacgtatacgtatggaacgcgatgcgctgatcgtggattagcattttcgactaggtagctacatatagcattatcaaataccctcacaataataaatatctaattgtccttctaaagcaagtatttcctacgtatgttgaaaaaaaaacttatctttatatcttgggctactatgaaaaccgaactatctttcattagatacgcaaatatatattcatttgattatatgcattattatgaataagtgcgcgtagcgtataagcacatgcagttatactgtgttttaaaaatacacaatcatatttatagtcaggtaaacgtaaacgtaccatgtattcatttatgtaccgggcctgttcatctgcactatagcaggctacgacgcagtcacctcacacggtattttgtgtagcataattatgtgttggattgggatcaggtgcagtcccaactacaactgcacacgttagggactacacaggatcatgtccatttaaattttcaatggaaggttcagattaaatgctacagtagcattggtataataatttttgttggattatctaaatgaacagcgctctattaaatttgggcctttgaatttgcatcctgcggccatagtataactgtctaagttgcagtcatagtaataactgcataagaattaagggtctgttcactttgatgccaaaattttgacaggatttcttatatagttaccaaaatttgacagcaaactaaatgtagccacttttttttgtaactttaccaaaatttggtaaggttgtaaatgatatcaaagtgaaccggctccaaatccgtatgtgttgtagccgctttaacatgttgccgaacacggctgctgcaactttatagagatattatccttactaaataaaatacaccatcgatgtccgaagaagaaaggaaaaatcatattgaacgatcaaaccattgtcgccgtatgttggtacacggtattaaacgtgccaaaaccatcttccccctccccacagacgtcaaacgtggcgaaccacttgacaccaacgtgtgcacgtctgacttcttgcactccctatacgtcttgacccccccaccccccaaacgcccaacggatccttctggaacccactcgcgccgtcaaaccaccaccgcctccgtctccttctccgttcccgtctccgtctcccccagagagctctcgtcgcgcgcgcgcacttttctcctctccgactgcggggcccaccagtcagaagagaactctcctggcgcctctctctcccccaaccccaccggatacctgatccgggccgtccgttcgatcgatccgacggcggagacgttgtcctgggctcccacggcaggaattggatggttctagaactcacccgagtcccgaccaccccacccccaccaccacagccgcctctcatatatcaagcggccgcccacgcgcccctcgcatctttcgcgaaggcgattcaggcgagaagagagagagagagcgcgaggccggcggttctagaagcttccagacccttcggcgcgagcgagctcacctcccccgtaggtacggcccacccttctcttcccaggtcgcgccgcgagttggatccgcgccaccgcccgcccgtggatctgatcgtgtttcggcgatttgttcgttgcgtttttgattttattttatttttttctggggtctcagcctggggggatggtttgcgctgctcgggtttcagccgcggagggatgatgtttttcgttgttattttttttttcgcggtagctgcgcgggattttgactcgctagggttttagatcggtcgtggtgcttagagtaatctcaaatccttgaattgttacaaatttttatttttgcagctctgcagatcgagatttatgtgattttagtgttgatgtttaggtggttataggtttggatcctgctgtgagtaactcgtagatcctgatcctgattgattgtatttatgtgcgcaggagctgttcattagatctgaataagggggattgaagcagtgaggagaagatgagcgtggtgggctttgatctagggaatgagagctgcattgtggccgtcgcgcggcagcgcggcattgatgtggtcctcaacgaggagtcgaagcgggagactccggctattgtctgcttcggcgacaagcagcggttcatcgggacagcgggcgctgcttcctccacgatgaacccgaagaattctgtttctcagatcaagcggctcctcgggcgcaagtactctgatcctgagctccagcgtgatattgcggccttccccttccgtgtctcggaagggcctgatggatttcctcttgttcatgcccgttaccttggtgaagagcgggttttcactccgacgcagctcatggctatggtgctttctaatctgaagggtattgcagagagcaacctgaatactgctgttgttgactgctgcataggcattccggtgtacttcacagaccttcagcgcagagctgtgcttgatgctgccaccattgccggcctctgcccattgcggttgtttcatgagaccaccgcaacagcattggcatatggtatttacaagactgatcttccagagaatgatcaattaaatgttgcctttgtggatgttggacatgccagcatgcaagtctgcattgctggttacaagaagggacaactcaagatcttgtcgcatgcatatgaccggtcccttggtgggagggacttcgatgaagtcctgtttaagcactttgcagcgaaattcaaggatgagtacaagatagatgtttaccagaatgctcgtgcctgcattaggctccgtgtggcttgtgagaagctcaagaaggtgctgagtgctaaccctgagtcaccaatgcacattgaatgcttgatggatgagaaggatgtgagaggttttatcaagagggaagagtttgagaagattagtgcatcaatactggaacgtgttaaggggccactggagaaggctttagcagaagctggtttaacgacagagaatgtccattttgttgaagttgttggttcaggttctcgtgtcccggcaataattaagatactcacagatttctttgggaaagaaccaaggaggacaatgaatgcgagtgaatgtgttgccaggggatgtgcgctggagtgtgctatccttagtcccacttttaaagtgcgagagtttcaggtatgtgcccgctttcaccctgctgccttctctgctttggctatctgcacaatacattaatagaaatcttgctgcttcatgccttaaaatctctaattaaggattgtttaagacgctcatcctcatgtgcaccgtcattaaagtttaattggatagtccaataagatttgtctccttacatgactccattaagatcatgcaaccatcaccaatagttattcatagtgtcgtaattttcatgacaattttatccggtactccaatgaaactgtttccttaatatcatgcaacctctagttataaccaataggtttatgcagaatgttcgtcataattttcataacaacttagcgtgatacttaacatgactcaaatatcatgcaacctctattcatgagttttgtgaccaatatggcttattatgcagaatgttggtcataattttcgttgtaatttaatctcatactccaataagattgtttctaacatgacttcattaagatcgtgcgaactcgcttatgcagagtttgtcttgttggctccttgaatctgggtttacccaccaatttaattcttgcctaataacattgctggaatctataaagctttcagcatattcttactgtttaaggataacatatgcactgaaggcctgatttgaatgagtagtatttggttcaaaaatctatttcactcccttgaagtcttaaaattaaaacaaatcttagtatactactactcaaaatcattttaggataacactaacactaggatttttttctttcgtgagtttacaataaatcatcctagttcttgcttgtacaacactaaagtatgttttttccccagctataacgctaaaccctgtgcaggttaatgatggtttccctttctcaattgcaatgtcatggaaaccagactctcagaatggtgataaccaacagactgttgtattccccaagggtaacccattgcccagcgttaaagcattgaccttctataggtccaatacatttcaagtagatgtcacgtatgttgatactggtgatttgcaaatatcaccaaagatcagcacttacacggtaactgacttaatatttccttttttatgttctcgaatgtgcttcgagtccaactatcgtgtattgatcatgttcttttgttgtgtgtgtttatgttaatgtataggttggtcctttcaatcccggcaaaggtgacaaagcgaaactgaaagtgaaagtccgccttaacatccatggggtggtcacagttgaatcagcaacagtgagtgataatgcaggctgttttttttttgtagttcttttcctaaatgattttcgttgaaataaatctgagagtatttctattggtctggtgcagatgttggaggaggaggaagtggaagttccagtagcagctacaactgagcctccgaaagattctgccaagatggagacagatgatgcacctaatgaagctgcttctggaactgatgtaaacatgcaggaagccaaagcccctgcagatgctgctgccgannnnnnnnnnnnnnnnnnnnnnnattctgaggaaaaatcagtccctatggaaactgatgccaaggtaaattttcattactgacaaaatcttgaattatcatgctagcaggtgcctgaagccttttaatttgaaaccttttgctttttgaagtatcatcagtacaaggtggaagttgaggaaacagtattctggacatgttttttattcagagctaacatatcttgcctttgtagtttatatttatagataaccttttgaagcttacatgcgcaagctgatctgattagtccactgcactgttatgccttcgatttgacactttccttgcattgattttatcacgactttttccatgccaaccacaatgtgccagtgtgcaacaaattcgttgcaattgctgtttttgtggtagttatctatcattctattgctgaaactatacttgatacaaatatgatcattctttactggatccttcctactgtggttcaaaatttggttttatcttttcctcaattcctcagtctgtttcagtttgccctaaagggacaagtgaattgatgaaatgcgatgaaggaaaaagtaaactgtatcagatgaactaacagttggcacattttgatgaaaaaactgcaggttgagccatcaaagaagaaagtaaagaaaactaatgttccagttgctgagttggtttatggtgccttggggactacagagttgcagaaggctgtggaaaaagagtatgaaatggctcttcaggacagggtgatggaagagacaaaagataagaagaatgccgtggagtcttatgtttatgacatgcgaaacaaggtttgatcgattccactctttcctgacttcatctttagttagaggcagaaactgataatatgttatttttcagctgtatgacaagtacaatgattttgtgactgctgaagacaaggaagcattcattgctaagcttcaagaggttgaggattggttgtacgaagatggtgaggatgagaccaaaggagtgtatgttgctaagcttgaagaacttaaaaaggtttgtctctttcatttattttgctccttacatcttgttagtttgtatattaaaaaaaagctatgatttttggtcacaggtggggggtcccattgaggcaaggtacaaggaatggatggacagaggcccttccatcgaccaacttgcttactgtatcaacagtttcagagatgctgccttgtccaaagatccgaagtttgatcacattgagatggaggagaaacagaaggtattcaatgcatcaactacaaaattagcacaatatcttttctctatacactgattgcaatgctagttcacgaactacgttctgctagtgaatggtaacagaaataaaatccttttattagggttacaaagtaattgacatacgccctgcttggccctacattggattatagcaattttgaatgaattgtaaagcttgatttttcagaataattttagatagacttttcactcgtcttagttgatcccaccgatagacggtattaaattcatttgcttgtcacatgcaggtgattaaccagtgttccgaagcagaagtctggctgagagagaaaatacagcagcaagatgctctgccgaagcatgctaaccctgtcctactctcttctgatttaaagaaaaaggccgaaacggttgacaggtccgtagataaatctctcttgacgccacttgctgttcctgtatcctatgtttaagcatacttctaacgcccattctttttacaggttctgcaaaccgataatgatgaagccgaaaccagctcctaagccacagacgcccccacaaacgccaccgaccgagaccccggctggcggagcccaaacaccagagcagcaacctcagggagctgaagcggctggcgaggccagcgagggcggcgccagcgaatctaccggcgagcaaatggagacggacaaaccggagggaactgaagctgcctaggctgcagctgcggaaacgtttttcagtttcctgcaagttgctgctgctcggtctgcattcgttatcagattccgacaccgaagttcagtagaggttcgctagggatggatttgtgattcaccatacttcgtgaggatcatctgcgtgaacgtacgtttaggtttatatcctactgtaccaatgtgttgttaaaatcggctttccctttttaatttttctgccaaggggttttctttcaattcgagatataagggcacgtttcagatttggtgtcctacggggtgggtgttatagcgggacttacaatggaactcaaatttttaagtccgatgtatcaactgattcttgttccatgggatttgcacgctcttctggacttacttttgcatgtgttaatgtgctggcctgggtttaatggcctgctagtgtgcattcttttgctgctggccttggtcttgggtgttttaagttttaaccggtggctcgttgcttctgcttgcgctcatctggacgacattttctccattaggacagggtagaccgtagacctagagaaatcaagaggctggaagggcactaaacatcatcagttactgatcaaggtcaagttgcaactgtgatacaagggcccattggtgcaaagggagccttgtgtgctgtggctgctcgcatttgttgtacgaggctccagccggcccactagtcctgtcgtgcaaagcaagtatggatgaaaacggaaaggatagttttcgttcgttccgaagaaaacgaatacaaatacgggtatgatactggggtttccgacaatatagatttggaatcctgtgaacaatactattcgggtatccgttcaagcaatgagatatactcaatttcttaataaccctacgaccttcgatctacatctttttatatttaatagtagtctatctttcaacactagtccacactattaatattatttaaaattttattattttataaattatattatattttatataaaacaagctaattatatatgatgatatttatttctattataaattgaggtgattttcgtgttttcagaaaaaaatgtttccatattcgtgtttgattatattcgatctttatttgtattcgagataattcatatttgtttccgtatattacaaaataatatgaaaacagtattgcatgattatccgttagttttcattcctagttgcacggaagtattcgccaaatacttcagtgttaaattgtaacgaatgctagacaacctcatggcgaattacagcggggctaaaaattaatagacgctttaaatagttagagagtgtagcttaattaaccgatatgtagatagaaccctatcgaggatgtatatgtgcatattttcttggaataattaactattttttcttaggcatgttttgtatgtgttgggcgccgcgtgggtgtaaatgttattgagagagtgtgcgttgcacgagtcacatatcatatgagatacgttgaatatatatagagtaaagttctgtacatgtgttaagaaaaactgtacaaggtctaatcgatatggctgttttcttccccctattttactaacccacatatctcgtttttcgcgtgcacgtttttcaaactgaaacggtgtaatttattaaaaaactttctatatgaaaactgtttttttaaaagaatcatattaatctatttttttaaaaaataattaatacttaattaattatataacaatacgagcagttttacgtgccgggaggagggttcccaccccctcctccagaacacagcatataggcgcttggctcatgcgagcacccacgttttagctcctcattttttcgccccaaagctatagataaaattccttgtgatagaaaattttctcattcttttcctttcatatctcctaggaaacgagggggatgaacgagtgaagactatgttttggcacatcgtatgtgtttgccatcgtttccaaccgttcgtgcactgaagtggtgtgccgccagcccgccactctgttgggtctgaatttttgcacatccatgtagtagtgagcatcctctaaactctccttgtgtatcgacattaattgcactgtaaagtggaagactatatatctcctacacttgtcaacaactcgacatagggggtatatggagttgttggattatcctcgaaccggtagtctatctggggcccatactttggtttggattactagccaagcaaagcatttgtattttcttggtgcccacagcttccagataagcatgccaaagttggttcggaccaacccaaaaaactatgcattgtatgccgaggcaatttgtgtgtacggggcatggtagttgtgtatggggcatggtccgtgagtttccacgaggtctggtcttcctccccctactcagatgtttttatcaatgcaactatattagagcaggtacaatagcagactataagccagctgcaaacatattttaaggagataaatgaggagagagaagggcagcgggctacagatttgtagccagctgtagcacggactccaagacacagtgtgtgtatgacaggtgggaccaggtactaatagtgtagtatataactattgtatgaatgagctattagattggctatagatgaattggagctagtagttggctatactattgaacttgctcttagtactagtactcatcacaagaaatttaaatgcttgctttggaaaagatgactaggaggtaatcaatgagggcagcaatgtaatttgccatgtcttttactatctccgtccttaaataaataaaattagttcaatttagcccaaaaatgtgtccctaaaagaatgtgcagtggtccacagtccactagacttttttttaatactatgttttcttctcatttttagtcgttgaactaataatactcctctttcttctcataatctcattttctttctatatcttttaaccccttacttaataatccattcgttaaaaaaatataagggattttgaccggatgtgttacacatcctagtaatacgaatctagacagaacatatgtcacatcagattaaaatcccttatttttgagacgaagtgagtatgtctttgctagctaaaagcctaaaactacacttaaatgaaatgaagggagtaatacagtgtgagatttgttagaacgacatatgtaaattgtaatagagggaataatataaatgcattgcttatggttagaaatgaaaatagcagttacgtttcataaattattttgaagcaaggccatggcaccttggcacgatcgatctgagcaaggcttgagtatacatgtaaagagttgatttttagcattcaaaatctgtaaaaaaaaaagatccttttatctactggagtattggtctactgcacaaagtacaaaccaaagtagtattaaattaacgagcattatccattcaatacctctcaattaccttcctaaacaataacttttttttattaatagagacatttttctcttcatactaatttttcctataacggttataaatgattttttttgagtactccctctatcctataatataaggcgcggtcaaagttggcacggtctccaaaactaatatttagcttataatttctcgtatgctataaggtttgtagcaacaaaattataaccgtatgaaagtaattttaaatctcaatctaatgatataatttttaacaaataaaattcatttcatattatactaagcgttggtcaaatgttttaaatgttgaatcttgaaaatgcatgtgcgccttgtattatgggatagagggagtagtacactttcaagttttaacgtgtgtctacataaaactcagagcgacccctaacaatttgaggattatatatgtgtaaaatgttaaataagactttatctttagaaaatactaatcgcatatataatagatcaagcctaaatattttttttacaaaacattgggatgggtctctactacgcatgcaaccagtgtccctccataaaagctacgatcaaataatactcttttctttagatatatcctactatcaaacgaacaagaattgttcacaaccataacacttagagctatgtcaaagaagctcacctacctacacatcaattcagtttattcttatttttagggtcatgtatagtcgctgtcatcttacacgtgtatattacacgtgtatagagacagatcttgtaaaactacgtacacttctaattgcgatgcatttagtataacttaaaaatacacttatacagagaacacaactaaaaatgcgaattttgataccttatggtttgtgtgaaacccacaagcatgctttgcacacattttccacccacacaaataattaactccaaaaatgaaactctcaaagcataaattaaaccaagcatgcccaaattaaggtgcaagggcaagggcaaggtccctcctttttctcccctctttcccccaccaaaccagcagccatcaccgcatgcgttactacgtgtgtgcatggcctccctcaccatcaccaccagcagcagccagcccaacgtatactccactactactactactacgtcagttacactccaccaccgcgtccgcgtccgcgtctcgccgctcgccgcccgcgcgcgctcgcgtctctcgcctcgcatgccaagtgtgcgccgcccgccgcgccgcgccgcgccccctagcgcgcgcgcgcctcctcatgaccaacgtgaccccacccaccaccaacccccgcttccgcgtcactccgctcgcctccaaaaccacaccgcgccgcgctcgcgctctcgctctcctcctcgctctcgctctctcgatcgatcgaatcgattccgctctcccgaatcatcccctcctcctctcgatcccctctcctctcccctccccgccgcacgaaaccctagcaaccaccgcgcccgcgcaagccaagatgcctcttccccgccgcgccgccaccgtgaggatccgccgcggccagatccaccgcgtcaccgccatgccaccgccgccgcagcaagccccggagccggccgggctgcaactgctgctgcagccggaggtggtggcgccgaaccacccgccgcccgctccaccggcgccggcggcggtgcccgcgccgccgcagccgcagggggaggcgaggtaccgtaggccgctggtgcggctgcaggccgtccccaacgaggaccacgtccccgacaactacggcgacggccccgacgagctcgggatcacgccggcggtgtaccaggcgctggagcgccacctgccgccggatctcgccggcgcccccgccgaggtgaagcgctacttcatgcgcagcgtcctccgcaactacgtcccctcgccgtcgcagcggatcagggtaagtgtagctagtatacgcgcttttactatttaggcgtctcattaattaattcatttcatcaaatcaagcttcattaatttttgattctctagcagctatagtcataaatgcagtttaatttggcttcatgtacgtagtagtcagttttgcttatttacaactgttttaagtttaattaaccatgagtagtgtgtcttgctattgcatgcatatgatgagttggatatatagtgttagtgtaagtacatacgtagtgtgtgttgttaattaattaagatgaattaatcacgtcgtaacttatgtataatctggaaactcgtttgcagacgcagaatcagagggagtacagggaaaggatcttgtccgcataccaggtacgtattttcttaagcattcatttttttttaaaaaatgcactcttgcactataatcaaaatgtatacacgtattagataatatattatgaatatgtagataggaactcttttttttttgtacatgtaaaaatgctactccttaattacatgctatttgcctagctagctagctaagaaagtattattgcttgaaatgtgccatagacacatttgaattaaaaagtgtgagccacactatttgcacattttatatataggtgaacacacaaactcataggtatatcatttaccctataatatgtacacttacagattttttttttcttattggatattttcaagccattacatccggagctgtacacaaatgatccatcaactttcatcctaccggcatttcttcaagccataaatggcaacaccgaagaaagcatcacaagcataatgatggagccagcaccgggagtgtttgcatttcctatgctgaagccctcattctgccagatgttaatgtcagaggtatgtgattatattgcagcatggaatatcattttggatatatcatgtagtattattttgctgctaattgtggacactaattaattagctttgtaaacgtatatatataaggttaagcaatatcggtaatgctcgtgtggtgtttattctcgcaggtgaacaattttttgaggtgggcacaatcagcgaatcaaaggataatgagaccaacatccttagataggcatgggagaggtgctgccctctctgattttggcttgcaagagatgttagacaatctgatgaaggatttcatctcaccaatgtctacaggtcaattacttgtctcacaacttgattttcttgtaggataggaaagtagattaagattatgatattcatgtatcaaaattttcctttctttaaaatgaaacgattaatgacttaactccttgatcatgcagttcttttccctgaagttggcggcaatacactggactcccaccatacattcgttcttgagtatggtgaggctgatggtgctagaggtatgctataaacatgtaaccacgcatctatgaattaatgactagaactatatataattgtgctacataactcccttagttcattttacatttaagttttagaatatgtgttgccatactttgatcatcatatctacgctctacactatatatctagctagattgatgatataaaaactatatcaatagatttaaagtgtgaaataaccttaataatattttaaatttttaattagggagtaccctaaatatgtacttatagagatatatattacatgtcgacactcaaaccatttgtgtacatgacatattacacacacttttgatgcaagcgcatatatagctaggaagtaatgttttaccatcattttcacagtagctatgtactctctctgtttttattttttgaaaaaaccaactacttctgccacatccaagtactatggaaaaaaaaaaactagtgcagtactacgtgataaaaatacatcaataattaattctatatctgtgtctcctgtagctatcggaaactgtgccgcacacacgatcgaggacattttggtcttttgttgttagcactaaatttgcatcgggcttttggaaatcttttttttttctgggacatatataggggaagctatcaagctatgcatgtagaaattaaaattgctgtcctgaggtaacatattaacatgatcagctttttcttatatattctaaacaacaattgatggagattgcaggtttccatgtggatgatagtgaggtaacactaaatatctgccttggcaaacacttcactggcgctgacatgtacttccgtggtatacgttgtggaaatcatgttaattcaggaacacatgatgaggtactgattgatgtataatttgtaaattaaattaattatgcacccattttatttagatgcccattaattgccatggagcaatgcaagtttttagtaaataaaaaaactattttcttttagtgttaatgctgatcatatcatccaaacctttttattcctttgagcatttctcctttagccttaacttttctattgcttcaggggttgaaccccacaagtcatctacatcctcaccttccttgaacttagctttgtttctttttctaatccatcagtcaaacaataacatttgaatgagaggatgcatgcatggctatgaatatcgacaaaggtgttgactaaagcttgactgtattgacggccatgatgatccagtaatggttggctggaagacatttagagcgagtagaaatgtcaacactatcacaaatacagagatctctaacagctccatgaaaaagaaatccatttgagatggttctaactagatgtcaaatcactaaaaattaatctggaatgggtcgcccaatattgaacccgccacaaacgatctttaatatctcctaatttgcaaatcattacagatcagtgaataatgaatgcaaagaagaggttgttcggagctaatctttatgatctaatgcttaacctataacatgatcatgtaattcataatttcttgtgcggaatttggtatacgagaaaggcggtggctgtctcgcagaagagggatggatgagacagaatcacgagagagcgtgagggagggatgatgacagtgggcacgcatgctagggtttgggtttggggaaggagaggtcaaggagggagtaggaggtagcgggcaccaagtgcatgagaggtgacccaatcgagctatcgtttccagttgatacgacgaccaatagctgatgcgtgctcggaatcctgcctccgtgcatggggcaatgttgatagcgcaagaggcgagcacaccttctcaaaatgccatgtcagcactagcttggggaggggggggggtaatcttcaaagccattagaacctctgtgtagtcaattgcctcttttggttttgccattgaagtagaagcagtctctcgcaaatatggttgctagcttgatgaccatcgtcgctagtggcagtgataattaatcttgtaggtgtcaatgtccctccagggcatcacctacattgcttgaaatggctgtttgggtctcctccagtgctagtgaggatagggtttcattaggttttccgaaagtgggcttgccgtgtgagagattgtcgcttcacgcacagggccggtttcccccatttaaaaaggccttgcggggcttgagggcatattcacaaagaatgaaacttgactccgatcatggggcgtacgtaagggaagtgatcatacggctttggttattcatgcaagatcttgttagggaagtgcacataatcgtggggtgggccacttcccaaacgtgattctcgggttagccaagatcaaccaatagggaacatggttttccccttcgttcattggtttaagcaataaatggatttcggactttcttactattattattgttttttaaatggagagcattatactttactttatcttatcactaaaatagtagacaaacataataagaacatactgcatcccacattccaaattaacacatgcgtacgaatcaaccgatttctacaacacaaagacaattgttaaacactttgttctttgtctactggtgtatagtgggggccatataaaccgatgaacaaattagcaaaaaatgtacatagctagaattgtatagaaattctagctatgtgtgatatttatccctggctagaggattgaatgtctactatttaattcttttagcacttgtatagcagatttttatcagattaattaacacatggaatttggatgtctgaaaaatttctgtaaatctgaaagtaggtttttatttatctataagtaggaaatatttccgtaaatcttctgtaggaaaagtcatgttaaaagagatcatatctacatctaataggtttcaaaattgcattattctagtttgcagatgtgtttttgtgctcatttcctttaattttgttactgttaatgcatgattatgcaaattaacatttgacatcttatttttgcccttcaatacttatacgattcaggagtattttgtacatcccaacgtgcccggacaagtcctgctgcatcatggtagtcacaggcatggtgtcttctcagtaacatctggacggagggttaacatggtcatgtggtgcaaaaggtaacactcaatgtaatatttttacctatatttttcttgtatgtacagtatgttggctactttgtttaggtgaattaatcaatataggaattcatatagtagtatgtccatgtaaaatcatgtcccttagtttccaacacttctaataaaggtgagattccatgagaaataccagctttcttgtaaatttaattaacctgattgaattggctgttgttaatttctgggctgatctggaatcatacatgcatgaaaaaccctagtatcacctcaatttatcgatctgtagctgaagtagtgtttcttgtatatacagctcagtgttcagggagatgaagaaattcatgactgatttttctgggttttgttgcgagtgccagtttcagaggacggcaagacaggtgcaacatcttcaggaattgacggtttgttacttaacccaactccaatatatagaaaagtagaagcgatacatatatacatgaatattcagtaaattgcaagcatgcagatgccatttaatttctgccaactcccctgaagttggaaaaccaataatagcgagtacatgaaacatttaatcaggataaatattgataaacacactggaatcaatttaatcttatatactcgctttatttcagtatagccttgctaggatttttgtaacaccccacttaatttccattaatatattggccatcataagatagcatgatcttttacctttgcttctctattcaagttgcaaggcttaaatattttatttttcatatgaaactgttacattacagttagtacctatatatagctaaccagcttgactactaccattctgaaatcgtttatgatcacttgaaatatgcaggctcgtatctctatcagcggacaggagtcagaagacgaaactccttaattaatatctgtccgatcgagttggccggccaaccagttcctgaacaattatgaacagtgaacagtgaataattaagaacatgttgttatgtattgcatgctataccgaatttactagtgttttcaatgtatgtttgtatgaacctagctactggttcattgaaaacttgctgcaactgactcgattggagctcaggattaaacaacttagccggttagagcctatgcttggttaattttcaggttgtgtttggttaattttcaggttgttggtttgatttcttgggttatttttagtttatttggtgtatagtggagagcggctgttgagttgcttgttgctctagatctaaggagtagccacaggaggagaattcgatttgggtgaaaaagggtgagaatacccatattttacgaccgaaactaagtcaacaaccacttcaagattgacaagagagaactgttttgccgcgctattaaaaaatttgcccctccatgaaatgacatgatacctagattatgagtgataaaaggtgcaatcttccgatggcgcaaacaaacaagatgtaggtgtaaatttatgggattgttttgtcgttttattgatttgtgggatattgagaggtacatttataggatagttttgttgctttattggttactggatatatcaaggagttgcggttgccctaatttataagcgacaaaaaagattgaagcaatcttttaatggcatggacaagcgagatgacatgtagagtggatgaaattgctcgtatgctaacactgggtgctccttttttagcataacggtttcgcttacccatttaggcactagtcctttccctttttataagtcagtgatttagttaactacccacaccgtacgaacactgcccatgtacttgtgaatccacgtgctatttgacttaagcattattttcagctaggccttgagcgtacgggactaagtgcactatcttttttattaattattaatttgttttggagttattttgaatatcttctgaaatttgagtacaaattttatacctttcatgtgaaagttttgtgcagaaactctctctctctacacacacacaaatttcataaaaccctaaattttagggtacacgtgacataaaaccccatatattgtgatttgtttcaaattatcgcaggttttaggccaaaatgttttatttttacgtcaatactcatattccattattacatatatgatattttaagtatatatttacattggtaggataataaatttacacacgcttctctattcaagttggaaagctcaagtattttattttttgaatgttattacaggtagctatagctagtcagcttgagtaccattttgaaattgttgctcgtatatctataagtggatatataggacgaagctgctccttaaatcttaaataactgttggagccaaccggtccgtgttgctccgcgagcaccagtatgttatgaattctggacaatgagtaacatgtctttatgtattggatgctatgaaataccaaatttaattaccagcattttttatgtttgtttgtgtgaacctaggtatatattggtttaaaaccttctgcaaactgaggcgattgacagccaagaatgaataacctagacctgtgcttggttaatttttaggccgttggtttgatttcttgggttagttttagtttatttgatgcgtaaaccgaagcatctgtacatttaactagtagctaaggctgtgttttaaaaaatcatattgatctatttttgaaaaaaagtagctaatacttaattaattacgcactaatggactgctccgttttccatgcgcactgtgcatattgcaaacatatgattccaaagacaaccttaagtgcagaagctaagtaagcgaatgctgcaacccttccagcttgacgaggtatataacagttttgccacgatattgagaattttgcccctccaagaaattatatgggacctaatttatgagcgacaaaaagatctttcaataacaaacaataagaagtataatttataggatattttttatgctttaatgtttattagaaatatcgagtagttgcatgagtgacaaaaattaaatgatgcaatctttcgatggaacggacatacgatatgacttatatatacgattgagttgacacaattgaaagggttgaaatcagcgacataattgaagtgatgccaattgtacttttaaatatttaatcgtaataagataaaaaaaaaccccaaccatcttaaataagttaacctaatacaagatatgaaatatatgaatcagaacaaaaatacctataataagatttaccacattccgcactggagtaggtatttcatatgaaaatgcctataatatgatttaccacattccgcactggagtaagagtagtaggttgaggaatcaaatagtagataataaccgtggtgattacttttttttttctcatagggacccccgtgcaacacagcaggtaggagagtataccagaatatatcgtgcggatcattagacaagcccaacctcgtcatatcaccgcactacgtactacgcagccttcaataccacccatcagtaaaaagcaaatttcagaccaaacaataatcacacaggatatatgtcctaaaaattcaccagtccatgacttcatatataaaccattgtattacccaggaaaacagtgagcattcagtaacatcaacatccagtccaaagtctaaaccatctttagtgatggtaagattgatgcccagcaccagcaccatagccatggccggctccaaatgtcgctccaggtccaccgtacagcaccccagcacggcgcgtgcccatggagcttcccggtgcgaagtgcggccgagcacctggtgccggtccgacaaaaccggcacgatcggtgtaggggaaagagtgggaggccgggttccgaaaagatgacccgtagttcgagttcgagccccttgagtacttggagggagggaaggactgaggcccggatgctccccgagctcgcttgttgttctggaatctgttcatgccactcggcttcctcctgtcagccttctctttctccatccttgcgaccttcttccttatgccatcgaggttaaatgctgatgttagctggcatgtctcgacacacctgatgatggacttgtaggcgttgcactccgagttgtttgcctcttcctgagaaagaaaacatgagcccttctttagtatgagagtatactaatgtaggacagaacaaataacaaaagatttggtgcaagagacaaaatacggtagaagtccatgaaaagaaatgccaagtaaatccaacactagagatcaggctggactagagatatataggccaacagctctccaaaattctcaacagccttatactgggctgttatttgttaagaactcaggtaaaatacatttcgaataaactgttaagaactgaaggtagaccgggcagggtttcgcagaaagtggtatgcaggtactgctagcatgctaaacctgctaatattaagtcacaaactgacagaatcataggtggtttgacaacgatagtagtaatattaaatcacatatagaccataaaaaaggaactcctcgtgcaggtggaggcttcaagtagagaaaaaaaggacctgcctaaatgagtcatgcaaaaagatatgctaaacagtaatacataaggcctctgactaaatagaatcatgtgctaacatagtaacgaaaaatacctctgcctaaacagaatcatgcacaaaacagtaataagaagatatattgggatggaaatggaatggagagtcttaccacaacagaatttgaatgtcttccacctctcagtgcaacctgagtcttgttagttattctctttatataagacttaagaagcggtacaggtggaaatcgctcaagcaaaccagcctcatgggcgatatgaatagcttctatctcatttcctgactttatgaattcctcaataacatctgaaacacaaaaccatattagttttgtcatgttttattttctccaggttaaaataatgctaaccgtgatagatgaattgaaatgactaaaattagtaattaaattgtgcgaagttcaaaatcaactcaacaaaagattgatataattcaaagtaattgcagaaatcactttatcactggaaagtagatattggtcagtaaacaaagcatcaataaaaaatgcattcaaatgcagcccatcgataaaaatagcagaaatcagttgtgatggcttttagttcaagataagatcacggtatcaacagcgatagcagatatcgcttgtgaaacttcatcattcaaattgtagctctacatcaaacaaagccatgatgagttgatctcttcagtaacctaaatttcaagtccatactcttttagcagagactatggagccctatacttttggggagtttcctctgctggagaaggatagtagtgaatgaagatgaattttagatgaaaaagtagcctgttttaatgaatcagttgctagcacacaaaaagatatttcataactaatagattgagcagcggttcgtatactgcctgaaagggaatatttattatttgcgttatatcctgccataagaagaccaatagaaacaatacttgaaatggcaattcattacagagcaccaatgctaagacctttcgactcctaactaaagaggtagccactgaagtatcacaagaacaaatatctaaatagaaagaaattgatgcttaagttgccgatttgaagtaacagcccaaatatttctcaatctaggtattgactcaagattattataatcctcatatgcagtagtacttttaattcttattgatatagttcataacctgccctatgatctcgattcaacaaacctaggatatgttcttaaatcagttcaatgaaagcgaaagcaacagataaaagcaacacaccattacctctgaggctatcctcgaaaccaaggacgcaagcgattctggcaagttccctcctccgtccattatcaactaatagccgcctcaagaaatctacatcatacctatcttttagtccaaatgcagcaaccatctgcaggaatatctgcacctctgcctgtccacccttctctccctccttcacctctcttcccgacgccttcttatcttcctcgactttcctcttctctacttcccctgtcttcgccgcattggccaccttggcttccgcctctcctccttccttctctacttcctctgggtcctcttcttccttctctacctcctctgcatctgcctcttcctccgacgcgggcaccatttcctctgggtcctcctcttcctcctcttcttcctcatctacatgctcttctttcttctctgtcgctgttgcgttctccaccaaaggcgcttctgtcatctccacctcattgttatccggtgcatacaattccatcttgatcccaaatttctctgaccaattcttggcaactccggccgccctctcaaccagcgtatctcctatctccggcggcttccggccatcggaatcaaacaacgagcgcagcagtatgccgagcacccagaactggtcctcacctgcaccatcctccgcggccaagaagtcggcgagggcgtcgagcacgaggcggggcgggtcgaccgacgcggcgacggcggggccgacctccttccggacggcggcgagctcccgccgccgcgccgccatgaagcgccacagcgcgggggcgtccatgcggccgcacatccaccggagcgcgccgcggacgtcggcgggcgggggctccgcggacccggcctccgcgacggccgcggacagcgccgcctcggcctcggcgaggcgcgccgggacggcggcctcgcgggcctcgagcgccgcgagggactcggaggtggaggcgcccgcggcggctagggcgtcgtcgagcgacgcggagcgggcggcgaggtcctcgtcgagcgaggcgaagtgggcgagcgcgcgcgaccaggcgtcgtggcaggaggcgaggagctgctggtgggagtcgaggtgggcgaggaggcgccggacctcgccggcggcggcggcggaatcgccggtggcggccatggcggtgagagcaagcaggttgggtttggattggaatcggggcggctcagatgtgggtggagatggaggtgggctttctattgggttttaattgggccataatggacttgtgcaatatttaatgggctttctgttggatttttatttgggccttggtggtgagacggaccaaagcaggtttgggtttggactgaatcggggcggctcagatgtgggtggagacgaaggtcttgtaataagttcactttgggtccctctatttgtcgaccattgaccacaaaaccgggtatgacccgtcccccaacttacgaaaaccagacaaacgaggtccataggcggttttgatagtggttttggctgacatggtgcctacgtggcttgtttgactaggtctccatcacatgtggcactgatgtggagcttacgtgacaaatatatctacgaaaaataataaaaagcgtggccccatatgttcgctgcacacaaaaaaaaaatttaaaatggtggggcccacacgggccccatgtcagcctcactcctctctcctttcctttcccctctctccttcctggacagcggacggcgcgggtgggcggcgcagcaggcgagctccggcagcggcggcgggcatggtcggcgccgccccccgacaggagcgccgcgtacagcgcggcgtaggcgagcagccacgcggagttggagaagttgaggcacgctgcacggccgcggagagcgggcatggcggcgtcgtgcgcgcgcgtgacggtgtcggcgccgtcgaactgccgagccagagcctgcagccgcggcgccccagcacgcggacctcgcacacccaccgccccgcgcacatctatcgcgctcgccggcgaccgctcgagcaggccagaggggcggcgaagcgggggtgagcggacatcgtcgcggccgtcgaccttgccgggtggtagaggagcggccgtcgacctttcacatttttttggtaagtcagacaacgaagaactagaaatgaacaaaagggatttcatagctatgctgaaccttgacccacttaggaaattcataatcaactaaaattttccttttcttttccacttcaatgttgcaaatcatcaataagaatcaaaatcatagacagtatattcctccctttattactagttacgagtagtagtacaatcgctcagcggcgacatgagggataaccaaagcggttggcttcaacagcgccggacgaaatcggtcacgacggcgagctccttgacggcattgtcgcagttagggatgaaaacggatcaaatacggtcggaaactaattatatcatattcgttttcattttttttttcggaatcgaaatcggatacggatacccggatatgaaaacggaatcgaatattatcgaatacaaatatggagcaaatacgaaacgaaacgaatacggtgacgaatattaatcagaatataaagacccctcaaactaagcatcacaaatcaacgaagaaatataactcattattttttctaataggacatatcaatattttcaaaatttagcaattaataataaacaactacaaacttgcacacactgatattatgaaataccatccatcatcatgtgaagtgaaaaggcaaagcactactaggcatgccagatactgtcaaccaatctttttagtctaaactctgaagtctgaaccacagttttttttcaactgaaaacacatgtaaaattcatagagcatggtaaagccacagctgcagcctgcagaacaaactaccgcaaggcacaagcctatttatgatataatcacacatgaatacacaatcattaacacaaacggcggcgacgttggcttggcccggcggcggcgtcgccttgcccctgcggcggcgatgtggcaagccagagggctcggcaggcgaggaggcgatggggcgccgcggcggcggcgttggcttggcccggcggcggtgatgtggcgcgtgacggcgcgaggaggcgatggggcgcggcagagccggcgttggttgctccgacggcggcgatgtggcgactgggcgaggaggcgattggtcccgacggcggcggcggcttggccccgcagcgaggaggcgacgacggcttggccccgcggcggcgccgacagggcacgccggcggcggcgccggccgatgaggaggtgaggagtgcgcctgtgggactctgtctgggactggacagtgggagactgggagtggactggatctgaatggatggagaattggagacttctagggtttcttgtaagtcagatatccggtgaaaaaaaccggatagtttccgactattatctgattccgacggatatcacctatatcatattcatttttgtatctgcaaaaaaatatctgtatttgtttccgtatccgaaaattttcgaatatatccaaccgaaacaatctgtatccgaaaaatggtccggtcggtcggaaattatccgaatcactttcaaccctagtagcagttgggcttgggcaagaagaagatttcaaccctagtagcagttgggcttgggcaagaagaagacatggccctcgccctcggtctcgtggaactccagctcgccgtcccactcgcacttcttgatcccctccgcgtacgagcgtgccctctccacgaaccagtagtgatccgccgtggtgaccaggacgcggctggccctgagctgcctccactcctccggcacgccaacgagttgacgcacgggcggtcgaggccgagcttgccggcgctggcgaactcccacgtgccgtggaacgagccgcggtagccggcgtcggtggactcgccgcccaggggtccttcccctagaagtagaggtccacatgggcccaccatttattattatgtgtgtgcaactgacacgtgggtcccatgggttatattattttttgcggttctaattgctacataagcgccacgtcaatgacacgttggacaaagacctagtcaaaatgagccacgtaggtgccacctagggataaaaccggagcggatagtttccgtccgctccggataaaaacgaatacggatacctctcggatcggataattctcggatagttcggatacggatacgaatacggatattttctctcggatacgaatacgaatatggtatcaggtcggatacggataataattcggatatccggtgaacagtgctattcggatatccgcagaagccaccagacataccccatttctttataactctatgaccttcaatatacctttttagattttaataatagttcatctcttaacactagtccacattattaatattatttaaaattttaaaaatatttataaattatactatattttatataaaatgatctaattatatatgttgatatttgtttctattagaagttgaattggttttcgtattccgagaaaaatttgttttcgtattcgtgtccgatcatattcgattcttattcgtattcgagatagtccgtatttgtttccgtattcgagctatccgtatttgtttccgtatccggcaaaaaatatgaaaacgaatatggtatgagcattatccgtccgtatccgctccgttttcatccctagtgccacctcagccaaaaccaccgagggacctcgtttacctggttttcataagttgggggacctgttgtacccgattttgcgagcaagggatgaaaatcggactgggcaacaaatagaggaacccaaagagggacccaaagtgaacttatttcggaggtctttgactccctcaactatgatccgagtatgattcatggcctccaaccacaaaactgtgtatattgactcctccaactatcaaaaccgatgcaaactatatccttgggtggttttgaaagcggttttagctgacgtggcacccacgtggcagtgttgacccagtcttcgtctcgcgtgtcgtcgacgtgtcgcttatctacatgtaataaaaaaacttgtgggaccgacatgtcattcacacaaaaataaaatagtgggacccacggacatgtgggcccacatgtcatcctcacctctcccccctctctctctttcatcttttccactcctctcaccttccaatagtagaagcggggcggcggcgacggcgacgacgcacgggggaggagctcgccggccgtccacactcgggggaggagcccgccggccgtccgcgcgcgggggtggagctcgccggccgtctgcgcgccgggggaggagctcgcctgccgtccgcgcgcgggggtggagctcgcctgccgtccgcgcgccggcgtccgcgcgcgggggtggagctcgccggccgtccgcgcgccgggggaggagctcgccggcgtccgcgcgcgggggtggagctcgccggccgttcgccttcagggggaggaccggaaggagctagccgtgctttaatttgggcatacgtacatatcgatccatcgatgcaaatgcatgcttgcatatgctttcactgttctggatatggtttcagataagctaagtagctcgtccggccgtccacgcgccgcgcgccggggaggagcttgtgcttcgtgcttcggccggctgatggaaggtgagagaggaaaaaatgagggagggggggattgaaaatgtggggcccacatgtgggtggtttttttttaatgtgcgaatgacacgtcggtcccacaattttttttactctgatgccatataagcgacacgtcgacgatacgagggacgaagaccgggtcaacaccgccacgtgggcgccatgtcagccaaaaccgcttctaaaaccacctagggagggatatagtttgcacggttttgatagttggatgagtcgatatacccggttttgtggttggaggtcatgaatcatactcgggtcatagttgaggggggtcaaagtatactttttccttcctatttggattgtccgaattcttcatgttgggctggtgggcacaaaacgaactctacatgggctgcacaagcgctctcatagcacttaaggccttgttcggttccttaggatttaatccccaagtggaatatatccagggagggattgagtgaatccctcccatatgtcactcgactcaatccctatgggggttggaatcccttgctctctcctattccctcttttaaaccccatgttcgttttagccagagattttagctatcaaaatatgataaatctcatggctgctccttcgagcagacctgcttttgttctatcagccgactgtaatcagaccagaattacgtcaaagttttcatttgcaatggctgtaacgagcagctaatatgagcagcgatgcttcaaagcttgtcaggacagtattgcagattagaagcacaggaaaaacaatgatgggtacaaagaaaaaaaatgatgtcgacagtatcaaatatcacacatttcactgtgtgggagcactcagtttaaacacattttttgtaactcagatacatcacaaactaaacaggtttatgagtggaatgagctgagcagcaggagacactataatgatgccctgactttcgtcatgctgtctgaagcaataaatcttcaggaacttcagaaaattactaccatcaaataaattatctggaatttccctaccagtcgatttcatggaacctacaaagcataatgagtaaacattagctttcctatctcacaaacagataaaaggaaacaaaacttgagatgattgaattttcagaagatgcagaaatcatgtataacaaatatatatggccaatgcagaaatcatgtttatcttgacttgtctgcattttcagaagatgcagagatcatatatacaacttatatagatatacaataaaataataattgtcaatgcacggctacatgctttttttgactttgtattgcagtacagagaaatggagactgctatgttatctagcagctacaggcaaaaggtcaaaaagggaaagcaacatgtatactgtactaattagtaatttactatagataagaatggtcaacatttatgaagaacacacttcagtaattaaattcaaatgaaaagtaaacagtggtaactatggctgaggaacaatctttgcggatggcatgtaaaaactaggatttgcatcagtgtaggatacatataagtgattttagggtatctagagaagaaaaagaacttggtgacaactcaaagttatgcacaagacacgaactaggatcatcgtcaacttttggcattcttaaacatgttggacatgacatgaaatagaatctgtttcaataactagaatatgcttcaacaattttggccgttcctgtatcaaagtgcaatagaagataccaagaagacctagtttactcaaatacagaaaactgaattgctggctccctaaaatttgccttgttgttttttttttgggaatttcagttatgttcattttggccatgagttgcagctaaacttatcattggcacaaaagacttgaacatgagttctcaaaaaatctataaccataaaacatacatatctatcatacagtaccaatcttggtaatcaggtagaactagttcttggtgaatcaaagacaaggaaaaaaggaaaatctctgcactgcaagtctgcaactatatctacatgactctgaatttcttcagattttgcaatcttgagaagaatcaagttcgaatcctgcaactttggaaagtaaaagaaagaagaaactcttctgtactgcacctgcaactagatgactctgaattccttcagatttcgcaaacctgcaactgcaactacatgactcagattccgacgtggagggtgccgacactttgaaggctacgggccaagaaccaagaaccctctcctcctccttctcctcctctcctctcctctctggcgtccaagaaccctcccgtgtcccggcaatgccaccgccggagccgaacaaggacaaagcgctgccgaagccgaagccacccaagcccaagccccaagccagagccgaagctgaacacgcggtcggcattggcgccggagcacgaccagacggccggcccctacggcacggtgcgtgcgacgacgggaaagccggaaagggagaagagaaggaaaccctaccctaactttgaaagaggaggggagagggggaagggaagcgtgctcactggagagaaggtggcggccggagaagagagctatgccgtcgccgtcgccgtagccgtcgcctctgggtcgcgccgcgctccgcccccgccgtcgcgtccgtgtcttcgtagcgccgccgctcctctcgaggaatttttccgctcctctcgagtaggtgattttttcctgggcctacagaacagggaaatcccgtggtgggctgggctaaaatccatgctagggattaaccgaaggaataagtccactgtgactcccttaaaagtaacatgaatctaatccgtaaccctcaaccgcaaaaccggatagaacgactccccaaactattgaaaccggtgcaatttgactcccttaacgattttggacggtggtttcgctacgtggtgcttacgtgacggtgttgatctagtctggtcttgatgtggcgcttaggtgacatttaattaaaaacatatttgtgggatccatttgtcattaaaaaaagtggagtccactgacatgtcatcctctctctttcttcttcctccctccctttctcccttctctctttctctccccttccaccgtccgcgggagcacggctggagcggcggcggggcgggggccgaagtactggcggccggcgggagctgaagcggcggcgggttggagctaacgcgggtggaggcggaacaaaaggaggcggcgacaggaggggcttgagtggcggcgacggtggaaaccgccccacgccacagacctccaacgaggcggctgcggctgcagctgcctctgactagcgcgctggattattcctagcctccgtcagctccagcccacttccgccgcccgccgctccagctagctcccgtgtcagctcccgccggccgtcaccactcgggctcctgacgacggggaggagcctcgacaacgggaacaggtcagcgacgccgaacctagtcgccttcttctgcgcctcacccagtgtctccaggaactcctcacgccaccggaagccgcactcccccatgatggcgcgcagcgtcaagtcggttagcgtcccggtgatctgcctgctcacgttcagtgccggcagcggcggtgatggcgccaaggagcgcacccgccaaagagtatccccactgtggtgccgatggagtccctcactgtacgcccagccatagaggtcaaagcccccgggccaggcgccaggaggaggccgagctccatgaggcgggcctatgtaggcctaacaggtgtcaccggacaccgggtaattttttgtgtcaagttatagtatataggtatatacagcatgggacacccaaaaaaaaattggattggaccccggcctgtccagataacttactaaagcccaactaaagaaacaatccatcaaagctcacgttagcccaactagagcccaactattcgtgggaaggtgaaacgacgccgtgtatctcgagactgaattaactgcgtctccggctctccgctccttttcctcgtcagtcgtcggtactcttcgagactcgagacactgaggggctgtttggttcccagccacactttaccattacttgccaacaaaagttcccacatcttgtctaaggtgaggtgatcaaattgttagccacaacttactaagcctaagggaatcttgccacacttttttgagccattgacacgtgggacccaatttgttggaggagaatcttgccacaactgtggctacaaccaaacacctgtcaaatttgcctaaccttaggcgtggcaaactgtggcaaagtgtggcttgcaaccaaacacaccctgaatcgctgctcttgctcgatccttcttttcgctcaatcgctgctctactcagatcaagatcaagatcaagcaccgcgcccgcgcggccgacgacacgctgcgtgtaggccacggcgagcggcaacagcatgcattcgcgtacgctcgacttccagtcttccaccagttgcaacttgcaaggtttgttttctaccattagtccagaattcagattattggattaggacattagttcattcaatattctttagtgctgtcagagtaggagcatcaaaacattttaatttattcaatcattttttagttgtccacattctgtatcgctgcttactgattggtgcttgcactagaataactggttggcagtgagctaagtggttagctaactgattgacatgggaatttatggaaaagtattacaagagaaaatctccatcacatggagaagatgttgccccatcgcagccatcacacagacataatgctgctacatttaatagaagagatgttcctgaagatatcaattgggaagtggagattcaatttgatcctggcaaaaggaaaagaattgaggattatcatcccaatcaaaaggagatggtaagaagaaaatacttggacaatgggccttgtcaacctcgtccggatgatctccctgttacaaatattggtggtagagatagaaaatttaatcctgaatggtatgatgagtttggcagttggcttgagtatagtgagtccaaagataaagtttattgcttttattgctttttgttcagagaccctaataagaaatcagcagggtatgatgcatttgttacaagtgggtggtctagttggaacaaaaaacacagattgaaggaacatgttggtgatattgatagtgttcataaccaagcaatgagggattgtgatgctttactgaaaaaagagcagcacattgatgtttctttgaacaaccaaagtaatgctgagaaaattgcttattatactcggttaaatggctcaattgatgttactagaatcttactgaagctaggtatgccttttcggggccatgatgagagtgaggagtctctcaataaaggaaatttcaaggaatttcatgcttataccgcagagcaaaatccagctttacacaaggttgcaggtaaaaatgctcctggtaacagtcagtatacatcttcaaagattcaaaatgacatcatacgttgctttgcaaaagaggtactgcgttatattcttgaagaagttgggaatgatgttttctgcttgctggttgatgagtcaagggatgtgtcttacaaggaacaaatggcagtggtcttgcgttatgttggtaaatgtgg

SEQ ID NO: 82236 - DNA, 3393 bp, Oryza sativa
taagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttgaagattaaatcggattaaaacacttaaattgattttaattgacttatgacgcaataatgaattatttttgaaaaggaaaagaggatttattgcgtcagcggctagggtttcggtggaccgggcgcacggcggcggttcacgcgaacggacggccgagatcgacttgatccaaaacggacggctgagatcgatcggtccacgaccggctcacggcgaacggccccgatgacgtcagcgatgacgtcaccaccggcggcggcggctcggcggctcgggcttgcatgctcgctggcgaacgacggcacggcggcgcaaacggaaggcaccaacgggtagagcgcgacgcgacgaactcaccggtgaccaaaagagcggcggaagatcaacggacggcgacggcgacgacgaagaaacggtggcggtcttcaggtcaacgacggcgacggtgctccggcggtcaacagcgacggcgaaggagtggacgaggacggcgacgcgatggcgatcttcccgagcgacggcaacgtctggaacggcggcggcgcacggctggagcgacggcggcgatggcggcgctagggcacacggcgttagggcgctacggacgacgagaggcgaaggcgagggtggcggcgggtagagaagagctcgggggtccttttaaaggggctcggaggcgacggcgaaggcccacgacgaccggcgacgagaaggaaaggtcgggctcaaagtgacgtggtgagatgaaagaatacttggagaaggtcttggtttggtccctaatcaacttcttcaatcatccatgcattccttatgctcggtctcttttctttcacccaagcaagtaactctgtaaatgaaaacacacaaaacttattgtgtagcaacgtttgtttaaatatataacaagtaaatctagtataaaacatatgcacatttggttgattaatacataaggtagttatggttatatccgagctagtcatgtcctcgtaatatagtttaacaatgatctatatgccatatttctattggaaatattgggaagataactgcatacactatgttcagtaggttgatttcccagattgaatggcataggatcagcatgcttactgacatgccattacactcattcatgagaaaaaaaagttcaaattatttgggccatatatctcttgaaaacaggaaaataaaaataaatctcttcaaaaccatgcacatgaagaggaaggcagcccaaagccttccagtcgactactgcataaaaaaaagtcagaagatatagggatctagaattagttagtaagcaaagaaagaaataaggacccagtattagcaacaaagaaagaaaatctaagcgcagcaatcgctactcgccttgcatttgctgagccgcatccaagcaatcaacgtggccgagctgcgttgccgccgtcacagggactccggaggcaaccacctccaccaccttaacaatagcgaggcgtagtccttgatatgtcggcgttgggatctgccggcggaggatcagcccgatgcaaggcgatgcggaggggggctgtggccgcgtggatcgggggattgaggggatgccgaggtcggggaacggggggagaggccgccactgccggtggtggatgacgcgacgatggcagatgagccgatggaggaggaggagtcgcggcaggactcacggaagaggcaagacaccgtggcggtggaggtagtcgccgtcggtagtggtgggcagggagctcggcggtagagtggatggtggcggcgaggaagcagacgatgacagctgggtttcagtggatttgggaattggaatcggctagggtttgaggaaccagggtatgaagcaatcacaacgcggctttaccgaaatgaccctagtgcgttgacaatagttattgaattatttggacaaaacagtcaattcaaatttaaaatggcttgaccgcaaagtggcccgaccgcgaagattttgcttttgaaaaattttggctcccaccccacaaaaaaattggcgtctacagctacagtatcattcttttttggaaaaaaaatacaaactatatgcaaaaataatttcaagagcaaataaacagtatattccaacataaatatattttaataaaatgaagacatttggtgaaaataagtgagaatgctaccaattttctgaaatggtgtatccaaaacaaattacaagagcaaaagaacattatattcctacataaatattttttaaataaaataaacacgtgttgtgaaaatgttaccaaaaaattcaattgaaaacatatatatgtggtaaagacgaaaaacaaattatattcatatgtaatattatgccaaagttatatgcaattactcccttcggacaattatactcgatgtcgatcggtctgcataggtcaacggtttgttatacaatcattcaaactgaatctaacttgattcctcatcaaatgttttttaagcatgatataaataattttatatttgcataaaaaattttacattagacgaatggtcagccgtcggtaaaataagtcaatgacgtaaaaaataactaccgttgtttcaaatgcaaaaatcagaaacaacaaaattgtagaactcatcgagatctacaactatcgtattggtattttttacgaataagttcatttgaaaaattaaaaatttgaattttcaaaatctgataatttcgaacgaaaattggggttaataaatgatttcaaatagaaaagtcaccaatacaaagttgtagaactcatcgagatgcaaaatttttattttggtcgtgtctccatctgactctatttgaataatttgaaattcaaagtttgagaacttcaaatagaattttttattagtgaacgacttcagctgaaaaagtcatcaacaacaaagttgtataaaattatttgaatgtcaaattatgacaacttcaaacaacattttcaaatactaaatgatttcaactgaaaaagtcatcaacaacgaaattgtataactcatcaagatatacaacttttgttttggtcgttttgctatatgactttgtttcaataatttgaatttgaatttcaaattatgacgacttcaaacaacattttcaaatactaaatgatttcaactgaaatgtcatcaacaacaaagctgtataactcatcaatatctataacttctattttggtcgtttcttcatccgacaaataacattctc

SEQ ID NO: 82237 - DNA, 2400 bp, Oryza sativa
ttatgcaaatagccacaaccgtcccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgccgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaaagtggtatcagagccaactcgactgtaggttgagccaaacggtcaaacactaaggacaagctttctgaaaaccctatttgaaaaatgtctcccctcgcccttcggcttttctttgccaaacggtttttcaaaattctcctccctgcccctccaattcctttagttgtcaaacctggaggacaaaccgccagcgtcatgcctgttcggaagtcaagtcaagcctcaagcttcgtgcagcaggagcaagaagttcagcccggagtcgtcgttgcgcgaagatcaagaagagttttcccgaagttcacctaaacctaatccttcccggaagagtagttcgttggattctagatcgtgtgttgtttgcttgtgtgtaggggtatggtttgcgtcattggtggggatgcgaccatactaggttgtttgcttaagcaacttgaacaataaaagtgtactcacaacagatcagtaggcaagtggtttagtaccttatctttagcgacccctctcttccacctctcttccgtcctggcagcagatggtcagtgttagagatagggtcaattaaagccacagatcaatggtttagttgaaagctaccaggtactcccaataccagaagaaccccagctcgtgatcagcttttggtatccaggatcagaagatgggtgtattgatgcaggagatgcaaagctcgatgcaaggtcgaatgtagcggaagcaactctagcagtagtgtgttgcagtcagagtcagtggatcagttcaaggcaacaagctaccagctgagtcggagcacctcgctctggtcagatcctggctagctgagatctaatgatggatgtgtcagatgttgataccgcaaccgtagagtccgaggcagcagatgcaacgacagtgtcaccgacaacaggtacaagctcggatgcaagcctagagtcagaatcagagttaatggcaaggcgtcagcgtcatcacatcaacagctgtatttgcaacacctcaactcctcaagttgtgtcagctccaatgtagagtcggtcagttcagttttgaggaatcaactatgcaactcgacaccgaagtcaggtcagaagaagaacagtcatgccagcagttggtacttatgggaaagttagtcaagggtcagtgtgttcatgagctaaatgagagtcacttttatgtggaatttcctatcatcaactaagggttaagttccaaatcttgtcgggatgaaagtgcatcgccattgcttcaatttgatggaccgatgaagttttagtcttcaaagtcagggcatctgtaaatccgagaaatgttggttatttttcaaggacaacagttcaaaggttctcagtcaggcgaaagtaagactacccacggtaaggggggggggggtaggtctctgagatgagttttggcttacctcgtcgccgtttcagtcgaaggatcgacgaggtgaaacaaagtggttagtagttaaaggagtcagttgcgagccactagcaaagttaccccaatctcaagtcaacaggttcgattcgaaggtacacccgtgaggccgggtcaacagttcagcttagagaagtagcatcgaggacggttgcagttcagacgaaagacaggtcaagcaggtttcctggaattacgtggcactcgagtcagaacccgttcaagcggacgtaggatcaatgagtttcaaaggtcagatgtaagtttcaggagcatccgtagttctggcctgggtcagttcaagcaaaacgagtcggtccagttttggcaaagcaaaggaacagaatggtcaatgccggtcagttcagtcgagcaggtttggaccattgaggaatcgttcagttgaatcagaaaggaacagtgcagtgtgcaaatcagtcagaccgcccgccagctccagctttctttccagccatcccagaatctcgggacgagattcctgtaaggggggtagatttgtaacgccccgattttcgttcgggattaaaaaa

SEQ ID NO: 82238 - DNA, 2136 bp, Oryza sativa
gagccagctcatggcggcgaacacgtcgccggggaccgggccggagaacgcgttccgggacaggtacagcgcgcgaagactgcgcacggcggcgaggctcgccggcagcgggccggagaagttgttgcggatgaggttgatggagtgcaaccccggtagccgcgacagcgccgcgaagtcgaagtcgccggagaggttgaggcgggcgaggcggaggccgatgaggacgccattgtagcactgcacccttggccaccggtgtgtttcatcgcacggcggcgacggcgacgacggcgaccacgcctctagcgcgttcgtcgggtcgatcagcgacgccttgagccggaggagcgccgccgcctcggtatcgggcgcggcggcggtatcgggcgcggcggcgccatcgggatcgacggcgatggcgccggcggcgaggaggaggaagagagtggagaggcggaaggcgaggaggagggtgaccatgaccaaattggtggaaggtcacagcctttcctctacctttcttccagcttctctaatgttttcctgcctttctttgggggctttgcctccttgtgccttttgtcaatggcttcttctgctccagtggttaggcaggcagatttgggagctaaaaataggataatgcagctgagacaacaaggtgatcaatggagatgatgcaatgcaatgcaatgcaatgcagctacaggtaatgcaatggcagattcttcacagcagacgtgcaaatggtgcaaatgcaaaatatgcaatggattaggctggattaacaggatttgcttactgcctgtttctctctcactgggaaaaaaaatgagggaggtgatgtggcagttgtcctgtaaatacacactaaaaatagtcagggtagcaaattaggcaaagattaaaattagtaaacggaaacagcttcctgctccttgtttctggagtgcaaaccatgagggcgatcaaaagcagggtgttctgaatatgagatgtgtcacactgcttgagactggaaatagagtcagaaatgtcacaacttcaccagaagtgctgaatcaccatgttacattgaagagtattacttaactacaggtaacctttgtccgtatacagcatcataattttttttgtactgcaaaagaagccatgtatgattttccttttttatgtatctccaaagcacagaaagacaatgaacaaggttaaaattagtaaactgaaacagcttcctgttccttgtttctggtgttgcaaaccatgagggcgatcaaaagcagggtgttctgaacatgagatggtgttctgaatatagatgtgtcacactgcttgagcctggaaatagcatcagaaatgtcacaacttcaccaggagtgctgaatcaccatgttacattgaagagtattactcctacttaactacaggtaatctttgtctgtatacagcatcattactttttttgtactgcaaaagaagccatgtatgattttccttttttatgtatctccaaagcacagaaagacaatgaacaactacaaagtacaaacactatggccaatctcctaactaggacaaaatttgcaacattcaaacctacatttgtctatgtacacggactagcaagcaatcattcaacactcagcctgggtcaccttgaatactgaacatagtgcacatatctgctatagacattcttgtcttgaaaacttgaaaatctcagctatgagctccaagggaagacccttcgtctctggaactcttaagtagacgaacacgagaaccaagcagcacacgaatgcataaatcgcacatgccccactgagcccaatggtacttagcatcaccgggaagcagtaaattgaaagtagtctgccaaaccagaaggcaagtgagcaaaaacttgcacatgttgcacgggcccttgttgggaacatctcggagcagagaatattgggtattggccccagaccgatgacatatgagcagaagcaaatggttaatgagagctggaagaggatttcatgtggcaaagatcccatcttcacgatgttggacaaagatatggcaccaactgataatgttaggaaggggatactgaccaggagaagaaccctgcataaatgtacattg

SEQ ID NO: 82239 - DNA, 739 bp, Oryza sativa
atacagaatttgttgaagttcttgccttcaggtaaccgctggaccacctttcttatttttatttaattttatccatgtccaaagatctaaagaaactagtaaaagttatagttatgccaacttacctattagtatgtttttatgtggcacctagctggctagctttgttgtctcatttgcccataccagctactttccagataacaggaagacctgttaattaactccataacgtactgttagagagattacttaaggaaacaactggatatgttatgaattagtaatatccatcgacacccgtcttgcctgttttggtctcctcacctttgatggtgtttcacttagtatggtttcaacttccaactgccagtccattattttgcatttccattaactatgcagttttacaccattccttcattcttctaatttattgtaattatttcaattgtttttacctgtacagtttgagttaaatctctctcatatggatcaattaccaatgtgcaggcagagccacaaagctttttttgataaatcggatctgttttttgtttgcatattacggccactttcctttgatattaccaagcaagattcagaaatcgaggcagctcaggtatttggaacctctattctagcaccaaactgacctatcagagaagggtcatttgttgccagtttcttattcaacctttgaactactttcatgtaaatgccctgttaacatacttct

SEQ ID NO: 82240 - DNA, 2691 bp, Oryza sativa
agattttgtgatgtatttgagtatttgagatgatcgattgtggatttggaggcaatttgaggatgattgatttgggattttggggacgggatggggtgaaatcaatatatattaaaaacaatgaagaaaaaaaaataataaagagcaaccggatctagtctttttagtcccggttgtatctttagtcccagttggtaacaccaaccggatttttactcccggttttttcacccgggactaaagatagcgatctttagtcccggattcgtagtcccggttgaaaaaccccttctccaccagtgtatggacatacgatttgaaactaagtactttaaaagttatggatggttatagtattaaggctgcgttctttgttaggagttcccaactccccaccatcgtttttcgcgcgtacgcttttcaaactactaaacggtgctttttttttgcaaaaagtttctatacgaaagttgctaaaaaaatcatattgatccatttttttttagaaaaaagctacttcctccatttaacatatatatatatatatatatatatataataagtcgtttcagccttgtgcgaaatgataaacaaataaataaaaatgttttttttgcaacttcctctaaattgttttactagggaaaaaccgtttgtataaacaaaggtagtatttagtagttaaaaaccaactagtaaggaaattttaaaaattatgcggatatctgaaacaacttatatttaattagcaaagaatgaaaataacagattgtattttgcaactggctggagaaactgtgtggagagctagtttccaccgccaaaacaataaaaaatatcattgtatgttgggtttacgattacgacaggctcttctgtttcgggcaccggcgaaattcggaatttcgtgaaatccggtaaaaaaccggtaaattccgaacaaatttcataaaccaaaatttgaatacaaatccctgagtttgtcgacaagttcttgaaaaccggtcggttttagcgaaattctgatcgaaatcatcgaaatttcgatcggtaatttgtctctttttttaattatttattcttttctttcttgatgtaagtttcaataaatacacacaatacatcatttttttcaaaaatttatatcccaattggttatatgaatatcatagtatttataagatttttttgatttttttctttttttatcaattcaaattgaatttggatgaaactcctcgaaatctcaaacggtttatactttcgagcctcatcgaaacgtcgaaatttcacgaaatcggactagattttgtcagaatcgtaaaccctgattgtatgtatctatactttgtatagttgatacccactagtatgtcatctcatcatccactagcaattaacatcttaaatttcacacaagcaagacacatcttctccccacattattttcataacatttcaacattcatcatttgtacaattttcacatatacccatccactaattccacgataaaacatggggtgtcacgtttgttgcaggcgtggtccaagctatcgtctccagaccgaaacacgtgaatgttgacgttatcgatactcctcatctactcactgagccatgatgtttcaacttaaaattgccaactactcaactttatcgaattgaaatttctaccaaaatttgttgcatcggatccacctctgtaaaaactgtgaaaagtttgaaactaaattaattatgagttcctcatgacaataggcgaggaagttatacgcgacatgcatgcaattttaataatcaactcatgttacgctatacagaacattgattttttttccttgctcttgaacttcgtgatgaactccattctatctctccaatgaaaaatgtgagctctgcctaaatgtctagttattgagcatgcaaattaagtttatatatctttttctttttaccgatttttacatgaacagtttactctcgccacgtaatactccctccgtccctaaatattatactgttgaccttttttaaacatatttgatcatttatcttattcaagaactttgtgaaatatataaaactatatatatatatatatatatatataaaagtatatttaaccatgaatcaaatgatagaaaaataattagtaattacttaaatttttttaataggacgaacggttattaaaaaaaatcttcccagttcccatccaatccaatccacctcccatttcccatccagtataatcaaatcaaatccaattcacagaaacatcacaaattcgcataacaaaacaaatccatagcaacacgacattccttgtcgctgtcaccaatggccgtcgttggtgaaactagcagtcaccgccgccatgccgagaaggatggttgccgtagccgagccacattcaccctcccctttgtcgcctctactggcctcctcccctcggaggatctgggaaagggaggggagagaaagggaagaggggagagtggagccgccacgtcatcccctcctcattctaccacgtgccgctgccaccgccaccctccttttacgacgcctgtcgccacaaacgttgatctcctccactctaaccaaatctaggagaccgatgggaggggactggagcctctgctatcgcccctccttctccctaccgttgaacgatgcaagacacca

SEQ ID NO: 82241 - DNA, 18542 bp, Oryza sativa
aatgccatagtagtgcccagatgtgggttatgaactcccctcctgactcgaggcattttttatgtgctgatgcattccaactaggggcgaggtgtataagtaattctgtccataccccagataggatctcccaacagtcttcatctcctctttcatcagtttatcagccaattttgccccttgtcgcagaacatcttcatttatgttttcttccccaacattttgggtattgttcttttctttaggcatcaatttatcatacctttcctgtagagactcacagcctttaagaatatcatcgtgagcaagtgtcacggcttcttgaaaaatcatattgggcacaaaaaagctgtcagggatcaggtcaggctttgaaaccagtagatatgcacagtatcgcgacaagctattcgcgatgatatatctttcctgcagcttaccgggcaatttcttttcatccataagatacaagctggaactgaagcaatttgtgaagcacgataatagatagcacaaaaatcctggtttgcttaaatcaacaccttcgtttttagcaagcttaatctcacagatgctggtagctatgtgccacacaagaatagtgtgggtgcatgtctgaagctcagagcatgcccatcggtaacttttccttttatcatcaagcagtgagataaccaccttgggcagatggccggccgtaaggtctatagagttgagtttctccaggatggcatgtttgacacattctggaatatcaatggggttgctgagttttgccccattgtccttctttggaaccattcctgtagatatcttgtgaatcagattccaaattctgggtctgtcgtcatatgactccaggaagacatattgatcgatttgtccatgccacctgttagcaataatgttagatttgaagaaggataatattaggttctccatgcagcggtttctggtacgctcatcatcccatcgcgcatacatgcacacaaggagtaatcttgtccaatctgacagtaagtaagtaaccatctcccagatctccttgaacagcatgaacaacatgaatacccatgtgatgatcatgtccacattgacaccctgcttcagatgaaccagctcaccctccgggggcttatagaccttacggatgtcaatggaaagccagcatataacacaaaatgtcaccatggatgcaagcaagctccaggagagcgaagttagaccagaccagaagaccataggatagcgggtgttgaagtaatcattgaggaaggccagctactgctccatgatcccaaaggcatgattggcatccttctcttcaatgattctcctcttgactagatttatatttatgcgaaaggtgcccctttgcagcttcacatcctcaagcctgcaacggagtagcctggacaatgcgaaggcgagggacagatccttttggtccttgccttgaatgatgttccctgaattgttggggctgggaatgttgtcacaggagcatagcaggtgcctgtgacatccccaaatcttatctagtgtgatcaaagatgatcttgtaattgtcttggacccgctagtagcgtggtggttgcctcgctcgctgcttctgcttcttcttctttgttgactggtagcttccaaatcatcttctttttgtaaggaggtagatctattcttgatattcaggacataccgaggtttctgtaacttgaccctttctccatagactaagtacttgaagccttccattgtctttgggttgcattcctcaggtttccagttgttagcttcacgcatgtactctgaaacgagctctgaactcctgccatgccagttggaattgatggccagagtacgtgaatggaatctgtaccagctcctcagcatctggagagcccaaagacaccagagtggtagcccaaatttggagccacgcgacaaattcaagaatgctgatccaagaagcttcaccacattcctccactctgtgaaccttcgccctcgacggtcaggaacaccataaccagagatgaagtcgacactgtaccgaaaattgacaagcacaagggcccagacgggaaacagttgattcttgaaaggtgcagttttcatagctcccagcaggtatatgactatggagtcagagacagcatcgaggatggtaaagatggctttcatggtcgcattgtggatgtggcgacgaaaaatgtccatgatgaacatcacaaggaacaacaccgtgaccagtaccaccaggaactcaatccgaaacaggatatacttcttctggttcagcatgacaaacagcgatgacagcagatcacggatctcatggaggccaatcatttttctttgctcgcttctttgtatgctggcccttaagtcagaccctgcaaggccacttaattggatgttttaaacataaattttagtaaaaagtaaattggcacagttcttcatactcttaagtgcggttcgttcaaaaaaaatatttttattggatgtttacaattcattggattttattttttatttttcaccaggaagtagcagttcaaagcataaacgaagcagaataaagagattacaatagtggtaaattttcctgagtggccacaaaagagaaggtcgttcacaaaagcgaggggatggatttgggacagaagaaggagataggacaggcatttgggttgcaccctctttgttcatccgacaatcgccaacaccttttggagctcaaggatgtcatggtcattgagacaacaggcgatcgaaatatcctcaagagcttcaggggtggttttggagttgaaatccgggagctttgtgtttggtaattgcttcattgagcttcgtggaacattggcaagctactccttcagtttcttcacctttaaggccttaacttcaatcgagaggaaggaagcagtttccttgttagccaaccgctcactcttgtgtcgtttgttttctctatccaaagttcttttcttctagcgagtgatcttcctcgcggagagctcatgttcagcctccataccgctgcagtcaaaatccggcgagtcatgctaatcctgagagtgctgctccaaactatctgccgatgagacagggacagtctagtcctgaggagcaggcggagacacctgggaaggcacaacaatttcgtccatctcggcaatagacggccaggcttgaactgcaggttagatcgcgagctgaaggccatcaccttctccaccaccgtggttgttgtgttggcgccgatgccatgttcgctgctgggccaggcggccagcaaggggcgagggatcccccggggcttgctgaaactgaaaggatgggaagtgacgcacgcacaacccgtcttcgtcaatattcccagcaaggtcccaagtcgcaatcactctgaccttagcgatgcaaacgcttccatcttggaagcggactaagaggtagggacggaaaacctttccaagttgatgctataaaaccaagcggagggaggattgatcatatctaaagaaacattcatcatcaatttcactcacaaagcccatacgaatcagggttgttccgattctaccagggaacagaagttctggagggaaatctgtgatgtccagctcggtgagttttgtcagatcctgaacaaatctggctttactgtcttcatatcgctccaagacaagaatgtggtccccagagtcaagcatttcctgatgctggatggcaatctcgcggtgagctcagagggtgaaacagagggacatagtactacgggaggaagcatgcatactaaagtgaaggtttggcatgtgctccctcatgagatctctgatagcagcagctagattggggcagacaagcgttagataggtagctgcaaagtgccccaccagcctgttgtcagtgaaggggacaaacatatcctggtagtcatcaggctgtaggtaaacaagctgaactgctggaggttgggggctgttcggagtgtcgtcagtgtcaccagaagcatattcttcaaacatatcactgttgtccgctgtagcatcctgagctggggacctcaggggggggggggggggggagcttcattgggtaggacagcaggctcactctcaggggcagccacaggagggacctggaatgctcatgcgcaggtggcgaagcaaaactagcagagagcaggcgatcttcacaaacaaaagtatccctggctggatctggaacagtgaaaggggccttggaggtggattgaccttccggaagcggccgagcaccgacaatgtaccacaccttgttctttggttggccggaaacgatgtgctataccgatggagcttggggtgaccagatggggagttcacccgggacgagatgtcgagggcggcgaccactgcggccactattgcagccacggccacgctagcagggatggccggagtgggcgcagcagcaactccagaagtggtagagatagcaactgaggcgtccccagcgacatcaacagcagcggcaatctcatcgacagcagcagcagcgacgacaatctcatcgagagggcccacgacggggtcgacatcagcagcaactagactaggaggagataccggcaccgcttcttcggtagcaggcagctcatggctgacgtttaggctatcctccagaagagcaatgacatcactcagtggtagaggcgcaaggttagccggtagagagctagggaagggagcttttggaaggcatgggagggctgttagagtttgcaggcgtttcttgacccagcgggtggtgaaggtgggacgagtagcagcggcaacggttggtggggtgggtagtggagtgttagaggctgcagaggagcgtcaagagttctggcgatggccggagcagtggcaggcggcgtgaacaagggggtcacggcattccctagccacatgatcgcggccaaggcagcggaatgaatcaacgcttgaacatcgtggtgcggcggtggagggaagctagggtttttctttgtggagggttttttgggcgagaaagcagcctctagaatgcatgcgtgtaacaccgagctcagccttcgtgtctagctctgagttgttgcgcggaggagtaagtccctgggccgttaagaaatgttcctaacaagacagagctgtgaatgcatgttgtgcttccactggctgcgaaatgttcattgggcggacctgcgttgaacatgcgtttgagccaatgggcaagcttgctcttggaccagtgggcaaaccttaacattgctttggaggaaaccattcaggaagaactgcacattttttgaaatcacgctggctgcagcagatttatctaggtgcatctgaagcatttaagattgaagaactgacgatccagctaagaacatgagaactgccacattgtaacatgcaacccgagtgcataaaatgccagaacccagcgaggaaatagagagaaaatcaggataggagcagaatcagtaattcaagaggttttggattgacaacaagctaaatattttttgattattagaaaggaaggacgagatccagagagtggaagggttaaattgttcgataggatggatggggcgactgaagagttgaaccaaatgagggcctggtcatggaacagctcaccgggccatacctttgattgttgaggccaccggatttctcgccgccggcaaggggagaagctgagccttcagtggggtgtcccccttgcaccctcccatcccccactaccaagtttgcttcatggatgtgtaattttacatgatgtggtacatgatctaagagtaaagaagcaatagggataattctaaaacttgattttgagaaggcttttgacaaagtaagatgggaatttgtttatgaagtgctcaacaggaaaagttccctttaaatggattcaccggatgaagagttgcataaaaggaggcaaagtctgcattaatatcaatggagagaggtcaagctacttcaaaacttataggggcctgagataggggatcctatctcacctctgcttttcaactttgtagtgatgttttggcacagtgtgttgatttagccaagtcaaatgtgtagagaaagtggaatggatgcctctcacaatgtgtgaaggagaattctcatatatatatatatatatatatatatatatatatatatatatatatagctgagttacacttaatgattcataagaccaagagtcatacttaaagctagtggagagttacactaaaagctataagttacataagaccaaaggtcttgaagataaacagcctaaggataaataaataatcctaatacccgcccgcagtcgcagcgggaggatcacgaacgcaaagactggaccgaaaatcagtgaataactgaaccggtaagcctttggtcatgatgtccgcgaactggtgagatgaagggacgtgaagtacccgtacttgtcctaaagccaccttttcacggacaaaatggatgtcaaccttgatatgcttcgtccgacgatgatgcataggattcgctgtcatataaacagcactgacattgtcacagtagacaatagtagccgaagtaatcgggacatgaagttcctggagcaattgccgcagccaacagcactcggcgacagcatgagctacggcacggtactccgccgcagcactgtaacgggagacagtagtctggcgcttggaggaccaagaaaccagattgtcaccaaggaagacacagtagccggacgtagaacgacgagaatcaggacaacccgcccaatccgcatcggagtatgccgtcagggactgaatcatgctggagccgatgtggaggctggtggagagactgcccttcacgtaccggagaatacgcttgaccaaggcgagatggggctcccgtgggtcatgcatgaagaggcagacctgttgaacggcatatgtcaaatccggtcgaatcaacgtgaggtactgtagagtaccagcgatgctcctatactccgaagggtcggcgacgggcaggccgtcggtggcggagagcttggcacgggtgtccactggtgtcgaggtagagtgacactcggccatgccagcccgctgaagaagatccacaacgtactggcgctgtgaaaggaagaggccggcagaggagcgcgtcacggagatgccgaggaagaagtggaggtcaccaaggtctgtcatggcgaactcggagtggaggcgtgccataagctgctgaagtagtgatgtggtcaaagcagtgaggatgatgtcgtcgacgtacaacagaagataggcaatacgatctccacctttgtaaacaaagagagatgtatcggacgtcgaaggtagaaatcccatctatcgaatatacgtggcgaaccgttggtaccatgcacggggagcttgctttagaccatacagggacttctgcaatagacagacaacatcaggggcagcagggtcaacaaacttggagggttgctgacagtacacggtctcctttaggtgaccatgaagaaagacgttcttcacatccagttgatgaatgggccaagcacgggaggcagcgatgctgagaacaacccatattgtggccgacttgacaaccgggctaaatgtctcgtcgtagtcgatgccgtgctgctgcgagtaaccacggaccacccaacgagccttgtgacgggcaagagagccgtcagagtggaacttgtgcttgaatatccacttgcccatcacaatgttggccctaggggggcgaggaacgagacgccaagtgccgttgtcgaccagcgccttgtactcatcagccatggcagcgcgccagttgggatcagccaacgcactgcgatagttggccggaacatgagaggcagtggcgtggtagccgtgtaggtcagccggtcaactggccgtagggagccagtctaggagtgcatcaccatggaatgcagccgaggagcaacagtcgtggcaacaatactaggtgaagatgatgtcgggaccgtcgtggttgcccaacgggtgtagacatggcggaagggtgacacgatggtaccggctcggatggcaccagccgacggagtagtgccgggtgaggaggcaccgaccaagggcgcaccagccgagcaggcgccgcttgccgccgtgacggtgttgttcggcaaatgtcggccgaagaggggaacatacggttgctcaacctccatggagggagccaccgtgagaggtcgcggtttctcaacctccgaggagggagccaccgtgagaggtcacggttgctcaacctccgaggagggagcgaccgctggaggaagtccctgcagcaaaaagtcaaaagacaaggcaacagggggagtcgccgcgaagggaaatcgggtttcgtcaaacacgacgtggcgcgaaatgatgatgcgacgagtggagagatccaaacatcggtatcccttgtgggaggccagatacccaagaaaaacgcaagctgtcgagcgagggacaagcttatgtggagtcgtggcactcatgtttgggtaacaaagacagcaaaaaacccgacggtgagagtagtctggagtggtgcgatgtaggagctgaaaaggcagtgagtggtgaatggaggaggagggtctccggttgagaaggtaggtggcggtggcgagagcctcagcccagtaggacggaggcatagaggcttgtataagaagggtgcgtatggagttgtggatgatgcggagcattcgttcggctttaccgttttgtggggaggtgtaagggcaggagagtcgtagctgggtgccacgactagcaagaaaggtagtggtggtggtattgacaaactctctgccattatcagcctggagagatttgagcggtaagccaaattgggtggaaacatactcggcgaactccacaatatgacgatgaacatcagatttgcatcggagtggaaaggtccaacagaaatgactgaaatcatcaaccaccactaagtaatatttaaaacccgaagtactcaacaccggagaggtccatacatcgcagtgaacaagctcaaagggaatgaaagtgcgagacgaagacctatcaaaaggtaatcgggtatgtttgcctaaccaacacgcatgacatagagaggtgtctattttattacaggaaatggaggacatagtccgaagactctggatggcggctggaccaatatgaccgagacgacggtgccaaagcatggatgaagtggcgagggagtagtgcgcggcgttggagggagtggcacctggaagggtgtagagttcccctcggctattgcagcgaagaatcacgcgtcaggtccgaaggtccttaacagagaaaccaaattcatcaaactcaatggaacatttattgtcgcgggtaaactggcgaactgaaagtaaattacgaactaaggaaggggcgacaatgatgtttttgagtgcaaatttggtggttcctatggggagaaatgaagtgccacgacaagttacggggatagtttgaccatttcctaccgtaataaaagtatgagagttaggcaagcgagtaacgaggataccatcggtggaggacatatgagatgtcgcgcctgtatccaaaacccagttgtttgggctttgaagagccatcttgttcagggctgcaatgaggctagcttgctcccagttgggctggcttgtagcagcagatgtgggcgacgtaaatggcccagcaaaagtggtgttggcctgggagtagtgggccgtcggagccggcccaagaaggccgaccaaagaggggcgccaggccggttgctgggccggccaggggttaaagcagacccaaggcccgtccggcctccagccagggttcacccagccggggccactcccaccagcagagaaaccaccgccgccaccagaggaaacgccgccgccagaaaaatgtcgagcgccaccaccacttccaccgccgccaccccccactgccgccccctatccagccgccattccctcctccgtttccacctccgcgtccgccgttttaccttgtggttgcggcggttggtgttgctgccggcgcgggcttggccaccagggaagccgccaccaccagcccctccgccagagaaggactggcgtgcgccgccaccactcccactgccgccacccccaccgccagaggagccgaagccgccgggagggcaggagccgaagctgctgccagccatcagcgtcgtggctgcctccaccttggcttcattggcgaggcacaactcctttagcatgagtgtgttgcacgctgaggtgaagctcgggaggacagccgcatttgcgatgttctcgccggtgttggagaagcgctcgttcaggcctcggagaaggttgagcacgagttgggattcggtgacggcgtggccgacgtcgcgcagggcgtcagcagcggtcttcatctcctggcagtaatcgtcgatggaggagtcaccttgaatcatggagtgaaattggtggctgaggaagatcgctcgaggctctttgttggcgtgaaacatgtccgtgatggtgacccagagctcccgagcggtctgatccggctccatggcgaggtcaaggatgttgtcagcgactgatccgaagatccagctgcggatgcagcagtcggcctgttcccaggccgggttattggggcgtggaggagcggagccatcgatgtgagccatcaacccgaacttgccacacaaggaggtaaagaaggccctccatttgttgtagtttgggtgggtgttttctagggtgatgggaacatgggatttgacggcgaccgtggcataggggtggaggaattcgctggtggtgctggaagaagaagaaccactagaggcggaggaggtggaggactgagttgattcagccgacatggccggagtgagggaggacgcagctgcgacagcagcgcgctggagcagcagaaaagaaggtaagagcctaggctctgataccatgtagaggaagtggaatggatgcctctcacaatgtgtggaggagaattctcatatatatatagctgagttacacttaatgattcataagaccaagagtcatacttaaagctagtggagagttacactaaaagctataagttacataagaccaaaggtcttgaagataaacagcctaaggattaataaataatcctaataaaatggtttactatctggggtagttcctcatctgttctcagggggtttgacccacctccaatatgttgatgatacaatcatatttattccctgtgttgacagagagataattgttactaagttcattctttactgctttgaagaaatgttagggttgaacattaactatgacaagagtgaagtgtctgctgtaggtttagaggtggatagagttgctaatatgcttaattgtcatgtaagatctttccccatgaaatatttgggcttacccatctgccctgataaggtgctaatatctgaccttatgttcttaccgcaaaaattagaggagattgggagtttggaagtctaacccctcttctggaggtagggatattctaatcaactcttgcttatctgcaattcattcctacacaatgggcttctatctgttacctaaaggtatccaccttaagatgtataaaattatgagcaggttttactgggctggtgtgggtagaaaaagaaaataccacatgatgagatgggaacatctgtgctctcctaaagagtttgggagattgggcttcacagagacaagaagttttaacattgttttgcttggaaaatggatctggaagttaagagtcaggtgataagggtccttgcatagagctgttgcgaaagaaatatctgggtgagaaaggttttttccaatatgagcagaaggggggttctcaggtttggaaaagcctacactcaattaaagagttgggtgaaacaaaactgtcaattgattgtaggtatgggttctcacattgaattctggtctgatgtctgctctgagtcttgccctctgaaaataaggtttaataacttgtgggagtgaaagagaagacgagttttggcttttgttagttcgaacttggtggttgacacaggtagcagaccaactgtaggagaagcttctgatagaagtgatattgcctagactgcaggagaaggtctactataaatatagttgctaacttccctgcgaattaaggctgtgttcctttggaggggttgggagtctctcccctccgcacggaaaatggagcaattaagattaacacataattaattaagtattatctataaaaaacttgaaaaatgattaatatgatttttaaagcaactttcctatataaattgtttgcaaaacgtgtaccgtttaacagtttgaaaacgtgcacgcgaaaaacgagatagatgagttgggaacttagagcaagtttaatagtatagtcaactaccggctctaattcatttatagccaatctaatagttcatccatacaatagttacatactacactattaatacctggtcccacatgtcatatacacacttcgtcttggagttcgtgctacagctggctacaaatctgtagcccgctgcttctctctcttatttatcttcttaaaatatatttgtaactggcttatagtctgctattgtacctgctcttatgggaaagaattgcatcaggttcccaacctcctctccctcgttttccacacgcatgcttttcaaactgctaaacggtgcgtttttttgctaaaagtttctatacgaaagttgcttaaaaaaatcaaataatctatttttttaaaaaaatagctaatacttaattaatcacgtgctaatggaccgttccgtttcccgtgcagaggagataggttacccaccccaacaatctaacacagcaagttgtgtggagaacgagagaggcggcagggagggagggagagatgtctctgtttgtagagatgacagcaagatcaatcttctctttcatgaaaaggctctttaagatggacacgatcactggtatggcgagcgtggagctgtggatgttgatgatagaccgacctcatttctctcctgatggtgcactagcaggaaaaggattggcaagcagttgcagcgaggcttcgacaccatcgtcacacttgctacctggtcaccttggaaggagaggagcactataggtctataggagtcttcaaccatgagttgtcaaactttgcactaggatcacccaggttagatctagtcgggtggtcctatttggatttgatgtacgacattgtagatgaaagggagagggtttagataccgaccggttgaggagttcgtggaggaagaggcgccggacatcgtcgttgtcatcgcggcttgacgtggacggcagcgacagtgtgcttgatggtggcggttgtcgttgcagcggtggttgtgggcgatcccggcgaggtcgtggcccggcggtggtgtttcccgtcactggctgcgccccctcgatcggattagggttttgtggggtggagttggcggcggcggtgaacttcgtaccttgtgccgtgccggcctccacccctcttttatatggcgcagtgtgacgggggcccaccagccattgggctgggcgccctcgatcagggcgcggtcaaggccccttgagccgttgggctcaaggggagggagatctatctaacattctcccccttgatctcactttttcttttagctttttctattccatcacagatttgtaaatagagcatgcttcatcgtcacggtcaatcaccgatggattcgacagccactatacacatctctattcagaaacagatactttacttttgggccctgtagtccaggattcataaggcttcccttaaacccatgccggctacatgttccttgaacacgttgggtggtaggccttttgtgagcggatccgcgagcatcctttctgttttaatgtgctcgagactgattgtttgatcccggactttgtccttcacaacatagtactttatgtcaatgtgtttggcagcaccacttgactgattgttgtgagcgtacattactgcgggttcgttgtcgcagtataacttcagtggtttctcaatactgtcaatcacctttaaaccgggtatgaacttctttagctagttcacctgccccgttgcctcatagcatgctataaactcagcatacatagtagaccctgcagtgatagtctgttttgagcttttccatgaaatagctcctcctgccagggtaaacacgtatcccgatgttgactttgtattatcttttgcaaagtcagaatctgaataccccactatctggagtgattctgatcttctgtaagacagcatgaggccttttgttccttgcaaataacgcaagactttctttaccaatttccagtgctctaggcctggattactttgaaatctgccaagtaacccggtaacaaatgccaagtcaggtcgtgtgcacacttgcgcatactgtaggcttcctacagctgacgcatatggctttgttttcatttcattgagctcatactgatttctgggacattgcgatgccccatacttttcgcctttcactataggagcaggtgtagcactgcatctgtacatgttgaatttcttcaacaccttttctatatatgtcttttgagaaagtcccaatgcatactttgttctatctcggtgaatctctatgcccaaaacatatgaagcttcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttaaacggcatcccatattttcgtttcctttcatgacaaaacctttcggttgcaccatgtatactatttcctccaaatctccatttagaaatgccgtttttacatccatctgatgtaattccaaatcataatgtgccactagtgccattaaatcctgaaggaatctttacacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcttttaggaatttcttctaaatcccaaacattgtttagtttcattgatttcatttcatctttcatggcttccaaccattcagatgagcgagcgcttctcatggcctcttcatatgaggtgggatcatcctccatatgcgactcttctatattataaattttatagtcatcacggatagccgatcttctgactctttcagaccttctaggagcctgcatatttggcacatcctgtacctgaggctcttgttgagtctcctgtactggcacattatctatttgtggctgttgcagctcctcctctggtgtggcaaccatttctgttgaatcctgtataacaggttcctcactctcattgttgccacaggaggggtaacaacagatgctggtacctcaatgacaggcattgcaggcacaacatcagcaggtaaacaaaagaaaggttcctgagtcgatggagcgggtacagacaccgcctctcctcaagatcaatttctcaaactaccgagctccccctaatcatttcgtcttccaagaagacggcatgtctcatttctacaaactttgtataactgtttggacagtagaaacgatagccttttgatctttcaggatagccaataaaatggcagccgactgtcttgggatccaacttcccaatatttgggttaaatactttggcctctgcagaactcccccacacacggaggtgagctagcgagggtactcttcctgtccatagctcatacggtgttttgggcaccgatttgcttggaattctgttgagaatatgaatggtggtttttaacgcctccatccataaacccagtggtagtgtggagtagctcatcatgctgcgcaccatatccataagggtacggttacgccttttagctaccccattctgttgaggttcgcccggtgttgaatactgggctactattccattctctaacaagaaccttgcaaaaggtccagggacttgcccataaggtgtatgtcgaccatagtactcccccccacggtcagatcttactactttaatctttatatcatgctgattttcaacttcagctttgaatatcttaaatttatccaatgcttctgatcgctctttaattggataaatataacaatagcgggagtaatcatctgtgaatgttatgaacgagtcatagccatccacacttttcacaggaaatggaccacaaatatctgtatgaatgatctctaaaattcttgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacggtgccataatttcgatgagacatcgggagttcgctttcttttcttgttttcttttgtcaacgaggacacaacattcacattctcagaaagagataacaaataaaactcgtctcgcaacacagcaagaccaatacatgcattattatgccatagttcacatttgccacttccaaagcggcaatcatatccatcaaaatccaactttgatacacttattaagtttctttgcaaagaaggaacataaaagacatctcgaagtaaaagcatgaagccattcgcgagctctagaggaagatctccaacagcttcaactttttcttcaactccattggcgactctaatggagctttctcttctttgcgtagtcctcgtcgaacggaatgcctttaaacaattacaagcatgaatagttgctccagaatcaatccaccatgtggatctagagtaaccaacataataagattcatttacaaatgtaataatgttctcacctttccttgccatgatcattttcaaaaaatcaggacaatctttcttgtagtgtcctgtcttcttgcaatggagacactgatctttctcaacagcgaactgttgttgctgaggcagatgctgagattgtttagcttttgaggcgggagacttgtggttctttttcttatctttaacatagtttattgaaccaccatttgatcctttgattctctcctcctcttgcacacaattagcaatgagcttctcaaagttctatttctctggacttatgttgtagttgacaataaaattgtcaaactgctttggcaatgaggccataactagatggaccagaaagtcatctgttatgcctaaatccattggcttcaacttggaagccatgttgctcattctaagtatgtgatctctaacaccacctccatggtacctttctgtcacaagctgcttgatcagctgtgtagcatacgtctttgaagagccagtaaactgactctttattttttcaaggtactctgagacagcgtcacactctgggattgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaagttcagcaggttctataggacatggggtagtcaacacacaatccacctctcccaagataaaagcaaggtcaagttttcttttccattatgcgtagttatctccttttagcgtcggaatatctttaatacaaaccatcaaggagtagccacttgaaataatcatgtgcggtgagaacaaaattaacattaaaatattatgcattaagcctacatcaccgttgggcagaattagacataacacatataaccataactataatattgcattaacaacgttggttagaaaattacaacatcatagcacataattaatgttcctaaaattaaattctcccgttggttcgaaatttaattttagaaacactaattttcatcaattacatctatttgcagcggaaaactatgtaaaaatcatatgaacagtagcaaaatctatgtaattctctctctgtgaaaattctcccattggttcaaatttaaacagaggtaaaacatgcaaaatcaatttaaaattctaatgtaatttgcatgaaaattatacaaaataaaatggaaaaattgctactgttctcttttctttattttcggcccccgagggacctcttctgaact

SEQ ID NO: 82242 - DNA, 2523 bp, Oryza sativa
ccactacttttgcgattttccataaaaataatattaattctcaaaaaaattcgaagacgaaggggaatggataagtcaatcgttatcctcctatttcgtctccacggaatactgtaaagtagtttttctgttacaactactaatccaatattgaaatctagcagctacagtgtatacactaagtatcccgcaataacgtgttggggtgtcatctagttagcattaggatccactgctcctttggtctagattgcctgtgcgtcagatccagtagataactgcaccgagatccacattacaacgcgattcagtcatgcatgctgctgagaacggtgcacacgtacggcaggaccagaaacagcgttctggtcatccacatgcatgcaatgcatggtttatcactctgttttttaaagtgcaaaatagcatgggagtgtcctactggctacagtgcgcatatattgttggtgtggaaatgcagaaatttgagttgcacgttagtggcttcattccctcgtgcattagttttttcacatggtcttcaatattatatgttgattattaaactttttctttatatattaacaactaattaagaaactaatatcatacgaaaatatttttgcaaatacaattacagtgattatatgcatgacattaaaaatatacttcctatattccaaaatataagtctaaatatttatttaggatgttcaattttgaattttgaccaactactaatccaataatatttactatctatattaaaaaatacatgcaactaaatggaggaaggttgtaatttgttgagaataaaatgtaggtgaagaagtttaaatatttttgataaatatattgtttattttttatggttcgagcgtgaaatagtgtaaaacaaatttgtgccaaagcttttttttgacagtcaacatatacactaatcttgcctagcggtgcggatctagtccgccctgccaccggcacaacatttcttaacctatgcttcttgtcgccccctgtccagctatgaacatggagagggaggattaggggagccggctcggctcggctccgctcgctttagctcgttaggataacgagctggctcagcttggctcgttatcctaacgagctagaagcccagctcggctcagctcgtttgaaagctcgagctagctcgttaggctcgcaagctagagctagtatgcaacagagaagtagagaacgcagcagcaagatgaaatggctccaaaattatctgagaaattatcaaaagatataagaaaaagtctacaatctcccatcaagaaactctaacacaacaacaccgaaatctttcaccgcgaaaagcaaaatcagaaaagcctcctactgtgacagagaagtagagagcagaaagcatcctttcgtttcttcatgcttcatcatccatggtcatgactgacaaggatgcatggccgatggcaacacaggatggagacagggagcagcgctggtgcggcatggagcggcgccggtgcggtagggcgtggcgagggatggacgcaggggagtagcagcgcggaggcgtggaggcgcggaggcgtggaggcgcggagcagccgacggctactcgatctggtgcaggaagcggcgccggtgcggcagggcgtggcgagggatggacgcagggagtagcagcgcggaggcgcgaaggctcagagcggccgacggcgactcgatctggattggagtttggagatagatgagaggaaggggaagcgatacttttctgttcggtagacgcatgcacgggggactaatgtacttggcctgtcatggggatttatatctatgtgtaagctcgttaaggctcgcgagctgctcgcgagccagctcgaactagctcgttatgcctaatgagctgaaactacagctcggctcgtttcaaaaccgtaacgcgccgagtcgattcgagccgagctcgtcacgagccgagcgagctaacgagccacgagcttttcgtccagccctagggaggatctagcccacactcagccatacaacccactgttgccaccagctgttacaaaactctcggtcttgccactagcacgcctacctgctgttgcgctgagtgccattgccataactggttgcgaaagcaggaaaggaggatctctaccccgcacgtacagctcgtccgccgatgcctcgtattgcacctccaccacatgacaccgtcaagcagctcaccattcttcccttgcgagccagcgcgcgacagcaaccaacccgccaccgcactagcccatggcaccaccacagaactcgtcggcactcctagagtgtgccactaaagccaggccgtcgacgagccgaccaagcactgccgccactgcgctccacaaatggagaggagaagagggactttcaacctggatttttcacattttggtccttttaaaaaacttatttcgtaaatagatccctaaaaaaaacttatcacagaaatggtcctttttggagcgccagagtggctgg

SEQ ID NO: 82243 - DNA, 1129 bp, Oryza sativa
gccgtgtatttggcctcctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggta

SEQ ID NO: 82244 - DNA, 3069 bp, Oryza sativa
ctccaacatttccatacgggtttggataaggagtctgcattctatttggacatagccgctggaggatcattcatgcacaaatgccgtcagaaggaagaataattttggatcgcgtcctagaaaatacttccttcatgacgcaacccaataaaccccagccggaggtatcgtgtccaagattgaggaacctctaacgatcgagccactcgctgaaccatccacttatgctagctcgattgatgagaaggttcctgagcagccgtccgtcgagaatgaagaaattcagactccggattgtgccgcaattctgctcagggactgttttgatgaagactacggcaataccctgaactattttagcaagaggaaaccacccattcctttgtcacctcccgatcctatggaactcgggctcctacgagaaactgtccgggagttgacatccataatgagcgatgaatggctaagggaggcagagctttcatccgaagtaattcggataaataccgctccccgaatcattccttgccatctggaagggaacaacatcggtattctctacagtccaactatcggggccaatctcgtttcggaatcttttgcattcgcttagttaagtggtaaggcagtgaccctgacaaacaaattttttaagcatccaaacggaaatatcattgaaggatttgggattgtacaagatgtgcctatctgctttgaagacagggaggcgatcttggatttccacatctttgaaatccaagactttgatatcctaattggggtacccattgagcaacttctcatcaacacaccctgattagatagcctcaaaataacactgggagggaatgaattctcaattccattctcgcgggcaaggatcaccttgacagaccctctcctcgaaattaagtcagcggaagaggttaccgcagttcctcctcatgagtctcccgaagcccttctggaagatgaggtcccccgacttcatcaaggaagaagtagatcccggtgagactctcgacctgccaatcatggaaccaccacctcgacctccgcttgagcttaaacttctacctccaggcctacgatatgccttcctatacaatgacggagaggcccctgtcataattagtgacaagctctctgaagacgagactcaacgtcttctcaccgtgttagagaagcatcgttctgttcttggctactctctccaagatcttagggggattaatctcgcgctttgcacccatcgtattcctattgaccctgagagtactccctccagggaacctcaatgacggctcaataaagcaatgcgagaggttgtaaagaaagaggtcttgaaactcctccatgccgggattatttatcccgtaccatacagtgagtgggttagcccagtctaggttgtgccaaagaagggaggaatgacggtcgttgcaaatgctcaaaatgaactaattccgcaacgaaccgtaaccgaatggaggatgtgcatcgtttacacgaaacttaacaaggctaaaaaaaggatcatttcccgctacccttcattgatgaaatgttggaacggctggcaaatcattcctttttctgtttccttgataggtattctggatatcatcaaattcctatccatccggaggaccaaagttagactacattcacatgtccatacggcacctatgcaacgctcctgcatctttccaaagatgtatgatgtctattttctcagacatgatcgaagacatcatggaagtcttcatggatgacttctcagtttatggaaagactttcggtcattgtttgcagaatctagacaaagtcttacaacgatgccaagaaaatgacctggtgcttaattgggaaaagtgccatttcatggtccgtgaagggatagttcttggtcatcgggtgtccgaacgatgaatcgaagttgatcgtgctaaaattgatgttatagatcagcttcctcctcccttgaacatcaaaggaatccacagtttcttgggacatgtcggcttttatagaaggttcatcgaggacttttctacaatcacccgacctctgaccaatctgctcaccaaggatgtgccctttgagttcgatgacgctgtttacacccaaatttagcacctatggacgaaacaggggaaaattgccaaagtttggaaagtgacgggtttccttttcacagagccggtcagaccacaggtgtgtgggtggtctgaccggctagtagggccggtctgaccgcaggtatgtgggcggttagaccgtcagggtccgagtccgagtctgttttcgtcgggtctcgggttttcttgctcgggaaggcatgtttcgtgtttcctttggtttttatcccgagttggacatggagaagggcctgtagagggcaagaccaacccctatttaagagacaaggcaggttcattgtaaaacccccgaatacaatttactttaattgttattttaccatgtttttctattttaccctagtttagtccatctttgtcggtttgcaccctaaactgtccgtcatcgctgcgagagtgcgacacctctttgtaggtttgtcctgaaaaccttccgtttttcccatgagacgggtagttatcctcatatcgatctaaatcggcctagaggctgattttgatctctaaatcggctccgctagctggtttagttgcttttctacaaaacccatcttgatttggccctttggttagattaaggtggttggcaactctatatcaccgtaaggcgtttaggtgttgcgatcgtgcttgtcgacttgtcaaaaaagttgccaacagacgcgtgcctaaaatcttttgaaattctcaaaaaggcactcgtcgctgctcaaaccattcaatcccctgattggactctgcccttcgagattatgtgtgatgcaagtgactttgctgttggagcggtcttgggctaaaccaaagataaaaaacatcatgcaatctgttacgctagcaaaactctaaccggagctcagttgaattatacaactactgaaaaagagctgctcgcggttgtttttgctat

SEQ ID NO: 82245 - DNA, 17563 bp, Oryza sativa
  unsure (1)..(17563): unsure at all n locations
cgccgcctccgcccgcatctcacgccgccgccgacctcgcccatccccgccgctgcagccgccgccgacctcgaccctccccaccgccgctgcaacctccccttccgccgccttcgcccgcatctcgcgccgccgttgacctcgcccctccccgcggcagccgccgccgacctcgccttccgccgccgcaaccgccgccgacctcggccctccccgccgccgctgcaacctcgccttccgccgcctccgcccgcatctcgcgccgccgccgacctcgctcatccccgccttccgccgctgcagccgccgccgccgacctcgccttccgtcgccgcgctctcgcctcttgacctgtggctgtcgctgatgcgcggtgaagcgacccgacctcgggcgctcgccctgctcgcccggccgctcgggcggttgcatccggcatctgcgaggtatattcctctttgggccgcccaatcccacttccgcccaccaaccaaacaggcaaaaaaaaaatgggccgccatctcccgttcacccaaaacctcccaaccaaacacaccccttactactccctccgtccaaaaaaaaattcattcctagcatcctgaggtggaattagtagagagtaagaatgactaaaaaaacccttaattattgaaaaaaatagtaagagtgatagataggtaaagggtattaaagggataaaacttctcgttttgcgtgttgagagtaggtagaatggtagaagtctgttttcagtttccacggcatgcggtcaggtccagcgtttcccaaaccgcagaggacggggttaccgcgccccggcgataagcacggttactgcgcggtaatcgtgaaaaccgtatgaaaccgtgtaaaatttatcaaaaatttgaattattttttaaatttatatgaatttaaggaggttaccgcggtttttctattactgtacctcgcggtaaggccggtaaccacagtaaccgtgcggttgtacctcgcggtaagatcggtaaccgcggtaaccgtgcggtgcggttatgaacggtaagttgaaccctggtcaggtcccatttattcctggtcataaaatggtgcaggcgtattgattggtggggcatcgtgtggattggctgcctgatcagtgactgacactgatggacatcactgtaccattttgccctccaacattagtaaggcccgttccctaaaatgttttccaaaaaatcagatcaaatcgttggatacgtgcatggagcattaaatatagataaaaataaaaactaattgcacagttaggaggaaaatcgcgagacgaatcttttgagactaattagttcatgattagccaaaaagtgctatagtaacccacatgtgttaatgatagattaattaggctcaaaagattcatctcgcggtttcctgatgagttataaaattagttatttttattcgtgcccgaaaactctttccgatatccggttaaacgtccgatgtgacatccaaaaattttcttttagccaactaaacaaggcctattcgttgttaacttgttattccctatgggcctcatttaccttctataaaaatgcaagaagaagtgaagagcagtgaccacctatcctacagtttcaccatggctctcctcattttcgtagcatcgcagcaagttcaaatcagatcgaatctttggatacgttctgccacgacggacaccatctcagctggccaaacgttggccaacgatgacaagcttgtctcaaaaaatgcaaggtacgcactcggcttcttcaacacaggtacaaaagcgtctggaaaaactaacaagtggtactaaagctgtgtttagttccaaagtttggatccaaagtttggatccaaactttagtcctttttcatcatatcaacctgtcatacacacacaacttttcagtcacatcatcttcaatttcaaccaaaatccaaacttcgcgctgaactaaacacagcctaaggaatatggttcaatcaggttgccaaaaaacttctgcatgggttgcaaatagggataagccgattgatgatcccgcatcattggagctaacaatcttccgtaatggaaatcttgccatcttaaaccgctcaaccagtgccgtcctttggactacccaagctaacatcaccacaaacaacaccattgttatgctcttaaatagtggaaatctcatcctaacaaacccctcaagctctttagaagtttttttggaagagctttaactaccccacagatacatttttccctggggcaaagcttggatggaacaagatcactggcctaaaccatcgtattatttttaagaaaaacttagtagacccagctatcggtatgtatcgtgaagagttagaccctactagtgttaatcaggccttgcttgcaccggtgaactccacgccatattgatctagtggagcatggaatggcgagtatttatcctnnnnnnnnnnnnnnnnnnnnnnnnnnnnnnnntaaatatggccatcatcccaataagagtccaaaattatatatcaatagtatcaaaataaaaatcccatatactttttagattaaaaaaatctaacaataattgattaaaatagcctttacctgaacatgcatttttagttaatgagtaataataataataataaataaataaattgttgaactagagaagaaaaataaggaggaggtcggttcacgctgcacctggtccacgaaggaagacctttttgcgtgtcttttgttgggagcagagggtagcacatctaaccgtccagccccagcaacggcgcgatccgcgtctccgactcagtcagatctccgtccgtccgtctgtgtctcttggccgagaccgagagagggttttccccgttctcccaccagtccattgccgctggtggcaatcttcttcttgttgaccaaaccctagctagcagcagcaaccatggcaaaccctaggcctccctatgtgttgctggagagagtagtgtttttcggaggacgcgagttacccgacggcacatggaaagatgccgcaggcatagtcatcggatggagcagagcgcggctgctgagtcggcgagaggcgatggaggcgatggaaccccatcccttcctcgccgatcctccgcaagtgagctccctgcggatgatgtcgccgacgcccgcgcacgcgcagcagctgggatccatccgcgacggcgacatcgccagcacccacaagggcatcgtcgtcatctacgccggcttctaccgaccaggctgctccgatgacctcgggggatgctacctcctctacgacgcccccaccaacgccctcaccgccatccccccgctgcccgactcgcctcgcttccccaccttgctacacctcggccgcaccgccgtcctcgtcgacgcctcccgctctgccgatgattacatcctcgccgatatcgtcaccaactccggcctgggcctccccgaagccaccatcttcgcatggtcatcgctgaccatgaagaagagcggcggcgagtgggtcaagtcctccattccccgcctccctctccctgcacatctatgtggtccaaaacacttgttccagatcgacctcgccttctccctggacagcggccgcatctgctgggttgatctcctacagggcatcttgttctgcgaccgcatcttggcaccggatggccccaagttggggttcattccgttgcccactgggtattgcatcgatgtccatcacaggctccgccatcagatgatgccactagcccggcgttccatggcctgcgtctctggcgccgtcaagtttgtcgccttggttggcttggaagatattcattgcccccccaatgaggtgatgctcaagacatgggttctgtcccctgatttcaaggagtggaaggaggatagcaggtccttatctgtggaagagatgtgggcaagtgagagcttcaagcaaatggggttgccatgtgttgtaccagtttcccctgtcctcagcctgacccaagatggggtaatgtataccattctgaatgtcatcgagcaggtacctgcacaagttgatgaatttgggatcgtcgttgtcgatgatgacctggtgcccattgccaattatatgatccgcttcgacattcggcgaaacaaggtcctgtcctccacaaagatatctcaacatggtgaattgcagtggcttatacccaatctcattgccactgacttcactgcatacctacaggaccaccaggtacttagtttacttgctactgcatgctacttaccctcagcgccacccagtgtacttctagcttcatatcctaactgttttactgttctatacttgtttgttttagacgtaagtgatatgtggacgcttatatttgtcacatcaagttagtttcacttgcacaactaattaaaaaatattgacatcttaatttggccagccatttatgttgaggtattgaacacagtttagtgtgtcatatgtgtgccagcttccctcttccggtcttctcatcaggaaccaatgagcagtacaaggctcatgttgaactttgctagtagtaattttcaaattaagaatcggtatcagcctaagtctattcaatgatttagtagagtgtgcactatgcagaggctcaaatttaaactgaaattttaaaaaaatcagcaacttccgtagcattttgttgttatgtcgacaaaaagtacaatacccttattaattctcacatttgcatttatggcttactgttttgccacaatacttattttaatcgattttttcttactttatagccatacgctatgatgctttcaatgtactattcctatatgggacaagcttaagatatccagtttgcggaatgcttgctaagtttcacttcttcaatacaaacctgagtgaattgtctaattaattacttaattaatgattgtagaggttttgaaatcaatttccgaatgatttgttgacacatggttgatgttgtgttctctttagtgtagaattttttcatagttggtttcacttatccaatacaaacttccttctcttgtcttaaccactgaaaattacctggctcatgttgaactttgatagtagtaattttcaaattaagaattggtatgagctaagtttattcgaagaggcacaaatttatgcagagcctaagcttgggtattagtttgagagtctttttctccaatataaacctgagtgaattatattgcctaatgaatgaatatagggagttcttgaaaacaattaccgaatacattattggtacaagcctaagttgattctaaaagatgcagcatgctgaagtgcaacgtgaatcttaactgatgctggcaacagtagcaacctttgtacatttacctttaactacattgatgccatggccactaacctcattagctacatgccttgaagtactgctgagtgcacactttccctctttttaaatgttcaaagtttattgttcaagcttaatttggggcatatacaacaacgggatcagatttaaaccatactgttttgacagtcatctttatttttgttttggtagagagctgaagaagcaggcaaggtaggagcaagcgccaaggggaagcgcaagcagatggagtactactgaatgatatgtagtatatttctgctatttatcatgcacataacatatcgctttttttagcttacatcctgtgactgtgagatgtaaggtcaaatgtgtttaggttaaccatcagagcttattttgtcactaccagaccttattttaatgactaagcctagcagttaaactgaatggtaaccagtatgtatgtgtaatcatcgtggatttatgtcatactactaatagtgttgggctcttcaaatccaacattgtaccaactcctgagttgaagtttgtgcttgatttcatcatgctttcttggccttaggtttaggggccggtggtgggaacacggccctgaagacccaggcagcaagaacagcaccaacaaaagggcatatccagtagacgtagaattgctcccatgtgttgtggcgattgttcacatatgcccagccaaacgcctatggaaatgtagataatatttaaccaagattagttaccagaaaacaaggaacagtagccaaaaggggcaaatgagaagagccgcaacttacatcagatcttactgaatgtataaatggaatacagtagcatgaattcaaattacaggaacagtttgcgatgcattctaaactctgcaaagatgtcgatttcagaggtatacaaggaatttccactaaattacctaattgaagtggacaggagtgaccaaatagaaattaactgagttaccctctgcagaatataagtataaccaggcactgtttttccatagtttttccccataaacaacaagctaggttttgaaataatgagatcactggcaagggttttatgcttatcgtgtacactccaaccaaaactgtggacgtccaataataatactggctccttcctgatgaaggagatttaaggaaatagtggaactttatgaaaattacacctatttagttgcttcatttgacctgttgcttagtactttgaaacaagggcaaagaaaacataaataaaaagagcttagcctggcagcatgtttggtaaagcaccataaatagatgaacatgtaaaaggggatgggtaatgcatgatcaacatttttattgctcaggttttcagcccaaatgacttgggactccgtttcctactcatcaacaagctaccaaactatcgcgggtgctcctgaattaatcctagctccatgttgtcttgaaaaaccaattgcatagaactagtaagcatcatgccgaattaatcctagctccatgttgtcttgaaaaaccaattgcatagtagtagcatcttatcttgggcatttaactgtttgccactggagtttaattatttatcacttatatctcaatgacgcgtggacctttatacgtataagatatgtagatccaagtgacaaatagttaattgccacatgcaggagtggtaaacagctaaatatcttatcttaccaaacaaaattaaatatcttatccagtgacccagtgatctaaagaaataaacaatacaacagaaaaaaaaaactttttgagaaatcatattattttgaaacgtgaagccaataataatccacgacaaatcatctagctggtgactgagatgatctctgctacaaaggcaacctccatgtcggctccaggagattcagatgccacggacaaatgcatctgccatgcttgggaccgggactaattcagcctgtcaatcaatttggtcccggagaagcaaatgatcaagcttaagctggctaaatgctctcagatcagagctgtatctatggctatcaatgaagctcttcgactggtccagcttttcagaactgttcagacataacagatttagctttcactatttggattagatttcattcagaaaggtagtgattgggttatctgcacttgatctctgaacaatgcataatcagaactggaatctacagcgcgaaaaggccagtagcctagtggttacaagagtctaagtagtatcttaggtcctaagttcaactccctatgagagcgaattttccagaatttaacggctttgtgctttcagtggtaggcgatgtacccgtcgacagcgaggcgccacaaattcgtcaatctccaggatttgccaacctagtcttcgaagatgggcgccacgacttcgtcaatctccaagatttgccggcccagtcttcaaagatgcgggttgggtttacgtgcgtgcatttataggggtgagtgtgtgtgcgttgtgagtgtaactcgtttgcatctaaattagcagaaactttaagcggtggtaaaagggttgaagaataattccagttcagctgtcacatgagtatgctaaaaatcctctaaaaaaaagagtatgctaaaaatgaatagataacttttatttttttaaaaaaaacaaacaaacaaagaacagagtacatgcaagtgtggttcagctcatcagtcaaagaacttatttgttatgtgtgtagttgttcaggagattgctgattcgttcaacaaaaaagtgctcatctctgaagactagattataactgatcaaatcaagtctacatgccgctgccaaatgattgagaattaacgtgcagagagaggccacttgcctgcttgcccacgagtaagcaaagccagcaagtttaaggtatccaaagcagcattagcagcagcagatgatgatgatgatgattcagagatccattgattacagccttctcacatgatcacatgagagaagctagatcacaacctgtgagcacacacttccagcagcacgccttcagaaacattacttaaatgctaatccaaattgcatcctcctcgctggtttgacgacacttcgtcaggattagccggccaaacgccaagattctcaaacctccattaaattagggccttcatacagaacgaccggattggagctttttggaacataagttgaatatatgatatggtatggtatctttacccaagacaagctagcatcgtggatgaaaacataatttgcagattttaaaaaccgcacgaatctttccacttttttttttcacgaaactcttacatataacttccagaaaagaaaatgaaatttgttaaatatgctttgtatttcaatccgtgcctctacttgctagatcaagctagcaactgatcatattggtgcattagttagttgatgaagaaaaaaatatacatagaaaaaagtagcagatagttggaaatgacatggatacttggatccaaagggtatcatgggtggcaccaccacaactctgatgcaaaacaatcaaaagtctaataacagaaagtggcccccatgtgacagcctgacagaccagtgaccagccactaaactaatcatgcacattatcctcctcaaagctcaaatcaatgcctccctagtgacagagatgcactgcatttcctacttgtttctttctaatcactggtgccacatgcattccagtcaactggcagtagtgcagtactaatgtactatcatggatcatggcaaagctagtgacatggtgcttcaatctagcttcccagcaagtatgcaagtcttttgtttagcttctaatagaagtggttgtgaacatgcatcatacatgtttatttcaataatggagtagtacttacatacttacaggctaacataatcaatcgattttttaaaatctcattatggttattacactcgtaggctgcagctggtctgaaaatttgaagagtgcactggccaagtgtccgtccgtgttgaaaagatttacaaaatacacatatgggcattatgataatctgtaaattacatagacaaattttcttagcaacacataatcattcgccattcggattctaggtattctagaagacaagcatagcactgacacttggtgtctctaggtaaatatcatcaagaataatctccagttattcttcgaaaaggaaaccaagctcagtgctagtgagagagattgagcaagtactgataccttgaactgtagagaatacaagaacacacaaactaattactgataaatttataatatccattcataccatccaccagttcaagagcaaacaagaccaatgaatgattgaaattacattcaggtcgtccaatcaaattaatgtgcatgctcttgggtttgtcagtgttccgaagctaattacctaaattactttgaattaaatatggtggaaaggattattccttgtaccattctagctaataaataatgttgggttcttcaaacccaacatctgtaccaactcctgagttgaagtttgtgcttgatttcctcatgctttcttggccttaggtttaggtgccggtggtgggaacacggccctgaagacccaggcagcaagaacagcgccaacaaaagggcatatccagtagacgtagaattgctcccatgtgttgtggcgattgttcacatatgcccagccaaacgcctgtggaattgtagataatatttaaccaagattagttaccagaaaacaaggaacagtagccaaaaagggcaaatgagaagagcggcaacttaacatcagatcctactggatgtataaatggaatacagtagcatgaattcaaattacaggaacaatttgcaatgcattctcaactctgcaaagatctcgatttcagaggtatacaaggaatttccactaaattacctaattgaagtggacaggagtgaccaaatagaaattaactgagttaccctctgcagaatataagtataatcaggcactatttttccatagtttttcctcataaacacgcaaggtttttaattaatgagatcactggcaacggttttatgcctattgtgtacactccaaccaaaactgtggacgtccaataataatactgactccttcctgatgaaggagatttaaggaaagagtggaactttttgaaaattacatctatttagttgcttcatttgacctgttgcttagtaatttaaaacaagagcaaaaaaaacataaataaaaagagcttagcctgacggcgtgtttgataagcaccataaaaggggatagataatgcacgatcaacatttttatcactcaggtttttggcacaaatgacttgggactccgtttcctattaattcatcaacaagctaccaaactatcgcgggtgctcctgaattaatcctagctccgtgttgtcttgaaaaaccaattgcatagtagtaagcatcgtgccgaattaatccttagctccatgttgtcttgaaaaaccaattgcataatagtagcgtcgtgcaagtgagagcaattgatgttgatatattttgataataataatataccaagatcagtaactagaaaaaaacctaaaggaagaaccgaaatctcacattggcagggttcatggatgggccagtgtaggcagcgccggtgaggacgaggcaaacggtggagatggagagcatccaggtcttgacgatgggattacggggccccttgacgatgatccagagcacggccaaggtgatgacgaaggtgagcaccagctcggcggcggcacccgtgtggagatccaccttgagcgatggccccccgagcatgtgcttgtactgctccggcatcagctccgagatcgccatcgccccacccaccgcacccgcggcctgccaagccaaaccaaattctcatcagcaatcgaaggagaagaaagcgagggggattgggaggagactgagtagtttatacctgggcggggaagcggagggcgagggggaagagggaggagtggcggggggaggagaggccggcggcgtggaaggcggcgagggcggtggggttgaagctggcgccgccgagggcgtcgcagaggaggttgaaggcgaagaggagcacggagaggagggagacggtgacgaggagcgcgtagtggatcccctcgtggatgcggaggtacgacgtcaccgccgccgtcgacgcccccagcgtcgacacgcacagcacccacaggaacgtcaccgccgcgtccgccgccgccgcccgcaccgccgccaccgccatcgccgcagccgccgctcgctctacttctgaatcggattggattggattggaatcggaggaggaggaggaggagcacgcgcggcgcctttctatcgatatagctacgctcctaaccacctaccccttttttcagctaaaaaaataaaataaaaactactcgaatatttttgtgcttatcattttattatcgaaaactaggaaaaagaaggtgcttggcaacggattttcttggaagtagaagagaaaaaataaattcattcattcagcatattattatagcataataagtcaatcatcagttgtaaaatgtgaactcatatacgaggtaaaacgttgggttttttaaaatagtattgacatttcctcggctcgatcgagccgaacagtgtaggctcgagctcttgtgtgctctctccgtcaaaagaaaaacttaatctaagaggggatttgatcccttctagtacaataaatctggacaactctttgcccagattcattaacctatgttgagtattttttggacggagtgaaaagtgtttatgagaatgtgttaggattgtgcttgtgagttagcgagagtgggctcaagcccatatcaaacattttcggctcaatggagatacatagtgggctcaatgaatacatggagtagtagtcattatgaaaccaagaaaaagcgatctttagataagcaccgaactaccaattgaggtgatggcagagttgtggattcataacttcactcaccatgtccaaaatcattagctattacttcctccgatcagtaatatttgatgttggacaacaaccattgattctaagtgtcaagtattatagaccggagagccgtcctagaaaaaaacaacttcgagctttttttttttctaagacggatgagggtgtatggttgagagctgcaatacacaccttttggctcacaatacaacaactccctaccataccaagttcctaaccaaatagtaccatagcaaattgtagcacacgactggtctagtggccaattgtgataggttttggctgaaaaataggcaagtgatcgatgtgattattgacatcaccaagcatgatcacaacagtctgaataggtgaatttttggggattgtatatatggctattttctcatcaattatattatgctcaacgcatgatcgaccaacttgcaaagaaacaaaaacaaaataccaatttataactcttcaagaagaaaaaaaaagaagaattaatggtaccaacataccaagatgatgagcatacgaaaagaaccgcaaaagatcagaaggctgaagattccttcctttgccttttctttaagatgacaggcatttgattttgggcacaccaagatggcttccccaagaatatatttttttgggacctttctctttcaaacaatcggttgggcagcaattatagtgtgatgccagcctcatctttcatacgcaagttgatagtatcatttttgtcaacgatttctgcgaaatttgtttttatcagatttgttatcttcttttactaatttacaacctgatttctgggaaattaaacaagagttcgaccaatgaaaagtatgtgtttcttttcatgccaaatcaatggctcggatcgcttctactgtcagtattcgatcactgtgaaaattatttcaggaaaaaatgttagatatatctcactatcagcctccttacgaaatatggagtattcgatcatgtgaaaggttatttctaaaaaaaaaattggatacctcactatcagcctcttgatgaaatactagtagtttatatggtcgatttcgcaagcattttggtacattgaaaaatgaaaaggggagtagtccaatcaacttcacatgcaagggcacatcacctaatctacaagaaacatgtttgaccaagctgggttattatacctaataacttgcattatttattgcaaattattatgtgctcactttgaattggacgagctcgttgaaaaaaaaaaactaaagaagacgcaaaactgatagtaaccatcttctggtaataaatgttagtgcatcaaactaatcagatgatcttagcaaactaatcctcatgtttataaaaatatatttttgacgttatttaggaaatgctgtctactgctgtcaaataaatttaaagcttgcctctgatcatacatatctacacagacgctttaatagctggtatgtgcaaaatttggcagatgttcataaattttgctgcaattactgatcatgcatggaagagttttttttttttttttgcggggaatcatgcatggaagagttgacatttacagatggggacagatatgatttctcacaatttttgactccaaaattgggaggaggaggaggaggagaagaaaaggagagaaattgagagaaaaagaaaatcaagaacgagaaagccaccggttttctctccgacgatcgccgccgccgccgccgccgccgctgccgtcgccgtcgtcgtcgtctacacggcgacccgctgcagcaccctcgacgggacggcgaagcgcgcggagaaggagcgcgagaggttctccggctccacccacgccgcgccgtcgtcgaagttctgcgcgtagctgtaggcgtcgtagggcaccctcgccgccgccgccgccgacgacgacgccggaacgcagccggtggcgcagagcaggatccgcttcttgttctcccgcaggatccgccgccacaggcccttcagcctcgtcccgcacccgcgccccgacgacgccgacgccgacgcaggagcccccgcgccgcgggacgccgcgccgggcttcccgtcggcgtggtggacaccgtcgaacaccccggcgccgaggtagccgtactcctcctcgtcgtcgtcgtcgtagtcgcccgcgaggtcgaagccgccgcggacgtagcggcgggacatggagatggagggggcgcaggagcaggaggcctggcgctggaagcgcgggctgtagccgccgccgccgacggcgtccatggcgagagcgatcggagtgtgagagaatgtgagggagaagaagaagaagaagggaggagtggcgtcgcggtcgtgtatttgtaggggggagggtggtttttcctttgctttgttgggaaaaaaaaccatttttgttaaccaaatcaaaggggatttattttatctactaatatttttccctccttgttgagtacataattggagggtattttctcacaccaaaagattttcccttttaaccttagaaatggttcatattccctcacaaatattcttcttttcgattacatggcagacacacgtacactattacacatctcagatcacattaaaatctacatctatgattttatcaaaatatagttaaaaacccacctatatatgcgtagtaggattgagatcctccgtagtcactgtaccgtgcctttgtactgacatgtgggcccggaggccatcgggcccacattgacaggatggtgcagttggctgcagaggatcctgatccatgcgtaatattcgtgaggcatcgagatttgaatcgtggtgaacagagtcatgcactcatgcacccatggactccggtgtttatcctgacacataagattttgttaatattgaataattactggataaaaaaagaaacgagtgacgggacaacctcagctattcaaagaaagaagaccagctgaaaggttataaacatatttttaataaacattagtttacttttgctagtcacgaaatgatacaaattttttttttcaaagcaaatgatatagagtcgagtccattgaacctgaagcatttctgtactgctcctgctcttgaagatactgttgtatactcctaagttgtaacttgtacagaacaacctaatcgttgactctcagtatgcccatcaacattttaaatgctccattgctcaacaagttttgcactttttgagactttaagtcatgttttgcaaggataaattattgtcaaaaaaagattatgctctgctataaagaaacatcatatcttcttttcagtgttactggatcgaaaattccttagtgctcctagaggtaagcgcatgaagtagtagggtaggtgatgggctcatgtcgccgtgtaaagtgaatcacaaattcacaagtggagagcccaattctaaagttgcaacaaattcacatgtgcaattcaatctttcaatctttataatatctgcttcatataccagatttcctactcttggatgctttgtagaaatttctaccccccaaacaagaaaattccccagcagaagaattttaaaaaactttatagagagacttatcacctattgttgaaggttttggagacatttataatcaaacagaatccaagattaaactatgaaggatttgaagaaaaaaaaaaggaaatacttttgggttgatttaattgggaccacagcccatatgttggaagttgacataatgtcgaagaccctacgtagtcgatgtggaagtgccaccaactgtaggatcaaaaccatctaaaaaaactgtgggaacaaaaaaaagcttttcaatttagtgttaaaggtgaaaaaaatgcattatcgcatattttcacaagaaaaatattaggctttagttgtatagtgcgaataatatcgagccgatgtaaattcatatattcatatattccaaaggagacctcatctcgcattgagtaaagatgccatatgcttaaatttgagtgtcgagatggatcaatgggtcaaattagtaagctttgcttgaaataagtttattaggagtgctcattcctatcattccagtattctttaatcttttctgttaaacaacaaaaagcacattttggcgcatgcttaggcacaattggcggtttgtcttgatgtttatcattgctaatcgagatccattactctggaatcaagacattgatcatgattgctactggctagcaccaatcctaccaaaagtgctgttgatcataaaaccaaagcctcattcattaatatatatgtttgtttatatgcggcggcagttcttaattctctggctaatctttctcttgccaaatggcatactataaccccttcggttaaccctaccatttggcagtttagccggagctattcatgtagctggagccatacatgtactaattatgcataaaatgaacatttttattattacagaatgtaacttttttgtgaaattattctgttcagaaactctgtaaatctgtcaagatttgcttactgattttgtgatattgcttgatttggatcaattcaattccatcatcttcaggggagtttgatgagatgaatcagattcaggccatgtgtgaatatgtgaagggcaccagcaggcagcagctgcacaagatagagtaacagtattaattagccatagttgttcagaacaccgaatttgactattgatatcagcatgttgcatgcagatctccaggcaagttgctgcgtacattgcatcactctctttgaaattgattctgtctctgcatgcatatccaataaatgaaagaatcagatggtcaaacaaagcgaaccaggtccatggatctgcacaaaagcctttcaaacttctttgacctgaaatttcaagaatcctataaactcatggattcacaagagaagaacccaaaaaaaaacaagaaggagaggaaagttcatggttgttcagacttcttagtcagaagaattccttttatcaaacaggacaggctaaactgctaaactggtggcaccaacctttcagtgtagtatttttctgttcagttctcgtttctaaaaaaatttgaaaagaatctgcaactcccaacaatatccatta

SEQ ID NO: 82246 - DNA, 8876 bp, Oryza sativa
aacagctaacttcaccccgatttatatttttgtatgcagtcgtttggcttcaaaggtcatgtccgactgtgaaaataatacccctacgttgggaaaaatgctttttctagtagtgataaccaaaaggtatggaaagaagtacatagactcacccagaatatggggagttcaatatcaaatcaaacaaatgctcactcaaaaggaaagaaacagaactaagcgtgaatccttctcttaaaattccagccatatgcagcataaaacttcagcactcttgattcgaggagcttgtaataagccttcaccatcttgccatcaacttcacaacagtgacaagagccttgcccaatgtgctacgctgaaaattacttgcaaaaacgagttaaaattgtaagcaataaaaaccacattattcccactcagccaaaccgtccaacaaattgcagctatacccacaaaaatcaacttttggattcttggattaaacctatttgaccaactaccaaacataagagctatgctgctgggttgacggatgccaaaggtaaagtagaatgaactccagatgtgcctcacaatgcaacaataaaaaaaaagaggtgtttcataatccattatgaaaaaaactaatacatagtttaatgctagttaatgataagagagagttgcggatttgtttcattgatttatgtctttttattttaataacaaaacaatggcagaagcaggagacgtaaaattcgattatctattttttattttttaatgacaaatttaacatgaaaatgttaaaaatgaccgaattgtcacaatttaagaataaaactgtcttagcactggcctgttcctacgaatgggaaaaaaaatgaatggttcagcagagacagcgggaatgttattcatttgtgtctaacaaaatgagttacacaaattgttgccatatcctaccctgatcattggacaatttcgactgacagacataaatttctgacggcgccgctctgctgacagatattatttgcccaagcaaatcttgctcggccgaagagaagatcacaccagtcgctactgacatatcgccatctaatcaagccaatctttttaaagcaacgcaaaatggggcaaatctgccatggataacaccgcaatatcttccagaacttccatcattgggccattggaccagcagacctggaacaatcgatggttagcacttcgcaattagcagattggttagtcatcagtgtgggaaggttggggtgttgtgtgtttgtgtgtgcagcgtgcatggttgttcagatccgagtcacctaatggggatttcttttgctgttgccttcggttgggcttgcttgctcagcttaatggggagctcggagctaccatttggaatggacaatttagctgcatgctctggcctttgcaattgtttgctttgggttcatggcaaaggatcaaacaataagatttgagaaattgagaaccttattaactatttgactgcctcaatttatttgagtttgggaaacagtttacttgaacaaaatggtagtctttgtttttttttaaaaaaaaacattttcagatggtcgtttcgcccttgctgattaggaatattcattttcaaaccaacgaaaccggttttattgaaatgaagaaaaagacagtttggtgatttatgaattgattgaaaccaggaaaaaccacatcgacatatgtatggacaaatgtcacagatcaaagtttatagtcactttcagttgatgaaaaccacactttcaaattgaaatcaatcactttctatccagcatatattgcactatcagcttgacaaatatcacattcacctaacaaactatgcatgttcatattcaacatgatcaatttgctcatgtctcctagcaaatcatgcattcatttaattcaaaatggaacactttaaaccgacagaggatcgtaatcacctctaattaatggtgtatccccactcgtagttgcattactgaagaaaaggtttatcagatgtataagcagaaacgactggagtagattggaaagttacatattgaaatgctcaatttttgctacactgatgactggttagtcatccctggttttgtcaaatctggtttaccttacttttattcgtaatttcacgaaagatcactagaataaattcatgtcaataagcaaacatataattctgtatactttcttcgtgggattagagaaaaatgcataacaccaaaaatggttaggttataatgatctcatttgtccagacagctttaagaaatttaatttttggcaagccaatattttccaatctatgttgcaaacaataagactaccgtattccaaaatttagaacaaatgagatagacagcaaaaagtccatattgtccccctctccgccccccgccccccaaaaaaaactatttatggcagtacaaattacccccctcgattcgaaagctataaattcttcttcatcaacttttcatactaaacgaattacccctcctgccgactctgaaaaggttttcgtcatgcgtggcacacacgtgacactccagtcatcataaaaaaaataaaatatagtgagggcccacttatcagttttgcctcttctctcggtcaccacatgtggaccctactcttttttatattttcttatgctgactggactataacatgtgcgcgatgtaggaccaaaactgcttcaaagactatcacaggataattcgtccggtataaaaagttggtgaaaatgtctggttttgaattttagagggggtgggggaaccacaatagtttagggggtaattcggacttttcccaagatacatatttttagcgaacattaatttaaataataaatgttaataatcaatttaatcttatataatggagccaaataagcccataattttttgaaaatgaagtatacataaatttataattcaaattttctcaggaaaatggcaaatgcggatacaatgtttttatcacggcttgaaaatgtaccggaagcatatcaaatgtcatggttttcggcctatgccggttcaaaatgttagaattatgttaaaataaaaaaaataggactctgcaaaaattagactaaattggataaatcttttttttctatttgctgttttcggtgattcggtcgtttcggccggatcccattacaaacccattcgaatttgccatcccttcctttcagtagaccatcaccacccctacaatataccctataaccagaaaaaagcctccctctaatttcctatttgagaaagatccctcctcttccctccataaaaaaaaaattcaaaaagtttgaaagggtcacaaacccatagaatacacacaaaattacacagcatctgcctttatttttctttttctccacttgtccctcccccctatatttcttctaccctgtctgtctgcctattccccccttccctctctctctatagacagacatccccgcaccgagaagagaggcgcgcgccccactttgttccgcgccgcgacgcgcacttcccgcctttgccgtcctcgcgccggcacgcgcgcgcgcacgaacgcacgaacgctcgcgtcgcgtcgcggagctcgaggcgtgttcccgcggcaatggcgcacgacgggttcctcggtggtggtggcggaagcttccacgcgatggcggcgtggccgctgccgttcgacgccgcggccgcgctgcacgggggagggtgggacagcgacccggcgctcggcgagctcgtgccatcgccggtgggggtgggggtcgggggcggggtgcacaaggccgcgctgatggacgagctggcgagcaggctcggcggcgtgtgcggcggcgggctcgggggcggcggggtgccgtcgccgccgtcgtcgtcgcggtacgcgtcgtgctacagcacgccggtgggctcgccgtgcaagcccgcgccggcgccgcctgtgccttccctgctcgccgcggcggacgccatgatcgccgagcgcgccgcgcggatgtcgtgcctggcggctgccggacacggcggcgggaagctctcacgcgcggcgagcagccagtccctcctcgcggagacggcggcggccggtggcgtccaccagctaccggcgagcgacgggtcgagcagcgacgctccttgtcggaagcggaaggcgccgtgcgccaaggctagaggcaaggacgcagcgacgaccattgccaaggtacttcgtctgctctctgctccgcctctgcaatcgcgacgccgaaccagccctgaaacaatggtgaattttccacagtcgccggagccggggacgaaggcgaagaaatgcaagctgtccgcggacgccgccggagacgaggacacgaagccggtcgccggcgacgcgggacacggcggcaatggcaagggaaaggtcctcgacgccgccggcgagccacccaaggactacatccacgtgcgcgctcgccgcggccaggccaccgacagccacagcctcgccgagcgggtaaaagccgccggcatcgatgccgccaatcataatttctttttctcttcaattctcgcgtttgctgacgccattgccgccgtttttcacctccaggtgaggagagaaaagatcagcgagcgcatgaagctgcttcaagacctcgttcctggctgcaacaaggtggcaaaattcagccaaaaaataaatttaaatttcacgctggtaaaacatttttcacagaggaattattaatttttcgagtttgtgaaattcaggtgacaggcaaggcagtgatgcttgacgagatcataaactacgtccagtcgttgcaacggcaagtggaggtgcgttgtcatgatcatcaccgacttaatttacaataatttctgattaattcctttcaaatttgttaatttgagcaagattgtttactgtcccaacagttcctatcaatgaagctttccaccgtcaacccgcagctggatttcgacgtcgacaacttcatcccaaaagatgtaacaatccaacctgaattcgctctgtcatttagttagttgaccttagaccaccatataattctgaaattttacttacaagtctctgaattttcagcaggctagtgatcccatcatgcccgcgccgttgtcgctgccaccgccaccgccaccgctatcctactcaccggagggcgcaagcccggggatctgctacgcgtcgtcgcaagggacagcaatgcagagcgtggtgacaagcaccaaacacttagaaacggcgccaacatttgcaaaccaccatgtcatcccagttccctcacttgatgggtttcacagtgctcattctcaggtaaaattgtactacaactcaagccacagaaatgatcatacagtgaaatcgccgtcatttttctccgacccactgatcgtaaaacgcaagaattgttgtggctgaatttttttcaggcagggagctgcatgtgggaggatgacctgcagagcgtggttcagatggggttcaggggcaatacatgatagattagatagatagataaacagatgagagcccccaatcatggccatggtctctgaattgattcggggacaaatcagtttcaccaatcaaagccaggagacggtcacccggggaggcatgtcgggtgcttggaacacttaacacgagggggttgggtttgagctacctccaacccaatcattggatcatccctccatgattgtacatacaacccccccaccttcaatgtgggggaagaaaatggaagaaggagaagggataaaatgccctacttgcccattgcctcagctcaaagatttgtaccacggcgaggccgaggcggaggcggaggcgaaggcaaaggcgaagacgaaaaaagaaaaagatttagttttcttcatttgctcttaggaattttcatccatctcacaaaggatgcaatatgtaatgttgcagtggaatgtaattgtttctagacttcaacttgggatttgaatataattatgagagaagtttcttgcatttggttgctactgtaggctttgtgccggtaggtggaattgttttgttctctgcgttatcatcgccattatcatcatcacggagtcttttaagccgtgtgagctggagtcaacaactctaggcagaatcttaacctcttttagtgtcttgcttgtttgtatgattgcattcttaatctcatctagtgagccctagacaactaatctttaggatagaattgttgtgtgtgccctttattctgcaaagcaccaaaactgctggcacggcagaaaggtcctttgggcgcatgatttgagccgaactgacatgatttgcgggagtttcatattggcaaatgtcttgggctcctgtcttgtcagcaaaattctttcttaggtttggtctacctaaaaaaaaaccttacaatatagaacaacaaaagaaaatcacatttttgtccaataatttaatgtacatgtgtattgcctctttcagtcaaccaatcaggctgatagaaatgtaatttacaattgtttttatcctttttataaaagataccgtttattattggccttttattccacggactattttctaatgctctaacattggtcaggttcagttaaccaaaggaactgaaaaaaaaaatactaaaccccatataaaaataaggtttgctgtcctgtagacacctctttaaccagacaaggaagagaagagaaaccccaaaaacaaaagggaaggtaggtattgggttacagagtggacaagattccatccagcatagaagcatctgttgcagagtactactgcctcttcttctacctctcctttagtcatatacaaaacctgtgataaacttttggcatctactatggtccttcctggcctcccaccagaaaataaacttaattctggtactttgcacagccaggtgtatatatatacaaaaataaaacaatatcagaggcttttttactttgtctcaaagtggccactctaccgctagatggcatggcaggtatctagtcattgtcaatactgttccattgggaggacaacttacaagattgcaccctccctagtgatggagacacaagtgctacccaattatcatgacgcctacaagggtccattttgatcaaggaaaaaacactgcaatgaaaggccatgcctaaacacacatttagacctcttaattgacaaggtttctcctgtggaagcacattcggtgcggtgatagagttaacccattcgtgacactctcgtgcatttatgcacacgctagtttgctttaatatttatttttgtgaggtccacaaacatatcattggcttttcagttgttgattgtgtgttgaggaagtcggtgtgtgcatgtatatgccctatgtgcatgtatcaaaaattgatggaccacatttctctccaagattcacaatagtcgaaccatgaaaacactttgaaagggcttgataaattcgggggaggatgtagaacaaaatggagaggtactagtcgcttgctttactaagttttggaccaaatttatattgatctgggtgtccaagtttcaattgagtggtgcacatatgaactaagctaacaatatttttgaccgggttcataggaaccctctcaattttgtagctccactctcaattattatgtatttctttgttactaaaaaaaatggataagtaccttgcaaataaaaatgtacatctttggtgctgaatggatttttcacttattggtttggaggatacatgaaagctagttttcatggtgatgccattttaatcaagtagatggatcccaatccctttatggggcatcattgtcacattcacgcagtgggcactcctgggaccgagacatgcgcaacaaactctaatagaggcacaattggagcttttcgtgatgtaagttggatcttatgatggtggctcagaccagatatggaatcatctgaaatgactttgacccacggagactaatatcaccatccattcatcaaattttgatatctgaattcatgtttgttgggaatagtcccacattgaaagtttagaggagtggcaccaacttaaaaggggaggggtccctcacctcatgagctagcttttggggtgtagaaaggctttctcccggttgggccaacgtctcccggtttttggccaacaagtggtatcagagctgggcccacaatctctctaagtgccgtgcacactcgtgtggtgtaagcccgaagcccagtggaccgcgggtgtgaggcccgtatgtgcctatgtgttgggccggttagtggaccgcgggtgtgaggcctgtatgtgctcgtgtgtgtagcccggttagggctaaggggcactaatgtgtgacgggggagattgttgggaatagtcccacattgaaagtttagggggagtggcaccaacttaaaaggggaggggtccctcacctcatgagctagcttttgtataaattccataggagtattaattactcgacatgccattgtcaggaatttttccagaattctaacagcagattattcgttgattctgaatcggacagacaaaatgtaaagaagttgtattccctgacaatggtaaagcaacacttctattcaagcaaccgaagagggtcatccgaatattattatgattgaagaaaaaagcaaatgttacaagaaagttttacatacaaaacaacactttttctctcgcaagtttgaactgaattgctgcagcaactctgcgtgtcgcgactcagcgtatgcattgcttgattccaaatgatccattcaatgccatgttcatgtcagcatagtgtacagatgctgttaggtcggccata

SEQ ID NO: 82247 - DNA, 1422 bp, Oryza sativa
cacaaatgcagaacccagagatacagaggaccagctgtagagttatttcatacaagggacttgagcatctgcaaacttcagtaacctcagtggacacctggaaccaattcttcatacatactgagggacaactatacatgcaaaatcctttaaagtgtttcaaagatattcttcatgagcacagaacaagccttaaatttgccttttttttgagacggagtcttgctctgttgcccaggctgcagtgcagttgtgcaatcttggctcactgcaagttccgccttccaggttcacaccattctcctgcctcagcctcccaagtagctgggactacaggcacctacaaccatgcctggctaattttttgtacttttagtagagacggggtttcacgatgttagccaggatggtctagatctcctgaccttgtgatccacctgcctcagcctcccaaagtgctgggattacaggtatgagccaccgcgcttggcctaaatttgactttttaaaaaaactttactgtgtaatgcaatttagcatacttatagagactttattggacaacaggtaagtaaaattatccttattttacatatgagaaaactgaatatgccagctactatttttgcattgaacacccagaaatgtggtgatgtaaagcaaccattttattaagttcacagattgttagtattggaattttggatagggtatagaaagaaaatcttgtctgtgctccacattttctagagcctcatttgggaagactcaaaggcaaggaatgactcagagggaagaatcatctggaggcatgttcatcagcatggctagagggtgatgttggctgtcagctaggacctgagcaggtctgtaggctggattgcctccatgtgccccctctgtgtgacctggcttcctccacagcagggcagcctcaggagagtggggcttctcacatgcagtccagagtttcagggatccacgtagaagttgcatcattttttgtgatctatccttgaaagttgcacagcatcattttattaccaaaatgccagaggtttggtctaagtcctgctgttcactccacagaaagccaatcactgagacaacaagtattgccagggaagaaggctttaatcaggtgctgctgttgaggatatgggagatcagtctcaaattcacttccctaactgactaccattaggggtttctaaagcagggaagaaatgtaaccatgtgcggggaaacaggaattagggagaggtagggaagaggagttcaccaacagaaagctggtgcttatttaagcagtcatgatgggtgaggactctggcatcccattgtctagatgccatgatctggtaagtttcacttccttgatactatctgggaagcctggggatcctctagagtcgactgcag

SEQ ID NO: 82248 - DNA, 2319 bp, Oryza sativa
cggcgtattagcgttgtacagtgccacgtggtggtttgggagtatttttaggaagtttatttaacttttagtatataatagatagatagatagatagatagatagatagatagatagatagatagatagatagaagatttaacatgggctagaaccttatggaaatttttctttgagtatttatctttacttaaattcttgtatttttttctgcggttcaattaaacgatattttgtatttttcctatattttgcaatcatttattttatatttatattcatatcagaatcttatgttttgcttattcgtctattttttttatttctacgattcaataggccctgattattctaattagtctgctgaaactagttctctgacgaacacattttcgccgggccatttcaaaataatggaaaaataattctaattagaagctctgaataaccaatttatattgaggaaaaccatagccgcaggcatcagttttcatgtcttctttgtaaatcagttgtttcctaattgtaaattaattagtgggttgttttagtcatgtattccatcatattatggaccacacgtgggaaaaaagagaaagaagaaaccaagtttgtattcttcactgctaacttacattatcatgtattgaccaatgaccatctgcactctatcaaccctgaatttttatattcaccgtaggtgtggaattaatggacgcttgtgattgacgaacggtaaactttggcactgtttattataggggtggaaagttttggtgtgtcacatcgcatatacatgaatacacaattaaagtattaaacgtagtctaataacaaaataaattgcagattttatctgtaaactgcgagacgaatttattatgtctaattaatctgtcattagcaaatgattactgtaacaccacattgtcaaatcatgacgcaattaaacttaaaatatttgtctcgcaatttacacacaatttgtgtaattagtttttttctatatttaatacttcatgcatgtgttaaatatttgatgtgatagggtaaaaagtttctgcgttgatactaaacagggcctttgttgttatgcccaaaggcaggggatgtgaaccccagacaaaagagcactacatttagaatagttcgttcataactttatattgatagtgcggcatgatgcaaaatagcgtattactcctatctatcagtgcatctttacataatatattgtcagtgcatgaaaataaaaaaaagtaatgcttttaaaatgtaaacaacaagagacataattattactccttccatttcatattgtaaacaacttatttaagtttaatcaaatttatagaataatatagtgttaattaccttggacaggtaaatatcccttttcacacagccgagggtacgccaggtacaccctgaacctcgccgcgctgctggtcatcagcgccagcgccggcacgccgagctccctcgccgcggcgagcggcgcgaaccagtcgacgtcggcgaccacgcacgcgacgccgccgccgtcctcctcctcctcctcctgccggagcgcgccggcgaggaggtcacggaacggcgccgcgcagttcctgttcagcgcgaacacgaacgacgggatgtcgccggacgcggccagctccggcgggaggccgtccggcacggtcaccagctcgcacccggcggggaggctccggcggtcgggcgcgcgcgtctccgtgtggacgacggtgacggcgaggccgcggtcgtgcagcgcggcggcgaggcggagcatggggttgatgtggccgtggtatggcagcgggagcagcagcacgcggcggcggccttcgtggccattccggtcgcttgcaggcgccatggcatcgagatgtgtgtgactgagacgcatgagtccatttatgacacaaatgcgtgcgtactttcatagggttttttttttcttttcttttcctttttcttgtggaaagcgtatttaatttgatagtttgtgggtgatgagtccgcacggcaacattttggcagtgtccagcattcctgttcccggggccaccacatccacatggccattctgtaaagacaaaaaaagaggaaagattcttttttcttacaattttcgagattttatttgaacgagacgacataagacagcggccatgtcatacgcatgagggtgactattggaacgattttggaatatagtgcaaatttttaatgctaagatccacacaatcttgataagaatgtgagatttaggggctgtttggttgctaccctgagagaaattgcctgacctaa

SEQ ID NO: 82249 - DNA, 11833 bp, Oryza sativa
tcttttattccagaatacagatatgatactactagtactggatacagaattcggctccacacatcgacccaggcagaatctactaggtggcaaccggcgcgctgctgtatatatatgatccgtctctgatcgatggctcagctcaccctgcacacacgcacatatatatagattagatgacatgtatatagtactccatcatgcaaagccatgcgtaattatatatatttaacggaattagatgtatatatagagagagagatgatgagatgattaactaattacctggagcagtcgatggaagcgctgatggtgtaggggacgctgacgccgcacttggaggggatgctggcggcgttgccggcgttgagccccttgatgccgcgggccgcgttcttgaggcagttgcaggcggtgcgccggtctgcggtcgtgcttgctgccgccttgaggctcctcacgccgctgcagcaggccgccgacggcccggcgccgccgcgggcgtaggtcaggcagggcccgacggcggagttgacctggccgcaggtgatggccacggcggcgtgcggggcggcgaggagcagagctgccaccagggcgaccaacaccaactgtgcacgggccatgcttcctagctagtactgttgatctagttgctggatcgatcgatcgatcggtgcgaattggttgctgatgatgagatggatgatggatggatgaggagaatacgcgggaatgcaggggcttaaataggtacatttgctagtgtggatgcatgcacagatgcgcagctgcaagagatcgagcaattaacaaagcaaggatgggtttgtggtgtttagacggtgcatgtgtccatacgttcattcaatacgattgggagctagcttagcagctggtggttggctgttgggaaaaccagagcttattcccctccatctacagtcgactgtatttgcgaattgtattgatgtaaatgtgtagaaagagtaaatatatttatattaattttagggaacgagggaacatgtcctcaaggttttccactaggaggaaggttgaggttttccacaggaggatgggtatatgagaaatgcgagtagttgacagttaaccttaaaaagaatagttggcaaatgatcaagacaaaactaagtttaatttgttcacacctgcagaataagaatattgtttggtttactattattccgagggatcactacttaaaaaagagacatatatattagcactataggtgctgtacgtgctaatactggcacctatatataatatttttcccacctcaactggatgaaaacataaaaaaccgacaccttttaaataactataggtgttggttctaaagaaaaatcgacacttatactatgagtgtcggtttttaagaaataaccggcatctgtaatatattataggtgtcggttaattaaaaaccaagacctataatatattataagtgccgttttttttaaccgacacctatctgccgaaccgaccgagccgagctgagccaccctatctacccccatccttatctcttcctcccctctctctctcgaactctatctcccgcacccacagtccacttcctcctctcttcttcttccctctttctctccatttcttccttctcctctctcctcctcctccatccaccatggcggggccctccactccgccagatccgatgggaggggaggcggtggtccggcggcagcacggctgcgtgctcccctatgccagagccgacgggaggagaggcagcggcccgaaagcggcggcaccctcccctccgccagatccagtgggaagggaggcggcaacatggcagggccctcccctccgccagatctagcaggaggggagacggtgacccggtggcggtccggaggggtggcccagcggcgggaggtggcatgcggcagtgggagagagctggctagaggtgcgacggtgttggcggccgtggatccatctcttctcctccctctttgtgatttgttcatgttgatgtgatctagatgtgtattatttgatctagatgcattgtttttctagggatttttttactatagttcatctgttcatggatttgacgcaatttagttcacgtgttcatggatttgacgcaattttgggatttggttattatttgggatcagcttgacggctcgatacatcaaaccgtttttttttttggctcgtgtatgcctcaaagatgtcggttttgacccgagtaatcaatgccgcttccgtggtgctggttggaaaaaccgacacctaaggaggtttctcaactggcaccgattagtgcttctgtagtagtggataagtaagctaggatgtatgggccatgaagccctttcccttgtatatactccccatatccaaataaaacttatcttagtttaaattttgtccaaaaaaaatcaacttctatcatcttaactactctcagcacacaaaacgagaagttttatcccttaaataccttttacctacctatcactactactaccttttccaacaataagaggtattttggtcatttttactcttcactattttcttcttgggattggaattgatatttcgtggtacggagggagtatgatccaaatgaataaatatttatgcatgacatagcttcttttccatatttgagattaatttgacgtgtatttgggccaagggcttcttcgccaggagaaatgaaacaaggccggcctgcggtgcatccgattcaaatgaagcacatgaaactttaggaactatatgtattagtacaccggcctgcctgtatatcgtccatccatcttttcaaacattatattatatcaaaagaacaagagtaaattgaagaagttatcatattcactctaaaggtctagaaaaataagtatcctttttattatgggaaaagtcacatactaactttttcttactaaattcttactaacactgacatatcatgctatgagtgcatctagattttttataactttcatctacttgaatcaaacagttgagacgattgttagtacaaatttagtaagaaaaatttagtacgtgtagcagtactcagcaaataggataatcattctcacactctgcgagcctataaaatgtgtgaggtaagttataactagacatatcttttttttttgcggggtagacatataaagcttggtcagatgattgcaagatatctgttggctatctaattaatacaatactccaacattgtattcgttgaacaacttaattatgtgttctcatagttttacccctttcaatagtctttcaaagtgcggctttgactatattaataattccatccaaaaatataagtattattggacttcgatatggtcttcacgatgctactttgactaacaatatttgtaaaagtaaggctgctttcaacagcatgtgaaagagagaaagtttgtttcgttagcggtgtgtttttttacactactaaatggtgtgtttttacaaaaaaaaatctatatgaaatttgctttgaaaaatcatatcaatccatttttgaagtttaaaatagttaatactcaattaatcatgcgctaatggtacacctcgttttgcgtatcttctcaatcttctcttttcttctcctctgaaactcagcatattttaaataaaaagagttgcatattgtgacagtttgtttaatgataaatctagtaatatcaattttacattattgattttttttgctattaataaccaaagttaaaaatatttgacttgacgctattttaaaaatgcttatatatttcgagatgaagggagtaatttattaatttattattagagtatatatatttcaagacaaattaacacagtactgtttttttacccaagtttgtatatatgtgtaatgccaggaagatggagtaatcggtgtagaacatgtatttgtatacgaaaaagagctatatatctatgtataatccacaacgtacacgcacgtagtacaagtagtactccatgtacatgcagaagtacatatgcatatggtacaaaaactgatctctagctctcaggtacgtatagtcgatcgacgaataaattaaggaaacagatagcgtagtgaccggccgggcgatcaaccatgtatgcatggcgatggatcgacctagctagctagctctcattttattcagcataaacacagataacacaagatacaaagcgtgagacgacagctgcatctcggccggcgctgcatgtcatcctccggtagcgatcgatcggattagttcacgctgcacgtatgtacacgcacaaattaatttatatgtacttaattaattagatgatcatatgcaaaacgatagtataaatttatcatattgatggatgattacctggagcagtcgatggaggggctgatggtgtaggggatgctgacgccgcacttggaggggatgctggcggcattgccggcgttgaggccgctgatgctgccggccacgttcttgaggcagttgcaggcggtgcggcggtcggcggtggtggtggcggcggagttgaggctcctgacgccgctgcagcaggccgccgacgggccggagccgccgcgggcgtagctgaggcagggcgacacggcggagttgacctggccgcagctgatggcggccatggtggtgtgtgggcccgccaggagcagagctgccacgagggcgaccaacaccagctgtgcacgggccatctcgatcttggtcgtgtgtgctgacgatcgatcgactttgctgctgctgctggtgtgtggtgctcgtttgctgctgcaggtgagatcgatcgatgagaattcccgggaatgtagggggctttaaatagctatgatttcatctgtgccgatgcatcgaccaagtcaaatgtagttactacgtggaatatatagtccacctataattagagaacatatcctatacacacaagctttacttatgtacacactatacatatcaattagcaaatgtcataaaaaattttagaaaaaattggacacatacttccaatagttttacacctacatgtgaaatcttatcttcaatttcattatattttagccataaaaaagacaaaatcctgatatttttacccttaaaactgtcgggttttttttcactttttgttacagctaaaattcgggtttttttcactttttgttacagctaaaatatattgaatttgaatatgagactttgcacatatgtataatactattaggagtaaatatctaatttgtttatagaatgtttcgtgacattttttaattggtgtacgcatagtgtaattaagcttggagtgctagtgtttaggcaccgttcttagtcgtcggtgcgtctaatgttattcaattcaattcaattgaatcagggtggttggttgttagggctggtttagctagctagtcacacagtgttagtattagtgatgagaaaatgattagcagcggcctaacggagctagtcgtttgtagcagctagcatgcatgttgtacatttggaacatgcaagtagttgagcgcattcatgatgtttggatccaagtgtccatcatatcagcagtaacatccaacgatccttccagtattcttctttcaaccacaaggacaacttatgcacacgcgtacgcttcacctggttacactatagcccaataatgcgctcggctattgctaagaaatataagaatcttacaagctaaaaagactaattaaaattgctcagctgctacaaaataaactatgaatgccaaccaacaacgacgatatgatgagtattttcaggagttggtacaaacacagtgaaatatctcaatagcacatcacattttagtacacaagagattgatatataattgggataaaagaataaaagtcatattaagaaactaatccaaatatattactatatgataaaattcggataacgtatttaatagtatttattcatgttcaggacgtgtattgtatcaaccatgcatgcatgtatttaagaggttaaaccgaaacttcatgtttcttatcacaagaatgtactagctggcctggcatgtgctccacaatgcaaagctctcagcagatcgatcaattaaatctaagaattttcagttactaaggtggtgtttgaaggtggtgtttggttggagggactaaagtggactaaagggacttatatttttgtgagagggactaaatttagtcctaatttctaaacacctcctaagtttaacgtagtttttaatcaatcagctgtatgctattttgcaatccaattaagctctagataagaccacgtacactatggagtagtagaattttatctttctttttcacaagaccaagctgctagctactccagttagtaggagtatttatttatcgttgacgtaggttatccctcccggccgggacggctgtcggtcgccagcaggtggcttccaaattgaagccgacgatccattatgttcatgtcattctcgtatcgatctacctgccaaccgttactcctcctcctaggtattaatgcatatcatgatgccacgtacagcaacccgtggccaactttctatgtagacgttagacaaattaaagagggctacgatcggttcatcttggcccgtgttagtttcaaaatatttcttcaaatttttaattttttcatcacatcaaaattttcctgcatacacaaacttctaatttttccgccacatcgttccaattttaaccaaacttttaattttggtgtgaactaaacacagccttggtgttttcgtcaggcttgtatgatagagcactattccctttgaaataagggtgtgcttacttcacaccaaaattgaaattttgattgaaattggaacgatgtgatggaaaagttaaaagtttatgtgtgtaggaaagttttgatgtaatggaaaagttgaaagtttgaagaaaaagttgggaactaaactaggcctaatatagagagtttgaaaaaaaagaattggacgtcacacgctcactagcatatgataaataagattagaggcctaactcacataacttcggtgggcacacgttttactgttgaacgtatctgtatatgtatatgtatacgtaggtagagtatatatatattctctcaagagattaaatctaaaagaaacaagcatatgtgcctatactatggcttgaatcaagataaaaaggttctaccacaagagaaagagcgttatcataaagtctggacaactaataatgttttccggtggtcgaccaatttttcgtgacatcgatggctatttgcagtggagatgtcaacgacggagcctgggcagccacccgaacacaaggacctttaccagtttgtagagtttacaacattatcatcgcgcgtttgcaaattggcttatcaaccaaatcaaaaatttgaattttcaaccataattctagagttgattttcaggtttcctctatcttggtttgtttttcgccattgtgttttaaattgccaacatagatatacaagttttatcctgtaaattattttagttgctctgttcttttttttacggctatattagctacatatcaaacgatgagagttgaaattatgatttgaggtgcaccagtaaattgaaataaattcttgggatgtccttacgaatatatgggctagggttttttttccatcccaaacaagtcctttaatctttttattgggtcgaaactcaataaatatatgatagatttattacaaaatgctagctagctagctaggacccaggtcaatgaatagaacacaagtagataagaaaaataaggggagaaataaaaaaaagcgataagttttattttagcggtaaataacgcattgagcctcatagttgcccacctatccctcttccctccctttccctcgtgatgtaaaaaaaaatatactctcacaagcattggttttgtcctagactctcacaactccccttggacccgtcctgtccctctcgttcctaccctcctctttggcactccctaacctcctgacgaaaaaaaaagattactctcaacctttctagagtataaaaatttatcttgtaactccccttccccacacccgctctttttttttgagaggccaccccatcctcttacgatgaaaaaagaagtatcccttgtttatgaacataaaaagaatataaatcttggtgacaaaaatattctttcacattaagaggaaagagtggggcatagttattatgaccggaccggaccggaccggcggtccgaccgggaaaaaccggaaccatggcctcgatcggtctggtccccttaaaagatcgactgttcgattgaactggggaaaacccattgaatcgtgcagtttttatataaaccgagctttgaaccggagtggtcagacctcggccggtccagtccccttaaaagatcagctatgcaattgaaccgggcggtttttatataaaccgggctttgaattggagtggtcagacagggtaacaagctactaggcttttgttgatgggctgaggcgaggcccaatgagcaaactccatcaaaagccttagcccactgagcaaactccatcaaaaattgactttgggtcgcatggctaagaagagtacgcactacccaacccactatctcttcacttttgttggtaccaaatatttacgtcatattgtacattgaactgcggttggactggcctaaccaatggtcgaaccaccatactagtgaaccgagagctctaccagttaattcttcggtccggtcttaataactatggagtagggggtggaggggacaaatgaagagcctgctatatagaactaatgtgtcacataaaggtgagagtagttttttttcatcataattaaggtgagagcaggggagcgggtatacacacttatatgaggactactacttagaataaacatcccattgaactgtgtacagtagttatttgttttgttcttttcttcttcttttttttcccattttaccccttattttctgattaactaattaaattttgtatggcatgggcctggcaaaaggaggtaaaaggatatagagcattctccctttggattgtttggtgggctaggatccaagaaatgaattgatgggccatatatgaagaaagagagcaggctagtctgcattacgttttttttttctttcagttttgaggcatggtgtgctgccggcccataaaaaacgtttgtacggaagtacgttcatcactacgtggtcgcatggagcctcgtcactgatccgtcattaattatattccagaattccatttggcatttcttcaaattaataacagctcatatcattccatccatatactattacttattgaagtaaaaaaacggggcacagcaagttcaagtgtgtgtacgcttgtatcagtacaacattattattattagattattatatatatgaaaaatatataagtagtgtacatagtacactacatgtaaacattgaaacgcattattacattatatagtgcacgtacgcatgcagcaagaaaataaacaaagctagcagtgaacagtcactctctagatcttcccatacatatcgatctcagctggagatgatcaagctagtaattagttgatcctgcataaaaaaggaaagaggaaattagcttaattaggccaacacatggatggagcaaatgcagatagagagagagaaaatgtagaatacttggagcagtcgacggaggtgctgatggggaaggcgacggagacgccacatttgctggggatggaggcggcgttgcccatgttgaggttcctgaaggaggaggccatgttcttgaggcagctgcaggcggtgcggcggtcggcggaggaggaggccttgccgttgagggtcctcaccccgctgcagcacgacgacgacggcgagctctccctccccatcacgtacgacaggcacggcgcgatcgacgacgtcacgtcgccgcagctcaccgccgccgacgccctctccgccaccaccgccgccgccaccaccgccaccaacgcaaccagcgccatcgtcctgcgagcacccgccattgtctcgatcgagatctagctctagctaactagcaacaatgtacactggtagtgagctgtaagctagagcttgtggtggagtactggagtgagcaaagctgtcgaggaggggtggtataaatagctagcgatagatggaggtggagaagaaagaaattaaggccgggttaattaggttagcttagctggttagcgataggaaacttccagatcggccggccggccggagatgggagatgatctactgtgtttagctaatagtatagagcgtgcatgcatatgcatatgtaccagccggtggttgcgtattgggaccctcgggatctgtcgatacgtgcgtgaatgcacgcatgtgatccatccatctttgtttgcatgctcaggaacaaccttcttaattgccaccattgttatcttgcgtcttttcactccgcgaatggacttcaccatttttttttgacaaattgatctttttgaaaaacttatttcgaaactagccactgccaaaaacttcaactatttccgtcggctcagcgctgaggttgtaaatagcagcgccactggacctgacgctgacctcgtgccagcgtggcagctgagccgacccccctgccgacgtggcaagaacctcagcgccaatcgcttcggtgctgtgttgcccaaccttagcgccaaccgcttcggcgctgagatgcccacccttagtgccaacgatcccgcaaagattctctacaagcatcgaactccataattaagaaagtccagttccctccgataaccatatgtagaaatcaagttcaattcttggataattcatctagtcggtcttatttgcacgtttgtcactaaaaatttgcatattactatgtcttgcatgtaggattgacatacagaaggaaaaacaagaagaccaccgatttgactgcttatcatcagacacacatcgatcgatggaaccagttcgaagccaaccgcatgccggataaagcaatgcacaacaggcaagagtttgacgcgtacttagcctggctcacgaggaactaccgcctcgccctacgtctgtcttggacgctagccaacatagcggacgacccaactggggtggaggagcagaacaagtacgatacaagtacccgtagaggtagcacggtcggggcgggtccagtttgagatagagtggtgagtatgggttctagttactcgttttcccatttccgtacttcgtgcttataacttctcctacaggcacgggagctgatcaggacagtcaacgatgcgggcgtggcacttggcatgccccccggctcgcaacaagagagcagcgttcttcgaaatgcattacaggtagatttgtaaaatttgtgcaccgtacacataattggaactaactccttccttctgttggtactagactctacgacagtgatgcagaagttggcggcacgtgtaggatgcagggccgatgatgccgtcgaaccaccttgacgggctgagcgggggagaagtcgaggagtggctcaagagggtgaacaagagggagaggaggaggaagaggaggagcaagtggagttcggtccctcccagctgcaggacgctccacaatcgttgcaggggccatctcgaccacagcgcaagagagcttatgtttccgactgaaggtacactcctgatcagcctcgcgctccaaggggta

SEQ ID NO: 82250 - DNA, 8359 bp, Oryza sativa
cagaagagagctcccccggatactagctgatgctgagcggcatagtggtgtgcactgctggtggcagtttaagttttctttgtttctcgatgcaaatggcacatgcacttcaccacgtcttctgcatttcatgactgtttctaaccggaagaaattttataagtgccatgtcttgactgacgatcatagtgactgaatttgctaaccaactgagaaaattcagaagagggcagtacaactctacgagtacactagtacactgctgcttaggtcaaagtaagacgtgattcaactgagaaattcgatttggctcggccaactggttgcaaaactcaggtctcatatgttggttcagatgcaaactgatgggttgtctgggatcagattctcaggatcctcgtttttatttttccacaagtactagcgtgtacgattaacctatcatcctgaattactgatgagcactagtagaaaacctactggcattgtagccagggccggtcctatgattttgagggtcctaggcgaattcatcacgatgggtcctctaagctatataaaaaattttatgatatatatagacactaattaattttacttgcaaaacaaatacatccatatattaaatcttaacatgtctggtaattatcgaaaaataaagttgatcaaatttgtaccttggaactaatatcactaccttaatgaagaatagaatcgcatcatatccattatttctcatgaaaagatacttctcgagcatttcttgatgcaaaatcatcaagaacaagtcgacgatgttgtgcgcttgtgcggttgtgccctgtgcgatgcgatgtcgtctgccgagttgccgacgacgctacaactcctatcgtctctcggacgtttctgcttccagatagacaataggcaggtactagactactagtattaggtgttggcccctccaccatcataggcccccgaccatcatgggcccccggcggtcgcctcggctgcatagccctagggccggccctgatcgtagcaaggtacactcacgaacaacagtagaggagagcaaaaaggccacgcgttttttttaagaaaaatgatgacactgaaacgcacgtatgactcgctcaccgggcttggaaaatttggagtgagcacaacaggcgtggcggacctctcagtagacctctcgcgaatacttgctacagtaaagttttccacttccctactcctctctctttcctccggcctaaggtggcttctcgccgatgaagaccgggaaaggggtcaagtccctcttctcctattgattcaggtttttcccgtggtctttttccttttggttctcgaggtggttgttggcgttggccgtccttgtcccggcatctgggtgagcgttgtcgggcttcttctcagaggcgatttactccatcgctgggactcttctcctgggtactacctagggcgcctccagatatgtacaaagagaggtatcgcctgcctacataaacatctccggcaaggtctttctaaggaaggggccttatgcttgatccctggcgacgaattttcacttggtggctaaaattttcaggttgcgccaagggggcctcaaccgggtacgcctcctgcctttttcacggtgaaatacatctggctgtgatctttggaatagttatggttttttaccgatttctctcaagaacaatggtgtaaatcttaattggtgttgctaatatttcattttgctcgtcaacgtcgtaacctccacgtgtgggaggcctcttcagggatcgagtaatggcgccacctcatgcaactcacctgatttcacactccaccggaagtgagctccaaatattttccatcggtgacgaagaccaaagaagaaggatttgattgttttttcaattctttttaagttttttttttgcaaattgttgggcaaaagtgtaatttgcccattcacaaggggcttcttttcaaaactggaagtgtcccagtagcactgtaacaactcatgtattttatgtttctaatctactttatataaataaatgcatgagttttaaaaaggaaaaaaatgactcgctcgccaggccttgttgcgatcatgctccatcttttcttttgctttcatgttcgtgatggccgttactcctattttctcagtggaattgtatttaggactggtgcagtagcatacacttatgttgagtctggacccacgtatcagccactgatcaatagcctacatcctattttatatggacattattgggagggtgggagtgggtggctgtgggtatggagggaagaatctctctcgcacagcgccacccaagttgaaagcttgggacaggtgcagccgcatgggtcgcgctctccgccactacgaaggagaggagtgatcaacctcagctacaccgttcaggtgctgcaaaaagcggcgtaacgtccctgcttcttgtactggctacgctgcaataattctgtactataaccacttgtcttagatctgataagatcgcgaggcctttatcactttgatctctggtcgtcatctgtcagcgacttttttctctctctctctcttttcatcttcttttctctcggaaagaccaggcttgatcaattcatgtgcatgtcttctttgcaggatagcggtccaggacattctgatattttagtgaacagaagaaagggccagttgcaaattttcccacacttaatgtattttgattttgcggggaaaaggtattttaagaaggcttttcatcactagttcactacaggaaaccagcagaaacatatcagacagtgaacggcacgaactagtagtagactataatatcttgtgcataagctcggcacatgattagtctttattttagtaacatgattgaggagccctctagctgtctggcatgcaaaagaactccagaaatgatggagatctgaaggaatctttcgtgctgtttttaaaatccatcaacttctgtacaaagcagaaataataaacctttttttccccctcacactttctgattgtcgacaaatttttgtcaggcagatggctgcctggccacttgtctgctctttcctgtggatcacagagtaaccgatccatgtgaaactcttcagtcctaaaatgtcgtttggtctcttgctgatggaaagtttataagctgcatctggtcgaatagctcgatgttagctgcattgatgtctcttttgttattctctttgggaagcatatgagcaacttcatacagatacgttggtattatctgttcagatcttcctcaaaatgtactactactactactatttagacgtctgcacatatgctgaagacaatagttaattctaagcattgctggtatcggcagttttcagcaaggaacacgaattagtcgctatctcaatacacaatttcccttcctcaatcccaaccccaagctgaaagcctgaaactcctggatagaactaagcaaacactgaaaagcaaacctttaaatggtccatcgcatatttcagatgtgagactagtgagcactagacttttgcgatgttttggcttcagtttggtctagcttctagcaattgcaatttcttccagaatcagaatctctcacaaacagtttagcttttaatctagattatgaaaaactgtagttatagaattcagaaaatgaattacttaaaagttagaaggtgagaaacctaaccttttcaaattctcagaaactaactaccgactagttatttctcataattttaaccttcacaaacagacccctagtacccataggccatatcgcgtgcatcaggagaagcaatgccaatgcagtgattgttaggttcgcgtcgtcgtcgtgcgtgcatgcgtgctcgcgtaaccgcgggacagatacatcgcccaaatcaagccttgtgtcttttcgccatgaccggcaaaccgacgacaaaacatgtgacgatctgtaaatatgtgtgcattgtctaacaactagtcgatcgatggtggatggttggatgccgcaacaataaccaccctaaaaagtctaggcgtcaacaaataagcgtgcctcctttctgcccggcctctcttttatttcctcatctgagaagtactgcgatgaagaacacgacgcgttactttctttttgtggctacaaaatccttagatgattggttttaaaaaatgttgtacgattgcacttttcgaaggagctagaagtacccgttgaaaatctagctggtgagactaggaaaatatgattttgatttcgagtttatttttcacattgtataactataaccttttaaaatctgaaaaaaaatctatttggaagagcttttagttataggagaacccaaacatgcctatatctgtttttcttccaaaaatctactagactttgtgaagtctgcccatccttggaaagatatctagaggtatcatattttctagtataaaattttggtacctctaggtactacgtatcttaaggtatcaaaaatttttagtataaaatttagttacctaaaaatacattttcaggactgtaaaattccactttacggaaagacattttggcccatctattattaaattactaggaaaaggagcctccacgtgcgctctcacgggctagaaattctcatattaatcggataaaaaaacagagtccatatataaatacaattttaaaatagctgaaattcgaaattaaaaaataaggaatattaaaacatgatactagagtccattccggtatacaatttagaaccaatgaaaattccgtattattttttaaaaaaagataaaagtagatgttagagttcatatagaaatacaatttagaaataactaaaattcggaattaagaaagggaatattgaaagaagagtatagagttaatatagaaatacaatttagaaatcactgaaattcggaatgaaaaaataaagaatattagaagaagagtatagagtccatctaggattacaattaagaaataaccgaaattcggaataaaagaaagaaatactagaagaagagtatagagtccatacagtaatttataattaactaaaatttagaataaaaataataaaattaaaagtagagtttagagtccatatagaaatacaattaaaaataataaaaattcaaaataaaaaaataaatattagaagaaaagcctagaggggtctagagtccacataggagtattatttagaaataactgaaattctgatttctaaaataagaaatatatgaataaattttatatgtaacaaaaaatcagaattaaaaaaatgagtattggaagatgagactaaagtcaatacaatttagaaagaactaaattcaatattaaaaataattaataactatcacgtacatacaatacaatatgaatattacatattgatagtttggtaaaattagtacaaaaatttaaattatgttatcattttaatatattgtaataataaaagaagaaaaaaatactattatagaagagaaaatatagggatgctagctaagttcaatatgaagcgtgcagagtggactagtggaaactgataaggcaaattgcgggcaataatttcaccatagtcatggcctccctttcgtcctccgtcagccaagacttcactaagttcagtagaactgtagatgagcaggaatcttgtagcctagctccttgtcaagttatccggagcggtaaattattggttaactagcactttagaagtggacaagttcggtccatctgtctcttttcgaataacttatcgcatgcaacaacaaaatgaccttcaactaaaaaaacaaacaaatgaaccgtcgccggatgtctcatcgattgacgtctcaagagtgttcttgtagaagatgctttgctctatggaaagtccgcttctgaagagaactcagctactacaagggaactcgccgtcgccggccgagtttgatttctgttggggatttggccctggtgctgggacttgggaggctggggccgtcgaattgggtcgcgtagcgtgaaggtgtgcgggccttgagccctgttgcttctccatcactgcccattgtacttgttactgggccattgtttgagtggatcagttttttggtccaaactcgagccccacagaaaaaaaaatcttcaacatttactctgactaaggacattcgtaaaatatctgcaacactcagtgtcgaagtcgactacctgtcaaactcaaatcagaaaaaaaaagatcacctatgattaaaacaaaaatcacttgagagcacgaacaaattgtgagagcacagccgcctcaaaacatgcatcattccattccaatgaaacacttcaagttgatgaagcagtacaccttccaatcccttaaccaattaaaccatgcaatgatcgatgcaacaatgcagataagtttcaaaaagcacgacgggttcgtccactcatgaagatatcaacttccactccactccactccactctacgctcactcactctcaccttcacgctcagcggcctccagaatggacgccgaaaaagtcgtagaacggaggcgcctcgctgctggggctgtccgagctctccgactcccacgagaacgacgcggacgcggacggcgtcgtcggggacacggcggcgcaggcgctcccggcgcggagcggcttgtgatccggcagcacgaaggtgggctgcagggggaacagctggagggtctcgcgcccaccggcgccgccgccgcggcggccatggccttccgcttccgccgcgccgcggccagccgccgccgcgaggtgtgcgctgctcggcggtgcctgcaggtacatggtggtggtggccggtggctgcgccgtggacttgtcgtgcggacacacttccatccctgggtacagcaacggcgtctgctgctgcgggtagtagctggcgttatttgtcgcgaccggcatgcaagcttggcgtcctgaacatcactgcaaggatcgaaagtgtgcatggatcagtgcagaacatggagtggagaattggcatttaagaattgaaatgcaaacacaaactgtagtaaaaatagaatctaataaacgcgcgcattatgatcaaatggatggtcatgctaagaacaacagatcaaacatgccaatgtcaacaacgatactcgaagctggattggatgacacgtgcaccgaccactcatgggacacattttcatgtcccaacattatgagatggaagggcagcatttcttggatgggaaaggaagcagctaaaggatgatgtggaaggttgtgtctggccgttttggccctagctaggaggatggtcatttccttctaccctcggtcatgcacagcatgacagcagcacagtgcacagaagattaatggagctacaaaagggtagcagcagaagctacataggcaggcaggcaacgttaaatcgtgtgaccatgaataggcagtctctctgttccactggcactgtatataggggggcagaggagaaaagacaggtgatacgaaacaatggaagaaatggaagaaaaaacggacggatttacagtaggagacatgaacaaggcatgcacatcgtgacagaatagtgatagctagctaagcaagcgtaatgcgattgcatgcaacgcaacgcgtgcatgcagaggataagtacaaatagacaactagcggcagtactactaccgtgttatacatcatgccgttgtgcaacaaagcggtcaaggtcaactgtgaagaatggatgttctacgccaagtatacttgtcatgccagccatgcatgtacaaaacgatttcgtatagatttattggcccatgcatgaaaaatgcaagaactgaaacgacagcacgagaactttgacctccatacgcatgaataccacgaaaaatgaatggatgccaggtgcatgacacccatgtgtaaagctaattaagcaagacatgccaaagagaagatttaatacgtgacatttaaagcacgagaaaaggtttggcttaccaccaccggcgttgcatgcggccgtcgtcgtcgtcgccggcggcggcggcggcggtggcatcgccgtcggcgccatggcgagagggaagggccgcgcgagtggcctgtggagcacgggcagcggcggcgggcggcggaacagcttgctgaagtagtcgaagctctgctgcttctgcttctgccgctgccgggccttgtggttctggaaccagtagaacacgttcttgccctcaatgtggccgtgctcccggagcctcgccgtgatctgctgtatctgctcggcggtcggcgtgcgcagcccctgccggtacagcccct

SEQ ID NO: 82251 - DNA, 668 bp, Oryza sativa
aagctctgttcacacacgttcccttggattcgataccctggaatactccgtaggggaagtgctacatcggtatatccgtgcgctgcggattttatctgtgatcgtaagaaataccaacaagcatttctggcgccgttgccggggaacggttgctgatcatttccgaacccagttcatcctcgtatcctttttcacttttttattctaccttcacccctgctatcctagagaagtattcctgtcaaactcttctcaccatggagcaatctctttttgagctgtctgctcctcagggcgaattctatgagccaactccttcatcggagcccatttatacaactggctatgaaattcgtcccgagctaatcagtatgttcagggaaaatcctttttttggctttgatctagaaaatccctaccatcatctatgagactttgaacaagtctgctcatgccttaagattcgtgtcatgagacaagaaactgtgccgtggaaattgttcccgttctctcttcaagagagagcaaagcaatggtacacctctaccgttggatgtgtaagcggtagccgggaaaagttgacagattctgccttgccttctctccagttactcgtattactgcccttcgagtagaaattctcagttttaagcagatcgaaaatgaat

SEQ ID NO: 82252 - DNA, 7940 bp, Oryza sativa
tccgcctccgccctctgccagcaagttctctttcacccatgtattttgtcttgtgttgttcatattgttccaattgttgctactgtgattgatgattctgagtcctatggtgattgagattcttgtgattttgttttgtgattgggacaactgcgatgaaacaaagaagaattgtgacaatttttttgatttgtgaatgccaaatgcaatcggtctaaatgaatgtgatggtaacctatgaggacggtgtttctctttttttttccctttttttcacaccagtgacggccccaattagttaggccatttgaggtgactctcacctgtgacgggttttggttgggaccagtcagaggtaactctcacctgtgacgggttttagttgggggccgtttgaggtggctcttacttctgacgggtcttcactcgtcacaggtgactcaagtcatcagtgaccactaatctctgacagggagctgaacccgtcaaagttgagggtttgagcccgtcagtgctgacctgatccagtgtagtgcgtggccatggccaacttggccatagatggtttaggcataggtaaggtggtggaaggagcatggtgcgttgccggccggaggagggcccatcacggctgcgggcttgcgctgtggccagggtggccgaccgcccgtccgtccgtcgcaaccttcccgaggcggaggacgacgagcactgccgctgcctctgcccccgccctgcctgcgctgtagccgagcgagcgcggcagccagtcccccctctcccccggtccaccaccgcgcgcgcaggccggccgggcagtctcagtctgatcctctgccctgcccggcctctcgctcgctcgctcactcggcgctcgctgctacagtttaaagctgacggccgcggctgcgtgctgacccacccacgtacaccagccacacacggggccgatcgctcgctcgctcggatgggctatggactgcagccgctgccccctcgctgcgacgcccacttgatcccctcaccgcgcgcagccgcggaaacgtgccgtgtttatccgcgggcgggggtagggtggtgtgactgtggaccaacatgagaaaccctggtgatgcgcgaggacggcgcatgccggcatccgtgcgagagtttgggggaaatctctgcgcggtggagcgcaaagcgcaacatcggatggaacgcaattcgtacggcgttggttgtgtgatctgtgaacctttgtgatttgtgaacctggcggaggtagcgaagctttaagccatttggagcaaaagttttcgggggactcgagcttttgacctcacgcacgggacggcaccgcatcggggccgctcgggccggcaactgcaaggctgccggatgcgtcgaccgtgcgtatgtatgtatgaacgtgtatgcgtgtgggggtgcgagcagcggcgcaggcttgtgtccggagtttgaacggtcgtctccaacaagagcactgctacggtgctctctacttgtagtattctattacaagtagaagcaatctgagccattaatttataagggcaaattagtattttactaatttatggttaagggtaatttttaacttttacttttttttcttaatagtaggatcagttcgtctgtgtcaccgctcctttcgttctcgcgtgcgcccgactccggcggcagtgcccactccggcatgtgcgagctcctccgttgaacagataatactacaaagaactactgaacaaagctatatagtcaaatcgaggagcaagagcaaatgtgctgttataaactcaccatgattatctttaaaacctatttattagtttctccacatgttgtgttttcagttcttaaagaattaagccattaacatcgctaaatttgtccaaggatggtaccgaagtatttaagttcagagtggtcatttgctcagttcagagcgatgctcaaaacaccgtaatattgattggcttcgatggcgttgaaatcgttgaattgatctgacttcttgtcgtggttcagggcttcaggctcgctagttatatgtctccttcttgggcctggcgtggaacgcatactgatctctagcatttgagccgctgggcaaggagtagcctcccgaggctgatcccccgccgtaatcccgcaacgatctcatggaagcacgccgccgatctgctcatcgcatctgctccgccacactcaccctaaacctagcacggcccaacgatgctcaagtgtttctaattgatatgcaaaattacgaattcaaccatccccgtccatattttttggacgattataccctctgacgtttctactattgctatttaagataggagtataaataaatctaacccattagatataaaacgatcaacggtttagattaatttatactccgagtggaaagcactggagtgggactcctccaacaatggaagtacgtagcagtaggagtagtttagatttcctgtggtactagttgcatctattgttgtggcttcgctggtcaaatttgctgttctacacttcataacagtagtttacgtaggagtactttactcgctctctctatatagtgcaacgaccgtcaagatatctatagttcgtagtagtactgggtttgccattcgtcaaacgatttgccttctcaaaaatggcagaaggcgaggaaaattagccccctcacacacctgacaaacccttgttgctgcaccagagcaaagaacaaaataaaacgcagagctttcatttcacggcagaggccagaagagcaacagatagtcgtaggaaattaaaaaatggggcgtcagccttgttccaacagcgaaaaccctgcataaacataggaaaacaccaagtgggtccttttttgggacgtcatggccctacgtgcacacatccagctccattatatagccatttttatgcctcttccacaggagcttctgacctcggtcactctcactctcatcagcttagctacactctctcacacagtctcactccccgtgattctgcccctctgctttagctatcttctccttcccatcgtctcggcgactgactgggtaacccttcttcacccctcgccacagtgcccatggagctctacgccgtggtgaagccgtgcaggctgtacaagaagaggagcagcagcggcggcggcggcaaggtggcgatgtgcgtgcgcagcggcggcgacggcggcgccggcaagagcaggccgtccttcacctgccggtgcgtgcggctcgtcaaggagcagcgcgcgaggttctacatcatgcgccgctgcgtcacgatgctcgtctgctggcacgagtaccaatgagagggtactcgatcgatcgatcgattcatggagggggcgagcaaatgcgatgaagctctctctctaggacttaaggaactttgtgtaaagagaatagtatcttttttccatttcttttcctcattttcctttccttttttttttcctctctgaggagtagagcgaatgagtggtgcagtaggccggccagtagcccagcatgcgtggtcgctgcactgcgcatttttatttctaattttttgatgtcatgtgagcgcatgagcatctaaatatagacggacgtactcgatcaaaatgggtgggtagttcttggattctgctggtgcagtggcgcttactctattccttctacttccgcttccggtgtttgactccctcgacgtgcgcgcgtgcgtgttggttcatcggagtgcgaagagatactcctctgaatctagatttggacggctcgccacctgccattttcctcaccctggcagaggattccattgcgtttcttgttctcctaccccaaaaaaaaaacacaccaagaaagctaccactaaaaccaccgtcactttccggtaaatccgttctcggcatcatgcaagttgcaactagtaaagcacaatccttgacagtttacgctggtgatttttaccatcgcgtagaggcagtaactcgcggtaaatctcgctgcatgcgactgaagggaggggggccaaattccgaaaggtaaaagaggggagccgttaccactagtagcattctgatgagccccctgacccggaatgaagctgtggagtgtggacactcccgaggaggagaggccccaagtgtgctgacgcatcgaattatttactcccaaaacgacgcctccgtatctgagcgcccctgtgagctgcgcgccatcaccagtaatcaaaaccctctctctctctctctctcacacacacacgcaaacacacagcttggaccttggaccaaatgggctcgcagtgtacttggctactttggtgaagtctcgcatgctccgatgctcctggcttggctacgagtatctaggagactaggactaccaacgggtggttcaacgatcgagtactctacctacttcacgggcatgcatccgcccagatttcggcctcactactatagtaggagtgtagtgtcgatcctgtttgagacagtcatgaggttatggctcatcctcatcatcatcatcatcacgaagagcggcagaagcttttttttttccttaggcagaagacagaggcagaggtcgtcagtcagtgtagattaggtatacttcgtactgaccaccagcttcgtgcgcatgcatgaatggcgaagtggtggtgtaactgacgatcgatttcgggaggtcgtcttctcttttactgttcccgggaagcacgttttctttcctacgtaggacgcggtaggagaggtgagtgagagtaggtagctgctgcaatggcgcatgcattgcagcagcgatatatgcgtgcgtacccagcatcttcggctgaagatgccagggacccatgcgtgctgcgatgctacgaacgttgcagaatcagcatgatcagtggccagtagcaagtttttttttctttttttctttctttcttttatttttggcgagcagtgtccagcgtgcagtagtaaagtggtcctatgatcctactgagatgagtgatgagtactcactacctaggtcctttgctctttgcaggtaaccggcgagtaagctaggagaggatgcacagccgcaggacccccccaccatccatgcacagtggccttcacaagctcgcagagctcagctccggctgcctgcactgcactggctgcaacatacggtttctgctcctgtcccccctctcccctccctctcttccaggacggctgctgcattcatgcccctatccagtatccggccttttgtgcttggatacttgcatgatcgatgaagcgtgtgtcacggagaggtagcaagggcagatcctttagagcaagtctaatagtatagcccactactagctataattcatctataaccgatttaatagccaattcatacaatagttgcttactacactattaatatatggtctcacctgtcatacacacagtatgtcttggagtccgtgctgcagctggctacaaatctgtagcccgctgctcttctctctcatcgtttatctcattaaaatatatttatagctggctaatagtctgctattgtacctgctcttatgtgtgtggttgcaatgattccgaccacagtgtgggtgactgttcctcttgatatcttgcatctggtaacagtggtgacaagtggacgctgatcagctacatgcatagttcagggctaatggtcctatgtagtagtatatttgtaaggcacgcagatgagaatagtaacaaaaagcataagaattgatgctagatagatttcattcggtgtttcagcgcataaaagtgtagctgaagttcgaaaagaaaacatgggcagaagatgtagttaagcttcagaatcttcagataagcaacaccatgtactatctcgttatctttacacctatgcgttatcaacacagacgtgggctgatctgatacgaactctgcacacgacttcttgactttggccaatataatccgtcactgcactgaatgcctttgcaggtgtaggtcgcccagatagtagcaaatattctctctactcgagtctcgtcatctcttatcttcagagttcgcactcttcaagaatacaccgggcaactcgccgaagaagaagcttcagcggcagaagaagaatcacccatcgagagttttcccctcccaaggaagatcagggtaattccgtatctccttcctcatggaaacgcactagttcatctttaggcccaaatcgaaaaagtttatatatggctagttcttgtgcatttttggtggtgtcactcatttcagtacttgatggagcatattattcaggaagaatattcagggaacatgattgtccatttttcatgttttgctcgtttgctgggataatctcttaggcattcaattttaaggaatcagatatcagcgtaccatgttttttcattagatcctaatagttttgtttttttgagaaaatgcattcttggatcaaatagaagaaataaaattttaaaaaaatgcataaaagtaggaagaaattggttgtggtttgcttcaactatatgctagtgggttctatgctgattttcaggatctcttcttgagataaaaacagtcatgtctgagaccatagatttaaccggagatagatgcattcttaagacagtgatcaggagagcaaaggatgatgctactgcaccttcagatagtcttcccattgttgatggtattgcagctatctacacatcttggtcttgcttcagtacacctattcttcagatttacaaaagcataaaagcttctgcttctaccttgtctacagttcactatgaaggaacacttgctgagaacggggaagtgtttgacactactcatgaagacaactccgtcttctcatttgaaattggagagggaactgtcatcaaggcatgggatatcgccgtgaaaacaatgaaggtaaatggatgaactgttcgctagttcattatgatcaatagcccaaacagttcttttgctgataatactgttgttaaattggacacctgaggttggagaggttgcaaagatcacatgcaagccagaatatgcttatggagctgcaggttcacctccagagataccgccagagtaagtctgaaaacttgatctgtcactagtaaagtctttggtttttttatgtacagagttcaaaggtaacagaaacagctctgtttttttttccacagtgcaactctcacttttgaggttgagttaatcgcatgcaggccgaggaaaggttctagtgtggaaagtgtatctgaagagaaagctaggcttgagtaagatatctgaacaatgttttcgtgcttcacaatttaagttcaagtaaagcattctattgacagcactacacgtgcaagactctgagtttgtgatgcatgctagttaattttgtctggatgcgactaactgttacatactagagtttccgatgacacctgccaaattgaaggattcagaattatcaaaacagacaaaaggggactgttctcatgtctagggttttacactttaacagggagttgaagaagcagagggagatcgctgctgcagccaaagaggaagagaagaggaaaagggaggaagcaaaagcagctgcagctgcgcgtgtacaagcaaaacttgaagcaaaaaagggcaagggaaagaaggccaaatagataatatcacactaagacaagttatgaggtaggagtatataaaaagtataaagttatgtatgaacctggtaactgtatgctgttgaaattccacacaaacacaaactttgtttggttgtagttaaaatgggccatgaatatgcatataaacaaaaagaagtcgtgtcactttgatcacagtgtgcaccagcccatttgtgcaagagttcaatgtctttagggcatgttcatgagatgcaattggt

SEQ ID NO: 82253 - DNA, 761 bp, Oryza sativa
tcctgcagcccagaaatgacaggaaccagccaattgagtcaaagaagaataggtctctcctaagatgtttactgaaaacgttaccacttaattatttttctatcaatattattcggcctaaaaaaatgtttttggattcattgaaatcagggtttaaaaaatatatttctataattatatcacatccggtcctggtggtacccaaaccacctttaaagttaacccaaacctaattaaaccttattccctttggccaaaggactctagtgataatggctgagtgccaggtaaaataaaaaatagtggaagaaattagtgcaaactctcgttaaccatattgtgaaaataatgaatgttggaaatgcacttctaatagcatagactgaaacaaacattctgaggggagtgactgtcatagtacctgccatggctttccaaactcatttaacgcttctgtcagctgttgctctgctttgttccaggtttcaatatcacctaagtacttttctggtctctgcaaaaaaaaaaaaaagagaaagatatgcaacattacaaccatgctgaggatcaagccataaccatcagttattcacatattgttccgtaggatgctgagaatttcccaacattaccagttcacaatagtgataggaaaatgggaaaacaactacctctgtccacaaatataagcatttctaggttgttcagcagatattaaggttgaggagaaagactctggtgcccctcattaaaggaggaat

SEQ ID NO: 82254 - DNA, 3427 bp, Oryza sativa
gattttgatgaattatacaactttgttgttgatgactttttcagttgaaatcatttaatatttgaaaatattgtttgaagttattataatttgaaattcaaattcaaactattcaataaatgttatatagagaaatgaccaaaataaaaattgtaaatcttgataagttatacaattttgttgttgatgacttttctatttgaaatcatttaatatttgaaattattgtttgaagttgtcatattttcaaatttgaattcaaactgttcaaaaaaaatgttatatagaaaaatgaccaaaacaaaagttatagatcttgatgggttatacaactttattgttgacaatttttccatttgaaatcatttactactcgaaaaattatttgaatttcttatattttaaaattcaaattttatatcgtgcaatcaaacccggatggagaaatgaccaaaataaaattggtagatctcaatgagttctacaactttgtttttggtagttttttcatatgagttcatttagtatcataaaattcaattcaaaatttatttttgcctagaagtctgatttgcctcctcatcatgttaatacttgctaaatatatatttgatccaattaactcggtttttctagtgaaacatgtgaaatatgtgaatggatgtgaaatatgtgatcaaaatgaatgttatgtgaatgtggttgtgttaaatatattgatggttgtgtatgtgaataaatgtataacttcttctccggaaaccgatcaccaaagaactttgaggttaagcgctcttagggtggagcaattttgggatgagtgaccgatcgggaagaaaagaccggcccgcggtcaccaaagaactttgaggttaagcgctcttagggtggagcaatttcgggatgagtgaccgatcgggaagaaaagaccggcccgcggtcgtgcctagtaaaggcttgagaatagctaaaaaaagaccaaaatttatttatcttttttggattatactcatccgtgacgggctataatttaggcccgattgagatgagagtcatccgtggcgggctataatttaggcccgattgagatgagaggcatccgtgacgtgctatagtttaggcccgattgagatgatagtcatccgtgacgggctatagtgttggcccgattgagatgtatgtcatccgtgacggccgcatgcccgattgagatattttctcatattagtgacatttgcttagtgacgggggcactacccgatagagatgaggctttaggcccgttacagatgaccgaacctgttccagtgttttaaaggtaaacattaattctcaccattaatatttgttctgatcgatcgataatgacccgccaaatcttctcaaccatgcaacagtgcaacacatatatatagcttcaattaattccaactgtacgcatatctctgctgcatttgtttgtttcagagttatataaattataccatgacctttcaattaattcaagctacgaccaagcaagaataaatatagataaattacacttatgatatacaaaattatatggtggatataaataaatatagcaacttataaatttaaacattcatttatgtacaatataataacatgtttagtccatgcaaacatatgtagattcaaacatatagctcgtagaggactcacatgtttattttgagatagagaaagtacgtgccgcgctagaaatttgtagtattttttgtagaaaaagaaaaattccaatcttgcatctcccattactctgcctttctgacttgtcatagggtagcacaaactaattgcatgaagagcaaaatcgtgatcaccggctggaacagtggaaccacactggaaatttgtattttgtagacaaaaaaaattcaatcttgcctctcccattactgggtcgtccttacttgtcataaaggaagatgcacttatagcagtgcagtggcaagggttagtgcgtggtttcaatcctgaaatctagagttcaatccccaatatgctcataatattttcttaaaataatgtttagaatgatgtctctttctctaaatctcctttcttttgtacttgtcacaatagaagcccagattgattgcatgaagagcaaagttgcggtcactggtggaaaccacactggaactgctaggctgctagctagcatggagccatggagttttacttggcaactaattttccacacctaatcttaaggaagtcataattttaatagatagtgtttggttcctgccacaactctactttatcctcaaccctagttaaaaatgtatgacaacattagtcctcgagcccaaattctccgatcaaaaatagccattgaaaaatacagggaccttaaatacttagataaagttacattgcaactttgcaagttacgggtttttttttctgcaaaataacaattaattagtactatcctgctagcatgggttggaacgtacaagcgtgttatagagagcgtcttgtaagatcatattcacttgagtggtcggtttaaactaagttagtacggactaagcaagttgtcacatcgcagaaagtgtttcgttgcacttatttgtatccaccttaagtttaattttactcaaggaagaattaatgtgttttaattgctggaaaatataacaggcagataaacataagaaggtgtccatcttaaagaaacaagagtacttgatcaactttgtttttttaaaaaagcatatataaatgctaattaaggcactgttaacttgaattaaacatctacagctataggatagtgctatcacacaagcaaagctcggcagctctaagtggtagcattcatcagtgggccaatataattataatttgcagtgggccatggaccatattttatatcggcttcaatcctattaccaatattggacgggccaatcctagcccatcaaaagccaatcctagttttcaaaaggaataagttcacctaccttcccttaactttacatcgattttatgacatcctcaatccccaataccagaaatgtctaccccttaaatatttgaaaccgtgcaaaataggttccatggcagtatatatgggtggtttcgctgacgtggcttcctaattagcaaagagggaataaaaattgtagggcccatatatcatcctcactccaattctcttctctgtatcctctatcagccaggagcagggcaagcggggtggtgtcgggcggagcagccatgcatgaagcaggcaggaggaacgacgatagccggagaagacagcgggcggagcggggtggcggcggtggggtatagaggagacccgggcaacacgccttctaccatggtgagctcgaaacgcaggcagcatagctccttgaaggagcggagcacctccgaggatgatggc

SEQ ID NO: 82255 - DNA, 6670 bp, Oryza sativa
tctcatacggactcgaaatcaggcaaataatatatgcacggacatctacagaaaaagttacatccaattctcccccgctttgccgggttcggcgatattaaaaactccaaattccacttgcaagattgtgttttcgaggagagaagtttttcggtggagctttggaaaattccatatgccacatatttcgtccgtttgagtttattttttacatggttggttcctatgagttcctaagtgtgaaaaaaatatcaaaaaaataaaataaaaataaaaaagttgcacatctctctcctctgcactagttcggagagaggagaggagaggaaaaattctacatgtcacatattacgttcatttgagttcaatttttctatggttggttcttgtgtgtccctaagcgtgaaaaaaatatcaaacaaataaaacaaaaataaaaaatttcaggggggggcgccagccactctggcgcactccccctagccacctcagcatcgccccgccacgtcagcagggggacggcgccaaagaggctgacgccgtcctgttgaacgacggcgccagccactctggcgccccaaaaaggaccatttttgggataagtttttctaagggtctacttgcgaaataagtttttcaaaaggaccaaaatgtgaaaaatccaggactttcaacatcagatggactatgcttcaggacatgacactattagctagttcctagcaagcttgctgcttgtatgcaggacttgtgagaagctccgtaggagccacactgttagggaccggcgtcgtccccgccactccggtcagatgggatccagcccaagccactaacctgtactcttttagacctaggttaatgggctttgtgctgtatcttgagacctcgaagaatataggaaaaagtacatcgaaggtccctcaatttatcattgggataaaaaaaacatcctcgaaccgtaaaaccaaatgagaaaaactatataacgggatcccgtcacacgggatcaagtctcaaatcgtgtcgtgacacaaacagctctatggcctttaggcccgcctccgtttccgctctctcgaagtatatgcgtctggtacatatgccgcagtagggtcatgcatagtggggtccatgcacttagtgaatatgtgcatgcatgcacaatggcaggcccaacaaccagtcaagtcctcttgtatgacagcatagaagaactaggcttttcctgggatccgcgtgtgcagctggtaaccggtgaaccagtgcatgcatcatcaaaagtacaagtacatataactagagtatatttatactttagaagtatcaccatcgatagttacatctatcatattttttatttaggccggtatcattataagtgcctaaaagtatcaacacctcaacttaggaggtatcaccattagcaactgcattgctatttgtggtaccatcaaaaaactctaatgatacctggtacctatatgatatcaaataaaacccggtacgatggtacctatgaatcagagttggtatcttattttttatttaggcaggtatcatcataagtgcctacaagtatcaacacctcagcttaggaggtatcaccactagaacctgcattgtcatttgtgataccatcacaaaaattctaatgatacctggtacctatatgatatcagataaaacccggtacaatggtacctatgaatcagagttggtatcatattttttatttaggcaggtatcatcataagtgcctacaagtatcaacacctgtcacgtcccaaaacgactctaaaatacatcctctaaatgatgcctagaataattaaaatccgtatgaaagcctccaaaaattaaaatgtgcaaagttaaaagtcaaataaggcttggaggatttttgaatatttcctaaaagcctaaaatgtgtaaataaattttagtggaattttcagagcacaaataataattaagaagaaataaacaaagttaaaatgattttataaaaagaaaaaccctaaaatccctccttctctctgatgggccgaattcggcccatctccctctctctcctctccccgcggaccattcggcctccctccccgcgggcgcgccgctgacgggcgggcccgcccgccaccctcgctgacgggtggggcccacccgtcatccctgacctcccgccgctcccgccgcctcgcccgtgccctagcgccgccgctgccgcgaatcccgccgcctcccgtcgtccccgcgtgcaataaagtggggggaaatattccccgtgatcccgtcttcctttccccccatttttccctctctctctcgcattcaaacggacggatttgcccccgcaaatctcgccggcgccattgatggcggccggacctcccgcgcctattccttcccctccggccgccctctcccccttccaaccctatataaaccctccccgtgcctcctccgtccgtttccgcctctcgccgcccttcctcctcgccggattcgagctcgcgacgtcgccctctctctccaccgttgccgccgagctccggtccgccgccgtcgccgccccggaccgtctcccgccccggcgtctcctcctccggcttcgccgcaccgccggcgaccccgtccaccccctcgccgagtccgccaaccgccggaacgccgaccctgtcgacccgagccgcgccggcgccttcctccgctccggccgcctttttcgtcgtcgccgtcgacctagggtgagccgtggaccgccgcctcttttcccccattccttcccctctctcggccgccgctccgccgtgcctatggccgccgccggtgaccatcggggcgcgggcgccgccgccacccgccggccgcgccgccgtggccgccttcgggcgcaccgagcggctgacgcgtggggcccacggcgccggccggtgcgagcccaggtgcgcccggtccaccgtggaccgtgaggctgccgcgtgggccccactcccgtggacccggtccgcgcgccccctccccctcggctgacgcaataaactttttttttaaattaaaatttaaatgaagaaattcgtaaatattcacttaaagagcatataaacttcaaatagccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattatgttgctttaaattattgcattatcgctttatttaaattcccgcgttatcactgttttatctagccatgcctatttagctttgttatgaccttattattgttattgttattatttccttgttcaccctagaataaacaaaaccccaactagtggacactctactcatggtaccactagtatgattttaggtagatgcttcgctatttaattaggtaacattaggtggttttacaactctagactttgggatattctcatcacctggacactatggaattgttggattattgtggaattggattcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtccgtataccgtgatggtatgtggcatgtggttacacgtgaggaagatgtgtcttgtgggtaaagttgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatcttgtatagctctaggatcgtatttacaaaatagctttgagcaactaagtgtcttttaatgctgtttactgcaaaccctaaccccccataatatgggtgtgtcttgttgagtacggtggttgtactcagtcttgctcaatttttcccaaacccagaagaggagcccctggatgttgaaggctttggtgtctagctcgtgcctgccatcaagcgcctgtggtcgtcgccctagtcttccgctgtttcccgtttgtctttgtgtgtgctgggccttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacaacacctcagcttaggaggtataaccactagcaactgcattgttatttgtgataccatcacaaaaactctaataatacctagtacctatatgatatcagataaaacccagtacaatggtacctatgaatcagagttggtatcattttttttatttaggcaggtatcaacataagtgcctacaagtatcaacacctcagcttaggaggtatcaccactagcaactacattgctatttgtgataccatcacaaaaactctaatgatacctatacctatatggtatcagataaaacccggtacgatggtacctatgaattagagttggtatcatatttttttatttaggcaggtctcatcataagtgcctacaagtatcatcacctcagcttaggaggtatcacagctagcaactgcattgctatttgtgataccatcacaaaaactctaatgatacctggtacctatatggtatcagataagactcgatacaatggtacctgacggagcgtggggctcctcaccgggagaccgcgcaggcccccctttgccggttcggccggggaccctgggtgaggttctaagctcttggtttgaggaaggttcgcgagagtggaagaagcacacaagacacgggcgatgtatacaggttcgggccgctgagaagcgtaataccctacaaagtgttttggtggatctgtgtatgaagaagctacaaagtgcgaaccagccccgatcgctctgggatcgttcggtccttttttttttttctctcgtccgatccccctctctaagtgggcaaggtcctccttttatatcccaaggggataccacatgcaccatctctctcttttgtgtggggacttatcctatcttttcataaatggacggagatttgtatggttgccgtctgaatgaccttctgatgggacggcccatacctacctccacttccgccggaaacaggcgcgacgtgggaacatggctgtctgctgacgacatgaccagtgtcagaccggtctcaaatcggtcattcttgtccaccacgcgtcagtttatcaatctgcatgttcgcccttcttcatacaatatcttgcttgtaatggttaggatgaagcctggcatatatctgaccgggacccacgtgccatctccaggaggtaacacgccggctccggctagggacgagtgcttggaagctctcatcttgacgggatggggcgaggcgtgtgtcagaccgcctgtcgccacctaatccacgatctgatcggtctgtgactggtcacagaccggataaacgagcgcgctgcactgcgttacatgcggcgtgacgcgcttgaccaaaccgcaataaatgcggttaggtgagccccgctgcgcttgcctaacccagacacgcggcgcaaaacccccaaggggtcggggcgcctcagccctcggggccgaaacgggagcggtccgacccctcggggagacataaaggggggcggccacatcaccctcgggcccgacccccccgagggggtcaggcctcgtgggtgattgctcctgcccaagcctctagtcatgatactcccggtcccatgtcaccgacagtacctatgaaccagagttggtaccaataggtatcggactcgatagtctaatactgataagtatcagatctaatacacatatctatgagatttggtaccattaaagtatgtgaattagtacccattagtacccatatagttagattagatctgatacatcgatatcatccctggtaccaatggtatcggattggtagttctagtactttagggtaccagttcctagtaccgttagctttgccacctattt

SEQ ID NO: 82256 - DNA, 1205 bp, Oryza sativa
ggatattgcattaataaagacttcatctaattcataacaactcaatgttgtaaactgattggcgtactgcttagctgttaatactaatgactaaaagtatatctccttcggacttgtctcaagtgcccttaggggagtttgtttaaaacatactcaacgtttgtttaaaatatagctcactcagtaagaagcttctttcatccttgcaattgttcttgagttattttttttagataatggatttatattaaacccggcctctacacttgtgagggtgtatacagccaaacaagtttccaagagtacataagactcatccagttatatgggagacaacacaaggtacgaagtttacataagactcatcccgatacatgggcaacatcacataaagataaaacccaaaataagaatcaagaaagctaagctttaattcttcttctaaaattccagccataagtagcataaaactccattacccgtgactccaaaattctacaatgaacttggacggcatctccatcgtcctctttaagaagcaaggaccaaagtcttgcccaatgagcccccctgaagattacctgcatgaaagaaataggattggagccattaaagactacatcattcctactaagccacaaagcccacaaaattgccgcaatgcccatataaatttgtcttttaagtctaggttcaaaaccattcaaccaatttccaaacatatgagccatgctacggggttggctaattccgaaagtaaagaaacatgcactccaaatgtaccttgccatgagacagtcaaagaaaagatggtgcatcgactctttagagttacaaaagcagcaacttagactacctctccatcttctcttagctaggttatcctttgttagaataaccccttctttaagataccacaagaatattttaatttcagtggaattctgagcttccaaatcaaagtctttctaggtatcactccattatacataagcaccttgtacatggagttaaccataaagagctcatccttgtttgctttccaaataaattgatccttttgatcagacatagtgacattcactgctttggaaactaaattataccaatcttgcaaatttcttccagttattgctcttctaaaggccaccttcaacggagttcttcccaaaacctctgccactactgcattcttattcctaacc

SEQ ID NO: 82257 - DNA, 8621 bp, Oryza sativa
gggggcgttcttgaccaacccggccctgccccgccccgttgccatccctaatctcgcggctgcatttgtttgtttcagagctactaaaaaagatttcacgcgctacgccgcgtggatacagaagcaggttagcaggctgactatgcttatgtttatggacttatcagccaaaatttaaatttgaagtttttttctttaagaattacacagtacaacacaaacactcacaacacatactcacccttatgaacgcacgcacgtaaaccctacccctatgagcatcctcacacctatgaacgcatacacgtaaaccctacccctatgagcatcttcgaagactgtgctggcaaatccatcttggagattgacaaagtcaccacgggcgcctcgttgtcgactgttacgttgcctaccactgaaagcacaaagccgttaaatcctggaaaattcgcttccacggggagtcgaacccagaatctaaggtgctactaaggctcttataaccactagattttggacttatcagccaaaaattaaatttggagtttggttttgggatttttttttaacgaagtttatttttttcagcctttgtttttaaatcgctaagaacacacatataaaagttttattcataaattattttttatgcaaatataccgtttggcttatttgaggaataagccagatatggtgagaacggacaaggattttctacacctaggtgctatggcacccatcattcgcatgcgacttaaatagttgtagaaaaaaattaaaaaaatagtaagattgtttgtgatgatataagtatatacacaaacatgcaggactaaatttgatctacaactaaagaaacaaaaataataaaattaaacactgaatagtgcccgtatagtgcagataaaatttgttatttttgtgtcttcatatattgattgaatttagacttgtatgtttgtgtagtgtcttatattatcatagtctatcttatcaaattttatgaaatttttatacaactgtttaagttacatgcatacacctaggtgccatggcacctaggtgtaagaaagtggtacctagatgtagaaaatactttccgtggtgagaactaattggagtgaaaagatttgttagtggcacacaactgaaaattgcataaagcaaggatagcctcatccgctggaaccacactggaactactagcgtggagtaaatttgcaaagcaaaattagccactggaaaatatagggacctttaaatataaaactacaagttacgggttctgcagaaaaagaacaatttgtactatcctgcttttttttttagaatatttgtactatcctgctagcatgggttggaatcttggaatcataagaaagctagcgtcatctaattaatcatttcgctggtagtggccggttttaattaaccaagtttggactaaccaagtttgcagagtaatactaagtgttttgtatgttattgcatctatttgtatccacccgtaaactcattcacgatgagtgcaatttactcgatcaagaattaatttgtaatatttaagagtagtgtccatatatagcaggaattctgggaaaatataacgtactgataatttaagaagatatgtgttaatcctatcttactataaagttaatgtcccctaactcctaaagctcaacatgcaaacatgtcacccactagtaataattacatatttaatctcatgcaaacatacaaaatcatttataatttatttaattctacaaatcaacatgcaagtatatctctaatcgttattcctcacatcatttccataatattttaacaaatatatctatcatttataatatttaacatatacatgttccatgttaaatcgtgggtatcatttgtttgttttatgataagtcctgctaaaccctcacgttttattatttttttttctttttaatactagctcgataatcgaaaaaaatattgaaaattaattagtaattcccgcagcaaaacgcgaggatcacctagtattttagaaacgagagtattttatcagctttatgttttgacgttgggaggtatttggatccagggactaaactttagtccatgtcatatcggatgtttggacactaatttgaagtattaaacatcgactacttacaaaactaattacataattgagagctaatttgcgtgataaattttttaaacctaattaatccataattagcacatgttttactgtagcatcacataagctaatcatggattaattaggctcaatagattcgtctcacgaattagtccagagttatggattgtattttagcaatagtctatatttaatacttctaattagtgtctaaacatccgaccagggtttagtcccatccaaaccaattaattccgttttatcccttacctgaactgggatcgttatcgatgacgtggtgtcaacatatacagagtcaagagtagtgatgacatcaggataacaatcaatataaatagatagaagcaaaataaagaaataaaatactacaacctacgtgtcaaccttacttcattttcacatggtgaggactcagtataatgtacatatatacatcaacacagtaacaatataacatatatatatatatatatatatatatatatatatatatatacatgcatgatctccattttggtgtgcatggcagcagcatccgtgagatgcacaagcgaaatagacagaagttgagatggtgagttaagatcaaggttaattgacgtcctgaatttgcgtgggttgagctaatttaccgttttcatgggcagatagtcggctagtgagctggtgggctgaaaattcggattatttgctaaacggttcatcgaatgatatgttcgaaataccgcgaataacttatatccaccgatttttttgcaataccacatctgatccacacctgcaccatacaattcgcatccgagggatttaaacaaacatataccatatcttgctccaaccaaattctgagagtatcggatcagaagctatcacatcagttttcaccgctaatatctagacggaggagtatatataaccactaaataagcacatactatgtatactccttagaattagtgaacactagttttaaacatatatatatatatatatatatatatatatatatatagtactcccttcgtattttaatgtatgatgccgttgactttttaatcaacgtttgaccattcgtcttattcaaaaaatttatgttattatcatttattttatcgtgacttgatttatcatcaaatgttctttaaacatgatataaatatttttatatttacacaaaaaatttggataagacaaatattcaaacgttaattaaaaagtcaacggcgtcatatattaaaatatggagggagcagtactttaacgaccctggtgagtttgggtgtacaacgaccgaacctactatccatccagtcataacccagctgctttcttatgaaagtgctactagctagtagacatagatcttgttatcaccattttgaacagttggatcaggctataatatctcacaccatccgttggagatgtgtgattccgacgatagaaaatgatttattatctgtttttatgttcattcttctccctttatcaattttaatatataatatttttcacatttccgtagaatcaatttcagggtatcattcttccttgtgaacaatcaagtaatagaatggccacgagtattacacagatgcggataggatttcaatatgactttagtgacatcagggatgtgctgttggttttcgtctcttggaacatgtgttagaggacgcattcgcggaggtacgagtgtggtgttgtttgtatagtggtgtgtatgtgtgtaaagctgtcatgtaaattaaaaataataataaagtgcagagctagggagcatgatatgcatttaccaatttttgcatatgacatactctccgtccaaaaaaacgaacataagactggatgtgacatattctagtacaataaatctaaatatacgtatgtacgtattgtagtaatagaatatatgtgtcatatttagtatattaggtttattttttatgggacggagggagtagaggggacaggggaataatgtaacaaggaaattactacagattgcctcagcaacaagaagctggagtacgtagctagctaggtccaagtctggacaagatgcaattcatcaacgtaggattacacgtacacagagcagtgtacagactcaagaaaattaagatagcatgctgatgcacgcacggagcgtgcaacataaagtatacagagatacagagagagatgaccagcgctgaatgatatgccccagctgttatttttactgtagctattattttggctagttgatcaactgcgagccagcatcgatcgatatatcgatcggtcggtctacgcaggattaatcgatctagctgaccctgcaccaatgaaataatcatgcatatatacagtggattagtcagtaaattaagttgaattaacctgaaaaaagtaacatgcatggatgatagtatatatttttacttgctgcagtcagtggagaggctgatggggaagccgacgttgacgccgcacttgccggggatgccggcggcggcgccgaggttgagagacttgatggtgccggcgagggtcttgaggcaccggcaggcggcctggcggtcagcggtggtgcgggcggcgttgttcagccccttgacgccgttgcagcatccctgggtgaggccacccctccccgtcacgtaagagatgcacggcgcgatcgccgaccccacctgcccgcacgttatcgccgccgacgcccccggcgccgccaccaccatcgccatcaccatcacggcggccaccgccttgaagttcaaagccgccatatctatctagactgatggatgatcgatcgagtagctaggtaagcttcgttcagtcagcgtctcctcgtcgccggcgatggatggatcgtcggtcgatgggtggagggtacgtataaataggaaaggcaacaggagatgcggccacgtgctatgatagaatcatccattgatggcagtcgctctgctaagtcgttgggagttggactccatcgagctagtagctagtactagagtcttctcaatctcaatgacgtactacaacaacatgtgttccgttagattaagtttgataatagtgtggctaaatgctagcttaaaaatcctatatctaatctaatagcatcattaaagtgttggaatggtaattaaggtgttgtttttttaaaagaaaataagactgtccatcatcttttcttggagtgtctctatacaaaattctttggagagcattgcaattttcttctggttcatccattccacatagtatatcatattttttaaaaatagctcgtggaggttgataaaaaaactcattcttataagagcatctgttttatgttgagcctatgatacggttgagcaaaaatgatatggtttttaataacactatctagatcatatttacatgtgcttttcagcgtaacatattggctctgatcatgtaatgaagacactaagttaataaaagttgcacattgcaaactggagtcaacgtttatgcaacttttcacaaattttggttggaagttcacaaacaatattcaataagtttgtactttattttttttcaattggtgttagtgccggtgtgtggctatgtcagtttggatgtgtcccttatgtctttatgtattcttttgaggtgtgattgtgtttggaatttttttaaataattagctctatgagcaaagaccgggattctattctattatcttaaaataatagcatcattaatacttgatctattgctcatatgcacgtaatatcttaaaacccgtgttaaagcttactataaatttgtaggaggattttcttctttttttttaatacgtgcttatagtttgcttataaattgttattgtacttgctctcagtgttctatcagtatcggaagatttattaatcatgggcgagtagtaatcactgctactatacttgcttctaactctatagcgcattcattttctaattgaggcaattaattattttttgaacattatttttttttccgctaataattaatatatcgagctttcttttggttcaactgataattgttgagctacaattatatatatttagctaggaaaattaagttgctgggatagtctctcggttttgtaatataaggttttattgacttttaaatattatgtttgattgttttatttaaaaatttagtgtgaatatgaataaataaatccataataaagtaacctttagtgtaaaagtttttttaaaagtaaatgatgataatatataaaggtttttcaggaaacaaatgtctaacaatattttcaaaagttaaccgtaccatatatttaattaaaaatggagattagtagtactcccttctcaaattgatcatcatacaatggaatttaaaatttctcaaattgatcatcatataaccgcatgaacacggatttcattataatataattaatgcagcatatgagaatgtgtgcatgttaaggtgtaattggcatggtgttaaatcaatgtgtgcattgtgagagaatgtgtacatggtgtcttgattgatgctatttaaattatactatttgatcttgctatataaacatatactccctccattccaaaatatacgacataatcacccctaacccaaagatcaagaaataattattatcatcttatagtttggatcatcctaataaatacaatacatgcatccaatagaattagaggacatgagagtggaggatttaaaaaaagtaataatttaatggagaatggtcatagttaattggctatatgcatgcatgccttatattatggaacatctaaaaaaagtggttgcgtcttatacttcctccgttctaaaatataaggcacaactacccttaacccaaagaccaagaaataattattattatttcctagtttgaatcaccctaataaatatgatgcatacatccaataaaattagagatcttgagggtggaggatttaaaaaagtaataatttaatggagaagaggtcctaattaattatatgcatgtatgcatgtcttatattatggagcatctaaaaaaagtagttgtgtcattatggaagggagggagtattatataatggagggagtatgatgattatttttgtaagaagggagtacactgcaacgtgtatggaagcgatcgtgtgtgtgcggttactctgccggttccctcagggtgctgtacctctacagccatcagaaatggactgtcgatctgtcttctcatgcgacgactcatgatcagtcaacacgatgtctgcgtgccaagcaaaatttgccccactgcaatcatgataaatagtttgtgtctaggatttaggattttaccggcgtcgatcgacggttatcctgttacagccaatcaacaatctggccagcaggtcttcagctgatcttcaatcacttcattaaatatcgctaatagtgatagctttaattttttctgttgaaaagtcattgttgtaataatgtagccccgctcgatcgctcctcgcgagatcgtacgttgaacacgtatttggagaagtaacatttgtagttttccaaaaataattataagctgatactatttttttttcaaaaatactatatatatttagggtcatatagcaggtggcatgtattggatttgtattactttcaattaattgatttcgtggttagtgacaatatatttaaaaattttaattattaaagttggaatttcaaatttggaaactgtatcaaaaggctatatacacaccttctatctttttcagcgcggaggaaaaatgtacatagttttcgtagtagcaggacatttcactagtacagaacctttcatctgtgacggcctctaacatgtttggaattagcgaccgtcacaaggaagccatctcaatcgggccgaaaaagcgcccgattgagataactcaggcccgtcacggatgacacatattagtgacatgagttttatgcccatctaacatgtctgtgcgaccatatctcaacaactaggcccgattgagatgacttagtattttttttttcattttacatatgaaatgtttatatttgtaagttgacatagcaaagtaattaaatgcagtataataatttattttatttgtcaaaataatttttcgggtagtaaatgatttcaaatggaaaaattttcaacaacaaagttgtataacttatcgatatttacaatttttattttggtcatttttctatataactttttttaactgtttgaatttgaatttgaaaatataacaacttcaaataatattttcaaatactaaatgatttcaaatggaaaagtcatcaacaataaagttgtataactcatcaagatctataacttttattttggtcatttttctatataactttttttaacggtttgaatttgaatttaaaaatatgattacttcaaaacaac

SEQ ID NO: 82258 - DNA, 19995 bp, Oryza sativa
gccgccgccagatctcccttcatgcatctcgatctctccgatctcgatctctctctgtcgcgccgcccgccacgagacgccgcgccacgacgacgacgcgccacgccgccgccttcgacgccgcgcaacgccgccgccgcatgccaacgccacgccgccgccgccgtcgccacgccgccgccgccttcgccgccgtgcgcgcaatgccgccgccgccacgccacgccgccgccgccacgccacaccacgccaccgccgccacgccacgccgccgccgccacggccccacaacgccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgagaacgatcgaacgaacgtgaacgagcgaacgaacgaggacgaacgttaacgtgaaatgcaatatatatatatatatatatatatatatatatatatatgttacttcgcatttatcctaatacattttttttatcttgcagaaaagacgtgttgtcggagtcgtccgtcaagcctgagtggaagagctagccctagaaggaattggagcagacaagtgacgtaataatataaatgattgttatatttgtaatgcaattaattaagattattagacctgtaattagacttatcacgtaaggttgcgtagggttctaatgtacaacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgacaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgtatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattactttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggacgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatccttcctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggccccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagtctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctatgaactataccagctggacgccctcgacgtctctattatgagttgctggattttgtaagtatatcgttcagttagatttcttactatacgtctcctttaattaattaggtccttgtatataagtagaccatagaaaataatatacccccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaaatcttgttaagttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacatgtgcgagtattgccactgccttgcagaccaaatcatcaccacaagagagctcgatgtacgtacaaataaattcaaattttcattacgtagcgatttcttgtttaattactaattaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatggtttatatatatatatatatatataaaccatgcagcaacaggggcatgcaaaaaaaaaaaggtcacgatctttagtcccggttggtaacaccaccgggactaaagattgctcagcctttcacccgagactaaagatagcgatctttagtcccggttggtactcccggtttggaaaccgggactaaaggggggttaggaaccgggactacaaagggtttctccaccagtgatatatatatatatatatatatatatatatatatatatatatatatatatatatatatatatatatatatatatatatatatatatatatatatatatatatatatatatatatatatatatatatatatatatatatatatatatatatacatatatatatatatatatacgtatatatatatacgtatatacatatatatatatatacatatatatatatatatatacatatatatatgtatggttgttttgtactcccgggagtacatacaccctcccctgacagtggatcatccaataggatccaatttaccggattgaacaaaaaaatgattaataaataaatgatgtaattaacaatcggggatgcatgcatgcaactaataatttgaaaattagtctgcctgttgcatgcaaagtagttacgtttgcattacacctttttttacttcataatattcggtatatatgtaccacgaccaacgttgaaaatgccttttcttttttagtatccggtatatactgtgtgtttatgtgtatgatttagtatgtacaccgtattacattttttgttgttggactgtatgcatttttttaatatccagtatgtatatacttgatcttttttagtatggcatatacttttttatgttagtaacagtatatacctttttaaattaggagagcagtatatactttttttaatccggtatatactggactagatcatgtactggttggttgtaggactacgtaccgctttaatttctttgtaggattcactatatattagaccaaatactgtttttttaggtacgatagctcttccttttttcagggagagtagtagtctttaagtagcagtgcatgctattttattttagtaagtcagtaggagtacatactgtttttaaacttagttgaagtatatacttgttttaacttagtataagtatataacttcttttaattagtaccagtatatgctacatacttttcaattactagtatatactttttatgagtatatactgttcttaaacttaattagtagccgtacatatgtttttatagtaagttaattagtaggagtgcacactgtttttaaacttagtagcagtatataccttttttaacttagtaacagtacatacctatttttcaacttagtaccagtatatagtttttgatgaatatattttttgaacaaacataaagatgtttgataaggaaaaaaatcaaaacaacttataatatgaaatgaagggagtagtataggtattttttttccacgtaatagtacgtaccatttttgtcttatagaatagaacaatacgtaaatttagtatgtgtagggttgctaattttgaataaactgtatcagtcaatgattgataaagaagtgtcgtcaatcattggcaaagtatcgggttgctgcattctgaataaagctaaatgaatgaaatacgctagaagtgcactgaattctgaatagacaattctacatgcaggctaacaaatcggttagcatcgatgggatcacgccaaacacgcgccggagagggaaacgagtattaatgtgccagcttgctggatcaacggaatcacggactcagcgccgtcgccagacgaccatacatgctggagtgttctgttgtcagcaccatctatgcccacgatagatgtgtctcgcatctgcatgcaccaaacaaatgcattcatcataggcttaatcattctatatatcaacgtcatacttcatgtctgcatcctcgtctgcaaacaataacagagatatacccaatagaaaaaggaagattatgtattatcattctacaggaaaaaattaatcaaacaaaactggaagaagaaagaaagggcttgccttgatcgttgcacgggcgctaaggtcaccggcgctagtttcgatcggtcagccaaggtgaagccaccgccccctccgcgtagacagcgtcaccgcacgggcagacggctagataggaagagccgatggatcgatgccgtgataccgtcgccacaagggtcggcaccgcctgggaacgccatgttgctgcagatgaatattgtcgccacatcccagcaaatcaccgatggatgttgccgccggcgtggttgctcgatccccaatggatcgtgctgtacctccgcttcgagtcgccagtagctagcgctcgatccgaatacagcggagagagcgagctgttaccatcgcggatgggatgggaaccaagggatttatacgacctgttcagaaccgattagtgcgggataattaaacattaggagaatattctttaaaaaaatggaaacgggtccggtgagtgcatccgctaacatggttgatcgtgggtggctactgatcaacggtggatgggagcaggtgtacgtactcctgggaatatagaaccattttcatatatatatatatatacacacacgtacgagttgaacatagctcaactggttaattagattcattgtggtggaacctcatcacttggacaaccggcttcaagctctaaaaaattgggcggatgcttgcattcatctaattgtcttcgttggtgcttataaagatattatgtgtatatgtttacagtggtgagtgtgcgtattttatgtgtataccgtatttgggggaaaacaccacgtatatttctatatggccataagtaaaaatttatttattgaatgtaacttcttatttaatttagctcatacagtttgcgcagataatttaatttggtttggtgaaagctgacgtctgtgacacttttgtctatgcatatatggttggcactcagctgtgctgttaagagttaaaaagtggcaggctggacctaggaacagtacattatctaacatgttttaggataattctcaccacatgtacagtgccatcgatggcaaaggctgacctgatgtaaaagacacccttttgcaaagccagacatgattccttgtcttttggacacatctgatcggttgatccccttaacttgaatcatcagtaccataatgttcacatttgttggcaaactactcgcactagaatatgcatgaatggctgcaaacttgcaaactttgtgatgatctgcaaactagaatatgcaaatcatcacgaagtatggctggatcgatcgatctgttgatcaaaattgctccaaatcttcgcaggcagcagtgtaaatggtaaatgtgcgggatgcacagatatatattagtggtgaattttcgaatcagagttttgaaataatatttaaattctaacaaggagtttggctgtacaccactactcttattttgttgtatgcacaacacatctgatattctgatgaatgaaatatctgtcaatggctcaatgggcgacaaggaaattaatttgacacatttcaagccgaaaaataggcgcacattgagtttctctattttttttcttgttttaagaaacagggacatacacatggtgacatggatgtacacaggacgcatgagtgcatgacacggttataagagcaagtttaataatatagccaaccgctggctacaaatcatctatagtcaacttaatagccaattcatacaataattacatataagcatatatactacaaaatcaatatctggtgtcatacacatgtgcgtcttggagtccgtgctgcaactggctacaaatatgtagcccgttgctcttatctctcctcttttatccacttaaaatatgtttatagctagcttatagtctgctattgtacctgctctaaagaggtaactgagacatgaagtgcttgctagcccaaagataaaacactaagggggtatcctagggacttattttttttttgagagaaggattaaagtttagtccctctctcccaaatacccccaagatgagtactcaattatggagaagacatatatacacatgggatggagaaaaagagggagagcatgtagctagagctatgtatatatacaaatacaaagtttatagctaggatttgagaatttttttaaagggagggagtacactatagcggggacatggcgtgcacgaatgcatatgcacatgcagctagctccatcccccatccgtgcagaggataacgaaacaaccatcagttagcctagcacgcatgtgcatgtgcatccatcgatcgatggatgatggatcaatcgagctactcgctagctagctagcacccactttcgtcaagcgctccgcgtccatctcgcactccttctcgcgcgcgcacgcacgcacggtcggcctagctattcaccaccaccttttccacagtagtagtgcactttgctcgatcgcgagatggagctggctagcgccatcataccattgccatgcatgatgcacatctctctctgccttttttttttcttggtgtgttggttgcatgcatggccaccgtaccaccctgcctaggctgctcgatcgatcgatcgtcatcatgaattcatgatcgatttactagctagtttgttccgttagagcaggtacaatagcaggctataagccagctataaacatattttaaagagataaaaaaattgagagaagagcagcgggctacagatctgtagccagctgcagtacggactccaaaatgtaatgtatgtatgataggtgagaccagatattaatagtatagcaagcaactattgtatgaattggctattacattggctatagatgatttggagttagtagtgggctatactattaaacttgctcttacttccatatgtttatatgttagctcaaccagtggcagagccagcagtttcgtaaatcgtgagcgattaaaagtatttttcggtggttgatcaattttttcttagggtgtgtttagttcacgccaaaattaaaaatttaattaaaattggaacgattgatgtgacggaaaagttagaagtttatgtgtgtagacaagttttaatgtgatggaaaagttagaagtttgaagaaaaagttaggaactaaaccaagccttcaacaatctacaataaaaacactagcagcgcgcgaacttcggacggttgcctgccctacccgggggctagtttttccgctaggcttaatcacccaattcaattattttcagaaacttatatgattattagtgtggattatttattttcatttaaaaatatgttttcttgacgaactttcatttattatattgcttagacattttgttttaaactactaattaagtttattataaaatattttgttaccctcaattaaatatataatatcatgcagtcattcgacaaataactaatctgttgcaaatttagaatttttttttctcccgcacttagtttcaagcatagtgcaaatacacattgcagtttgacacattgcgcgatattcattctgtgtccgaagatatataatgttaggcacacattagatgttatgtcaagatatatgtagtgacggctccatgcctagggtagctaggcctcgagtcttatgtgtaggacaataagtttccatataaatttcatattttttcttgaattttagagaactaggataaaataatacaagctggctccacccctgtcaacatgcatatgcaacggataatactgttcttaataataagctcagattacaaaacaggtgcactttagctagctaatattccttgccccagcaattattatgagtttatcaccatgcatctcggttgccattatatgcaagcagctagtagccagctatcacagcacgtgagctgatgatgcagcccggatttcactaatcatgccacccatgcacgtaaatttcgatcacaatcaccccacggccatccctgcatcttgtaactaatgataaacattgccagtatattttacatttgacaacaaaattctattttttttcttcatcatatatcatttgtgagtgtgtgagcgtgatgtgcacgtgtgcgtctttcaagcaataaaaaaaaaactaaggcttatcttttatcaacatgaaaaataccctttctttaactacaattgctttttttaaaccttacttccaacttgtttacacttagacgacttgatttgtgaaaaaaaaagcatttcactcgaaaaatatataagaaagaatgaatcgcttaatgtgagatgtactccgtattactaattacttctcatatcataaaatatactacttcctccgtttcataatgtaagtcattctaacatttcccacattcatattgatattaatgaatctagacatatatatctatttagattcattaccaccaatataaatgtgagaaatagtagaatgacttacattgtgaaacggaggaagtaataacttagaattaaattttacaatagacttagaactgaatcaaatactaggttaatgacctatccattaaatacttagaactgaattttttagaaactatttggatggatgccgcatctcatgttagttacgtcataactgcttagccccctttttgttttgcttctatagtttagcgtgtcaaagaggcagctctttgctgctttgccacatatttttgagctaaaagatatggtgagaattttgtttaccacacttttgatagatgcctaacttaaggtgtggcaacttgaaacacccaatcaaccatgcccttagtcttcgtgtttccggcatgtcgaaatggtgatgggcctaatccacacgctgaaagtcccaaaggttaagacttaggcccatcagacccaataccggtgtgcttctctcgaaaagcccaaatcgcccagttccgttcccccgatcacgtgacgccacgtgccgcgtcgcgttggcatccgatggccgcgatgccacatctcctcttctcttctcctctctcttcggtttctcttctctctgatttctccacggctttcttctacctctctcgccgtccttactcctctccctgctctgatccagccgcggcggcctcgccgcgcctcgcctcgcctcggcgcgctgccgccggcgagaagggcgcccgcaggcaccccctcctcgtcccccgagcggcggggcatcctcgtcgtcgcgtgcgcggtcggcgaggaggtgggaggcgacgcggcgggccttcgtgttctgcttgcgttatccgtctcgggttcggatcgaatcggaggtatgttcctcgttgttctctcgtactcgtagccctagctgactcggtccctcccgcgcgcgtggattccaggacttgatgagtggataatttggttgatttccatccctccaattaacctatccactttcttctgggtttcgttgatgcgtagtgtagtgctagtagcagcttgtgtttccataaatgtttgggggttctgcttatgccccatatgtgacgctcctgccaagctggattgcgttctgttttattactgtaattgtcaatggccgaatcatttttagggctgtgtgtttagttggcgagtatatgcaatagtggctagtagctattccattttatctgcaataagtaaggtcggaatatgcagtagcaagctatacaatttcctgtgcattgtagcggctagtgagctataccattttatctgcaataagtaatgtcggaatatgcagtagcaagctatacaatttcctgtgcattgtagcggctagttagctataccattttatctgcaataagtaatgtcggaatatgcagtagcacgcgatacaatttcctgtgcattgtgcagtctttctgtattatgtcaactaaagttttttttgtatgtttttattcaagcaatgttgcttggtaccattagcaggtgaacgggtgcctaccaacaatgtctacatctcgtgaagtagatgatgggcccgctgtgctacagttatatagatggaaaagctcccaaccgcatcttgaactatcgaaatttcgagaagcttttatatctcctacacggcgcctatttgggctgctctcggaccatggtgaggttttactgcttcactgttctctgccactgccatccctgttggagcccttcattgctctgctaacttactatattgttgtttccgtactgattctggttttataatccaggggatcttatcttgtcaatgaccaatgttgatcaatcacaagttgaatcaccttccctctcagatagctgtagtccagtcgtctttgattgcttctcttctattcctagagtgaagtctttagcatgggggcaatgttataatgcctctagccaacttgaggattcaatttttaatgaagttcttgttgtatctgatgatgattctatcacacttcatgggttttgtcattcttacaaaagcacactaacagacaattctaaattggacactggagatttgcatggggagtggaaagagtggcgtcctactcagtgttcagttccggaggatgatgaggcaggtacaaagaacagttttcgttcttttctgactacaatcagtggatctgtttctgatggaaaataccaagccaaatttcctctaaaatcttcacttccgcattcagcagaggtggtatcgtttagcatatacgacattactctatcttttattaagttctggtctagcaattatccttcaaagacctggatgcaaaacgatactaaatcccaacaaggttttcttggtcatgttcctacaactgaaacatcctgcaactgccagtgggaatgtttgaaggttttgcctagttcttcaggttatttgattggcttggtcttaattcgtaatgaaccagtgagctgtgaggtccatcaacgcaacatgaaggatattttggttgttgttattgagctaaatcagtggggtatacagtggaactttgtggcagaccttcagaatgtatatgatggtgctgttcctaatcaacaatgggttgatttccaattgtcagatgattttcttgcatgccttaactcgggagggtttgttgtcatttggaatgtgagaacttgtaacattgccgcctcctttagtgttcttgaacggtgcagaacagatatagatattcctatggggagcatcacccccaccgtaaaaacttctgatggagaaaatatctatattgggaatcatgcaagaagaatgtttaagaggttagttttggcatcatattctcttgttcttgctgtcgtagatgaggttggggtaatctatttgttctatgccaaggacatcttagatttcaaaaccagtatgcatggaaactttcatccgccttccatgttttatcgtggtgatagttttgctgcctgggaagctgctggtcatgatattgggagtgtaacattttgttgtcatcggtctgtacagcaattggtctatgacttctcagaaagagacaatcctggtgttgtcaggcctaggaaaagaagaaaacattgtagcagtaatgaaaatcaggtggatagctggccaagtggtttcagtactacaacaccgatgaaagatgggttagcttaccctgatacaatggcagtttccaatccattaagaagagtgatccttccaccatgcagattacaggagaatataattagcctctcaccatttgggttaacgagaatctttaaaagtcacaatgcggatggaaacaagcattttagaattgttcacacaaactttcttatggcttcattacaccttgatgagagggatattgatgctagtttccttaaaaggtcctcatttcagaaggactctacttttaccggagagtgtgtcctttgctcctttcagggatatgtgtatctgattacccaggatagcctttctgtggttcttccatcaatttctgtttcatccttttcatctcacaacaatggcatcaaattttggcaaccgacttctgctggtggtagtgcatgcgatgctctgaatttgtcctcagtaaacagacctgaaacaagatggaagccttggcaaatagaagttttggacagggcattattgtatgaaggacctgcatttgcagacaggctctgctgggagaatggtgtgttttaatacacttggcaatatctttagttttttcatattgtctgttgtcctgctattctaactgcttttagtcccgagtctctttctagatgttcggttgcctgtcccatcttgcagtcctgccgttttcttaatatttggctcatggatttatttttccttaaggttatgcttacagatttatttgcagtgtattgcaaacagaaatttgagctacactattttaatcagaaatgagctaaactatttcgatttatactaaaatatttgcgagataaatgttgtacccaagtattttgaatatggtggatttttattctatttttggtgattggtcaattgtcgttttctggaataaacactgttccaattattattcacagtagttagttcgatgggttgactaatacctgaatattaatgcgcactattaaaacattataattcattttacattattattactatcattttgtgtcaagtatccaacaagcaatgatctcattccctttttctgttagtacttatttctcatttatgtatataatgaaatatccaattctgatagatgatagcattgcctcaatgcaatgttctgttcaacacatgctgggtgttataaaagtacacgccatatgctctgaccctgctatgtgcttattgcattggcaggatgggaccttaaattctctaggttacgttggctgcaattggccttgcactacacaaagatcagtgatcttgagcagtaagatcttgtacttttcttttgtcttgacattaatatcagctttgttgtttttcttttatttcatctcttttacctatgccctagtttcttatacattaataccagtattatgtttgtggtacatgtcttatgatttcaatgaacagttacaactgtttggagagcattaaaatatttgttatacatacagagcaaactagttaaatgaactaggacatgaatgtattgcttatgtgtttggaaattgttaaaagatatggttttctaggaggaaagttgaatttatagctggaagaatatactgaataagacttacatttataccagtcacaactcacaaagaggaaacaattaatttcatgctatcatgaatctcctttcagtcatgtactcatatgcatatacttggttctcacttcatcctttatgcacattgtttctatatatacattgtttcgtgttattatgctttaatttttagctagttccatgcctacctttttctttttcttttttactttttgaatgaattatttgaatttgcattgacatgatctttttatatatgcaagaatatctaacaaaactgaattgctagatcattaaatatgctcgtggaggtcaatctcgcagaagaaggtgtcttgcaactgctattagcatctgtctaccggctattaagtagggcggaaagtgatagtgaagttgcggcgtcatccaagtatattttattccctgataaccttttttattatgagtcaacttaattagccgtattactaaactgtggtcccttgatacaaacagtttgtactttctctaaaataaggaacaagttctactttattcttggaaatatgttgctctgtctacagaactgtgatgcagaaaaacattttttaggtacatacctctgaattggttaactaagaacagaaaaaatcacgtgccttgattactacccaactaatgacattggtcccccaacatagacacaatcaagcttttaagctttgctccttctcggatcgagtacctttttaataaacaattctctagttcaaatgttgtttccacgaatagcataatttgcacactgggtacaattgtgggctgtgtattatatattttttagataatggaagcttttattgatctcagtcaattacatcaaggtgatacaactgttccgaggactctcccggtctctacataacgaggatgcacaccgactgtgtattatatagcggaaatattaagatagagcaattctatggtagtactgttacactccgtgcaacaaggttgcactatccattgacacattcatttttccaaatgggacagattattcatgttgaattaaaaatacttctgtttatcatgttctaaggttgcaaagtataattaacattttattttgtgataaacatgcttgtcaaagaaattttcagtaggtgaaaatataatggtaagacaggaaataatttgaatatagtgattggacggtcaagaataaaatttgtatggaaaatggagttaaatggaactgatatacgttcatactttgatacagtaatactgatttaacatagacatgttatgacacatcgatacatactaccattctgcaatacttaaaatggaaaatcatttgttggtcaagcacttggacaaagacctgacacctgctgatgcagatacatccaaacaatgtagcattgagccgtctttaaaactgtagtagaatttatttaggatttgctacaatccgatgttcctttctgttcttttccttgttttgaattgatgaagcctgcaatatgtcatatgctttcaacttttagcttcgtaatatgtaagcttacagtgtgaaaacaggctgatggttttagctgtgcgctttgcgacgagaatgatcaaatgctatgggctacttaagcaaaataagggtaagatcttttattttgcaccatttattttatttgtgttatgtgagacttaccctctatttctcagatgcaccagataattcagtaaaacttcatgaaatggctttccttttgggggtaattagaagtatccagagccgaatctctgcaaagaaccagaattctattcggatggtaaaatgataataattcctttttgtacacatgtagtcgtacttgtactttggatgatccttcttatttggtaatcctgtggttattttgtagcagggtgatgacaaaaactcatcgaaaataggtgcagaagtatcactgaacacttcactgccaattgttgtagtggatggtgtttcagcaggacaatcaggtggtatagaatctcgtgataggcaagagtcaacacctgcgatgtttgagttagtttctggtagcaatggacaattagctttaactccagttgaatcctctattagtgctactatgcatcatgccattgatactgatcaagttgtaataccaagtactcaaggaaatatcaaagatatgatgaaccggtgggaaacgaataatctggacttgagaactgtagtaaaagaagcactgcagtctggtagactacctttggctgtccttcaactgcaactattgcgccagagggaatcattttccaacgatccagaagatgttttctctgaagttcatgaaataggaaggtccatcatatatgacctgttaatgaaggtaatgtagtactccataccatttgcttaacacgtgtatactctctacatttcctgtcatctaatgcttttatctgcagggtgaaactggattggctgtcgcaaccctggaaagactaggagatgacatagagtcagacctcagacaacttatgcaaggtacagtcaggaggctacttaggcggcaaattgccgaggagatgaagaagcgtgggtacatgagttcaaatgagtggaagatgctggagataatatcattgattgaggtttgcttctaccccctgctttagctaattgggaaaattatgatatttcaatatattttgtttttgttcatttggttccaatttataaaagatcaaaatgctggcttgatatttgctttcatagtgatcaacttttttttttctctgtggaaaagcaattttacccaagcagcagtttctgggacacgtatcttggcagggagaatgtcattcacgatgctgcaaaaattgttactctaccaggagaagataaaccagtactagttctcgatattcataaccactgtcctattgaatgtggtgatgttgatggagctgtgatcggttcttgggcgaatgtgaatgattacactaatttgaaggagttctctgaaagcattttatctgatggttattgggcctgtgctgccatatggtctgatgcttgggatcaaagaactgtggaccgtgtaagtcacgacttaacatttttgcttgttagtattgagattgcaccttatttctgattgtggcaatgtgctgtagcttatctgaaaatgtaaaagaattttgctagtcttgttagatctgtccaatcactgtgaaatcaagtggaatttgttatgctatatatgggataattatgtatttccaactcatcgcaagatcaatttgaccatatatgttgccacagaaataatgataatgttggtctgtgttattcattttccctttcgtggaaatgtgtttggtatcaccttaaatttgttggtgtgatgctttttgtaatgagctaaattctgaactagggcctgaattaattttggtatagtcatggacttatggttcttatatgctctatagataatactggaccagccttgtcacgcacatgcgtatgctcatttctcatgggaatctcagtttgaatattttgttgctcataatgatgtgctggaagtctgcaaactcctggacagtattcctgacagtgtacttctagaagggattcttagagtgaatgtggacaattcacaagctacttacaacactctgtctgacgtagcaacccacggttataaaatgtacttatttgactcagaagagatagaacctgtttgtatggaaataccacatgtcaaagtgttcagatctttgtgtaatcatgaatcaacttcttggatgagaatgatcatgctacaggaattggcaaagaagcatatctttatgaaagagtactggcaaagcactactgaaatta

SEQ ID NO: 82259 - DNA, 28449 bp, Oryza sativa
atgattattgttagtcatacgaatatgcgatacagaaaattgcaaacacagtaacaatcaatattatcattgattattttagatgaatatggctattgttagtagcaattagcagaggtttacatgacaaaggtggtgcttttcgctaaatatttaaggaaaaatactacacaagaggcttcagatcagcaagccccctcaaaaaaaaaaagatctcctaatgaactgggaaacacatacgacgtttcaccctagttcctgatctttacaagatgtgcaatttcagttcttccatataaaagctacgcttcagaaaacagagaatttctggaatgcatccaagctgtttgcaagtaaatcgctcacacttaaactgtcggtgccactcaaaagtcttgaacaagatgctccgacttctggctccccagtcgattcagactgaaaacaagatgctcccagtcttggctccccagtagattcagactgaaaccaagtagatgacgatacataagaatcagatcagctctttaagaatcaaatagaacatatcaatgtttattagaggctctggtgagtaccactgggatgtctggcttcacattattgtcatcattggccaagagtgatgcctgagggttcggttcctctcttctatcttcagtagaacattgctgcagagacaagccgataagcaaatgcatagtgtccttggcaagaaaaaaggtattagaagagcaagtgaatggtggctaatagaggtaccttctcaccgtctgtaccagattccagaattgtgcctaggacagacaaggtactagcaccacaactgctaggagttgtaccaggtgtcctgcgtgaaattcgattctgggaaggaaatgcatggcacgtttcttctgcatcccaaagggatggagttgacaccttcggctggctacttgcttgttgccgagcaatcagggaagcaatagcagcatcaaatgaatcagcggtaagaggtatctgttggagacttgagttgttttgtggaagtaactgcttgctgtcttgagaaggcgcagcttcagctaatagtgctccaaaacttatattagatatgcagtcaatccatgaaagtggtgtctctttgctttgattatcctgtttctgaaaacatgtaatcagtgttaggtcaagtcaaaatataattgatgatattgaaagaaaactataacgtttgaacttaccatagtctttactgtgttggcctcagtggacggtgcagcaaagttactcgggaattcactcaaagcagtcatctgtttctgttccctgacaacaggatctaaaggctcgttgtcgattatattgcctgcagagtgcactaatcctaaagatactccactgttttgttccccaaaattgggtggaaaccaaccatatctaagaaaaaagatgtgatattcagccataagttttgtgctcaatatatgcatggatgcaaacaaaagtaaagtaaaccaggtctggagaagaaagcgaaccttaagcgaaatgtcgaagggctgccaacagcaacatgcacatcagctgctgtgcaagaatcactacgagtccatctctcactgccatttatgttatcaagcctagtaccgtcagggaagagcatgagttcacctcttgcacactgagaattgccccattttgtgttgagatgctgcagaactgaggatattttctttcgaggagccacagtcaattccaggtaaggattgtggtttttctgttaattatacagagcaagccacacattatggaatctgaacgaggtcgtatacaataatcacacatagaaatcttgcaaaagctgaagtaatcacctgctgcagggacttctgaaactcctcatctattgggaacagttgaagtgcgatctttccagaatggcagggtggtcgagcagacacattcttagaatcatggaacagtgcttccataaagctaccatcctttggtgcactttgtttttcagtatacaattgaggtgatgaggcaccagctcttctgtattttgtgctagcattgcctgaaaagtaaagcacatgttgagtttgagaccagttttactcgtagatgtactttacacaatggcatatgtactttactccataaataacttttatttctcttaatggaaaaaatgcgctccttgcgtattcccgaaaaaaacaatggcatatggatgggcacctaacgacatcatggaactgtcttgattcaattgtagcaacagacatttattttctacttcaaattttaattttgtttgataagtgcagcaggtacaccatacagtaaaggaaattgggaacaagattccaacacattacctgatgatttgttgatatattttccaggtttcaggctttgcatcgtactgccaccaagttttgccgccgttcctgtatcagttggtttacagcgctgctgaagaggtttcatggttttctgatattcagcagcaaaactatctggtgtgcaattttgtaatcctactcctgcaaaattgtaaaaccaacattagtttgccccacacctccatagttccattaattgtctgcaaagagcacggttatagcatcacctcaggaggacaggacctttttagcagtctgcccaaaatcacaagacagacaacttttttggtaatggaagagctaaatcttttttttttaaccaaggggaagagttaacacctagctgctacggctctgagattattccttagtttgcagcgatagtgctaatcagacaactagtacataaaaataaaaatcaaacaacagaaataaatccttttatccaattataaaaaagtcagatacatatcatatcattcaagcattagtataatggaccagcaccaaagttcctacacacaatgggaaagcccactgatctatctcttatgatgaaaacgagctatggattttaatgaaagaattatatctatgaattctagcataaattctagcaaacattagaaagattaagttctgaagtttctagggcataattgttctgatccctaattgtgaattataactataacaaaatcactcttatgcacaggaattcaatgggatgcaccgaatgtgctaaaggcagacttccagcggaagcattcattcgttcacgttcctttcagaaactggcattcgagttttgagtttctcgagtcgctcccctaaacctaatccccgaattctcccgcagcccaacatttcattcaaccacgaaatcacgccgcgcgtacccaccagtcacctcgctgtagcaagaattcatccataagaggcgtacctgatctcacaaccctagatctcctggaccccggagaacccgaggcggcgaaaccctagcccacccaccgccggcaagacccccgacctccgcaaccgcggagagagagagagagcgagcgaggagtcggaggcgagcacgaaccctcaaggccgcgaatccccacacccgcccgtcgccggagttcaccggaaggcttcgcggcgcccgcggcggaggccggcgagcagcgaatcgtcggaggcggaagagacggatttttattttttatttttttttgggaaatttttgaactctggtttgttcacttgccgcctcccctccgaaatggtacgcccgtatttatacccgtacagtatgacagacgtgttgggctacgactctaaatgggccaccatttggtggcccatgtagtttgggcctccattcctaggcccaaacagtttgggccggcccacctgcacccggtccacgggggcctcgtgcgccgctgccactgccaccaccataagacgacgccgccatcgccgcgtcacgccacgccacgccacgcgcacgccgcggcagcgccagcgcacggctcgtcctcgtctccgtgcgtcgccgacgtggggggtaacgggggtttggaagcttcctcgctagggcgggatggcggcggcggcgaagaagcggaggccggaggaggaggaggcggcgggggcggaggaggagatgcacctggcgttcaggggcgccgccaacgcgctgtcgcaggtgtacgggcaggccgtggccgcgcaggagaagtcgttccgcgccggcgagcgccgcgccatggtacgtccttggcctccgcctgcccgttcccctccccaccgatcggtggccgagtcgcctgaagaactgcgttcttggggccttgagtcttggggtccggtttagttttgggattttacgcggagatgcgaagggggatgggatcctgcttcgagttctttcgagttgctggtgcgttggggataggggaatttatgttctggacgaatttttagctgagaattatgggtgtggtttggtatggtgggattggagagtttctcggtgaaatgctgcggctgatcttgaaattagcttctgcagttgtaaattgttggaaatccatcagtctgagttcttggatgtgcttccatattgtgaacttatgattttattatcaaattgattcaatcctgtttctgaattttggcaggagaatgtctatcgatggatttgcagcaagcatcaagaaggtttggaggtgtctgttgccgatctagttgctttcctgcaggtcagtttgtctttatctttttctttagtttaatccctgtttgacatttatgctagccaatgccttgtgtcatatgcaaagattgagagtcagggtgacttactagtgttcaatttatagaatgatttttgcatgtggatcatgtcacacattgctggctaaccaataggatcaaatgtgactctactacaactgtgaattgtctgatgagtataatctttatgaatgtgtaataatgattcagtttcgagcacatctacaatttgtatagccagggtctggagattatactatgaaacaattgtactagttaagtattacgtcagatgtatgtacataagagccatgaaaatgtttagtgaagcactgaaggtgctgaaatcaaaaccacattgccttttgagaattcattcagtacaataggcaggccatagcgttcccttttctttcctttttcctttttttcccctagctctgttgttattccagtatgtgtatgcggctcaaatccttgcctgatgcttctcttctacgcacagactgagattgagcacagagcaggggaggtgccggggtcattgcagcatacaagtgcacagccagcatgtcaatttccttctgcaaatattcaaagcaattcgttctcttttgggaatgtaacggatgcacttaactcccatacagcgcaaactggccaaacacaaactgccggcgtgttaaatgctccgcccaacccattgcggcaaaatttacactcaaatcatcatccgattcattgttcagcgtatggcactatcaactccctaccagatggaattggagctcaaagcaaccatcctccccaacatcagaatttcatgcactgcaactcgtatgaaccctccatggatgagtcatgatgcttgttgaggatgtgagccatatgaaaacccgcagcttgtttgcttagttcccccggagccttcaagatctgatatcaccttaattgctggagaagtcccatcgattgccgatagatatgctcctctccatctgggtatcgcaatgcaaagcttgtaagatgtcgatatcatcttcacttttttctgacatcttgtacattacaaccaagaaagtccccttcaggtcccgcgtgttgattgaaagattgaagctgcaacctttgcttcagcgtaattgtgcttgcaatattagttcttttctgttgcttgcaaaaaccatgctctggttaacaaggatcaggaggacgaggatggtgcattagttgttgatgaatttactgctgtgttccatgtatatctgttaaagctgtattggttcagagagcctgagagcattgtttcacccttttttttttttgcactctcttttggtgtgtgaatgatttctagttaaaaggtgttgtaaccttacagatattcagaccatacattggttagaagaaagtcttgtataatagataatgtaaacagagaagtctgtgtcctttgataattgatacttttctgctagagtaagttttccatcaaatcaaattctcaaaaaaccgagcgcttggtggaaatggaacacgtatgatctcacgcttgtcaattattactcgggtctgtctgctgtgttattgcataatttaacgaatttaccgaatcaaatgcatcgtttatattcattgtttctaatttgcagcgctaccctataagcggaattttctcttcttcacattgtatttttttgaggacgaggggttatacgtaagaaacataacaccctataagtggaattttctcttcttcgcattgtatttttttgaggacgaggggttatacgtaaaaaacataacagggtgtcagacggtccgaggacctatgcgatattccgtcgaaacgcgtggagctttttgcaaaagtgcaaaacactcgtaatcaaaaaaaaaaaaaaaaggagaaagtcggaaccatattttcgtgacgaactataaacaaatgagagttacagatgatccaccgctgaacgttcacgaactacgagcaaaacggaaattgctgaatattcatttgcaagttcagcaggaaactggaaatagatacaacagcagaaaaggatatacctctgcttccccggttaccatatggaaagatttttacgttacagacatacaagttacagcacaagcagttttcatatgcttgaacatctaatgtcagcggtagcacattaaccaaaagtaaagtaaaaatcacatcttgggagcaagccccgtatcatgcttgggaacatcagctaatatcagtcttaaatcacatctcaggaaactggccggcaagtcatcctttcctactcgctgatcctacagcagctgcttgcagtgacagtcatggtgtggccttgtcagcaagtgagtgggcagccgagctccttcgccgccgcggtgaggaaggcgagcgtcagcccggtggcgcggcggctgtgggcttcccactctatgcatctctccacatcggcttgccagttgatgatgcttgctgccaagcactggtaggttgggctctggatgccattccggtgttccccttggatgagcttactggagtttatttgtccgctgttcaagatgtcgcgaaggacggacatgctgagtgcacggacatgcgcgctggggtgcgaaagacagcggatggtggttgatagacggcactgcatatcaagattcagtcaggatgatggatcatggatgatgatgagtaagtttggcatgaacgtgagtgagatcagagaagaggacatgccttcagcagattggagaggccatcagcgacggatacacctgaatctccccattcgacgatgagatggactgctctggcggttacttccaatagctgctcgtaattgatcccgagatgaaccggtcagtaagcgagatgaaccatacaaagtagaactgattattcttcactgggatttgcacctaaggacctcatgaatgaaggtgttacctctaattgtggtaaagtacaagcttcaccatcaacaagcattccatcagttgctcgaagaagaagatctgaagcactagcaaggatcaccaatgcttctgggctatcgtggttcctcataagctctgctatcagcttaactattcgctggttgactctccacatcttctgaccttgctcatcatctcgagcaatccagggctgcaagtccttctcggcctgtgaaagatacaagagtcggggaagatgactgaggaaatgggtatattttatatcggtaatgatgctgatgctttgaaaccaagaaatgagaacaaaagaagctacagtatggaactttttttttcaaaggtacatacaatatgaagcttttaaatatgataacaagtatgtaaatataacaataacaatatcttgacctgcagaacgatagcagctgaagccttggtcggtgaggctgaaacaatgtcacaaagcgcatccacaacctacccatgaaaaacaaagattatcattgtgtataagaatgctgacaaccaaggacggtcttcatagcattattctggtatcttataagcaggaatgaccatacctttctccaaccctgatgagctgatgtactttctgcagacatctgcatttcgggagatgcaatgagcttctgccagagcaatgagacaacagagaagcatagctcctgcttctctgacagtacagatcttaggagagtttgagaacctctgtaacccccatttcggtccatggtgaggaagtttgccaaatcagaagcttccacctgtaaacttgcaatggctttcccagaagtacttgcgacatcaccatttagtataacatcttctgcacatttcaagagtggtcttgcaaaaccatttttcctgtgtgatcttgaagcatcctttttttccaatgcaccaccatctgatgagttaatgttcttttcctcaatgggaggttcatccttttttactggtgtaagggtcaggtgagcttctagaggctcagctttgttcacaatggaggtcactgttttaccatgcaagtcaatcaaatggtaaagggatgatgccctggtagaaatctcagcatcccacttgcattgcttcagcgcagacagtgcatttaagcatggcctggatcgacgaaataactcagaaacatgagcagcaaccatagctgctgcaacaatctcatttgaactataactccatgaagtaccaacagatgatggcttcaaggagaacagagcttccaagatgccaagtattctacgagtatgaagaatcgctgagctaatgctattgtgtagctcgttactgataccagtggtttttccaggtatgactatctttatggagtccttcagatttgaatggttcccattcttggaaataaaagggaacagctggagctcacaagataaggcacaaacggctgctagaacgtatgagtcgaatgtagcaactggtccttgtctcttcttacatctgtttcttccattggttaatctcgaatcatttgtgacctcctcagaggaatgattatcactaccagttggccttttacttcccccaggcaaagcttgatgactgacgcaaacagttaatactacaaatagtaatctggacgcaaggtccattgaagcacaggactccacaaagagtgaatgtatcattgttcggagttcagcaacagcaaggttcttagattgacttcttggtttcctggattgttcagaggtttctgatggaaaagttcttctcagtatagcttcaactgttgccacaaaaattctcataaggcatgcttcagatggactcccacgaggtaaatactcaaatactttcaacaatggcaagtataggctccatgacaaagtaggtggctgaagtggagcagctacaacaatttcaggcaaatcaactgctgatgaactcagaggtagcaaaccatacgcagcctcccagatggtacatattctccactcaacatcgggaccatgagcacatagcatggaagcaatgccttgcgcagtggcatcaatagtggcttcagatgcaggaacttccagctttgtgcagttgaaggagcacatatgaaaatataagtcaatatgaagctaaaacatgtagggtgcatatattttacgacataatcaaattccaactttggtaggtagcaatatctatattaacttgtttgatgatacctttaaaacagttttaacataatatcctagcagtcataaaatatacaagaatacatcatagctccaaaagaactgatataaacttatcatagcatgttgacgacaagcatacagagactcctaaaaggttacaaaaaaatgaccaaaagatttaattttctattcaaaacaatagaggctagacaaatctagctttgcaatattgtagctaaactactttagtcatgatgatgtaatctggcagctaacagtacttaatgaaaaaaaaattcagaacagagtctggataatgtagccgtttagtgacaagcctattagcatatatttcgagaaaactgataaaaaggaaattgaatacatcaaatacagaataggtagcaagtaggtgcaggaaacactgcatacctgccttttctattcaaaacaatagaggctagacaaatctagctttgcaatattgtagctaaactactttagtcatgatgatgtaatctggcagctaacagtacttaatgaaaaaaaaattcagaacagagtctggataatgtagccgtttagtgacaagcctattagcatatatttcgagaaaactgataaaaaggaaattgaatacatcaaatacagaataggtagcaagtaggtgcaggaaacactgcatacctgccttttgtacgatgatacatagccacctagtggctcatgatggagttcaactccttcggcatgtctcagtggaggaaaaagtaatgtcggttgggagagtattcggaaaagtaaagcagcagacgtatcagcagcgataccagctctcattgacattgcagttccaatagcacgcaggaaatgaagatgcatccagttctttggaagctaaaacataaaacaaagctatgacaatcaataaaatattcaaaacacataatgtgctgttatgataatattgcatgatgtgtcatcttgattgatagcactgaaacaacagccagagagatgtatgatatacccgcatgccagaatcgtaatcttccgctgctctaaggagttcaacaagctgtactgctgcatcaagtgcatctggggcccatgatggtggtgcctcgagaagaccaaaaagcaacctttgggtagcacttggagtagcaattgcatagtatctgacgaaaaatagcatgttagcaatcatttggaaagtacacatggtacaacagtggacaggatcataagagcttacctatgaaacaagcgagcatatggttcaagaggagggagccccgcaaccaaatgttcgtccaatggtgtggtcggtggaggtaatagaagtgcaggaacagctgccgcagtcaaatttgctgtctcataacgagctacttcctcatcacagacacttagtataactccagctccattggcaacagcccatctgggcgtggatggcataagttgtgggtgcttcccagatcctcggctgtaagctgaatgacccaagcacatgttagtaacttgtgtttataataagcattagcatccgagttgcaagaaaaagataaaggtcccactccaatgcagaaaaacatgcatagtatgagctcataaagcccatatgcactatgttttttaagaagcaaaaaaactgaatgcaagtttcaaagtaatttacaaacttccattaaaaagtaatttgcaaacatatcacaccttttttaataatatgtactctagaatctagaaaaaatgtgctcccagtaaaataaacaatcaggctaactttaatttgtaggttatgtcttgtcgccacaggacatgttctacttgtttactttgatttacaatatacatcatttgctttgtcaccaaatgctagtagtaaacaaatataaaatgctcactttcacagcatattgccattcactcctattataatccatactcactcctgtcaaaaataaacttttggtctgatcaatctctctatggacattaagatcaaccatgcaaaaatgatgagtatatttgtccctgaatgtacattcttcacattataatttttccatgctttattaatatattacaaaagaaactgctattcaaagttttgttttgaagaatgtgtttatgcctaaagtatcactttttttttatttgagggagtaagttattgatactccagtttccctttggggatcttaagaagggaactgatctaccaaagaatgcaaaatatgcaattgtagacattgtcacatggtatctcaacagaataaaaagacatgggagtaattaatgttacaataattataaaaaattcacgatagaaaattccattgctgattttaccaaccagttgttggaggcttcaattctccaccagctgcgtattttcccatgactccaccacacctgatgcatttgaagacaaaacagggaatggtaagcgtccattagcaatagaagagtactcaagcaaatttttcatcatcagcagcaaatatatagtatgttccaacatgcttgacaaaagcaagtttacacaatgcatgcagttccattagcatacttttaaaagttgtctatttttcttgccatacttgcattggggaattatgaacatgcatgaagtttgaacttgttatgagttccaccccttgctcctgcgttctgctcacatacttctattattttccgtgttttaactttaaattatatgcgctcttccttcttgtcaatatcaccataaaattgaggttgtatttctcaagaaaggaggatttcagattttcagtccacagaacaataatatgttatcatttattatgactcaccatctaaaatagtcacttctaatacccagaggtgcagcaagcaatatgtctgtgatccaaggagatagtggcctcaatggcttccggtcaggttcatttcttggagaaccgttagcccttttctccatagactcacatgatgaggcctgatcagatgtgctgctacattccgcttcactatgttggtgatcaactttgaagattggcctgttgtagtgagttagaactctaagaatttctccacaggccaaggcccactgctccgagtactctttctgcataaaagttgcatctttatgagcaagagtagtttgataagctataagcagcacagtttagatataatattgaaatgcacagcagaggcaaaatcttatcaaacacagagaaatgaaccaataaattggaactaaccattagagtaggggccttacctcagaagtatggctaaataaagagatgaaggacatgaacgggaaaccatttctatcataactgagtgtcccatctatgatgcgtgacagaatcggatgcacaactgcatggccatgctcaggatgatgaagaacaaaagttgctggaaatatgagaaaaatatgtcaaactctttcttcaattgtttgtggaacatgtattgatcactggatcaaattacctaatacttcatctacaaggcgcttttcttttgatggatagcaactttgaattagctgcaagcatgcaagaaaaagaatgcaaaagttaacacactggagaaagattttatcacagaagatactaaacatgcttagagatacagtacctgagctatatcttcagggaattgctcactgtcagctgtaaactggccaaagtactcaacataggccagaatttgtgccttcagagaggagacgcaaccaagtttcccattgaggcaagtatgttcaacatatagaatttctaacaagaatcaaataggaataatgttacctgtttttgttgtgaatcctgtggtgggggccagaacagtgatgagaactggagcccatcaatccacttctcatttgaagctgacatacttggtagctcaagagcctgcccaagaaactgagagaattctcaaagagaaagaaagaaactacacaaactgctccagttagcaataaaagcacctgtaatcaacaccacgttgaagccgccagttagttcatccatttatgccaccaaagtccaaatcttcttataagctacttgccttggtatcaagaaacttcgagcaagaaagttataagagtgctatccacttcattcaatcaacccccataacgggggtctgcatctcacaacgtgacacgttatcatatcaaccaatgccaaccatatgagcttcagagtctctacactgtaatatatcgcacaacaaaaaccaaaaaaggaggaaaatacatgaattttaattaatgcaaaaaaaaatttactccctccgtttcatattataagccgtttgacttttttcttactgaaatttcttccaagtttgactaagtttatagaaaaatatagaagtattttcaacacaaaaaaaacatattatcaaaatatattcaatgttagatttgatgaaaccaatttaatattttagatattgctaaattttactataaactttgtcaaacttaacaaagtctgactaggaaaaaagtcaaacgacttaaaatatgaaacggagggagtagaaaaaaactgacaaatgaaaagagagggaggtaatgcaacgaaaattgcataatcttacaagcgcattattttattgtcaagtacaactaaattcataatcaaacgaaaaaatatatctaggaaaaaggtggaagctttctcgtttttaattatcgaaatgaaaaggtacatgttgcaatcatttataaggtaaagtttaccataacatttagttatggtgcaagctcacatgtcgataaatatgttaaggaaggcatcatagaaataggcaaatttatggtaatgctaatggatgtggtgtacagaaccattcacttggttcctcgtaggctcctatggcttatcacacaaaatcaatagatgtgtttttcgtgacatttatacttcatttgttattccacgtcactcatcggtctgtttttgttggtcgattataaatgtattgtctaagacagaatttaatgatgttgttctatcttgttattctttctttttttggcaagcaaagattctatttcgggtactatgacaccgaaccagaaagtatattacctaaagcatagaaatggaaaatatataggaacaaaacaggttcttcttttggtgtttaattacaggtgtctctgctcatcggttggtgtctgtattcacttccactgttaacgaaatgaggaagggatcccttgttactgtttcaggggaaaaaatattaaagcagagctagcttactgcgaattaattttcagtaattatccccgcacaaattacatccacagccgtatgcaccacatctaaacgcctccacgaagcagcaaaatccagctagaatcaacgctactcgcctaaaaaaaccacaaaaacctcctgaaattcgcagtaataagcatccatctcgcgttgatctatccgatgccacgaattattacaatactaatcagctcaacctcgccgtcaaatttcaaaactaatttccctttcacgtcttcaaaatcccaaccgcatctaccaccaaaactctctccccccaaacaaaaatcccctcaacataacaccacaaatccacccgaaccacctcgccccccatacacgacaaccttagaaaggccatcatcaaaaccagcctaaaaatagttttaaagaaaaaaccaccaagcacagcacagaaaaactaaaaccgcacgggaaaaataaaaaagcattacctcgatcagcctttcaaccaatccggacctcacgcggcgtagacggcggcggcggcgaggggatagacgcgcgcggcggcgacacgggcggtggaggaggcgcaggggaaggaggaggagagagagagggagagaaacggctcggaggaaggagaggcgagaaaaagattttttccggggatggtggtggtggtggtggtagtggccgcgctatttcccacccgcgcgcgcgcgtggggtgggggcccacgcggcggttccgggtcgccgacacgtgggggcgggtgatgtggggcccacgtgtcggtgataggcgggtggggtagctgcggggtgagatacttattcgtgagtgcggcgggggggtgggaaggctttgcttggcttggcggatcgcctcctggcgattgctgacatggccttgatattttcgggggtgcatggcatgtatgtatgtatgtatgtatgcttggtgatcgtcatgcatgaccccccatggccatggccaatgacatggattttgtggttctagtccttgtgttgtgagattattgcgaaatggtccctatgatttttgaggtactatcatggtaagcggttaaagtggaggtatatatccattttcttttgcaagtgaatgattactttttttagagagttgactaaggctcccatcggttgtcattttacccaaaatgacttatttggcttattagaaaattaaaattaatttataagtaaaacttttgtagatttgttcgtagcgacttaaaagccaacattaacaaaaattacgttaaaagcatttcaaaatcaacttcaaaatcaagttcaaaaattcaaattttggcttattctttggctgtttaggccaaacgatggggctataaaatttagcctctgtattcaaactggatctacacggttaaagtgataagagcaaatttaatagtaaagtcaacaagttgctataagctcctattccatgcgtcccaaaatacaaggttagttctattttcctctcatctctctttctctctctacaaatttaggctgagttctttctccgaatttttcaactcactttcctcgtttttcacgcgtacgttttttaaactgctaaaaacagtatgtttttttgcaaaaattttatatacaaaattgcttaaaaaatcatattaatctatttttttaaaaaaaatagtaaatggtttattaatcataagaaaatgtgtcactccattttacgtgcgtaggaggtgagtttccaatctcacctcccgaaacacaacctcaatgtttctatgttggagtatacgtagagatggctcttgttcgagaggcaacaatacacgttttcttttatttctttcctccgtatatgtttatagttggtttatatctaaatagtgtacttgctcttaaatgatagtgagattgcatgttccttgagcttctaaacaatgtgatttgtatgaaaaaatttgcatatgaactttataaaaataccattttaaaacccattttcagcattgtaaaatttaatttattcattggtgccctcgaacagttatcccaaaaatatccatccatttagcttgcaagaatagggatagtggtgataggacaatagccatttggaaaaaaaataggattattataggacattttaggactatttgaaaaaaatggctgttaggaatcttgtctcgaaaataaattgcgaccgttgttaggaattgagagaatgatacaagtaaaatgcatattctcaatggtcctttaaaatgcaacactgctatactatacttgatatatttcttctttgatttttccctgcatttagatcttcatgttggagtactagttaagaactaaaatcttaacaccacaccaacatgaagccttgattcaacttcttggctgagcgggcatgtttctcaaactagtaaataacatgtttaatttaaagaatttacataaaatgcttattcaaaatattaaataaatcatttttatattgtaataggtaattaatcactcgctaatctaagtattggacgaaacacattttagtactaaaattttggacgaatattgtccaaatttatagtagtagaatttatctcatccgttattattatgttgctatattataggatgtacgaggcttgatccttaaaaaattaccagcaataataaagcgtagccgacaaagtctagtgcttagtacaagtgcacaatactaggttctaccactatatatgtaattttactaacaccgagtcaaccaagccatcagaaagaagggcctaattataattatcgctaatgacgcgtcagacccccgaatatttgaccgattagcatgtcaaccgttggatggaaggacgtggccatcggacggcctcaacgaggaggcatccgcttcgctttaccttctcgggaacggcaatcggggtgacgtcaccgctacgaagctggacggctgtagatcacggatgggaggtcactggacggtggtgcgacgttgccattttttatattttaattgctcgctcgtcctcgtccattattgtcgtggtgggccccacccattggctaattgcgctttagatctgtgtgaattgtgattaggtcgaaatttggatgcttaatggagtaattaacaaagcagagtagtagtagtattaggtttgatgcatgcatgtgtctcactatctctctttctttctttctcgtgatgcccccaccttgtgattaggttgttttgtggaaatgcaatgggctatagctatggctgatagatccatcagatcactcgaattgatatttcctcgtgacctgcaatcatggaggcagaaatgttatcattaattcatttttcacatgtaaaccgggagcagtaatcgtatggatatatacaaagtatgctgatcaaactgtaaattacatgagtgtagtataaaaaccactgactttaggcccgactcttttttgcttaacggatgaatggacgaaaaatgcgcacactttcaagcatgcacttgttgaatgaatatatgagtttgtaattactaacatacatggctgaatggttgtagtatctaactatcttctaatcaagttaatctaattagaccactgaagaaaagccatagaaatcttataagatcccagctgtaacattgttcgatgcatcttgctcctctccacacgtttgcaaaagccaaagttgcagcaccagtggcacattaaaatattttcaaggaacaataattaaacaaacaaagcaaagacatcacaccaaaacttacgtacgctaagaatctctagtcaaatatccaagcaccttctgctttagaactctctagaaccatctagcttttagcttactcctcgtcttcgcagaaaaatatactactcctaatcaatcttagcttaattaccacggcgcaagttactaaccgggtttcgcgggcagtggacctgagagggaatatccgatccgcatcggacggcccacaggcgtccacgctcgccacgagttgacctcgcggcggtaagtgggatgcgtgggtggatggcgacggcctggggatgtgggcccgcgggggcggtgccacgtgtgaagagaaggatggcccaggtggccactgttggaacgtgggtcccaccatacctttgatttgcaaaataattatgccatatctcgtgctaatatatttgtttgttttgggataaaaaatttttatctatgtgagagagctagcctaaatcattacaggtgagttggtgagatgagaatttagaccggtccaccaaacgagatgatggtacatttagacactactctctctgtgaaatactttatctttcttttttgccttcactacataaacagaaatgcatttcggctgaactcattctggctagagcgcagccaattcaaacggccgtatttagtactccatccgtttcataatttaagacattttagcattattcatatttatatagatgttaataaatctagacacacactatgtgtctagattcattaacatctatataaatgtatagtgtgtctagattcattaacatctatataaatgtgaataatgctagaataacttacattatgaaacgaaggaagtatgtgttacagtgcaactaaactggtctatattttataacaagtgaggattatactatcttactactctgagttgtgagtaggacaagtgtctggttatgtttgcaacgatgaggcgaagttgtctacctagtgtttttgctgtgacttgtgaggccacacatgtgcaaaggctgtgtgcttataactatctcgaggattgattcggagcggcaagtaaccgacggtgtttggtgcaaggaattcaatccaagcaaaaaaaaaaaagaaaaagagaaaatctatctcagccacgcaaataattactcagcccaaatcaaagagctccatcaattagcctaataaaataaagtaaaagtcaaaatttaaatttcgaacttgattttgaagttgattttatgacattgacatttaaactgctacgaacaaatatataaaaaattatctataagttattttttattctctaataatctgtgttttggtctattggtgaatacgcacaagagatgaggctgaaaagccattgggcatagacggacaacacggggcgacgtgtccgggaggcgaaggcgcacggagcacaaatccgccttcgcttctcctcctcccgcggagaaaggggatgatggccaatgggaggggagcaaaggatattttctctctgatgacaagcccgcgtccgcgtgtcgacccggggcgcgcacgaataatttaagcaagcggggagacccaaccgagaggggaggggacggccccacctgtcagcgcatgcatggatggatggatggatatgcctagccccggatgggtagcatgggcgtggtggggcccaccagctctctcaacttgtcatgttggtccctgtgagattactgtatctccttcaccctactacttctaccctgcgatattggcatcacaccggttttttcgtgctaagactaacctgaataaaaaactgtctagattcgtattattatagtatatcagcatcagatactgggttggttttattaggaagaaggaagtttaaatgttattttcttcgtcccagaaaaaaaaaaactcaatctatgagacggaggggtactacttgcatcccctgtgatcctatgattcttcgctttgtttagttactgaaataaataaaaaaacgcattatcattacataaattggttcctaaaatctgcaatcacttaaaattgtaagatcacatactgcaagagagtatctagccaggatatgcagtttcgtggaaaacccattgagatttgtgaactggttttttgatttcgagccagctcaaaattggtcaacatcaaggaggagttcaaatggtttttgagaaattcaaatctgaaatagtagatttgattgaattcaatcaaaatttggttcgacatctggctggcagcagcagcagcagcagaagaactattacctccaaaatatactccttgaagtgaactgtccactgtcgatggaacaaaaaatgtttgtctccaacgaggtcaacttcaataacagtccaaacaaagagagaaaaacatgggcgccggcataacacaccagcaagcagattggtagtttgggagtacaatacaagcagaaagactgcaaaggtggactactggtgggccctgaacacattaaactgaatacttaagcatatgaaacgtgcagtacagtatgtagtacttgccactaaattgtgcagaaacagcatgctcaactcaggtgactggatgccaccagtggcgaagccagaataaaaattactaggcgttcttgatatgcttatatactaatttttaagtaatataatgcttaatataactaaaacacctagaaataaataagctatccggtgtccggggacaccgggtagatacatgtaggaacgcccctggatgctaccaaccgtgtgttactgctactagtaatactagtacgacataaattgtactgaatgcgatttgaacaatgatcctgtcaagtgtcaagaaattaattgaggtggtagaggacaggtttaatataatccattattaaaaaagaaattaactgaggtgctctccgtatcataaaaaacatgcatatccatattaatttcataatattaagatatgaaacatttcatattagattttttttagacgagaaaagtatttagtactctaaatcacaatactccaccataataacctgactaactatagtattactccgaggcaaacatgggtaaacctgtcaaagactcaaaggtcctgattgagagggcttccagttcctgcagcttttcccattagctccagcttcccagacaatttagattatcagaatatgtagttagaattcaaaaaataaactagaagccaaaagatagaaaaaaaacttctccaaattcttagggtccccttgaatcacaagaataaaaaaaaatagagaaatagaaaaaaatagaattatgacagtattgcaaatataaaacaaaatattacaaaacaacacagaaaacaacacaagaatgaccgtttgattggaacacaaaaaaaaaggaatttgagaagagataaagactcggggcccctttgttcgcaggataggaaaaacacatgaattgaaatagtatgtttctcaattcccatatgaatgaaaaaccataggaaatacaatgggagtaatttgatagtgccatgagaaaaataaaggaaagttcacaaagagatcacatctatcattatttttcctctgaaatgtgaagcacatgaatacaattctatgagaatttttctttctttcctatgaattaaagggacatgtaggaaaaaaaaatcatacaaatttgaatcagagtttttctccaaaacttacatgaaatgaggcattccataggaatttaatagggctccatagggtacattccttcgattcaaaggactatataggaaaaatcctataagaattaaatcctctaaaatttgtatgattttttttcaaattaaagggattttaaaaaattggttaccaaccagctgcttattataattttagtctccccaaacagggccaaagttttgctgacacctgggagatagtggtggtactgtaatgtacaatggccaatgggggatagctgcttcagattagccaacgcaaacagataggttcgctgtccgctcaaccaaaagatgataaacatgaatcacaaactgttgctggacatcatgctatccatatgtcgcgatcgacctttgcattccccaacttgattagttagtctcgcccgggtttacctttcgtcctttcccatgaactggtaacgcggatttccttaatttttactcgaattttctttttggaatacaaatttctcaaaaaaattcgattttttttatcgaaatctactttttgcccccatgtcgaaacctcaaaaatttaatcagaagataatgcttaatatatgctatccaaaggcatcgatcgcatatcggtcggtctgctgtatggcccagttggatctcaatctactcaagttgccatttctcagcccaaaagagattcagcgtggatatcaattgggcccagcccaaagctctacagatagatccccctcttttccccttcttttcttttcgtgtacaattttccctttccctgatttaagaatatggaatatatccttgaacacccccacccccccccccaaaataaagtgaatatatacaggcttaacataagataagtacactaatgcatgcatgaataacgtataatgattgtcatacagaagacagtatacttacgtgctcatgatcaactgataaaaggtccgatcagctaactgataaaatgcacgcaagaaaggaataaagggtttggacgatggaaaagagagctcaacgtacagacagatcgatcgacatagatcgagagggaaagagacatgagagaagcccgcaagttatgctgtccatccatgcgggcgtccagctttttttcatcactatttcaccggatccctaaactgctgcttgtattcatccatcacctacaaacaggacagaggtctaacttctaaatctattatataattaaaggaataggaaaaggagcctccacgttcgctcttatagcctagaaattctcacattaatcagagaaaaagaaaaaaacagagtccatatagaaatacaatttagaaatagctcaaattcggaattaaaaaataaaaaatattagaagaggagactagagtccatatagaaatacactttagaaatagttgaaattcggaattaaaaaataaggaatattagaagaggagactagagtagttattacacattagtagttttgaaaagttattgcaaaatttaaaattatgttgtcagtgtaatatattttaataatataatgagaaaacatatatgctattatatgagagaaaatataatgatgctagctgcacaatttgcacgggccaccatgctagttaaactttaattaagagtcggatttagaataaagttgtaaagtactagtgtcttgaactccgctccatcgcactagtctatttcatgagaccgctcaacctctctagtccatttcattttcatgagagaactctaacccgtttcgctctcttttttaggtttgagttgaaaccgtttgaatattgagatctacttcaagagctacaaacatttgcttaataacccaccggctacagaaaactgtactccataatattactcggctacgtacaacaagcgctatatataagtaattatcaccagcctaactaactaacataactatgataacggtgacaaattaaacaacagtaacagcaaatagtaataataataatacacacacaagcatgtgatatcgaaatgcagtcgtcgatggatatatgaccagctagctgatcatcagcttgtggatcggagtcggagaaggcgaaggacgacgacgacgacgacgacgggagagctaggtagaggaagcaagctaccagatgaaggtcatctcggcggaggcgcgggcggcgtcgtcgtcgtcgcgggagggggagtggacgtggcggccctcgtaggtggtgatcaccatgcgggggtcctccgccagccgctccacccgcttcttcacccggcagttgtcctgcgtgcaccggtaatagctcctgcatatatatatatatatatatgcaaatatatatccacaatcacacacacagttaaccacatatatacttcagtacgtgtgtgtgtatatgcgtaggagtgtgtaaatttgctttaaggttatcacttatcaacaagaaaatcgattttgattaatcttgccttttcttgcaacacaacgcacagatcaaaatatagtatagtaatacggagtagtattgaattagggactaactaatacgcgtcgctagtagcctagctagtaaatacatgttcggatgacatccaaacaactttttagtacggagtataacatactccaagtagttctgtttagcgttatggcaacggatgcttttgctagctagtagatctacgcacgtcctaaagcttagatatacctttctacccggtactgctcgtgctactctattctacctacactctacaaatatggagtatagtttttatgtagtcggatttccaggtgaaagagagattacaagtattctaggaattggtatgttaaagtacaaggagagacagatattggaaaattctcaatcatggcctgaccctgctgacacaccaactagctaggccatggagataatattccaggctacccagctggtagcatcattcctcatctcaaacctaaggggcatagatattgagaaagatgtggtaataattacagggtacaaaaatcttgggccctttgcaaagctcaaatccaccttttcatcatctcatggccctttacccaacagtaaagattctccatcagctcccacagccaacaaaaagcagatatatcacacatccaatatatattcactttaaggcaatatcataattgttttttcctagaattttcaagcaaaacatgaaaaaaaatcagcattcgaaataagaacatacccctccatctaaaaaaaagtctaatactaactatgaacctggacacatatatgtccaaattcgtagctaagggttgagttttatggaacggagtagcatatatcaccacgcttatactttcatcctctcgcagctctacataagaacttgcatgcttaattatatgttggcctcaaccgtctaaagtctctctactgcatatcaacacccacatataatacctacaattgttcgcatgaacctactaatatacttctatatgtccagattcgttgtagtaaaaagtggcacattcaatgtttgattgggttttttttgaacggaagaagtaacagcttacacatatacgtacaggttgcgatcaaattaagttgtctcataaccagatgtatttgtgagacttaatttgctcgatcgtcgttacgttgacacaatctcgacgctaattaatactgtatgatacgatacaccagattatccattactaatactaccctgcagtattagttttgacaatcaagaaagtagaagaaaaatgaggatgattgccaatcgattggaaaagtcatgggtgtgttgtagtagtggtgtgtgagccagaggaccggatgggaggagagggtttctgagtggcatcattgcaaggggctaatcagattggactggatgctgggctcatgtctgctgcggtgtgggtcaatgctttggcactacctgtcatgatcaccatcacgcatagacagatgttcacacaagcacagaggctcctaggtggtctgccaggagatgatatagatcttgtcatgtcatttccatcaattttatagtagcatgaatagtagggctgtgtcgagttccacgttaaatttagaagctcgaaaaaattagaacaatatcacgaaaaagttagaagtttgtatgcgcagaaaagtttgatgtgatggaaaagctgaaagttttaagaaaaaagttggaatataaacaaaaacctaggtgcaaactttatactccctcgttgatgtcactagctacttctgattatcctaaaataaatttaattttaagtaatcattatatcatatcagagtttataaaaatacatagagaataataaatatattaaaaataaataaaagggaaataattacattaagattcgataaagtgggagtattctagtctttatattttgtattggtatatatggaatgagtaaaaaatgaactttggtacatagagtaatttttttaattattacttcttccgtgttaaaatacttgttattgtaggcaattcagccttattaaatgatgtcaatatgattaggagtagtacttcagagtgacaaatattttagaacaaattttggaaaaaaaaaaagctactactttctccgtccgtccaaaaataagtgcagccgtaagaatctgtgtccaacatttaacgtctgtcttattttaaaatattataattttttttaaaaaaatcacacataaaatactattaatgttttatcatctaataacaataaaaatactaatcataaaaaaaaaatcaaataagataaatggaaatgaacagttcaaaacaaaataaaatgtagaataaaatgcatcctccgagtgtccatatttatagaacaaaatagaggtggtattaataaatgtagaataaaatgcactcccgagtgtccaaatttatagccatgggtaattcttttttaacgaaggaaaagtatattcatagaggtagattaggaggtttcataaattaaactgcacaaaaaaatgctttgctaattcagtatcataaaattatccgatagtaccaattaagattacaaattactaagatagtttgcttttcttctgttgcgacagttgttgtctacacatgggatgagtggacgttagtgggactgttagatggtgcaatgagcattcaacctactaagttaggatgcacgtcattctctacatgggagctcagttggtcctacgtgaaatggactagtcgatcgatcaatttcattcttgaacagaatgaaacaaatgtagcgcaatctgacccaatctagctattctggagtgatctaatcatctacctgaagcaaaatatcatttgttggtggttagttggaatattagtaatcactaaaaaccggggaaatagttgcatattatgtataaaatcaagcaatcaatgccaaagttattccacgaaacaaaggaatatagatatatatgagcgagaaagatacactggtggagaaaccatctttggtcggtccggcaaaatccacaatagtcccggatccaaaaagaaccgggactaaagattgtttttagtcccggttataaaaattttgatctttagtcccggttggtaacaccaaccaggacaaaagatgatctttagtcccggttcatccgctgtcagatgtatgtcagggggccgaggatctttagtcctggttgatgtcaataaccgagactaaagatcaccactttagacccggttggtagtaccaaccgggactaaaattaagggctgcaggaa

SEQ ID NO: 82260 - DNA, 9438 bp, Oryza sativa
gtcccaaaatattgttgcatgtttatagattttgaaattttgattttaaaattacattttgggacaaaaaatgacttaaaataaaaaaaattcaactacaaagttgtaaatcgcgttgagggctacaagtttgatataaagtttatcttcattagagttcacatgaaaaagttatgaattatttttaaatataaagtctttagaccgtcctatttgacccagatgatattcaaatccaaatttagggaccgaggtggcacaactgaacaagttggaggacctaaacgagtgatctataagtttagggatcgggatgacacagtcgaacaagtttgaggacatgaatagtcgatttgcgagtttagggaccaggatgacacagcggtacaagtctagggaccggtgatggactttactctttagaaaatctccatcccaaacctttccagataaacaatcaaggccatccatctcccaaagacctaaatcggcactggcaacattaactgacatgtcgactggtacgatctctattttgtcgccttgccactgaattaagcattggtgcatagtcgaaggaatgcaacaattggtgtgaatccaatcccttccgagcaacaaactgtaagaacccttcccatcgatgacaaaaaacgtagtaggaatagtcttactgccgactgtcagctccacatttagaacacctttggtttccgatggattaccaccaaagtccttgagtgccatatttgtcttgatgaggtcctcagcgtttctacccaacttcctgaacgtagcataaggcatcaaatttaccgcggctccaccatcgaccatcatctttgacatcggcttcccattgacgtagccatttacatacaacggtttaagatgccgattgtctgtcccctcaggtttctcgaacactgcctgttctagtgacagaaccaacttagccgattcctgttccacttcgtcgacatcggcttgatcgattccgaactcagctggcaaggtaaaaaccatgttaattggagctgttacaacactcctcccttttgccaacttcttcgccttatcggctgcgacaccatcagctacaggaacttgattcttaacacgccactcttgccttggctttgctttcctcagccgatggttaatttcctgttcaacctcctggacgcgctccctgctcctcaatctttgaacccttcttttctgattcttcgtgaaaatactagaaggacaccattgattcttccttattacctcatcctcttggccacgatcatgattcgcaggacccaatctttgatgaacagaaactcttgcctgcttcagccgattacccctattatatgatcggcttgaactctcgacgatatcactgcacccagggcaattttcgatagatggcaacctcatcccttcattccaacagaatctgaagaactcacaaccccaatgaggatcaaaaccatcatcgcattcctcataatgcttctcctgctgcttgtcatacttcctttgatatttgttgataaccttagccgaattcacctgaaaaccccttgcatggatcctatcggctgtttggctagctgtatacaccatattaacaggaaaaggattaccatcgaccttcatcggctttttggagtcatcgaacttaatcttgcccccctcaatagccacctgaatctgctgtctaaaaaccttacaatcattagtagaatgagacccagaattgtgccatttgcaatacctctttttgcctaattcctcggccgatgggatcgtatgaccagcagaaagttgaatttgcttctctcggagtagcagatcaaagatcttatcagctttagtaacatcgaaatcatacttctcctcctttccagaacttttcacccactgacatagtatgacctttttgctcctaacccactcggctgcagctatttcggaatcatcatcctcatcatccaatccatacatataaggataaacatgattaatcttcctagagttcttcctagcttccgcaaacttttgttcatgcaaagataccttctgtgtaaggtgcgacaagctttcaaagtcttccgatgagaacttctccctgatcggagcaatcattccctgaaaagccaagtcggctaactgggcatcggtcaagctcaagctgtaacacttattcctcatttccctgaacctctgaatatactcgtgcaccggctcatcatgcttatgcttgttcgacgtaagatcggacaacttcatctcatgaaccccactatagaaataactatgaaactgcttttctaaatcggcccaactgttaattgacccatgcggcaaagaggaaaaccaagtaaaagccgatccatccaatgacaaccggaataacctaaccatcaaagcatccacagccgatgcctcaccacactgagctaaaaatcggcttatgtgctcataggttgatgtagtatcttgtcctgaaaattttgagaaatttggcactttaaaccgattaggtagaggaactctttcaaaccactcaggataaggttgtcggtacaaatttccagtttcttttggtttaagcccaaatttctccctcatcacatcagctatcacatcggcccatgttcgttgctgaggcgttccctgaggttgttgtggtataggcccaaatttattgtattgaggaacaaactgaagctgagccgattctgcctgctggtattgaacttgcggtgatgtaggttgatactgataattcaaatcgccccctggtaattgtgaaggttcggttgaataccacgcaccaaatgtttaggaataacttggggtatcactatgccatctggttgtacgtgatgaaccaagtgctctgggatgacttatttgcagcatactgcacatgctgaccagcatgtgctgcaaacccagccgatgcatccattcagccctgctgccgagtcggctgaacgacctgctgtctcaacggcgtctgctgaatcggctgtacaactggccgatttggtggtgtttgttggattggttgcgtgacctgctggattgggggcatttgttgaacaggttgcacaacttgttgcctgggtggtgtttgttgaatcagctgctgctgagttggatcaaccgtattccaagtaggtaaatatatagatgcaacctgatcctgcgttagctgggtcacatttggtccagcatggtgtggttgctctcttaccaacaattgaggattgatcaattggcccagagctaaaagttgcgcagcaaacgtgggagccgatgctggtgtcgtcggctgcggtggcgacggaatgggaggagctgcctgaatagacggctgagcatcagtgatcaaaggccgataatttgggaagacacctccttgtaaatacactgggcctgcagcctgatgctcagctattgaaccatcggctattgacttcatcatatttgacaaagtgttaaccaacaccccggactgatcgatcaaagcattgtgaacagcatagtcaacccggtcttggaaattgttaaaaaagtcttgtgccacttcactattctgattaagattccctccttgtggcccctgagcaccgtcactctgaactccatgaactccttgagacatgtcaccttgatttcctaaagagccatcggtagcacctttgatactcggctgagctgagccgtctggagcttgttttccttctccatctttagaagaaccggtcccaggatcatcagcaaccactcctatcttgtacttttgaacaagtgtccccttgcgggtctgcataaatgagttcaaaaactgatcccgtgtttgctgcaacgttgcttcaaactctttcttctgttcgggtgtgaacttttctggatcgattggcatgacgttcttttcaatgatgtcatccaatcccgactttgacgccttgtttttagcagaacctgggctagatggtggtggaggttgtttctcggccatgagggagaggttgtctgacttcttgagtgtcctaccgggcgtgccaaaagcgtgttgacagaaaacacgagacctgggagatctgcttaactccagtgcaggtccaaagctcgccttcgaatgtataagcgtgccagttgatttgatcctacaatcaacaagaaacaaagacaaacaaaccgtagttaaatctataaatgatagccgatcggctgtttgccaatgacatatcatttatctctgagccgatgtcgtatgtgaatcgatcggcgatcatcaataagtaacaaaacaccaaatctactagatcggctgtagatatcaataatatataatctttatatcaatatacacttaaatcaagtgattggagtagatcggtcaccataccgagacagtataaatcacttaaatcaaaatatatattaataacgagattatatatatgtttgtagcatggctgatcaaatagatctagcatgtatcggctaatactccgatactgctttatattaagatattgaagcagataaaatactcaagcagatgcttaatatacttagatgtgacaagatcttaatataaagggcagatttaacatgtcaatgaagcatataaagcaaatattgtcaaatcagatcagatcggctgaaactccgatactaccctaatcggcaaccagaaggcaggctagagattgtaattctaagcacgacttaatagatcaaactcaactgatgcagcattaagtatgaaaaggacaatatctagacaatcaaaccgctggatgtttcatagggtggtagatatcttatataatctgaatcaacattgaaatctaacctaatcggttgccttccttgatagatgttagccgattgtaggttagatgacgatattgccagagattacgtaagatatatgataactcgacgaatcacataaacaagattacagtatcgtaaagatggaagtacaaatcccgagaacgcaagttatcataacaagttttacctcttgttgaagatcaaaccgatgcagctcaacccgaaagcaagaactcgtcgaaataaaattaaagcaaaaggtggcgatgcgccaaaattgtattgaacgtgtgtgttaaaaattacataggtctcggggtctatttatacccaagaattacaagatatgcccataccggacacgactgttatctctaacaaactctaagatatcataagtctttgcggaagacttttgcccacatttatctataaggaatttacataaaatatcctaattaatagatacaattgcctttccaggactctatccgtgcgtggcaatcatattgaagtacattaatttgaacccaatgtcgtatacaagtcgtattgtcggaatcggctgaatcacttaacccaatctgactcagacttagccgatcctaaccgtagccgatctagactccagccgatactcattctgtttccacgacaatcctcatcttcgattccacttcgatcccatcttcctctccgatgctgacactaccaaatatggttgttaaccaacaggagggggaggggtttcgccttctttactgccgccatgcttgtatggaggagctctctacagcaaaaaggaggagggcaagggggaaaggaggggcgaaataaaaggcagaggaggaatacgaagaatttttttgagaattaatattatttttatggaaaatcgcaaaagtagtggccaaccggggaaaatcgcgaaagtaggtccatgtcgaacgggtgtagttcgatagggcacctatcgaacgacgggcagtcgacaaagccctttcgaacggctggcgttcgacaagctcacctgtcgaacggagggagttcaacagggcccaccacccggcgccgcgaggcctgtcgaaccgggggcgttcgacaagaccctccaccgaccctgtcgaacaatgggcattcgacaggccggtttaaagccccgtccacccaggccgcgatgcttgttcgatttgtttgaggaccacatcgccagccgccgccgagagtcgccacatcgtcgccgtgagcgccggagggagcgaggggaggggatagcaggccggagaggaggccgaggaggcgccggccgggaggaaagggttggcgacaccctcctgcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaatttagttcttagttagtacatattattgatatgttgtgtgttaaaataggtacaaaggtgttatattttatttggattattaaactagttgtttgttactaatagttgtaaattagtacacggcaatgtagtataagttgtaatagggtaattatcgaatgattaaatgattaaacgtgaaactatttgttatgttttatcaggatgtcaggtgatatgcccattcgtctgtattatggcgatgctcctatacaaatatgtgatagcggggtggatttgactgtatatgccttccatgatactagtctgaatgcaccggagcatatgcgtttgaacgacgtgttagggtggttgtataatatgtttggggtagatccagtgcacgataaatttgtcataaatgccgtctgaccagtgaggggtcaacatggatggcactggagagtagtggaggttgcgtcaactgggagttggagaaagtttgttagtaaagtaagggagaaaggctatagcctggcaatactggtgcagaagacaacatgtgttgatcgatcgggggagtcaagtcatgccgtggtggaagaaactccattggaaggtggacaagctgaaaatgtttggcggactgagcaaggtcgaggggaagaagtagtagagggtaatacacaaggagaggtcattgttcgtggtactaatcgtgaggccaacgactcggacgatgaagaaccggattcgcctatgcgtgttgatgcagcggaggagaatgaggcggtagtggatcagatggaagtggaaaacgaggaatacattgcgcttgtagtggaaggagaagatacaacactgtgggacaacgaaactaacatacccgatgattggacgaccatatcaatgagtcgtatgaaggtaaacgatggtttagatgcctactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcgagggttgagcaacatacgtgtttgttggagaatacccatctggtgcacagaaacctgacagcggcatttgtggcacaaatggtatattcaaaggtggttagaaaaacatctttgtcccctttcaccataatgcatgacgttgagaaagagtacggatctgagatatcgtacgacaaggcttggagggcaaaacagaaagcattggagatgtggtttggaacttatgaggattcttatcacaatcttcccccactattagaggtgaagcaggtactccagaaaggggctcgggctttcctacgagctagttattgtgaccacggttcagccgatggtacaagagtgggagcacgcagctgataacttggcacttcagacacctccagacgatgggagttattatggagcttaccttcgttggtaccgcagtgttacacgatggaggtgttttcctccacaaagagatagcaccgtcccccaccaggcagcgattactgacacgtttgcccctcagcctagatcagcttacaactcaatggtacgtgtttatttgtggaatttgagcaactagttcaattttttaaaaaagttagcaagtagttcagtatgtctaataaatgtgcaattggttcaactagttccttttcttacataaatgtggaactagttcagtatttaaaatgatgtgcaactggttcattatttctaacaaatgtgcatcttgttaaatactcttaataaatatgcaaatggttaaataattttaattgccttgattatttgtggaacaggccgaatttgttgagcacgttcacgtggagtccgacaccctgctgcaaagactagaggcgagacctccagtcgtcaggcctgacgacgtggcgagagtccttcgcaacttccgtgcacgtgctgccgcactactacgtcgtgtctcctatcggagcgcggcagatgtggtgcagacgtcgggccgacggccatcaccaccactaccccgacgttccagcgtggatcggagtggtccatcctcttcacgtcgcgggtacgaagcagcccacacatctcacgatcgtccttcctttcagctcaccccagcaccggagtacaccagggggtcagctggatcaggggtacccacgtcgagcacggcaccaccacgtccgcaggtattccaaactccgccttatgttcaacccacgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacagcattcattgaggacttcttttccactgatcctccccatggggaagtagggatggattactggcacgcagcacctcaggtcacacagccgacgcaggagacggaggccggtcaggggccagaagtgacaccacagcaggcagctagagataggcacccccctgataatttgacatatcccactgagcagattaggcataggaagaagggaggacctaacaagcgtgcaaagggcactgatcgtccttgacttatctatttgtattaaacttttagtcatttatgttctgtccgtactatttgagaaacactttacgattaacttagtactatcagtactatttcataaacttcttcggataattactcagtagcatacccttcgaatgaatcatgacaaattatcattcaaatatacaaataatgaaacttaattattcaaaatatttt

SEQ ID NO: 82261 - DNA, 2510 bp, Oryza sativa
aaaagtcaacggtgtcaaacatttcgaaacggagggagtatcaattaaaggttttctattgtttcatcaataatcaccatttgtatcacaatcctctgtccagaatttaagaaaggtttaaaaaatatgtatggccatttttggaaagaccatatttgaaagagaaaccagcaatccgttgcaacacatgatacacatctttggcgacaccaatttctcatagtatgccatagtatgccaaaagaaaatccaaatctcattctgttggacatacctggtccaaatcgaatttctagaaactaatctagccaacaatgagcatttgtttcttttgcaaggaccgctgaacaacttacagaaagggcatatcaaccattaaagtatccaagtaagaattgttttagactgagagagctttgatagccacccatcaaaggttcaaggcacttttatgaattaagaaggcatgaaacttataaaacaagatgcacatctatattacatccaaaccaaggtctctaaaatactactacgtagttattagccaatgcatatccacaaggaaaaaataacgtgaacagtgatttgacaaactgatatttgcactcaaatatgatagacaaggttcagcaaaagatattattaaaccctgatcaatctagtttgtgaaattatctgaattctgaagcgctttacgcaaggagcagatcaatgatgatatatgccatattcaagtcactacttacagtgcttctcccctacttacatactcacacagaactcaacacttgttgaacactgcagagatcacaattcatgtttcacaattctgaacattaccgatcgatttgacactcttgccggaaccatcatatagtttgtacttcctccgtttcacaatataagttattttagcattttccacattaatattaatattaatgaatctagatagatatatatgtctagattcattagcatcaatatgaatatggaaaatgctagaatgacttagattgtgaaacggagggagtagaagtgatattagcaaatatagacaagcacggtataattaagctagcacatcaaatggtttggtctaagagattttaccatgtcccagcaacagagcagcacctcgccatggttcgtgtggaaggctggaagcccacctggttgtctgccgccgatttggacggggatgctgctcccgtcggcagtggcgatgctgctggtccggttggaggggcgcggtccgcggtggccgtggacagaggtgtgacccacgcgatttggcgcgagatgctatgaggcgaccagggcaaggaggcagagcgtcacggcgtcgatctggcgagggcacagggctaggcggcggcggcggctactggttgaggactacgtgagggcggcttcgactggggatcggcagcgttctcgatgacgactgcaacggcgacgagccacgacgcttgaggcggtggattcgacggggattgacggaggaagacagcgcggttagggattagggagggagcgcgtgaatacggggagggggaaggacgtgactgcagtttgcgctgggtcctggcggcggagcgaatcggcggcgggaaggcctgtgcgacgacgacttggtggagggcagagtgcgaagggcggcgcgggatgggggtctgactgtgcgagggccgcggttgacgattcgacggagggcggagggccggcgtgcgaaggaaaagggagtgcaaaccgagcggtgatcccgcatgcgcgatttttcgccgggtgaccccatgtgctacgtggctggttgtaatgcgttagatgtaagcgagataatccggaccgttgagcgaggaatgaaaggtgagtgatgagtgatgagttaaatcatttgttgaactatagggtagattagcatcctattaaagcgtgaaaaaagggcaacccatcacactaaagcccatctaactacttacggatcgatacaatcaaagaaaccctaattcccacgctacacatcgatccgccgccaccccaactgcgctctttccgccgctcgccatgctacacatcgatccgccgccaccccaactccgttctttccgccgctcgagtccgtgtactgattccacgcgcggaggtcgcggcaacctttctgattagcgccgccatatcccactccggtcttcctctctgccctagccgcttgcttttccttctctagcgttgtccatgcttttcctcatctagtgctgctcatcccctcgcctgtagaggagaaacaaccatatcttactagtcggcgccgctgctaacccgggggtgcggggacccggaaggtgtgcgggggcgggtcttgttttgcacccgatctgtgcttcgggggcgggaacgggggtgagagtcagggagcgggagcaggggcgggggcccaggttcacaccattctcctgcctcagcctcccaaagtagctgggactacaggcacctacaaccatgcctgg

SEQ ID NO: 82262 - DNA, 6743 bp, Oryza sativa
cgtcaaacatttagggatggagggagtatatttttatgtatacatataattttacatatttcataaaagcaaatatatttaaaaaagttaacagcgtcaaatatttagagacggagggagtagtagctatcagtatcaggtgatttaattacatcatgggcgatcgagttggaattaatattttgcaatcgatctctcctctatcgagcgaattcatcttcaacaattaatattgatgaatattgctccagtcttctgaatatcaacgttaagcccctgtttctttcagcttaggattattataatccagattattaggagtaagctgaaagaaacagacaacttattagagtagcttattataatctggagtccagcttattataatctgataagctcatttatgtgagctttttctagattattaggtgaaaaattacccaccatgccaccacacttcctctttagacttgcaaacctaataatctagactctaataattaaaaaagaaacaactaaccgcttattctactacagattataacaatctagcaatctgactcaataatccagattataataattttaagctgaaagaaacagagcctaagtcttctgaatctgatcaacgacatttgtacaacatgcatgtgttccgttatatagttctatcagtatcaggtgatataatcatggtcatgggcgagtaggaatcattattacttgcgtttagctcttctagcgaaatcatcttctaattacggcaatgaattatttggaacaccagaatcaatattccgataagctttaatttcggtactactgaattttacgttactatatgtgtacgtgcctagcaaaattaagttactagtactactctctctattttcttactcatgacatggtttacttttaaacgttatgtgttgaccgtttgcctcatttaaaaattaagtagtgcatgtaaatatgtaaatacgtaagttatgtttaaattttctatatataacaataaaaacaagtggcaacaaaataaatatacatagctagttttaaataagatgaacagctaaacatcaaattcaaaaaatatcaatatatcacatatttggaaacagagggcagtacaatgcaacgtgtacatgtggatgctactgtgtgtgatgttattgtctagctactggttccctcagggcggcgtacctctacagccagcagaaatggattattcatctggtgtctgctcatgcgacgactcatctgcagtcaacacgatgtaggacaatgcaatatatgcatgccaagcaaataggagtaattgccatttgcccccgctgcgtgcatgcatgatataagagtagcttttgtgtgtgtatagtatttttaattaccggcgtcgatggatggttatccagcctgttacaaccaatcaaaaatctggccagcaggtctttactatagctgttattcaatcaaagcaggtacaatagactataagctagttataaacttattttaagaagataaaagataagaaataagagcagcgggctacagaattataaccagttgtaacacatactccaagatacatatgtatacgataggttggaccagatattaattatatagtacatacttataggtaattattgtatgaattggctattaaattgactatagatgattttgagccaataattggctataccattaaacttgctcgtttcacttcattaaatatatcgctaatagtgatagctttaaattttttgttgaaaagtcattgtttgtagtaataatgtagccctgcttagggatgaaaacggagtggatgatactcataccgtattcgttttcatatttttgccagatacgagagcaaatacggatagctcgaatatggaaacaaatacggattatctcgaatatgaataagaatcgaatatgatcggacatgaatatggaaacaattttttatcgaaacacgaaaaccaactcaaattctaataggaacaaatatcaacatatataattacctcattttatataaaatgtagtataatttataatttttttttaattttaaataatattaatattgtggactagtgttaagagatgaactactattaaaatctaaaaaggtatattgaaagttatagaattataaagaaatgaggtatgtctcatgacttctgtggatatctgaatagcactgttcaccggatatccgaattattatccgtatccgacggaaaccccgataccatatctgtatccgtatccgggaggaaatatccgtatccaaactatccgatccgaaaggtatccgtattcgtttttctctggagtggacggaaactatccgcttcgtttttatccctagccccgctagctcctagcacgatcgttgagcacgcgtaagtaacgtacgtatttggagaaaattacatttgtagtttttcaaaaataattaagctaataccaattatttttgtgaaaatactactccctccatctcattgaataagacacgcatgtattctaatattcatttgtttaaatatctgacccataactatttcattataaattaaattttatttgatgaaaatagtattatattggattgatattttaatttgctttcttataattattattttgttactataaatattatattatatgagaaatttaaagtcaaagattaattttgtaggtcatgccaagtttgattgtgcattgttcagtaacggagcgggtaagatatttagcatcacataggtgccatgtattggatttgtatcactttcaattaatttcctggttagtgataatatatttagaaattttagttatattaaagtttaacactggaaactgtaaattgaaggctgtacaccttatatctttttcagcaggatagtgctaacactataatagtagcagaacatattaaagagtcaaaaattttctcacaaagtcacaaagtgatgcattaatatttgctctgatcaatcgataatgaccagccaaatcttctcagccgtgcaacaatgcaacacatatattagttgcttcaattaataccaactgtacacgtatctcgcgtagggatggcaatttacccggtaggggcggggacccgtaggggacgggtccctgcccctatggggctggggtcgggactggtttcgtacccacggggcgaccggggcagggccccgactttgttcggggccgggggaagaattccacccgcgggtccccatgggcccccgaaaatatagccaatgaatacccatgtctatactagtaatatgtccgtgctaacgctacgtgacatctcacaacagcatcacaatgatactttgacaggaaaaaaattctgtacaaaatatcatgcttgattccattgttcaattttcttttgtataacagaacaccatacgaataagcccgagtacggtctgatataggttaacatgtattgcctccgttttttaatagatgacagccgttgactttttctcacatgtttgaccattcatctttttcaaaaaatttacgtaattataattcattttgttatgagttgttttatcactcatagtactttaagtgtgatttttttttgcggggaaaaagagaataaattactcaggaatcaaatcgtttcttacaagatttgatacaaaggtgcaatcacttccgcaccaaaccttgttgaggttctcacatctacctttatttgctaagtagtgactaactgaattttggcttctgtgagtcttcctgagtagaattttggctaagtgtgatttatatcttatacatttgtataaaatttttgaataagatgaatgatcaaacatgtgagaaaaagtcaacggcgtcatctattaaaaaacagagggagtactttacgaacaggaaatttaatatacacagtttgaaatttgaaacagtagtgatgtatatgtctcgactttttagaatatacacagaatttatatgtctcgacttttagaatatacacagaatttgcgtagtattttatgcaacgattattggttagatgttgctctgaagaaaaataagcatatttaattataaataaattgaatagaccatgcaatcccatctctgtagagcaggtcatcaaggcatacaaatacaaaaatatgaattagtattcattcattaatatgaattaaagtctgattattgtgtctgcttggtgcggtggtgcctatgctttcttgcgctgcaatgtcatcatgtccctcttctctaccttgatgatgacaaaatccatttgttcctccatgaaaaataataaacaaggtcatgataaaaaggaacatgatcacaactgccagtaaacagatgaacagaaataaaaaagatcatgcaaaacttacatctccaactgtatagctgtatcacctatgaagcacttaatgtctttcttaacagcacgtacaagatggattccagtgttacattggatatgctataccattcttctatgaatcaatgatagttgcaacctggctgtgtgtgttagtagcagatctatgcaagtagtctacaagaattacattattaggtggcaggacaagaagcactgttatatgtcgaggatattcacattcatttgaagagtttccacatttacctaaaacaggaaatgaaaccattgtatcgtatacccagccatacctttaacctcttccaagccccacagcgttgatggagctgttcgattaaccagccagcacaagcacatcttattgatatgtttgtcttcgactccaaactttaacttcaatgttttccgttagcacacaattcaaactactaaatggcgagttttttttaaaaaaattatatagaagatatttgaaaaatcaaataaatctattttaaagtttataatagttaattcttaattaattatgtgctaatgagctttcttgctttacgtgcgcgaaaaatctttcttcaaactcaccaaaagaacgcaaccttatctcaacagatccaactgagcctatatggtctgattcaccgtgcacccaaattaagaaatattaaccgaatatgtggtcaatatacatccacgaaaacactaaatatcttaaactaaacagatatactatcccgcattccattaacaaatcacaaaggtgtcattttcataatgcatagagaaacaaaacttatggagtgaagtcgtaccaatttaccatcagagtttataaaatgattataaatattccaccataacttgagctaccaaaatagcatgtacagttatcaacaggttaagtgacagtgagtcagtgacatgccatacgaatgatcatggtagcacatcctgcaattaggaaaaattgtagatttataacaaggattgcagcgtttaatataaagattcatagggagtatattaatgcaattcggaaaaatctgaacagatatacagttgaaaaaaagaacttttttgcaagattaatccagctcttgttcatcgcagccggcggcaaaccgaatagactggcgtgccagtgaacatgcgcatatcagcaagagtagcgactatatgtaccttagcagttagctagacacatatgatgtgatgaatagacaatgtttgtttaatttcacctttcaacctgaaatttatcggttcagaaaagtaagaacactaatattagccatgaaacaagatttccaatatggcgcatgaatatatatatatatatatatatatatatatatatatatatatatatatatatatatatatatatatatatatataatgtcaatgtaattctgcagttctactgataagaaactatggagatggacacttaaagcactgatttatacagagggggctgcgaggacggtggcgtggtggagatgtgttcggaaacttattaaaatagggcactagtgacagtattgcaaacattttctgtggaaggaagtgaaatgatcaaaccgaatatccgacatgcatcaggaaaggaaactattttaccaaatgcagagctctgttctctccggtaggcattgaaccaaatgctcaaaatatgcaaccgccatacaacaaacattttgacaattagcaagctgacatgaaaaaaatcaaaacaatgttatcttaacaatttgtgcataacaattagcttaaacttcaacttctagtcttctctagccaatagacatcagagaaccaagagagaaatgaataatttaaagcttgtgggttccataagcatactaagaccctgaaattacactctaataaaataggggtgggacccaaatttttcaccaggccacctctcaagcatcagaatatggcaatatttaatagtaaaattagtcaaacctctcttgaagccacctctcaagcataatttacccgtgctaacactacggcgatgtttaggaaatatgcacatgaaatccatgttaaaaagttcatttcctacttaaaaaatattttactattttgaggtccagatttatttaaattttattattacaaacaggagtagcctttagttataaaagttccaagtctcaatcaagagtaatttgttcactattaccatgttgatgtgtaatagttgatctgactactttataagatggttcttatttttctacatgcataaacaaatactccctccgtttcaaaatgtttgacaccg

SEQ ID NO: 82263 - DNA, 10062 bp, Oryza sativa
ttcctgcagcccaatcctcatcttcgattccgcttcgatcccatcttcctgtccgatgctgacactaccaaatttggttgttaacacatgccccccaagtccgggatatttggtaatgttccgaatttgtcatgtaccgtctccgagtaagtttcgcactccgccattattgaccgttattccagcgctttaaatactaaccgttcccctcgagaaatctcacgccgtgacttccgttttcaccgctcaagcaaaacttcttcctctctcttctccggcgattcctccggcgcaaaggcgatttccaggcgacttcctccccgacgagatttccgcccgcagcgatgtcgtcttccgccggcccatctgatgcgccatcagccgagtacgctgaggtaagttctcatcggctaaatcccttttcccaagagtagattgattttctcttgtctcctattgttctcttcttctcggtcgctttggatttgtagcacctctccaacctagttgcgattcctagcttatcgcatgaaaaccactactttctcggcccaatcggcaatcctgatccaaccgagttcattatctgtgaaaccaataggattccgttaagattaaccaatccagatccaggtcactggaaaaacacctttaaatcttggccgtctctagaaaaaacttccctcgagaaaagttggactacatggttcatgcgtatgtcggctagcaaaagagttcactgggacgaaattggaatcagccaagaacttgacctaaccatagcaaactcagccaaggatgaacctctcatggcagctgcctcttatttctggtccaacactatcaatgccttcttattcaaccaagggccgatgaccccaactctcctagatatcgtcatgatcacgggtctggatatcacctcatcggctaaccctatgagcttgaacataaagaaccaatatgacttcaagaccaagagcataggcggctggtcaagttatgtagcagtatatatgggccaaggttcggtcaccccccgagaacatgtggctttcttgttaatgtggctagagaaattcctcttttgtggatcaagctgtggccctacaaccaactggcagtttatagctgaagctctagaaacaaagagacaatttctcttgggtaaaatcctcctcggctatttataccagatgctgaacaatgcatcggctaagatagctgtcggcgcagtagttggagcaggctgaccatggttgctccaaacttggctaaatttgatagtcatgaaagttgtcaatcggccaaccgtgtcagaatccgagttaccaagactgtcacaccttaaaaatcccaaatgtataaattgttgtttaaatggaattattagaaataattttaaaagccttgaagcaaagatctaattttaaataagaaattccaatataaaagtgggctagataaaattttataaaatacttcgattgattctatagttcctagatttttttgggatttatttgagccaaggaagtatttttaataaatggaattgcatttcatgaataatttaaatggaaaaaggttttaaaatacctcttttggctttgggccgaaagtcggcccaaaaccttcctctctctctccccggcccagttcgcgccggtccagccagcccgccagccgagccgccgctctctccctctctctctctcgctgacaggtggggcccacctgtcaggatcttcatccacctcgcgccagccgtgccctagccgcgccgcgcgtagccgccgccgcccttccaaaattcgcccgagtctttccatctctggtcgaatcaatagaggggaaatgatcctcgggatatcctctatcttttctcttttggaatcttcatctaatttcgtttggaaatcgccggatttgagttcgaatcggattcgttttttttccccccgaatcttaactttccttctcgccgccggccgccgtgggcctccatcgccgccccctagcccctttataaggacccccgggacctcctctctccgtagccaccctcgctttagctcgtcgtcgcttgtagcgccgcctccgcgttagctcttgcgccgccgtcgtcgccgcgtgtccagccgtgcgccgccgtcgtctcggtcgtcgtcgtcgcttgagaagaccgccgtcgggatcgccaagtcgtcgccgtcctcgtcccgtcctccgtttccaccgaagagcgccggagcaccgccgtcgtcgttgacccaaacgtcaccgccgcttcgacctcgccgccgtcgccgtccgttgccgtccgtcgtcgtccaagccctcggtgagttcgccgcgtctccctctacgcatagatgccctccgtttacgccgccgcgccgtcgttcgccggcgagcatgcgaggccaagtcgctgccggtgatgacgacatcgccgacgtcaccgtcgatgtccccatagacccgcggtagaccgattcgatctcggccatccgttttgcattagatccatctcggccattcgtttcgtagaccgttcccgtgcacccggtccaccatgaacccgagccgctgacgcaataaatcattttttcttttcaaaaataattctttattgcgtcatgattcaattaaaatctaaataagtgttttaatccggttcaatctttaaaaattcataactaattcatcttagctcggatttagttggtttaagtctctaattttttctaaaattgagatctacatgttaaaaatatccacatgtactattcatgattttttatgtgctgttttggtgattttgctcttttatgcttagattccgatgttcccggagagtccgattttgcaggagaagactttgaagagttccaaggccagcaaggcaagtcacacagatcccaaataaccctttgagcatgttgatcccgtttaaagctatggtttctattcaactattgcatttatttctgaatgtcattgggtgggaataacctattgccttgttatagcccttttgatattgattatctattctttgtcgtttggttaataattggattagctagaacattatatggttttagcaaaagtcattaggatgcttagccatgcttagagacactagctcacataaatggaataacttatgattcactattatttaatgatggcttaattatagttcacgatggttaatcatgattggttaattaattaatgtgccaactaaaacctaataatggtgggttgtgagcacatggttttgatggtcgtgctcatgacaattaagcaccggttcacgattttcggttgtgaaacattaatcgtgccaaccacaagccagcgtgggcaacgactttactttctatatagtatggttcattgtagagcaccagactgtgaagtggcggagataaacccacgggggtcgctggggagtccatgcctttatttacaagggggtgattatgatccgggaacggtgcactactttgaattgtgttatgcagggggtattgtcacaatctctattcgggtacttgttaagtatcgcgacgcatggttgacatgatgttgaggttgtgtcttgtgggtacagttgtacatctctggccagagtaaaactattcgaatagccgtgcccgcggttatgggcgggtctaacaatgtctttcgtgattagtttcatatctctcaccataataaatgatgatgataataatttgtttagctcctggtttggaatggtatattcctggtttggagatagaactgtgcagccgggattggttgttcagaatggttgggcctatgcaatacgggagtgttgtatagtgtttacttaatattgcttaattacgcaactgttttactattctctcaaatgcttattaaatgttgtttatgcaaataagaccatattatgccatcctttgttatcccctgtatttgcatatttgctgcgtggcttgttgagtatgtcatatactcaccttgcaatcattcatcagaggaggagttctatagtgatgctgaaggtgtggatgattaggcgtagccctggtcaagctgcttgtgggatggagtcgtctgtgccgtttattttattttccgctgcttagaattttattgtttgagaggaactatctatctctgtaatgactttatattcgcttattaattagggtaataattgtactctattatcaatttgttattgtatgccgctgattcctggacgagggtttacacacatgtaagcgtttggaattttggatagaaattccgggcgtgacaagagccgattgtagaagatgatggagaagagcgcactcatcgcagatgtatgtcatacggagaatatgcatccacaccaaccgatgccggagcaaaactatcagctgagctgctcaaggattagttctgcaacttctatgaaggctttcagaaagatgctcgagtatggtttctttatgaagattcggctgaccttgagctcccatcggactttagattcgaagacattaaccatgagatataccaatcgtctagggaaattttctcagctgcaatcagcccatgcatccttcccgtcggtattcatcaaggaagaaacatccaagtttcttatgaattctatcatccaatgagctcagctagacaacttggaatgggtcaactcctaatcggcttattttttgctgacaagatccaatgccgaggagaaatttcatcaaccttgatgatggatcgactgctcaaccttctaggaccccctctgggcagtattgaaaacatagaactggcaatgttcagaagaagaaactttgatagatggtggggtgaatggaagctgcatctattccaccaaccagcttcaatgtatatgacagacctctttccagatgttgtccctcaagtaagtcctaacttcacttgatttcatttaaataattgcttagccgattaatcttaactaatcccccttttgatttgtagacaacagaatcttctcctcctcgtcagagcaacagtggcaaggatatccattatgccccaggcttaattcctaatggaggtgggccatcccctccggttattggctatgatgcccccaagacctcagctcttcttcaagggctcatcaaagaaccagccgatgccggcaaaaagaggaaaaccagatcatcggctgtaaacatcgcagtcccaactaagaagaaaaagacaaggaaaaccaagccagccgatgacctgcctaccctagacccatccattgaacaagctctggatgaagagataattgaagatgaagttgatcaggctgcagccgaagtaagcgatactgaaaaaacaccatcagcttcgcccaagcaaacgcctccaactccctctactccagtcctcttttcaagagtaagcatctttctttaacccttttcacaattattttgtcttatagccgatcactcccaaatttataattgcaaaaaaagaagactgcggtgaaaaagaaatcggttgcaacaacatctaaaccagctccaccagtaagatagttttaattttcattagttaactttcagccgattctgtctaacacttgtttccttttagccacctcctccttccccttctgtacatcaatcatcaagcgatcagacttcatcagctgtagggagtcaccatatagaagaagaaattcaaccaattgttcctgctatcccagtaagtttttctcttgacaacaatcactcagattagctatgcccatttaacctctaactgcttctacatcattactgcaggtcttagccgatcttttctctttcgacatcaaagattatcttgatgaaggagaagaagacaccacaagcaaagctttagcccctttatctgatgatgtaaagaaaactctggaaggttgatgtgactatggctaccacggatgcaaccattgctcacatcatggatgaacaagaagatatcaagatcacatcgtccaagagctggaatccgattcggctacatgctacactgctgacttcaaacggccgccgaatctacatacgacctccgttttcggcccgtgagtacttgatggaaagctctcggagccctctttccaacagatccagcctcatctccgaattccatcttgtgtggccggaatcacaggcacaaggtgctacgtcacctataatgggcctataggcttgtaacttcatttgggaccccggcccaggtggggcccatgtggggtgccccccaaccaggtggagcacgaccctaggcacccctaggtaccccttcagggtttcttcggttttgatagattaaagtttagccattgctacttgcttgcagcgcgcgtgtcggctagaccgtccgtctgcttgttcttcggaaccccaacttatcttttgtattaaattcctatttgcaatatcagattgcttttatcttgttcttgcttgtttcttcgatttgctttcaggaatagggttgatctgcaccggcaagatcaacaacccacggagaggtgtatcgatcgctaagccgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagttttcatttacctataactagaaaatagcccgaaaaaaaaattcatacattacctagccacatttgtgccattgcattgttcttttcagtttttgctttgttgaaatttgtgttgcatcgtcacgtcatgttgctggtcatagcgtttagtttgtttagagtttcgagttctggtcacgttttgtaccactgtcatcgttgtcgtcgtgtgctttgttgtcgtcgggacctacgaaaacggaatcgtctttccgccaaggtttcatttttctagttttcagaagtttctattggtcggttttgttgttgctgagttgcatctagttttttgtggtgtgattctgcgctgtcccgaggccgtgttgctgccgtgtgttccatttgccgtgcatgtgtatgcgaggaagaaggaaggaggagagatctgtctagattagattggattggtttctgtttggtggccaacgtagaaaagaaaaaggaagggagggatttgtctctgttttcacatggagcctttccatagatcgggaatcaatctccacccgtgacagagatctccagccaccgtttcctctcggcattggtgagtccgactccctccatcccctctcctcacagtatagacagcttggtgaaaaaatttcgtgtatcggattggagatccgtttgcaaaaacggaacctacgggacgacagcattccatttttgtatagttttaattttgagtttggacatttacagttgagtccctgtatttttttatatttatatttgagtccctgtaaacttgatttatagtccttgaggttgtttttgttaaaaaaaatccaaaaaaaaagaaaaaaaggcagaaaggtgcatacaaaaaagaaaagaaaagaaaaagccgcaccaaaaaaaaagaaaagaaaaggaaagaaagaagaaaaaaaaaggaaaagagaaaaatcagttgtatctttgaatttgctttcatatatcagagttgtgcataagttgttcctagtgctatcttgtggtaccgtttgtgtctaggctcgcgtctctagtacgttctagcctaggaccagcacggtgcttgactttgaacaattattcaactttgcattctctgatttgagcatttgctattcctttactacatatttaagcctacccagagctttacagatttgattgcagccgtacagcaagtgttagccaagacatcgatacatccaacctccattggggtgcttggttgaatcggtgtatgtcaccattccgcttgcattagtaagatcttgtaagagcttggttaaaagcttgagtgtgtgtgatttttgagctgccattacctagtagttaataggaaagcgcatatttttgtgtatgtttcttgttttctacgaacaatggcagggatacgcaagataattggggatagctgtactcaacatcgacatcttcgtcgagacatgaggagtgatcaacatgacctttatgaggtaagtgacgatgttctaggtaagatcaaatctgcactgccttattttgagggaaactatgatcctcatgcttacattaattgggagctagcggttgatagtgaatttcaaaagcatgtcttgtctgagaaacaaaaggttatgtgtgcctctagtgttttagctaaacatgcttctaatgattggaaacatctttgtaggcataacaaaataccacaatcttggtgtcacgtcccaaaacgactctaaaatatatcctttaaatgatgcctagaataattaaaatccatgtgaaagactccaacaattaaaatgtgcaaagttaaaagtcaaataaggcttggaggatttttgtatatttcctaaaagcctaaaatgcgtaaataaattttagtggaattttcagagcacacataataattattaagaaataaacaaaattaaaatgattttataaaaagaaaagctctaaaaagtcccctttccctccctctccctcttgggccggctcggcccatctccctccccctccctctcctctccccgcggcccattcggcctctccccgcgcgcgcgccactgacgggcgggcccgcccgccaccctcgctgacgggtggggcccacctgtcatccccttcctcccgccgctcccgccgcctcgcctgcgccctaacgccgccgccgccgcggattccgccgcatcccgccgtccccgcgtgcaataaagtgggggggaatcattccccgtgattccctctccctttccctctatttttccctctctctctctcgttcaaacgggcggatttgcccccgcaaacctcgccggcgccattgatggagcccgagatcaccgcgccggtttccttcccctccggacactctctcccccttccaaccttatataaaccctccccgcgcctacctcgcccgtttccgcccttgccgcaccgtctcctcgccggaatagagctcgcgccggcgctctctctctccgctgtcgccgtcgagctccggtccgccgccgtcgccgccccgtaccacctcccacctcagcgctgcctgcttcggttcaacgggatcctcggcgacctcgtccacccctccgtttcgctcgtcgaccgccggagcgccgccgtccccgtcgacccgagccgcgccgccgccttcttccgctccggccgccttttcgtcgtcgccgtcgacctagggtgagccgtggaccgccgcctcgtttcccccattccctcccttctctcggccgccgctccgccgtgcctatggccgccgccggtgaccatcggggcgcgggcgcgccgccacccgccggccgcgccgccgtggccgccttcgggcgcaccgagcggctgacgcgtggcgctcacggcgccggccggtgcgagcccaggtgcgcccggtccaccgtggaccgtgaggctgccgcgtgggccccactcccgtggacccggtccgcgcgccccctccccctcggctgacgcaataaactttttttttaaattaaaatttaaatgaagaaattcgtaaatattcacttaaagagcatataaacttcaaatagccataacttggccatttgaactcggaattggaccgttcaagtctctaatttttccttaagaagtcaagaacccatttttgtgctttgttcctgcttgttatatggagtttattagagtaaaagccttttcttttccgttgatcgtgtagacgctgcaccttcggaagatccactcttcgtggaagttgaagccgacggttgggaaagcgagcaaggcaagtcacatcatccttgaacatattgaat

SEQ ID NO: 82264 - DNA, 1978 bp, Oryza sativa
cccaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatactctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagagggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttccttgcgcgaactagagccaagtgctcctcgatgtaaggagctaccaatgaagagtgttgcagaacagtgaaatgggctttacggaataaattgttgtctaccgtcgttcttgctttccttccgagagttccctttccccgtagtctcccttcatggcgtgattcaggtaccccgattgggcgaaggtcttcgataaattctatgcaaaattcgatgacctcctctgttccataacccttggcgatgcttgcctctggacgagcacggttacgaacatacttcttcagaacgcccatgtacctctcgaaaggaaacatgttgtgtaggtacataggcccaagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatatctttgttattgttgtccggacattgtctggaaggataccccttattacaactggtagcagttgtgtcatcaacacgtgacagtcatgagactttaggtttgtgaacttcttctcct

SEQ ID NO: 82265 - DNA, 15463 bp, Oryza sativa
  unsure (1)..(15463): unsure at all n locations
acctaacttaaaatgtatagctcaagacaacggttagtccacaattagcgcttgtcattaattaccaaaattaacaccgggggcctagatgcttcaacgccgtgctaggtcgtcgagttcgatgttgtccttgcgatatacgtgtcgaacttcgatcccgtcaaaccttttctcctgcaaggtacttggataactcggggctagagcacttgtagtctttgtgcacctggtttacgactagttcggaatctcctttcacgattagtcgcttgactcctagtgcggctgctgctcttatcccagcgagtagtccttcgtactcggctgtgttgttggtcgccttcaagttgaggtgaattgcatgcttgaactggtctcccgaaggtgatgtcaagatgaacccttcccctgctccttggctgtagagtgcaccgtcgaacgccattgtccatgtttcgctgtcggtttgactgtccagcctgttttcaggcatagtccagtcagctacgaaattggcgaggacctgggacttgatggttgttcgtggtacaaagtggacatcaaactagcttagctcgactacccatttcgcgatgcggccgacaatgtctttatttctcacgacttcactaagagggatggagaaaacaactatgaccctgtgggcttggaagtagtggcgtagctttcttgatgtcatgattactgcgtaaagcagcttttggatctgtgtgtatcttgtctttgcattgtggagagcttcgctgacttaataaactggcctttgcaccttctctctcgacaacaatgatggtactcacagaatatggcgtggcagcgatatagaggaataattcttcattaggttggggagcaacaagtatagggggatttgacaggtagcgcttgagtgcgatgaacgcctcttcggcttcctgtgtccatacaaatttatcttgtttcttcagcagagcgaagaaaggttgtccacgctctcccatcctagcgacgaactgtcacgcccggaatttctatccaaaattccaaacgcttacatgtgtgtaaaccctcgtccaggaatcagccgaggcacacaataacaaattgataatagagtacaattattactctaattaataagcgaataaaatgtcattacagaggtagatagttcctctcaaacaataaagatctaagcagtggaaaaataagataaacggtgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggtttcatttgcaaaagcagcatttaacaaacatttgagaatttaataaaacagttaagtattaaacaatattaatccaacgctatacaacataccctgttgtataggcccaaccattctggacaaccatcccggctgcacagttctatctccaaaccaggaatgtaccattccaaaccaggagctaatcaaattattaccaattatagcatcatttactatggtgagaagtgtgggactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcgaaaaggagttgtgacaataccccttgcacaacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtcgttggcacggttaatgtttcacaaccgaaactcgtgaaccggtccttaattgtcatgagcacaaccatcaaaaccatgtgctcacaacccaccattaccaggttttagttggcacattaattaattaaccaatcacgattgaccatcgtgaactatcattaagccatcattaaataatagtgagtcataagttatcccaatagtgagctaatgtttctaagcagggctaagcaattatatctaatatctagttgaaccaatatacatagcccaactagtcaagttataataacccaaggtatcaaggaataaagtaatcaagaacaaatgggctataacaatgaataggttaattccacccaatgacattcgaaaataaatgcaatagttgaaaagaaacaatagctttaaataggatcaacatgctcaaagggttgtttggaatctgtgtgacttgccttgctggccttggaactcttcaaactcttttccggcgaaaacgactctccggaaacgacggaatctaagcagaaaagagcaaaatcaccaaaacagcacataaacaagcatgaatgtggatttttaatatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaagaggatttattgcgtcagcgggctagggtttcggtggaccgggcgcacggcggcggttcacgcgaacggacggccgagatcgatccatccaaaacagacggccgagatcgatcggtccacgaccggctcacgggagagggcgacgatgacatcagcggtgacgtcaccaccggcggcggcggctcggcggctcgggcgcgcatgctcgccggcgtacggcggcgcttcggcacgaacggagggcaccaacgggtagagcgcgacgcggcgaactcaccggtgaccaaaggagcggcggaagaccaacggacggcgacggcaacgaggttaaaacggcggcggtcttcggcttgacgacggcgacggtgctccggcggtctacagcgacggcgaaggggcggacgaggacggcgacaacttggcgaccacgacgacggtcttcccgagcgacggcgacgtctggaacggcggcggcgcacggctgaagcgacggcgacgacggcggcgctagggcacacggcgctagggcgtttccgacgacgagagacgacggcaagggtggcgacgggtagaggagacaccggggaaccttttaaaggggctcggaggcgacggcgaaggcccacggctgctggcgacgagaaggaaggtttagggttcggaggaaagagacgaatccgattcgaactcgaatccaacgatttccaaaaagaattagccgatgattccaaaagagaaaaggtagaggagatcccggagattgtttcccctctatcaattcggccggagaaggaaaggatcgaccgaatttggaaaggaacggcggcagcgcgaaactagggtttcgggcggcggcggccgaagatagacgacgaccctgacaggtgggccccacctgtcagcgggcggacgcgcgcgcgcgcggcggcggactgggccggactgggccgaggagagagagagaaaggttttgggccgacttttggcccaaagccaaaagggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaaattagatcttctcttcaagacttttaaaattatttctaaaaattccatttaaacaacaatttatatattttgaattttcagggtgtgacacgaacgtgcttagtgccgccatgcatccagttagcttctggacttccttgagttttgtgggcgacttcatgttctcgattgccttgatcttctcgggattttcttctatccctcttccagagacgaggaacccgagcagcttgcccgatggtactccgaacgtgcatttctctggattaagcatgaggcgatatcgtcggaagttgtcgaacgtttcccggagatcgtcaatcaatgagtcgcttgtgttggtcttgacaacaatgtcatcgacgtaggtctcgacattgttcccaagctgatcgttaagtgctccctggaccgtgcattggaaagtatttcctacggttatcagtccaaacggcatcttaaagtaacagaatacaccaaacggcgtgatgaatgttgtcttctcctcgtcctctttcgccatgctgatctattcgaggaagatggaagtgatcctttgggctcgccttgttgaggtcggtgaagtcaacacacatcctccacttcccgttggccttgcgcaccatgactggattggctagccactctggacggagaacctctctgatgaagccagctttgagaagcttgtcgagctcttctcgtatgggttgtttccggtctggtgcaaatctccgcatttttgttttattggcttggcatcgggtcgcaccatgagtttgtgctcaatcacctccctggggaccccgggcatgtcgaacggctgccaagcgaacacgtctgcattgtcgtagaggaaggtgatgagcgcgagttcctatttctcgtccagtgacgcctcgatcttgacggtcttgtcggggatggcactggagagtggaacgatcttgattgcgtcgtctggctttggcgtcttgtttgttttactcactttcttgggtggctcagctgtggcgggtgggttgggcgtgtgctcgaccatgtcgaggctccgcctgtcgcactgccccgcgagctttgcgttaccctgaatagtgattgttcccttcggcccgggcatcttgagcacttggtacgtgtagtgagaaccggccatgaacttcgcgagtgcagttctcctgatgatggcattgtatgctgtatcaaatccagtgatctgttctgttcggaagttgtttgcttggccgaaagttacaggcaacgtaatcttgcccaatggcttagacgatgactgaggagtaattccatggaagggttgatcagtgggcgtcaacaacagtcttggggtggtctgcttcagagaattcgatcttctgctcagaccacttcatcttgggggtagccccctgccatgtcgaacaaacttcgcgctccacttttttgtactcttgcttcgaggagtatgccgtggaacctccgaagatatgcgaaacatgaatatgggaatctgggtatgctgagtccgagtcctgagtagctgcttcagtggctttctcgactacacgtactcgcttacccttctccaatgccaattgttttgcgagtggctttttgaaaacgaaacaagcttctagggagtgcttgtccgatttgtgtataaggcaccatattttcttcgtatcgtccctttgtgggtctgggtgcttgggtggttccgcgtattctgctacgaggacttctgtttgagctttccttttcccactcttgcgactcttcttcttgcttgactcaggtgcgtccttggctggtttcttctctcctcccttcttcggcttatcgttcttgcgtctcagtgcgtcgtccgcgtgagcgcatcgatcgacaatctcgaatagctttcgagcagttgtgatctgtctcgtcgccaactcctgggtggtgtagcgatctctgacaccagtcttaaaagcgcggatcacagaagcgtcgatgatctcggggatcatatttctgcacccattaaagcgccgaacgtagtccctcaatgattcacccagattttgtgtcaacgcgtgtaggtcgtcttcgatcgcgtggcgcttgtatgttccttggaagttggctatgatctgctgccacagatctgcccatgaagaaatctagtatggtgggaggtggactagccataaacgtgcagatcctttcaacgccgcttgcaaataattcaccaacacgttgtcgtctgctccggcagcgtagaatactatggaatagacctgaaggaactcctcagggtcagtgctcccatcgtacttctatattgctctcggtcgaaatctctcaggctatcgaacatcacatagagcacgactgaaagctctacacccgccgccgggggcggtgggttgtcggtgatcgtatgtcctccgtggatgtctgtctgatcacgaggatgatgaggatgacgatgagtcacttggttccggggtacgaatacgaggatgacgtctaggttctcgagaatcctgtcgtcgcccaccgttgttgtcccgacggcgatctccgtcgtcgtcatcattttggtggcgtccttgatcagtctcgcccggcatccgctgttcgcgatcatcgcgttcgtggcggttatcacggtcttggttcttgctcgggtgtcctcctcgctcttcgttctcccgacgtcgtgaagagacgagatgtcgggaacggttttcgttgtctcgtgcgcgtcgtgcttctcggcggccattcaaatggtcacggagatcgctggtgccgcgaggtggaggggtggcttgacgaggtgatgcccgctgcccaggtagttcgccattggcaccgccaattggcgggtgttctgtcggtactccggcggcggccccctcgaacgcgttactgaggttagccactgattcccgtagtcgttctgtccactgtgcgagatcatcgttcagaacgggatcataaggggtttccctcagtattgcgttgatggccctgatgtgctgggccggtgtaaccacttgatcctccgcttatgcgttagcgcgcgcagacatgctggtcctatcgataacgaacacatcacatggtgtactcgtcgatgatgaggcctggtcttcgagcaagtgtagaaccgacagctcgtggggatcgacgtcgattaccccaacgaatcgatctgagataactgtcgctccttgttccttgtccgcatctctaagagagatttgtgactgctggaccttaggaggtgacgtcctcatggcactgagaagaaccttgcagcttgagaggtcgtgattctttgtcttgtgaatatgacaatagacatcacgggttggagaagtacattgaattccacgctctttgcaggcacagatctcagcttgtacgtcgagaaaaacccagcaagcctgcaaggtgtgtttcctggttttgtggataggacaccaggaccttgttgcctcagaaattgtccttgtcggctcgtgattctcgtcggaaggacaagatttggccgcattaggatccttctcgggcttggatgtcgtcgatgtgtaacatacctgaattctaggattaaggaatttccatcaaaactagttgaaagggaagttcttcaattttgtaaaccaaaaatttccattttaaacctaggtgaagttgatctaactcttgcatgataaaattttagaacaaattaaaaacctttgcatctctaacctaggacaaaaatataaatttatgtgtaagcatgcatactctcatagacatgtttgacttgagtccttcatatgcaattggatttggattgcattcggattttcgatttgcatatcataataggtctcatgaatattaactaagatctagataaacaactggaccattagggcctagtgctagctagaggaagttaaaataggaaccatacaccttaaaatatatcaacaaggccaatgccaagccccacaaaactattttggtcatccatctgaagactagtcatgaacatggaagtgaccaaataaattatatcatataggatatattctatcttaatcatctctataagcattctcttaatttaatactaaagtaaacttgtgcataataggtaaggagcttatgacctgtgtaaggtaaactgaaattctaacatatcattatcacctcaggttaatgagagtccaaatataacttttataaacatttacatgcatttaggaaaggaaacacatataagacataactcttgagaattatctaaaataattcgtgcaagataaaatcatgggaaaattcatgtaggctctactcaacacatacaactcactgtaattttggtatgatttaataactaaatttgtacctcaaataaatcagtcaaactaataaaaactagattaactgtagttcttaatcggctaaaaccatactttatctaaaagtgcatttaactgcatagaagtgtataagtaaaataatttattcaaatactaggtcatttatcattaataaaaataattttttcagaatttatcttctctgtttagggctcctaaaaattcgaactagtttccaaagaacccatattcctctaatttctgtgagtaatctatccataatttttgagtgcaaccaaagaaaatggaaactaggtacatacacctacctccagtaaaatcaacactagttaatctgatcaacacattaagtattgaagctacaaaattagaggagaaaataattccggaaattcgtccaaaaaccaagctcacccatgtttctgcctacacatctctcttccacctagtttacttcgacctgngccccccttgtcagtccctccggcttgcccttcctctgtgcaacttccctagccgaccgagaaacactgagagggagagatcgagcgccgaccggctctggacgccgcacgacgcgtggccacgacgtgtcgacgccctaaaaacgccgagctccatttctgcctctcccagacgcgtcgccactcttcacccaccattccagtgccgatccatcgagggagagcatcctcgctgctcttctccactggttctccatcgccggctgcgaagaagacgatggccgcaatcgttgatgagccgcggtcgtttcctcttctcttgcgttccatactctcctcaccatgccgaatatttctccttttgatttcatcctctctggtgcagccaatcggcgggaacgctgccatgcacaccggagctctggagcgcgctctgcgcaccgccgcagcaacatcgtcgccgttgccatcaatctagatcaagccggagcgagccaccacgccaccagcttcacctcaacctcctctccatttcccctcaagaatcttgaagaatggtgctacgagtgtggagatcgtccaccgtcttctccacctccggtcgccgtcgccattgtcgattccgcctcctccggtgagccattgtccgattcttcgcgtatacaccatccctgggacctcactaaccccatgaaacacatgcatgtcaattcgatgagtggatcgagccgttgccgtcttcccggagctctacaccgtcgccggaccatcttcttctccgctgccgctgtccagactttccggcgcctcgttcaaggttcggtgagcacccttgagcccataggattgcattcatgcatttcattcacttagaattgagcaccaactcaacatgcagtagcagcctaagcacagccgccgctcggactcgccgccggcgttactccgatgtccactgaccaagaaaagaagaggaatggaatcgcaatagcatgatcttcattttgtcttttggtcgcaccctcaaacgagccaccgtttgccgctggcaagcttgagatcgagctcagccatggcttgatctgcttcagctcgaaccagggacctcgtcacaagaatttaggttaatgtagggctctttatgcaaaagctcaagacacacagaacagtcataggactgcgggttgatttcctgaaactataggagcctttttgcatattggcctgagactgacagtgcaccccttggaaacaaaatctgaaattataaaagaacagtaactaaaacttgtaaaaatccatataaaattaaatatagctcattttaagatgattcaaatttctgtgaactcaccaaattgggaactttgatgttatggaataaaaacttgcactcacagtacaaatttagcctctaaaatttatccaagttaaatcacacataaagcacgcacaaaatttataaaatgcatacaaaattcatttcaactcattttggagcaaactcaatttctacagatccaccaacttatgttctcctataaagcaaaatgaaatagtatacatactatacatcaaatgcctctaaaactattacctttaaatgactagttttagataagctgaattttagaagttcatataaaattcatcttagatctttttttagtaaacccaagttctgtagaatcaccaaaacatatacttccaaattataaaataaaattatatacttactgtatgataaaagcctctaaatacttatgtaagtaataaccatcatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctctaaactttaaatttataggataggtgctaatcacatagtatcgattgagcaatatgtatatatataaatgtatatagaaatacactctagctataatgaaactcaaataaaacttgttagaccagtgaatgcatagttccattcccatccaccaaaacttaaggcacttagctcatataataatttctaggttgatataataaattgctaacatggactagagctcccctagtttataaaatatgaaccatgataataaagaccataagcctatgaactaaggttagattagttaactaaaatattcattttatacatcactagctagatgaggcaagttctagacctaaacctctaaagccatgaacctatagaacactatacacctataacacgttataacttgtaaaatacaaaaagaattcatattaactctaaaaattatgaaaccaaatgtgttagtgttagaaaacacatatcttcaccccagcaaacataaacttaataagaattaccttacaacagcatttcacaacagtaactaagtaaatcctacactataccgacgaaacttctaaaattcataactcccaaataaaatgagataaaatagaaattctttcacctaaattaattttagaccagtacctattcactgtgcacaaatcatccattttagagtattttggatttttcgcatatttcggtgtttaattgcataacgtgtactttgtatagatgattgcttaaacggtgaagaagtgatttaggtgctgacattttcctgattcaaggcaagtcccacctccatctctttgatcactttgaacctatgttttggaggttattgaaaatgtttgcaaatcttgcatgtcgattgtacactaataaattaaaattttgttaaacttgttagacaaactcctattgtttgcattcaccttgaccccacatatatccatatccctcattcctaaccttaggaacaatatgactataccactttatatatgaattttggagtcactaggttactataatgcttagccatgcttagaatggtcttccttgtcattatgggctcattacaaatatgaaaaattgattttgaaataatctggacagaactttaatacttgtgattttgataaataaaatgatggaaaacatggattttaggtttgagcctcaagtggtgcacatatggtgattagttgtgtaccgatagggggagagtgtgcccaaaccgacctaaggacttcactcaatgtcagttcatttcgtatacagtgcaaccacatgtgctagtatgggatagcccaagcttagtaaattatttatggtttagccttacattctggtaggccggtgtgtatgagttcgtataattcagaggagcttcctatttaccccgaagtggtagtttaggtgactaagcgtgtccaatacaacggtattgtgccacgtggtgggttcccgttgtgtccgccaccacggcgttaagtttaaggcgtgggcccgccacttaacggttctaggtcatataacatgtatggcttaggatggagtaacacgtatcgtgctggtgtagggctaaatcatgaattttggaaaagctttgttgcaggtaataaatcgggtacttatgtatcgcgtgacatgctcttgcatgattattatttcgtatcatgtgggtaaagtgtacaaactctgcagagttaaaactaatcgattagccgtgctcgcggtcatgagcggcgtgtggatatgtattgagtatagacttgtgtttattcttctaaatgctgaaatttaccttcaaattgtgatgagatttgagaatgatctccttgctgccatggaaggcaatgaggtgcatatttatacatgattaatgcctaccttgatgcccaatatgtcaaatactagcttgctgaaattttatttgaaagtaaacctgatttagaaatgttttatgcaaataaaacttgctttatgctaaaaagaaccatattatgccttccttgattatatgccttgcaagtagggtcttaggcttgtcttggtgcttgccagtacattatttctaataatgtactgactcttgctattgaattaaccttttgcttgcaggttttagatttagtctttgagtgatgcgggtaatcgactacttcttctaggacttgaacttaatggggtaaacccctagtcgatgtgcttgtggattgagtagacaagcttccgctgttctatatatttatttggtcagttggccaatgtaactaaagtagatgtagtttataatcgctttcatgttatttgtgtttgctatgtataatcatgcttgagatgaaagtgtgaatctagtgcacatcctgggaactagattcacatgagtatgagttaagaatatttgagatgttgtagatctttagccattgttgtcaagtctcctgaatgtgtaacacatctggtcaccgccttcgagtggtttgacgggcacatctcaggctgaagttgactggcaggctaaaggctcggcaatgtctccaatattcctctctcgaggcgtcggatatttcattatacttgtttgatgacttgaattatacatttcatctctcaattataatggaaggtccggagagcctacgacacgatgttccgttctccacttctgagggaggattcttcgacatggagccgtccagggttgtaaccacggtgttctcgcttccggtcattgatggaccagtcgagatcgacaccgtggtgtaaaccaggaagacgagtttgccgacctaagtccataccagcattgttgaagtagaaactccttggttgatgctggggttgacgctgttgtcgacgaagcttgatgacacttgagtaccaaagccccctacctggcgcgccactatcgacgggggatacccgtagaccggatatagagggtattggggtacattggtacgagaatctacgtaatacgacatcaagcaaataaaagacaaggattatactggttcgggccccttgataggtaatagccctaatccagttggtatgggattatatgatggaaaccacaaagacaaggattatattggttcaggccccttgataggtaatagccctaatccagttggtatgggattatatgatggaaaccacagattacaaagggaatagtagaactcaatgataccgacaagaccgtagtcgagttggttcgactagatcacccggcgacttagctcctgtaggctccgacttcgtaggctgtggtggttgtgttggcggtgagattcgatccctttggtcctcccggggggtcccttttataccgcgggtcagtcgatctccaactagaactcggagatatcggactccacacgatatagtaacgactcagttctatctgagtaggactccttccatccgtggactccgtttctgttacatgatggatttccttaacatgtacaggaaacatccgtatatgtgcaggtataccgtatcggtatacaacatacatccaagggtagagggtataccttatccgtaaccctaacactcgtcgctagtgattgtctgcacatcactgcttcctgagccctagtcttcacatgaccctgttggcatgtgccaccttagcattaattgacccctagccaccaacactccttgacaaccagcaccgatccctgagtcacccaacgatgccatcccccatggcataaggtctagccacagtttgccactatgttccatcttatgaaaatttgtcttgcctgtatttttcattttacatatttggatgtggatttgtttttgttgtgacacacgaagcctcgaaagatatatttagctctagtataggtcctatcaattaggttcatgttatgctagttagtttgattttgtaactaacaaaatgaaaataaatatattagaccataaggccgatcggccaatatataaagcattttcctaacactgtgttttattttttcaagcagacaaaatattttcacttttaccgtttgaaaataccaagaggcctcatatctttggctccacctatgaaaaattgacttttacaggcgaggtttgaagaggtttgcctatgaaaatacctcatattttcgcaggtggaaactctttagaccgtgcctataaaaattaatttttgctggcggggtctaaagtcgtctgtctagaaagtggggttatagtgtgggggcgttactaaaatcaggacccgatcgatccagcggagctcgcagcgactaagtcttggtagtctcctccttcaccatgcctccaccaccggttcccctccccttccctctcctccactactgcagcagggcagcatggtggtgatgggggctcctcccctccaaatctagctggaggtaggtctgcagcacctgacgatagagaggagaggcggtggcggatgctccactgccgtcccctcctgttctatcccctcccatccctccttttcctcgcaactggctggaggcgtggttggcagcgccccagattggtggtgtcttgcatcgttcaacggtagggagaaggaggggcgatagcagaggctccagtcccctcccatcggtctcctagatttggttagagtggaggagatcaacgtttgtggcgacaggcgtcgtaaaaggagggtggcggtggcagcggcacgtggtagaatgaggaggggatgacgtggcggctccactctcccctcttccctttctctcccctccctttc

SEQ ID NO: 82266 - DNA, 750 bp, Oryza sativa
gcttaatttattctataccttaaaaaatatgtacgtgttacctccatattttaatataatatagatgtttagaataaactaattaggtaaaaaccaaattagctcctttggatgggaggattttcaaaagaaaaatgaaggatttgtatccttaggattttttttcctatggagtttatttggtttgtacgatttgggcttgcaaaattcctgtatatggaatcattcctatatctcagttcttttcaaaagaatttagggtttctttgaagaaacacgaattttgaaaacactggccgaggtaagaaaaaaaaggatgggagtgccgtcacatctcagatcttatggatagaaaaaacacagaaaaactataggaatgactatttggatggaacacaggaaaacacacaagaattagaagagagatagacacatatgagtttttccaagaggtttaatctcatgttggaaatcctccaaaattcatatgaattgaggcaattctaaggaatttcaaaggaatttaggagagccatttcttcattccaaaggaccccttttataggaatatatctaattaatccttcaaaattcctttgttccaaaggaacccaacctcatgttatttttccccactggtggagaaaccatctttcgtcggtcggccgatttccacaatagtcccggatgcaataaaaaccggggctaaagatgatctttagtcccggttcaaaatggggggcgcaggaa

SEQ ID NO: 82267 - DNA, 5839 bp, Oryza sativa
tgccttgttagtacccgtcatctatttcccttgtatgtccaaaactgttaaaaagaactccttttatcacagaaaaaaagtatgggaagctattcttccttctctcagtacttcagtatccaagaagcacaaatatgaatcagaagctgagcaaggaacggcgccgccgcctctcaaactttgccctccgcttcatatcagtcttgattggcatcataagcaacctttcggtatccagttctgactgcagggaggatttcagccttttgaggtgcccaatgcatagtgcgtgatctgaagctgtgctgtggaagtcttgctcaatgtgcaggtctatcctctcatacttggaatgccattttgcttggagataaggcaaggatctccaaggaggcagaggcatagagttctgcttaagcgaccattttgcagcatctaccataacatgcaagaactgtttcagtctgggaagagtgccaacatagaccaccggaagtgaattgagcagactgtcataagaatcaacagccctggctatttcaaagtggctcctgaagtcgatatcaatgatcagacgatattcagtatcactattcatgatgacatcgatatactcatgatcacctagtcaccgaaaaaaaaacaaacagataagttacacagttcaattccaaggagagattgtaaagatgtactgttagttatgattttgagacttgttaggcaagtacctccaggtatcttgtcgaatccctgccattttgatacgcaaacagctgcatcatatcccgaatatctcaagagcttcacaagtaaatgacggatgcagctggcactgcattgacctcttttgaaagccagaaggtctgactcatggatcgagaataacagcgagtggaccatggagagtagctcgttttctttctcatcgccgccttgcttgtagatctgaaatggaacacatagataaaacggtgagttatgacagatgaagcataatagtaatagtaatatttaaagttgtatccaacagtaagctatccagtatccaattatgaatttagataggaggagtagcagttacacaaataggcttgctaataataaattgagaggtagaaattggtagcgctagttaatggcagggcaggaaatgaaggatgcataatgaaaccctcgagtagcagctagcgtaggcatcataggggcagatttaatcgtcgttgcaatttcacgggacagaagcgccaaaaactagtaggatcatgggatgataaaatgataagaaacgagctaggcagtggtaagttgtaatgagaaattgaaagtagagtaatacccaattggaattagaagggttcccttgtgagaattttgatgcgcaattgagggggaaaagatatgcaaattacaggagaggagagggaaatcctgtcgagttgttcaaggcagaggagagaggggtatgtattgcatacagaaatgttatcggcgaggtggtcggagagggcggagtcggagtcgctgctggcgcgggaatcggcgcctccggtgccgccgttctcaaggaagtcggtgacgagcatggccaaatccatctcgctctcgtggctgtggctcccgaacccgtctcctcctcctccggctcctttggtccggagccagaggtctccgacggccacgggcgagccaccggagggagaggcggggaccctggcaggcggcggcctccggcgaggagtgaccgctgccggcggcgacaggcccaactccttggcgagcagcatcatccttcaattccttggggccttggattggaggaggagaaatttgagagaaatgatggctcagcggggtgggggacgagaaattgacgagatctcgcgaaaaggaattactagtatgttatggggaaggaagaaagaatgggcaaggcaacgccagcgcatcgcggcggattgtcggttggttttctttttcttatttatagctgacaggtgggcccgcagagcagcggcgggaagcggtttataccgtttcgatttggcgtttgctcctccgctccgctatccactgctgccatcctggccgttggttggattcatgggattcaatcccatcacatctgcgcttctctttttactcacattaaccattagcttagctgtcaattttttaggtaggagtactttattttggaagcaataatactccctccatctacttttgataagtatatttctaaatctgaaaaatttatttttgataggcatatttcaatccaacaaactattatcttaatgactttcttagatttaacgggcaactctccattctttcacacaaaattgactacatggacatcgagaaatgtaaatattaatgaatcgtttgtttacgaggaataactagtactagcatgcttgtttacgaggaataactagtactagcatatttaaatggatgataagtagaattatttatccttggtctgtgtgctaagatgaaatatgactatcaaaagtatatgaagggagtagtactccctccgtactcgtaaaggaagtcgtttaggacagcgacacggtctccaaaacacaactttgactttatatttctataaaaatatttattgaaaagtgatatatgtatacttttatgaaagtagttttcaagataaatctattcatataagttttacattttcaaactcaacaacttgagagttatttatgatttatattcctaatgtttgacttgaacattgtactaaacgacttcctttacaagtacggagggagtatgtagtaagtagtatatgcaagttcgttaaattaaattagagggtggatagtataaacgggaattattgagtactccctccgtactcgtaaagaaagtggttttggatagtgacacagtctccaaaacaaaattttaacttcttgtttctataaaaaatatttattgaaaagtgatatatgtatacttttatgaaattattttttaaaataaatctattcatataattatttacatttttaaactcaacaactaacaacttgagagttattaatgatttatatttctaatctttgacttaaaaattgttataaacgactttctaccgatggagtactagtagtagatggattaggtgggccggggggacaatgattaattagtcgattgccattaagattttaactatgggatcctaagattagggagagtatatggatctcgtcggtctgtctgcttgcacgtgcctgcgggtaactaattaagctgattcatttctttcttgccgcacaagattaagcatttctttcttgccgcacaagagtaagttaggagtagctagtttcgttagttataagtataaaactatatatatagctgactatgtatactaaaatataagaaattttgtttatgtagttattatagtatatattttgggacggataggtccgatcggaggtagtacgtacatatagtaacagttaggagtgtacaacatagtgattagtaatcatagttagatcatgacctttcgaaccggccgttcaggtacttccttcgtccaaaacaatacaatattatttaggtggtgttacattttaatttagattagtttttttttacggaaaaagtatatagctagctagctctagctgtgtttaatcacacatcggtcagtgtctttttaattagaagctctagagttttggtacagttcgtatatgtgtagtgcacaccaaagataagtagagataagtaggcagtcctactatctaaagaaaaacccacttgacagtttatttttaacatgatagtaattttggaagaaaaaataaattagaagtggaataagcggaaaaagaaacgggtttgcccacccttgcacccctaggattgaggcgcttcttacgaattgataattttcaatgggtcatatcgagaaacaaccatacatggctagaattctatataatttttagtttttcctttaaataaaaatacctcacaaacttttgttttacacacgtatctctgttgaaatcttatgtttttctctttttttttatcaaggggccagatcccatttttatttttattagtagaatgcatgaagacaagagagttttgacactacaaaagcatcgacaaaagaagatttgctcaagcacgctagcagagtttccaacagagaaacagacggggcacttttgccctttgcagcccccccccccccccccccccgcacccaaaaaaaaagtaaaaataaaaataaaaaaaatagagctacaaaaagttccagtaatgacaaccatttccagcagcaaaaagtcttcggttcaggttcttcttgctccaatcctgtagatcatgaagctcaacacagccgtttccagtttgcccttccatattgagagaatgggagttgaagacttcatttgtatgattaattaaatattagctaatttttttaaaaaatggtttaatttgatttttttaagcaactttcgtatagaaactttttttgcaaaaaacacaccgtttagctatttgaaaagcgtgcgcgcggaaaacgagggagaggggttgagaaacacagtctaaacttgtcttcgcaactgaactccccacaactatggctgtgtttagttcagcgcaaagtttgaattttggttgaaattggagatgatgtgactgaaaagttatgtgtgtatgacaggttgatgtgatggaaaaggactgaagtttggatctaaacacagcctgtctttctcgcttttcctcggaaatctgcagaatggcccatgaagacataaaagaacaggcatggtgtaagatttcagtggaatcagcaggaatgatttgatcaaaacaagctttatttctaattttcctaattgcccagaaaactacatcgacccctacaagcagcaactgctttgtttgtttttcacagctttgtaaccaagttccacgcacttgctgtaaatttacaattagtttcagattaaaggcacagattattatgtcccatgtgaacattgttaaagagcattaaaaaataagtgatgaatttgtttcctttatgtcacagaatgggcagttatcagtcctttgttctaacctcttcttttcaagttgtgacactgtttttacattaactagaggaataccttaatttttaagggtattttgataatccaaatcttcatgtgtggaaaacccacattctgtagtttcggagctttatagaaggatttcagagtgaagtttccacttcttgtcaattcaactggatttcatctttttgatccgtcagaggttaattgttacgagcatttttttttattttactctaactaggatcttaggtttttcctccgtttttctcagtctagtcttttaaaggacagagtcttaggatatatgatcgagaaagagaggagtaataaagaaacaaaagttggggtgttcaatctcgttgacataatgacatactcttaggctctgttcgtttcctggagttcccaactcccccatctcattttccgcgcgcacgcttttcaaactgctaaacggtgtgttttttgcaaaaagtttatatacgaaagttgcttaaaaattatattgatccatttttttaaaaaaaattagcaaataattaattaaccacgtgctaatggactgcttcgttttccgtaccggagggatgggttcccaactcaaccaaaagaacagagcctaaatttgttcccaagcctcagaatgcagataatactagtttggttttcgatcgaaacggatggtcgggctgcag

SEQ ID NO: 82268 - DNA, 726 bp, Oryza sativa
cacttctgtcaattttcaaaataaaaaattatttttgtaaaacttttaataaaaaaaattaaaaataaaaaaagtttgcgaccattcggtggcctcgaatatctcgtgggctttgtttccttggcccactaaccaaaccacggcccactaggagagcccaccaatgcattccacaacaaccatgaccgcctcctacctccgcctcctgcgccgcttccctcgccggagcgccgccggcggccaccagctccacgcgctgctcgccaagctcggcctgctccaccgctctgaatttctctccgctctcctctctcgcctcccgccttcgccgtcggcgctctccctcctactcgaggcacccccggccgtcctctcgccgtcactcgtctgcccggtaatcgtcgccttctcttcctcccaggccccgtcctccgcgctcctcctcttcaatcatgcctcctcgtgctccctccccaccccgcttcccaccttccctgcgctactcaaatcctgcgcccgcgcattcaaccacagctctcgcgccagtgccgcgtcggtcttcgtctccaaggggatggagctgcattgccgtgtcttgaagcttggctgcgggaaggatcgctatgtgcggaatgcgctcgtctccatgtatggcaagttcggtcgcctcggggatgcacggaaagcgttcgatgaaatgcctgacaagaatgccgtctcctggaa

SEQ ID NO: 82269 - DNA, 18946 bp, Oryza sativa
gacatgacaggcgtgtgaccagtcacagaccggtcactctcgtccaccacgcgtgagtttggcaagctgcatgtctgcccttcttcatacaatgacttccttacaatggttgggatgaagcctggcatatatctgaccgggaccgacgtgccatcttcaggagctggcacgccgtctccggctagggacaagtgcctggaggctctcatcaatccgacgggacggggcgaggcgtgtaacaggccacctgccaccacctaacccgcgatctgaccggtctgtgaccggtcacacgctgcgcccggtcacggaccggataagcgagcgcgctgagctgcattacatgcggcgtgacgcgctcatccaacccgcaatatatgcggttaggtgagccccgctgtgctcacctaacccatatacgtggcgccaaacccacagggggtcggggcgccccggccctcggggtcgaaacgggagcagtccgacccctcggggagacaaagggaggggcggccacatcaccctcgggcccgacccccccgagggggtcaggccacgtgggtgatcgcggctgcccaagcctctagtcatgatactcccggtcccatgtcaccgacagtagcccccggcgttatgccagggcgatcgcccccccccccccccgaaggaagcgctcgggcgtgacgccactccttaggcctggtgacaggtggggccggtctctacaggcgggcagaaacccagcggtcgcaaatcgcgcacatcggcaacggaaaaccgactgtctataatgagcggtctcttcaagaccgctacattactcgagtagcacgcgaatcgggacgagccggttcgttttgcctggagatatgatgatggcgcttcggtcggcgagcgtagttaacgcgcgcacgatatgttccatctcaactgccacagccgcgcatccacctcgtgcgccgcaaacgggcgagcggaattagtggcgacgtgggcgcgagaaacgagggggcgagatagtgggcgcgggaagcgaggagccgggcatagcgttggcaagggtataaagacgccgaggaagagattcgcttccttcctctcgtcattattccccttgccttcgccgcttgcgccctaactccttgtttcctgtgccctaccctcgccgcactcactcgttttcaagctccttctccgccggcgtcatggcacggggctccgcaccgctcgacggtagcgtgctgccgccttcccgcatcgtgagcgagaggcaggccgggctgccgcgccgattcatgccggcatctgccgccggccgggaggtggtcgagctgggcgagggacgcccggcaccacactacccgaggcggtccgtcttcttcctccctttcgcaatggcagggctggtcccgccattctcttctttcttcatggatgttctggagttttatgacctccagatggcgcaccttacccccaacgcgataatgacgttggccatcttcgcgcacctgtgcgagatgtttatcgaggtgcacccatctcttcggctgtctcggtggttcttcaccgtacagccagtgtcgccgccgtcggtagttggtggctgctacttccagccgcgggggccggcgctgagccgctacattccctgcgtcctccgcaagaagtgggacgactggaagagtgactggttctacacccccctcgccgacgaagcgcgcctccaacttccgagccagcccccagcgcaggagaaacaaacgcgtcgcaatctggaaggtgccagcgccgagagggccgcactggatcagcgggccgctgagctcgaggcacgggcaagggagctggatgcgagggcgcgtagcggcggggcggccacgggcgacggcgatctagccgcccgcctcgcagctgccgaacacaccatcgccgagctgcagggcgcgctggactcgtccgccggggaggtcgaggccctccgcttggcaggcgaggtagggcccggcatgcttcgggacgccgtctcccgtctagaccgcgccgggcggcaggcgggcctctggggcgggcggatcgcgaaatatgccgccaaccaggggggcctcgcccagcgcctctcagagatggccgggactctccagcggctccccgaggagctcgaggagacgatcaagtcatcctcgagagacctcgcccggggggcagtggagcttgtactggcaagctaccaggccagggacccggacttctccccgtgggcggcgctggacgagttccctcccggaaccgaggacgacgcgcgcgcgcaggtccgggacgccgccgaccacatcgtccacagcttcgagggtacggcccctcggctcgcgttcgccctcgactccgacgtggagggcggcgacggtggtgtggacgacagcaacgacgaggccggcgacccgggagcctcgaagtgagcccccaggcccccgccaatcttaaatagtttttcctttcttcttccgaggccttcgggcccccttcttgtacaaactaatttaatctgcaatcaaataaagaggaaatttttgtgtcagctctgtttgttgtgtgtatgagacgaggatggtctgtgccgtggtccttctgtgtcttggtttgaacgagggctcatgcccaggtcccagcctcaaatggcgcgggtcggggctagtgcctggggagatccacgtgtcgagactggccaggccgggaacgtggtgaccgagggttatggatgacccgattgtgggcctttgccgattcccccccggagttcaccacgccccggggcacggctcggttctgggccccgtttggcgatttccgccggcccgggccaccgagggcagggtcgagcacgagcatgctaattcaagccaagactctttgaaaggaaacaatggcacagacacagtccttaggaaatcgaaaatgcttttattgaaatacggaagagaaaaaagataagtatatgcatgtggtagcccccggccaaccctgcacgcccagggggggtgcggggttggcccgagcacgagacctgacacccgacccctactaggggtagaaacgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcctcgcagtacttggtggcccgaggggacctcagggtgagctcggatgggagaaccgcctccgcgccgtagacgaggaagaaaggcgtttccccggttgctcggcttggcgtggttcggttcgcccagagaaccgctggcaactcctcgatccacgagtcgccgtgcttcttgaggatgttgaaggtcttggttttgaggcccttgaggatttccgcgttggcgcgctccacttggccattgcttctggggtgggcgggggaggcgaagcagagtttgatgcccatgtcttcgcagtagtcaccgaagagttcactagtgaattgggtgccgttatccgtaataatacggttaggcaccccaaaccgggctgtgatgcccttgatgaatttaagtgcggagtgcttatcgatcttgatgaccggataagcctcgggccacttagtgaacttgtcgatagcgacatacagatactcgaacccgcccggggcccgtctaaacggacccaggatatcgagcccccagacggcgaacggccatgaaagaggtattgtctgcagggcctgggccggctgatgggtttgcttggcgtggaactggcacgccctgcaccgccggaccaggtcgaccgcatcgttgagagccgtcggccaatagaaaccctggcgaaaggccttgccaaccaaggtgcgtgaggcagagtgggctccgcactcgccttcatggatatcggcaagaagctcgacgccttgttcccgaggaatgcacttcaggaggactccgttagccgcgcgccgatagagggtcccttccaccagtacgtagcgcttggagatgcactggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcgcgccgatggctgggcaagcctttcttaaaaggcgcccggtggggtctgggctcacgaggaggcgagccttgagagttcgtcggcgaccgtgttatcccgtctgggcacgtgccgaagctctatcccgtcaaaatggcgctccatacgccgcacatggcgcacgtaagcatccatctgcgggtcagagcactggtactccttggagacctggttaacgaccaactgagagtcgcctaacaccaggaggcggcggatccccagtccagccgccactctgagtcccgcaaggagtccctcgtactctgccatatttgttggttgcccgaaagtcgaggcggaccaggtatttgaggacatctccgctcggcgaggtcaacgtgacccccgcaccggcgccctgaagagacagggagccgtcgaactgcatcacccaataggcggtgtgaggcagctgcgaggggcccgagctggcctcggggacggagatgggctcaggggccggggtccactctgccacaaagtcggcgagggcctggctcttgactgcgtggcgtggttcaaagcgcaaatcgaactcagagagttcgattgcccatttcaccacccgtccagtaccctctcggttatgcaagatttggccgagggggtaagacgtaaccaccgtgacccgatgcgcctgaaaataatggcgcaacttcctcgaagccatcagaatagcgtaaagcatcttctgggcctgagggtatcgagtcttagcgtcccggagggcctcgctaacgaagtagacgggccgctgcacctttcggcggggccgatcttcttcactaggggccgtatctccagggcgctcttcgtccgagaggcctcgcggggcgcactcggcttctgtgccgacgacctcggggtcggagggcgataggcgcggccttcccgcagtggccccggagccatcctaggggtcgggggcgcctggcaccgtcggacaagcgggcggagggccagctccggccgtcggggtccttgggccaccgttcggctcgggggcctctcctccctgctctctcccgggtcgagtcgacacaaggtggggatgcgcggagcgagggtcgtcctcgtcacgctccgagaggccgcgcggggcgcactcggcttctgtgccgacgacctcggggtcagaaggcgacatgcgcggccttcccgcagtggccccgtggccatcctgggggtcgggggcgcctggcaccttcggacaagcgggcggagggccagctccggccgtcgggggccttggtccaccgttcggctcgggggcctctcctccctgctctctcccgggtcgagttgacacagggtggggatgcgcggagcgagggtcgtcctcgtcgcgctccacgaccaacgccgcgctgaccacctgcggggttgccgccaggtaaagtagcaacggctcatctagctccggggcgatcaggactgggggagaactgaggtacgccttcaactgagtgagggcccgttcagcctcctccgtccagataaacggcccggagcgtttgagaagcttaaataggggtagcgccttctctcccagcctcgatatgaatcgactgagggcggccatacagccagtgacacattgcacatccctaagcttgctgggggggcacatccgctctatagctcgtaccttctcggggttggcctcaatgcctcgggcagagaccaagaacccgagaagcttgcccgcaggcacgccgaacacgcacttgtcggggttcagctttatgcgggcggtgcggagactttcgaaagtttccgctagatccgagagtaaggtctcttggttgcatgttttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccaaccactccggatggataacctctcggatgaatccggcctccagaagtcgcgccacctcctcgcggatgaaggcttgacgttccggggcctgccgccgcactttctgacggaccggccttgcgcccggccgtacggcgagacggtgctcaatcacctccctggggaccccgggcatgtccgccggtctccatgcaaagacgtcagcgtttgcccgcaggaaggagacgagcgcgtcttcctatttgccgtccagcagaccaccgattcgtgtggtcttggacgggccgtcgcccagggcaacctccttgaccgggacctcgtcgcacgtggccatccgctgcctcggggcggcggggacggaggtgccgagcctctcgtcgccaccctcgggcttggacgcggcggcgaggtggtccgcgcgctgctccatacaagcaagcgcgactttgaggtcgccatggacagagatggggccaacggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcggctgggacggccggagcaccatccccggggccttgatggcgtcaaaggctgtgggggaaaggatgttgagggctgctcccccgtctatgaggacacgccccaacttcacgttgcaaacggtgggggaaaccaccatcgcgatctgtcctccccgggcaacgcacggcgggtggtcggtctggtcgaaggtgagggcaacctccgaccaccgcgcccgccgcatcgcctcatgggtaggggccgcggccagaagctctcgcttcatggccttgaggctccggcgagaaacgtgagcgcatgctcccccatcgacggtggcgatggtggccccaggctcctggaaccctaggtcatcgtcgccatcgtcaatgtcctcggcgggggccttctgcttggcctcacttcgccggttgccagagggagccgctggggccttgccctcacggcgctcctgcctcctctcctcctcccacttcctcgttcgctcagccaaacttttgaccgcgcggcagtccacgaggtcgtggagggaggtgttgtgcacggtgcaccacttgccggtcgggcgctccctgctgggagcgccggcctccttctttttgtcgctcgcaggcctcccctttcgggtggcccgcgaagcgccctcgatggcgaggacgtgaccctcgtcgtcggaatgggccgacctcttcttcctcctcccgtcccgccgccctgaccgagcggcggatccgggggcggctgaagctgccacaccggaaccggtggagttccaggtccatgcctcctccttgcgagccacacggtccgcgagctgaaaaagctccgcagtggtctggggctccttggaggcgatcttctcgagcatgcggttgtgccgcacgccccccctgaacgcgtagatcaccgcgtgtgcagggatacatggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctgtcctctcagggccatggggaagaaattcgccatgaccctgtcgtcacccctggcggcctcgatcccagtcatgtagatctggagaaactcggcggggttgacgcttccgtcgtatatttcggtgatggtgggccggaaccttgggggccaacggacgttccgaaggctcgccacaaaggctcgacagccggcaccgccaaccggggacacggggggctggcctccgtgcccggaccgaagtggcgctccggacgaggaagcgccctccgatgcgtgggcagcacggcgatcattgcgccggcgctcgatattgaggcgggcatccggcccctcacgcacatcttcttgggtcggaggcattgacgagggaatggcggacgaacggcgggcaacggccgccgctcgccgcgccctccgcctcgacgatacggagccggcagtagcagcaccagtggccttggtggcggaggaccgcccgccggcgcctaaacgctgctgcgccgtcatgaccaagttggccacgtcatctagccaacgtcgagttggagtctctggatcagggacgacgggcgggtgacgcaggagcgcgcccgcagcctggagcgcgccctggggcgtcgtgccatcaccgtagatgaggagacgacgctccccgtctcgccgtccttctccatcgctcgtggacggcgaagtcgcggatctttcgaccccctcgagcgcctcctcccgcctaagacttcggcgagagggggcggcggagtacgagctcgacgacgcgggttctgctcgctgtcgtcaccgctagcgctcggagagaggttgtgcgcttttgctcgttcggccattgggctgaacgggaaaagcttggcgcacacgaaagaggatgagagcttagaaaaacacacgcgccccctacctggcgcgccagatgacggagcgtggggctcctcaccgggagaccgcgcgggcccccctttgccggttcggccgggggcgctaagtgagcttctaaactcttgatctgtggaatggttcgcgagagagcaaacgctcaagacacgggcgatgtagacaggttcgggccgctgagaagcgtaataccctactcctgtgttctggcggatctgtctctgaaggagttacaaagagctggaaagcaagagccttctaactctagagaccctctccctactctttttccccgtcctttctacgagctcccctttctccttctttctttttttcccctttttcttggtaggcatggtcctccttttatatctcaaggggatactacatataccatttctacctacccttcttttgggtggggacccatcctactttgagcaagatttggctcgtacttttatctgacaccgggatagccctgtcctccctcattaatgggcggagatttgcaatggctgctgtttgaatgaccctccgatgggatgggtcataccaacctccactccgtcggaagcaggtgcaacgtggaagcacggttgtttgccgatgacatgacaggcgtgtgaccagtcacagaccggtcactctcgtccaccacgcgtcagtttggcaagctgcatatctgcccttcttcatacaatgacttccttacaatggttgggatgaagcctggcatatatctgaccgggaccgacgtgccatcttcaggagctggcacgccgtctccggctagggacaagtgcctggaggctctcatcaatccgacgggacggggcgaggcgtgtaacaggccacctgccaccacctaacccgcgatctgaccggtctgtgaccggtcacacgctgcgcccggtcacggaccggataagcgagcgcgctgcgctgcattacatgcggcgtgacgcgctcgtccaacccgcaataaatgcggttaggtgagccccgctgtgctcacctaacccatatacgtggcgccaaacccacagggggtcggggcgccctggccctcggggtcgaaacgggagcagtccgacccctcggggagacaaagggaggggcggccacatcaccctcgggcccgacccccccgagggggtcaggccacgtgggtgatcgcggctgcccaagcctctagtcatgatactcccggtcccatgtcaccgacacataccttcagggaatttccgcagatggtgagggcagtgatgttggagaggataggcagggcactacagatgtaaaggccggtgagcctaccggcgccggcaggaatgtagaacgagctagggctgccgccgtagtggtaggagcggaggcgattgcgttgtaggagaaccaatctcgagatcttcacactccactatggtgaagaaccgctgcgttggtgcccagatggagacatcgcgaagtctgtgcagtagagcaccttgaggacgcggagaacgggccgacaaaaggagaccatgccaacgagcaattcgtcggtgatgcggatggagttgaggtggatagtcgtgaggtgggcgaagggcggggggcggggagacccaatagaacaatcgagcggagaagttgatctcgcggagcgtgtggctctgaaggagcggattcagatagtggaaggagaaggtgatcctgtccctcgccgaactgctgcgtaggtggatgtagaggtgtttgacagtggactgctcggcgccgacgaggaagcgccagacgaactcgcctctcgtcaggcttatgtagtggtcgacgacaaggaagaagatcttgaggtgcctcgccgaccgctccaccaggcacttgagcttctccaactgggtgtcgggggctgaactcgacttgcacagagtgccccaccaaccgccgctgcacggcgtcacgccactacggggagagcaccgacgtgtggatgacatcgtcaagcggaggagatcaagtatctgctcgtgcattcccgccggaatcctctcgaagtggttcactggacatcagaaaccttgcacaccgtcgatgattctaatccattgccgtaccgcccctggttgccgaccacctcccgctccgccactctctcccttttccatcttctcaatgaaactacacgtaatgaaattgtgtgttgtccattttgctttcgaagcagaggccacaggggattaggccatttaaatggctggcgactggagaggatgtgccttgccagctacgcaaaatggacctggagctttgaccgggtgatgactgctgggcccacctgcaagtgaaagatagcaaatgagatacaaaggttgcgttcgaatattataagattcacattaaatacatgcacgtaaaataagaaatctatcagcgtataattaattgacttttaattactacaaggaaaatgctttacatacgaccacgagcgtccgactctcgtacaaccacggcgacggcatatgtgacatccgcgagctgacctattaggttgtgatccgaatctcaatctcattgggccttccaaaagcctagtcacaaccgtggctaattacgatgtctggccgggtccctggaatcagcaacaatactaccaacagattcctcgtgtgcgtggaaatcaccgtcttacatgagcttttaatggatcttcttcatgtgctaattttcaattcttttcttagtttcttctattcatcattacattgtacaagtctgtccagataatttgtttgtatgttacggctgtgagagtataagtgggttttcacatgctattggaatgcttatggccctcagttaattgtgcatagcttaattgtttgacataagcacaatcgataattggtaagctagttatatgaactgatcttggtggttatagtatataaaagagtaaaaaaagaacttgctttacctagttatatgaactgatattggtaacatctactacactgaaaataatactagaatgttgagatcaagttgacagttagtggattcagcatttcagattgacctaaagctccggcagaagcagcgtgtgaccatgttgacatgatatggtggtttggacttgtacatgggcctatgtatatgatatgagagtgttatgggcttgtggcgtaggtccaatctacagcatcactttacgccgtcgccgtttcagtcgtacgctagtcgtataacttcatcggattatataggtcacttattacaaacttgaaaatggatatatttgatattttaaaacaactttcatatagaaagtattcacataaaacacatcgtttaatagtttgataagcgtgctagtggaaaccaagataaaatctttatcttcatattgtcacaggtaaccaacacaaacaaaattttagcatagtttaatccttaagatattatttaagatatactttctcagtctcaaaataaaccaacctcgtaggtacgagattggttcatgacggagggagtattaacaagatactataatgacttggtaaagtggaaaaatatctcgatcatgtcaacgataacaatgacttatggcacccgcaatggttatctataggctctctacaagagatccatgtcagcatatttttctacttggaagagattaaatgaagagaaagagtaaagctatctactaacttagagatagtctatagagaaaaacgaggcaatggatgagatagctatagatacccatgtagacatactattgaggtggtttactattaatctagtctattgctgagatataaatgttttatagagagcaccttactttaccattgcgggtgctcttagttcatgtccaaaattttttgaaacaaatgcatgcgttgtgtaaaagattttaaaaaaaactcgatgttacaaacaaaatttcagagcttttcttggagtgtccatggcggagcgcataaattggctttttcccgtgatattcacgcaagcagaaatttgttagacacatacacaagttgccaattttgagcatgcagtaccacaaaccataatcaagaggagcataacatgagggcatagtaaaactgcagagttaaattaacataagggtcaaaacagtttgccttcaacagtaataccgttcacacaagtaaagcaattcatcgcccctcacaaaaaacttaaattaagacatcacggacaggaataagcaaacactgcagccattctcaagagggaggcgaagaacattccaaatgccaacgggctatcagtcacaaggacccactctaggctcctttgggatcagacggcagcgaagtcggcgatgcagatggcactccatcattcacaccattggcagcaccttcctgggacagaccttcaatcaatggaaacataagtttttgaacataatggaaatggaaacataagttagtcaaaattctgaacaatatgtaatcgatttggtaaaaactagctagcctgttgttatgcattggagaaaatgaagtagaacttaactaaggggtaaaactgtcatagatcacctgctggcgattttcatttcacaaagattctatggtaaaacaaaacttatcaagtatttgtgagaacttaccaaactagaaatgtatagtaaaacaaaacttatcaagtactagtactttctcaaactttcctggggaatatatggacataaaacagcaaaacaggtaaacaaaaatggcaaatgcaaaagtcaaaacaggtaaacatccaaaaaaaattttgtagctctgcttgcgcaagagatgtgcacataagtgtcaaaaatgccaaatccaaaagtcaagatatatagaagatggtcactatacattctagaccaaaatttgtccaaatctatcgaactctaggaaccaaacagccaagcaagcaactcaaatgaacgccgttccgctgagaattcacaactgcatagttatcatgaaaaacataggcattacacacatgccacatacacacgacacaccaatcaacatgacacatcaaacacacgaattaaccgatcaagccatgacattgaacgcaaaagcagatataattgatgatataatctgtagctgctcaacactgacacgagcaattggatccgtactgcaaaccagaacattgacaggaaaatgtgaagcttgcggaatcgcattacctgcggagagcgcgggtgggagtttccatggaagaacgctttcagaagagtcgcgggcctcgtactccacgaccttcctcgcgcgcacgtcgacgcccaagatatgcttcttcaggaagaagtacagcacgtccgggttcatggggtggacgaacgcgttcctgagttgaggggccttctccggcagctcggtcgccttgtagctctcgctggcccagatgtcggcgaagctcaccgtgtactcaggcgcccactccgcggtctctggattaaccagcgtgcgcatggagacctcgggagcggcgccgtggcttggagagctcacctccacacacctgaacttgccgtcgatcagctgcacgatgcggccggtggcgagcactctctcggcgcagtagccgcagccatcgtcatcgtcttcgtcttcagattggaggtcgtcctccttgtcctccagtggaacgtacttcatgtccggctcatcggcgaacggatcgcacaagaggaggcccgccgcggtgtccacccaccagagcttgccgtcgtgacagatgatgtcatagaaggtccagatccagctcggcagtgggttgccgacgtccttctcctcccactcgccggtcacggacgagaagcagagcagggtggcctcgtcatcgccgacgatggtctggagctcgacgaccatgtagttcccccggcctcctcctggcgcggcgatgacaccgaggtcgttgttgaagatgaggcgctccgggtcggggacgtgggaggcggtggcggcggcgacgtcgcagacgaagtagagcgggcgcgggatgaggctgacgcggaacgtgcgctcgttgccgtcgcggtcggtccaggaccgcaggtcgccggagtcgtcgggggacggtggcggcggcgcgacgaggaggacgagccccgcggaggggtcgagcgcgaggacgaagggggacttgcacctggcgcaggggtccacctcggccggcgagacgcgccgggacaccgagagcaccgcgacgcgcggcggcgcggcgagggagagggcgacgtcggctccctgcggcaggacggggtcgtcgccgccgccgcacacccgcggctcgcagctcaggatcacccacgacggaggcgccattcgggcttggtgcgagttggagagcggcgagccggcgatcgatgaggaggagtactagtagaagctagggtttgaggaggggatgagatgagcaaatcgaatcaatgggaaagattggtgggacgagtttgaatcaatccttggtttttgtggcgtggcggagaccagaaatgcagagctggagcctggaggatgcatgggtgatcttccttttttcttttggcacttgccgtttcggtgtgtgcggggaggggcagctcggggaaaaggcagacgagccgcatcgacgtgaacggaaatattcgccgcaagctccggaccactgcccgtgtctactacgcatatcatcacaggtcgtaacctcatgacacgaacatggtgtcgtcgtcctccccgtcgtcgcctaatactggcttgaactcgaccaccatgtagttccccccgcctcctgggccctggcgcggcgatgacgccgaggtcatcgttcaaggtgggctcccccggtaggggacgcgggtggcggtgccggcggcgacgtccaagacgaactgacgaagtagtactagtacgggacccagggcatgcagcggctcgtcggagtccggaggggatgggggcttggacgaggacaagccccgcggaggggtcgagcgcgcgaggacggagcgagacacgcggggacacggtgagcaccgactcgcgcggcgagctcgagggagacgtcggcggcgcgctgcattcgtgcgtgcgtgagccgagcgagacgtgactcgtgtagcaacgtgagctttgctgctgccggcgtgccgagctagtcggcgtacgtgagtcggacgtcgcgcgcggcagcaccaccgccacgccagcggccgcgctgcttcgaccagctgaacacaaatgagcagcgcacgaaaccttccgctaggttttaggtccacgagccagtgagagagattagggtaagaaaagaaacaaaatgccaaaagagatgcacgtcgtcgcatgcaacatgacgcgaacaaaatactttctactaggcatagcatagcttaacccttgagatttcttaacaacatactagaacgataattacttcacaatgtgaaaaaaattgattcaccggatacaataagcactccagaaaaattcaaacaaatgcatgccttggtgaacaatctaatgatttcgtaatctgtgtttaggagcgtttagtatttttttaaaaaaaaacagaacaatttaatcccttttcgtcaagatgtagattgaatttatggcttgcaattttttttctaaactactacacgggaacccgccttgatggggatcaaaaagaagagcagcaaatggagaccaggtgtgcaggcagggcaacttgacaagtactgtgtgattttcactcaaagttgattccaggttccaactttgaggatgcagcagcagaaacaataatcaagaggagcataaaaaaaggcaaattaaacctgcaaagttaatttaattatccaggcatgcgatcaacatactactcgagtactagcgcaataagtgcaacagtactatccgacataagcacaacaaatcatgaaaaggaatagcagcattctacagtcattctcaagaggcaggcgaagagaactccaaaatgccaacatttgaaagatccaatgcaaaatgcctacatccaactggttatcacacgcacaggtagcttcttcacttgagctttgtggttccctggacgaaacaagaacaacccactctaggatccattgggatcagatggcggggaagccagtgacgcagatctcacaccactcgaattattggcagcaccctccttagacaaaccttcaatcaaagaaaacacaagtttgtcaaatactaacgaacatgcatgtttgagtgacaggaagtggtactaataatcttgccctaaaagtgcatttgcatggtttgataaaaactagacaaatttctgttattataggataaaatgaagaggaagcgataactgatagaacaacttgatttgagtgacaggaattgaagtggtaataatcttgccctaaaaagtgctatatggttgtcaatattcacatatatgaataagagaatatgaagagcaagaggaaataataatctgagactgcagcaagaagttggtgcaaatgttaggaataacaacatacagcaaaataaactactagcagtaacgtttaagtgatgaatgaaaaagaaaacatgaattgatgtttgtagatgtatccatcttcaatacaatgtgtacaattgtgtatattgttctcaatgataggtctttgtgtcttaacaccttattagtacattcagaaaaattcagggcaacataaatgttctttacatgaacaaaaatgaatgtattgcaatttcagcgtatggatgcaagatgtgtaattatacatgacacatatcacacggttcatgcagtcactttcagtagatagtgggtatgaattaagcagcagaactgaactttttatcatactgagtaatgcatatttatgtgcaaattaatgtttgtgaaaacgaacaccataaataaagttctagacattgtcaaaatttaatgaatttcaggaaccatcaagatcaacatatgaatggccaaatagatatgcaagaaactcaaatgaacaccaatcaacatggaacactgaacacaaaaactaactaatcaaaccatgagattataaacgcgcgcaaaacggacaaaatagctagaacatactgctagtagtataaaattcatcaatactgtcactacacgaccaataggagcaatactttgaaaccgcagtaccatgtcccgttctaattagcagattcgagaacattgacaagacgagcactagtaatatcaaggaagtgtcgagcgcacagaacaattacctgcggagagcgcgggcgggagctccattggaagaaggccgtaagaaaacacacgggcgttctccggcacggtcatcttgtgtgtctcgtactccaggacctccttcgcgcgcaggtcgacgccgacgagctggtccttcacgaagaagtacaccatgtcggggttcttggggtggacgagcgcgagcaccggggccttctccggcagcccagccgccttgtagctctcgctggcccagatgtcggcgaagctcacggcgtactcaagcgtccacaccttggt

SEQ ID NO: 82270 - DNA, 3700 bp, Oryza sativa
ctgggggagggcgattttatactgtgctttatatttttgtataaatatcaatagttatcaaatctttttatattgaaaactatacaagattaaaatctccaagactggtaaaatataattttattattttttagggcctatttggaatgttactgtacaaatattttgttagtgccaaaatataagcaagttttggcactaccaaatatttggtaaggtaaaattgtatttgatcatatttggtttgctgccaaaatgtaaaattgtagtgaagaatgttctacataatctcaaatctagattacgtattaccaataaataggcttcaatcgaaatcaaacacaagtactattcaaattaccaaaatattggtagggcatgtttttggtagcaatccaaataggcccttagtcatacgcaccactgcaatgtgcactctctctaggaaccagtaccagctttcagtgttctcactctctacaaatgcaaaagccataggtagaacctggttgttcccatcacacccaattgctgtcaatatctgacctcagtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaagcctttgcatagcttatggtgtacttgaatttgttctcgatgtgcctaataattgattttagttcaaagccaatgttaccaacaacactgttgtacatctcacttgccacaaaagctgaagtgatgtttcggtgatacttctccaccccttgtaagtagcacttgtgctcggtcacaatgctaactttccaataatcattccatttacccttatatgcatggacacgtcacggacaatcttccttcatgcacctcacttcatacacataatttgttgacttgaccaccctaaactctctctgcaaggaaactgcccaatgcttcactgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcctttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgtaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaactcgcatttctgtactacgccctaagttacattctctacaatattgttctccaaaattctaaaagtaggttacattctccagatcaaactagactacaatcttacaattaacactactgtgtaggtctcaattaatgctattatattctatgctcgggatctacacatatgtggtgtgtgctacagatatgataaaatatatggaacgtaaaactaaaacgcaacatatatactcaaacataacatattagtacaaatgcaaaagatgtatgggagcaaacctgtgatgaagtgagcgaaccagcagggcttcgccgctccccttgtgctgccctcccctctctctctttcgttttttttggatttttagtgaatataatgaagtttcagagaggggggaatggggtttatagggggaggcaaaaatcgccctcccccagggcggcaagggggccgcctgcaaaattccatgccccctcgccgcccatttgcaggcggcccccgcacagtacaaaatcgacctagcggagggcggcaaggaggccgcctgcaaaattcaatgccccctcgccgcccatttgcaggcggcctcccgcacagtataaaatcgccctagcggagggcggcaagggggccgcctgcaaatttcgttgacggccgtcgcccgagagcgaacggccgtctgccacatcattttcgccgccctctgggagggcgattttcggtaggcgattttcaaaatggaaaattatttttgtaaaacttttaataaaaaaaattaaaaataaaaaaaattcgaatggtcgcagggggaaaggaggaaccgtggcttgaagccgcaggcagagacagcgtcttcttctcctcttcgtcttcgtcttcctgccgccgccgaggagccgagcaaaatacaataataatccatcatcggagacgagcacgagcacgagcacgcgcatcaatcatcgtagagtgactcatcggaggaggcgtgcgcgaacaaggggagaaaattccacctttccttttcttttcttttcttttcccccccttgtattctcttattattaaaatcccaaccccgtaatccgtaccccacccacccgcgcccatcgccggcggcgcccagatcgccaccgatcgcctccgccggtgggcacctcttccgccgcctcctgcatcaccttaatccctcttctagcggcggttgctccacgtctccggaggagggagggagggagggaggaggcaactcggggcgttggaccgggctcccacggcgacgcccatggttgacaaccagggctgctcgccggcgctcgagcccgtgcccacgccgtccaaccccgacccctcatccatctcgcaggaggcctgggatcccctcgaggccgccgccggagccgtcgtcgcccggatccagcccaacccgccctccgaggaccgccgcgccgccgtcatagcctacgtccagggcctcctcaggttcaacgttggctgccaggttcatctcttactttgctcacgcctgcctttctagtattccgcaataactactactctacctttcctttgtgcgtcaatggcatgtccacaacacctagtatgagcttacatgttaatcttattcagtcatgtaattattccctctcgatcatttctatgtagacagctgctctggggtgtttaggaggattcttttattactgtttcacatgttgtttctattctctctttggatatggaaatgtagtcaggacaacatgctacatacattgttgcctctgatttggctaattaccatccttggagtttcatatacctacaatgtgatgg

SEQ ID NO: 82271 - DNA, 6138 bp, Oryza sativa
tcggagatcgaggtgctcaatgtctatattaattatatggattaccgattgcaaaacaaatttaggtatcatcttattcttttttatgttaaaagctaaagttagttagttaattaaatttagctactgagtattttttttacaagtcaaggttgtgaaggttttacaaggaagctcagtacagatggcagggttaaaaggaggaggaaaaatagaaaatacatcttgccaacggagagctacagccctatatattcttgttgtttgaggcgctcagcacatagccgagcttaattcctgcttgcatcctcgcggagtgttggagatcgaaggctgctgattaattacgaaagttgttgacatcatgttgattgttccagagcgatcagcatctagaataattcatccttatgtagatctagtaaacactttacgtaggataaaatcgtcatccaaaccatcgtgggaatggattttcacagattttaatactggggttttacgattgaggaatgggaatgaaactggactcataaagtgaacttttctttcagtctgtcgctccaaccaagcgtgcaaacaatattcatatttggacaggcaaatcaacatgggccgcaggacacacattatgggccgcgcttgagccccattcccgtcccaggccagcccagacttataggctgcacgcgggctaagggtgctccggcccaacagatacaggccgcgctccagctggaaaacgacggtaggatgcgattgcttagtacggaccgacgattaaagttgattgatttctggaggcaaagattttacttgaaaacattttactcatatatatccctgatctttgcgctttgactgacaaaacaagttactatatattactattgttttattttaaacccagtgagacaaacaagttcagcagcatccagcattatattccagttaggtgctaaaatactgtaaatcatcaccccggccatgaggagtacaaatgaagaacatgccagaatctgtaggagcattatatgtagattagcatatatgtatgcagatccagctaatgaactgaaataattgacaagatgcattattaaaagactcttcattggatggatatatattgaagcatgcatgcatgcagtaaggtacaatgcaagcaggtcctctaaaattcatgcatgattcgtctgcccctcgtcccgtaaaggagacagatcaaaatcaaccctcacactcttacactagctataacgacgactatcaaaccgcgacgaagcaacaggtaagcagatagtaacagaacggaggagtaacatgcatttctagctcgatctctctgacgacgacgaatattgcagatagcaaccgcaaaatgagagccgcagatcgatggatccatctctccattattattgtggcatcacttgacgttgatccactcagtgcaccctgcatgcgaatgcacaatacataggcagattaacaattaatggttaattaagctgcagctaatagcacagatcaaaatcgtagtagtacgtagtaaatatcatactgatggtaatcaactataatgaattacctggagcagtcggtggaagggctgatagcgtaggggatgttgacgccgcacttggaggggatgccggcgaccaggtcgggcctcaggccgcccatggcgctggtctgctgcttgaggcaagcgcaggtggtctggcggtcggcggtggtggcgacggcggagttgagggtcctgaccccgtcgcagcagccgccggtgggggcggacaccctccccgtcgcgtacatgatgcacggcgccagcatgctcaccacctgcccgcatgtcaccgcgctcgccgccggcgccgccaacagcagcgccaccaccatcaccgccgccacatacttattattcgccgcgcgagccatcgatcggtcacacgaagatcaagttaagttgctgcttaattagctaagcgcagtactatgctggagtggagtgtggtgtgggtgagtgagggaggggtagggagagggtttatataggggttttgggccaagccggagatcgatgatagacctataagttggagttggttttcatcctagagagtaattagtgaaatcatgcacccacgcttatgtgcttcaattcccggtaatttttcaagaagcgcagtgtttcaatcctagagaaaagaggacttccgagtccgagtgtccgacacatcagttgataccttacacgtgcagttacatgtgcagggcggtggaaagctaaaattaacactgcgtgcttttagttaactgtacatatgacttttgatctcatgagttggtggttgttgagttgtttcatttactacttgccaactttaatttgcagtaccccaatttaggataaattcatggcacctgcatccagccatccggagagagtttataaataagtactccttctgtcctctagaattttgacattttacttatattgtttgaccattcgtgtttttcaaaaaaattgaaattattatttattttatttgtgatttactttattatttaaagtactttaaacctaactttttgtttttatatttgcacaaattttttaataaggcgaaagggcctgtagcctagtggttacaagagcctcagtagcacttgaggtcctgggttcaactctccacgggagcgaattttccaggatttatcggtattgtgctttcagtggtaggcgacgtacccctagacagcgagacgcctgtggtgacttcgtcaatcttaaggatttgctagctcagtcttcgaagatgttcatatgggtagtttaataagacgagtggtcaaacagtacaaataaaatgtcaaaatcccttatattagggtcccttatattaggggacgaaggaagtatatgtatatgctattacagcggtttatgtatagtgtgagctactacgagtatttgtggttaaggatagtggaacatgcccataatctagataaaaacgacatgcacaagcagccatggattcagaaaccaacgtgtatacatattctgccctgcagaacagtaagagttcgaagagagaaacaaagtatacgtacagtctccaatattacaccataacaacagtagataatttacattgtgaatagaatattgcaacagtaatgacttaatggcagtatcatttttatgtatggcgtatatacaaaatacaattcacaagcatacatattaaaagacaggtctttagaaagattgacatttgacacgcagcttcaattccatctgtgggcaaacagagcaatgggtactccactgttgaaggaatccatatttattgaatgaaagctaccagcttcatttatttgtagcctatcgattgggcagatggatcagcagctacttcgcaaatttctcctttcatcagtgtgaccatacagatacagtaatgtgcagtgcttggtcctggtgcagagctatagcagcctgcagcaacctgatcgatccattaattcatccagagacgtcgcctagcaacgtatactactctgttcatttgatcctcatctcgataggtcagataaaacctcgcatgcacatgaatggcatcaactccatgctcctaatgtcaccaaccaactacatgcctgaaataagaaaatgatagggagtactaattaatttatatggaattaaggagataagattagatatgtcaatgacaaaggagattataatttataagattagtcattttatataccttcttgcccctaatattcagctcttactgagtctccagaactgtttcatttgtgcccatataaatttccattgctccatatacaccgaaacttaaaacttttactggaatgtcgttcaccagcattgtatagcaaatattacagttaccatctggcaatcttaaaaatgaagccaagaaagaatgcattctgcaatcctatttgtgtttgcccatctggatcagcttctcgagctcgtcaccatggtatttaacttccaccgaaatactacttgctttggtacttgctgaaaattccacctttcatgggctactgatctagcgaagcgttcgcattgaaatcacttctaggcagagcacagagttcaacttcattctccttttctgcatttcagtagccaatttagccagtgcagtttactgacaacagacactaagtggagtagacatccaaaatttcacatattgcaatggaaatggatagaaacccaatattttcattttgtctgatgcatgttgggaaacaatgcacttctccaaagtcctaaccacaatgattgtgacatactcaaaaacgaggactctcagtggaaaaatccaaggcatttgatggaacaggcacatttcagcacaagaagaaggttatctcccatctgctgtgcatcaatacattaatagtttaatacgactcaaagttcttacgaaattcacagttcagcagtcttcactttgagaattagcagcagtattgtcctaaacatcacagaaggtaattttagaaaatatgaaattatgaataaacaatattcagatagataaaaaagttacttgagaaacgtgaactcacccgttggaactacagtctagaagtggtagcaaagtggacttctggaaatgaagctgaatattacactgtacagcttgcggcgggtttattggctacctaaaattaacttggctgtttgcagcatgctttgaggcattgtatctgatcatctctgttctcagatactcaacttcactccatctctgcttctgcccaaacctttggtactgagtgatatgagtgaaggggcaatgatgtgagcaattcttttgctgccagttattcatgtctaaaacattcaattagcccggaagtcatgattcagtttcagaaacatttgttgttgatcaacaaaaccattcaagcaacggtatcggttaattttcttgtgccatcacacatatgtccatctggaaatcttaagataaacaagcatgccataacaatagttataatttgcccttcttaacccttctgtacttaaaatgacttgacaccaacatcaagataaaaatgaagctaccaacattaaaattattggagctacagcccagcaaaactcaagagctagggcttctagaattaagaatgatcattatttcctatagtttcaggcagatgtattgcttacattacgtccatttgactatgtgcagcatgcttcaaagcactgttgcatctgaccttcattctcagatgctcgacatcatcccatctcttcgcttctgcataaacatttgatattgtgacaagtcctccattatcagttagaatcaactcacgtagttcatgaaaaaacatgtaagcaagatcgatgtgcccatgcactcggcaagctgccaacaacatcttccacagaacagagcttgctgttgaagggttttctttaatcatcagataagcttcttcaatttttccatagcggcaaagcatatcaatcatgcagccataatgcttaacatcaggaacaattctgtagtcctcaatcatgctattaaaatatttcctcccctcattcactaggccaccatggctgcaggcggtcaagacacccaaaaatgtgacaggatttggctcaatcttcatcgaatcaaagagctctagagcctcacgtgagcagccatgcacagagaaaccaacgatcatcgcattccagcatgtaatatccctcatagacattctgtcaaagaccttcttggcaagatccaacatcccacattttgcatacatatcaatgagtgcattgccaaccaagccatcagctacaatgcccttgttctgaaggtttctgtggatgtttgtccccaggtccagcttaccaatctttgcacaagccccaaggactagtacaagtgtaagctcagtaggttgaatgccattctcctgcatttcttgaaaaatccccaatgcttgggtatatttgccgagctttgtgtagccactgatcaaagagttccatgatacagcatccctctctggcatttcgctgaaaatccttgcagcctcatccatatacccgatcct

SEQ ID NO: 82272 - DNA, 3736 bp, Oryza sativa
attatccgtggccgtcgcagttttgcagtgagtaaagtgatcgatcgatatggccctctctagatagctaggaggaatctttgcatccatggccacggcggccattgcagataatgttcaagatggcccatgagtagtgcaaaaggcacaaaagatgataatcatgatactagatcacttggtaattgtcccacactacgcatccacactgattcgatccaaaattccaaatgtgcaccgatttgcaaggtaaatttaatcacaccaccttcaaaactttctccagtttctttcagaactgatccaatttctctggagagaatctattctataccactaagtttgttcaagttcaatgatttgtcatcgacattatctctttctataatataccggtgactttatcaactattttacaatacgttattgggttgaaccttattttcaaaaatagccttagagatatacaatattaacagttgatttatctcatccgaagtttcaaaaaactatgaattttttttgtggcctccttacacaacatgggagtttgtatacaagtttcaatttttttttctgcatatttagtttttagaaaaaatatttttatgtggtatatgagagagaatttgcttatacaggacataatagcataaaaatatcttatgtagtgtatgaaagatgatttatattaaaaacaataataaaaaagtattttataacatataacaaataagttatatttttgagtaaatttcacaaaactacaggtattttgtataatttatcacataactacaaatttaagagcttgttttacaaaactacaggttcggtgtctccgtttatcacaaagctacaggtattgtgtacaatctatcacaaaactacatatttaagaacttgtttcacaaaactatagatttagtgtattcgtttatcacagaactacacatttagtgtctccatttatcacaaaactacatatttagtgtctccattatcacaaaactacattttttaataatgctaaaacctgtagatttgtgataatgaagatactaaacttgtagttttgtgataaacgaagacattgaatctgtagttttgtgaaacaagttcttaaatctgtagttttgtagttttgtgatatattgtgcaaaatatctgcagttttgtgataaacgaagatattgaatctgtagttttgtgaaacaagttcttaaatctgtagttttgtgatagattgtgcgaagtatacgtagttttataaaatttactctatatttttttaataaaaaatagaaataaaaaaatagaaatgtaaaaaacttgcaaaattgtgtaaggaggccacataaaagttttcatatttttgaaactttaaattagataaatcaattattaaccttgtatgtgtataagggtattgttcttaagtattataaaataattgataaagttatcggtatattatagaaagcggcaatctcgatggcaaatcgttgaattctaataaattcagtggtatagaatagattctctcatttctctgggattcctttgttcaaagggaagttggtttagaatgtgcaatatgcgttattacattctcagagcttttatctttgctctttagtttatcagccacaaccaaaatttaaattttaaatcttactttttatatttggttttagtgttttgtcatcatagtttcttttccaacgttatcttttaagttgttaaaagtacatgtatataaaaatcttacctacattttttttattttttacgttaatacacgttgccgtttataatagatggaacgatgggactcatgcagtatgcctgccagattaatgattggtcatcaatttttcaactttcaagtgcgtacggcacgcatatatgttcagttgtacattcaaccttgcaccgtggaacataagactttgaattttgtctaaacccgactactagaatatcttcacctaatagtattatatcttcagttgctttacctaacaaaacatcgcttggaacatggtacgtcggtgcatgcagcaatacttacgtttcgccatgaacagtctggcctcatctttatcttctatatatgaattcaacatccaaggaaaagtatatcctttgagtccttgatgattttggaacatccaaggtaaagtataatcttggtggttttcacgagaaaaaaaaaagccttaattggtggtttcaactgatataagtttcgatttcttgacgcactgggaaagttggaaatgaccataattttattatcagttatactgccacgaatatttttcatcacggatagccaccaagaaaatggacttttccctcgttctcgttggcaggttttcctcgttggtcgaccgacaaaacttgttaccttggtgatttttattccatctttggtgggttgtgcctctcaataaaatttgggattctggtaatgacataagtgggtgtaatatgttgtgtcaaatgccccgtgtttgttcgttaaaaaaaaattgacaagtgccaatttcacccgatggcgttgaaaccagggttgccaaaattttggtcatttcggtgaccccccgatacaatattaattcggccaaaatttttgaatttttgaattttttttcatgaatttgggtaatatttgttcaaattcaactaaattttgttcaaaattttggaaatttcggacctaaatttttgaaatttcggtgacccccgatcaacaaccctaaacggatagagtgaaccctggttgaaacttgaataacatgtggtgatttttctttgatttttcgctacggattatttgctcgtgcttcttaaaaatatgatttctaaaaaataacctttttctatttcattgtctatactgtctattctaacttattaaagttttttttttaaaaaaacactaatttactgtgtttaatcaaatgaataatctgtgtttatgaaaaaaaaactgcatcaaacagggggaaggaatgaatgatgggtttttccaagattcgtggatcaggacgtttgttgggctcgaagaccaacactggctattattgggctttcttctgcatctcggtggcgaatcgggcgaaatgaaggcctgccaaaattatcgtcccgtttgcgatcattcaactccccaatcaccaaacaagctgcgaatctgcgataggatgaaatgaaaaccttcccgccaccgccacacgcgcgcccacccccctctcgatctccgctcccgccgcggccggcgcctcctccgcgcccatgccacgacgacgcctcctctccgcgcacctcatcggcggccgccgagcgcgacctctcccgcggccgcaccaccgaccggcgcgctgaggctgttcggcgaaatgcctgtggcggaccggaatgccgtctcttggacggcggccattggcgtgctcatgcgggccgggagggtgtgtcgcatgctgcaatgccacgatttctgtgtactgcagcagcggtcgtgcccacgatgcttttatgcattatttgaggggatgccgaggaagaacgtgatctcttggattgcgatgatcagcggcgggtatgatcaaaatggttaaagcaagaatgccctctccttgtttagtcagatgtgggctacgggaaggatgaagcccacgccaagcaccttggcatgtgccaatgtgccagacatattgcttggtttgca

SEQ ID NO: 82273 - DNA, 28142 bp, Oryza sativa
tgctattatatgcgataccaatcaagaatgcaagggatgctatttcatcatagcaggagccagtgtaaaggtgcttgaacttaagccaaaagaccccacaagcttagtccaagtgggttggcctcaaggtggcttatttaaatagcataaggccacatatagcagacaaacagcttgaaccttcttcactagcattttttttaaaaaaacaacagtgcattcattccatgaagttggggttcttttctctgagttggtttggcatgctctattatagttttctagttctttccccccaaactagcaacttcgttattaccctcttcaggagaaagacttgagggtggaacatcatttgcaccgtggtcgagcactagctgctttcaggcatcttcttggtaaaagagcttcacagttaaaatcagccaatgcaagccaagtgatctcagtgcagtctagtgttcaagcagatgtacaattgatactagctcctttaagtcaaactgaacgacctattcttctatcggtatgtccatgtttcttgctttttttttttaactttaaaatacttattctgctggtattcatcagtcctttttgttgcaaatttgcaatataaatagtttaccatcatatcactgtccaaactccaaaataactgagttgccaccattgttcaaattttattcatctgaataatcagaggcctgcaaatatgaacaaatactttggacttctatagtgtaaatgtgaacggacatatggaggtattgactgttctatttagtagtatttatttggcacttgtgaggtgacaatattccaaatattttatgggagtgtgatatgctaaaattctacttctagttctgacttctgattctattatactgaaccattgaacatttaatcagcataagcttgcaaaacttcttatattaatttgtttatttaggaataggttgtcatatttctattttttaatgctttaggttgttggatgtcttttcactttcctatgccttttcaatatcaggtagctccacttgctatcacaaactttgaggactcaactcttgttgcttcgtgcacattcctgttggaactctgtggtctctgtgctaacatgcttcgtctagatattgctgcacttcaacgtatctcctcctactataagtcatttcagcaaaataaacaatgtgatctatcttcaccgaggagtcctgggctacatgtactctcccatggagctgaccttgctcctactcttgcccgaacattagcagaagattatatccagtctgatcatcttcatgttttggagcagaagcagccctctaaggctcccaagagggaacattcatcacaacctcttaaagctattctgcatcaccttgaaaaagcaagtttgccagtgttagaagaaggtagaacctgtggattttggctcttgaatggtattggtgatgcatctctttaccgaacacagcaaaatgaagccagccaacattggaatttggttacagaattctgtcaggcacaccatctgccattaagtacaaagtatcttgctttactggccaatgacaatgactgggtattcactaattattttcttctcatgttggatattgttgtttatatatgtccacacattaatttgatgcaatatttttttggcaggttggttttttaacagaagctcaggtgtcaggttttccaattgaagttgtcattgaagtggtattgtttcttattttggaaagtagacattttgattatagttcatggggaaaaaaactatattcatttgttctctctggttttgtgttcaggcagccaaagagataagggattcaagattgagaactcatatactaacaattctgaagaacatgatgtcagctagaaggaaatcctctagtaatgtatcttcaggaagtgattcctctttctttgctgttgatggtgacaactctatggaacttttctctgttcttgctgtctgtgaaaaacaaaagaatcctggggaggccctcctgaataaagcaaaacaaatgcagtggtctttattggctatgattgcttcttgtttttcagatgtgactcctctctcatgcttaagtgtttggcttgacattacagcttcaaggtagcacattgagcatgtcatctgtagaaattctgttatctaattttgcaagcttcattactatcactggtgtgtaatattattgcattggcatttatgtctgtcatcagggagatgtcattaatcaaggtggatgatatttcctcgaaaatagcaaaaaatgtgggatccgctgttgaggccacaaataaattaccaagcatgagtaggaatgttgaatatcgttacaacaggaagaatccaaaacgaaggcgattcctagaggcttctcaagaaagcttcacatcaggtttctcatcatgtggaccaagccctactgcaactcctaattttccaaattttgatgttcagcagaaaatactgaagcccatatctgaagagactaaaattccagttgatattgatgaaagatttgcatctttgtcaagtatggtagcagtgctttgtgaacagcagttgttcctaccattgcttagagcttttgaaatgtttctgccttcgtgctcccttctccccttcattcgatctcttcaggttggtatatattcattttttgaaagtactggtttattcaatttaacataatcatttgcactatctttttaatttaacattatcatttgtgccatctttttaatttaacatgatcatttgtcctatctttttaaggcattttgtcaaatgcgtctgtccgaggcttctgcacatttggcatcattttctgcaagactgaaagacgaaacatcccatgctcaattaaactcttccaaagaagagtcagctatggcaggatgggtagctgttactgttgtaaaagccgcagatgcagtactctcgacatgtccatcaatttatgagaagagatgtttgctacagctccttgcagtggttgatttttctgatggtggctcctcagcagcttactttcgccgaggttattggaaaataattttggctgaaccttctgtatgcaaagatggtgatacctacaagtggaatgattccatggatgatgcttccctcttagcatcattagaaaaggatggtcgatgggaggaagcacgaacttgggcaagacaactggagtcgagtgatgtagcttgggagtctacttttgatcatgtgacagaatcacaggtatttggtttgtaccttcatctgttacattaccaagtgtgcccttatgacttttatgctgatatgaattttttctgtgtgtgtaggcagaagctatggttgctgaatggaaggagttcctctgggatatcccacaagaacgtgcagctttgtggagccactgtcaatcgcttttcatgaaatattctttacctcctttacaggtactatcttctgaaatagcctaatatattcttcatgtggtcttttatctgtataaaatttatcggttgtttatatccattcaattgtgtttgcaggctggatcttttttcctcaagcacgctgaagcggtaggagaagagataccggcacgggagcttcatgaaatacttctgctatctttgcaatggctaagcggaactatgactaactcctctccgtaagcttctttgtaatatgtattgctgctgtacttggtctcattatctccttacagatatatatacattttttgcagggtatatccacttcatcttctccgtgacattgagactagggtttggctcctggccgtggagtcagagagtcagtgtaaagctgacggagaatatgcaccttccagtgttactcaaaatctagctactggaaacaataccaatattatagaacaaacagctgatgttatcacaaaaatagacaatagtatgagttcaccacggatgagaataacagaaaggaatggtataagggacaacaccaccccatcattccatcaacatttgcaactctttgagtctaatggcgaaggcgtacataacacaagagcaaggcgaagatcaaagacaaatacgctacttagacgggttgccaaggatagtgttgaaagtagcataaatgattctggtgataattctaactcctttaatagctcaaagattgctggacaagcaagaagtttactgtcagaagaggagtttgcaaagatggaagtgtctttatccggttgggagcaaaatgttaggcctgttgatatggagaaggctgttctctccttactggaatttggacaaataactgctgccacgcaacttcaacaaaagctgtctccatcgtatgttcctgaggaacttgtccttgttgatattgctttaagagttgccaataacagcagtaatggagagatcagtttatcatgctttgacccagaagctctttcaatacttcagtcactaggaagcaatacgactgatccatcagaggtctgtttttttccattgtacttatttctttcagaactttctattagactattacgaacattaaataacaggattgattgtttgcatgactaattgaactgtaatgatgaaattacagtaataaatattttgctcgcagtgcaaaacacaacaaaagagttagcacagaaattggtattgaatgctactgttggtattatctcagattcattcattttatgagtacaatagtgctccggtattaatgatcacatggttactgccttttccatggtcagaattacaggctatcattgtctcttgaaagttttggtaataaatgtttgagtggtgcacggtccacaaattacaacaagttgttctttcttttatgtcaggttatggagaaactagccatgaaatgtggcgagggtcgtggacgagctcttgtcaggagaatagcagcagttgttcaaactgcaaaagtactgggactcccattttctgaagcatttgagaaacagccaattgaacttcttcagttgctttctctgaaagctcaggattcttttgatgaagctaaatttctggtggagacacacaccatgcctgcatctagcattgcaagaattcttgctgattcctttctaaaggtacaccaactacaccatcctttaaacacacttcattttggaggaacagcaaaggcattctatatattgtctaatgtgcttttaatatttggcaggggcttttagctgcacatcgtggaggttatctggattcccaaaaggaagaaggccctgcacccctgttgtggaggtctagtgacttcttgaagtgggcaaagctatgtccatcagaaccagaaattggccatgctttgatgcgtttggttatgactggccatgaagtaccacatgcttgcgaggttgtatgatcttctaagttaccaagacaatactgatttgtatacatgcaaatgccatcttctaagaaatataacttatccaaacagtgttatgcaaagttcatgtttgacccttgatatattatcaaggtataatatttaattagtgtcagtatgattatgccataaatttgttaatttcaaaaaaaaaacatgcacatcagttttattccactcataaagtgactaacttatggaactcaagtaacatgcactcaacttgatgaggtgtcggtgtttaaagtggtggcttatggaattatggaacaaatcagcttaataaaaaccagttgatttggagtattgggatttcagtccttttttggttcgtgcttcttgtggcctatgggtaacaagtatctattactcttgcgcataaccttatttatttcactgcagtattggaagaaacaagttataattgtataagatctgaaactcactgactcacctgtatttgctttaaactggccagtgctggctagtgccctgttgattgtgaaagaatttgctagtttccacattctttgcatcatatattagtaggtttatactgagccactttttaagccattgcttatatagagtgaagtgaagaaccaatttcctcatttgaaaactagaagttatccatctttgtcagtcttgcgttgtatttagttcagtattcctagtgttgttaactataagttactgacatttgactgtggcctgtgggttgcttgaaagtaatcaaatttgcagaatactgatatgcatgagccttcgttggtattgatatgtttgtgttatcttatgtaaacttaatgtatccaggctacttagctaccatcagattgactatggtttggtttgaattttactgttgtatgctgttcccttgccgtctctgaactttccatttcaaatgttttgcaggttgaactcctaatactgtcctaccacttctacatgtcttcttcttgtctcgatggagtggatgttctagtcacatttgcagctaatagagtggagtcgtatgtgtcagagggggatttttcttgtttagctcgcttgatcactggagtgagcaattttcattccttgagcttcattctttccatccttatagaaaatggacaattggagttgttacttcaaaagtactctgcaactgactcagccactggggcacctgcatcagttagagggtttaggatggctgttatcacctcactgaaacattttatcccaagtgatgacgacgctctttctctggtatatatctctctctctctctccctctctctctggaaattttggtttctgaaatgtattgatgtctgagacacgttcttttaccatccaattagtctgcatacaatcaaacaaccgacataatgtgtgatccaatctaggtccaaagccaagtagtgcatggcctgaaaggagttcatttatcacaaaggagcatcactgtggatatatctgatgacctaatgctttgtcaaagcttaaaactgctgattgagcacataccatgccatcttcgcttttgtgcatacagaaaatgtgctaacaacagcttgttttaatctgctagagattatctagttgggaaatatatgaggtttgttagtaaactagagatagagatcagattagtttccgttatattcaacattagtttcttggatgtcaagtcagtccatcctatatataaagcgaccccatttatcatattatcaatcaagcaatgaatctaaagttagtcaaataaacctcagaacatctcttagctcgacagggaagccctgtcagcgcaatttgacgacgagtgccctatcctctgtctaactatcttcatgcccttatcctagccagttcataagttctatctgttgattgagcacattcaatgccatctatgcattagtatgtacagaaaattcattgagcaattttagcttatttagcatctacatgaagaataaaagaaaacctgagactttagtttccttcatagttagtcgatcctgacagcttcacttttacaatgacaagacatacctcctggctgtttctttacattcttacaacctctgtatactatgcaggtatataagcactttgacatgaagcatgaggctgcttctctccttgagtcacgtgcagaacaatacatgaacagctggttatctcgatatgacaaagaaaggaggaatgatgagctccttgaggctatgcatcaccttgttgagatggctgaggttctttcaacaattgatgctggccaaaggacacaccgggcgtgtgcgcgagcttctctcctatcacttcagatccgtatacctgaccttctgtggattggtctttcggaaaccaatgctcggcggattttcgtagaacaatctaggttccaagaggccctcattgttgctgaagcatacaacataaatcagccgatggaatgggctccagttttttggaaccaaatgctgaaaccagatctaattgagcaatttgtggctgagtttgtgttggtgctgcccctgcagccaccaatgctactcgagcttgcaagattttaccgggcggaggttgcagccaggggggaccagtcacacttctcggtctggctttcgcccggaggcttgcctgcagagtgggtgaaacatcttggcagatcgttcaggagccttctccgtcgaacgagggatatgaggctgaggctgcagttggcaactcttgcaacgggatttagtgacgttcttgacgcatgcaatagtgttttggacaaggttccggagaacgctggccctctaatcctgaggaagggccatggtggtacatacctccctctcatgtaaatccttccattttgatccatcttgttcaactttcggcagactgaatcttacaggagttcagtatatagtgaggtgagaatttttcccgtcctttctttgggcctgcgttcagcattctagttttttgatacatatggatgaagccatgggagatattcggtttgtatatatacaagcattctgagtggataagatgaacatagccgattgagagtgagtttttgcggcttcagtcggtggaagttttcgtgtgggttgtagcgccgtactcgtggtgcctgatgtctgtagtttgttgtaaattccattgacccaaccatgaaattttgtacaattttcttcacgtcacttatgcttcacaagatactcattgatatgctggttgtctggatctgaatccatcgaactgccatgaaatctgaatccttcaggaccaattgtgagttcagagttctggcagttttgagccccctagtcctgcttgagaagatatgcacttgatcagattgtgcctttgatattcttgataagattgtgctatttgattgagattgtactgttcattcccaacaaccctggcggcgatcgtccaacgccggatggataattcttctcacgtggattccaacaatccatgccacacgagacttggacttcttgctaagaaaaagaaatatagcattccagtaggccataaggaaatattcaagcctaggacggccccaatttcgtctgccaccaccaaccaaaccaaactcctcacgagcgtcgccggcgaggcgaagcagccgtagaaaaacccaagatcagcgagttgcgtccatctctcgccgtctccctcagctgctcagctttgatatgatagctcaagggcgatacgtttagtatggtcgccggcagcaaggagctcgcggcggcgatggccccggtgacccggccgcgctggtcagtgctgccggcgccgcctcgtcgcctccggtggccgcccccgccgcccgccggaatcgccgccgtctgcttcggctaccgacgtactgtaactcacctctcgcctcctctacaactctactagtacttcactgttatacgtggtgatggagagtgcgtacgagtggttaggaacagcttaatatttttcagttttccagctaatctttgtttagatttttcttttccatttgtcttctataattacttttccccgttctggaataattggcagtaacagtaataaaacttaaaactctataaagttataaaaaatactttccatttttccatcttgcttgtctctttttaaaaaatacttaaaattatgtcataattattaaaatatctgatgtcgaaaaatattacaatacggttttcattcatcacaatataattatttaaaagtaatttgtggttaaagtgagatgatcgtaagtattattgcgactattattaacaaccggcggtactataaatcaaattaggacaatgttattcatcacagtaacaattgatcaccccattctctaccatttgtgtagttttcccaaatcgaagttcaattatgcaaacatgcatttgctctgcttatatttataagccaaaatttaaatagaacttagttttgagtttgattttttttctaattgtactttactttacatcatttactaagtacatgtactttttaataaacaattcggataagtatacgagtgagcgcaacaatgcttccataattctaggggatgctttgcttcaaccatttggtcgaagcccaaaagtgagtaatgaaagcttcatttctctacttcccacgtgtcaccctgacgtgcactgctggcagctgacgtggcactcccgtaattatatatattttcccctggaagcttcctgccctgcccctccttttcccacgaatcccgattccgatccgattccgcggcgcactgtcaatcccattcccattcccattcccattccctccccccgaaacgaaaacgaagcaaaaacgtctcaacctctccgcctccgcagatcgcctccgcgccgcgccgccgccgacaatggtcgccgtcgacccgccgccgcgggaggccgcggccgccccgcccgccatgaagcggagcgcgagcttcgaccgcgtcccggaggaggcgcgccgcatcctgcaccgcctcgccggggagctctggggcggcgacgtcgaccccgccgcgctcgccgtgtcccagctcaagggcgccatgaccaacgaggtgttccggatcacctggcccggcggcggcggcggcgagggcgagggcgagggcgaccaccgcaaggtgctcgtccgcatctacggccagggcgtcgaggtcttcttcgaccgcgccgacgaggtccgcaccttcgagtgcatgtcccgccacggccagggcccccgcctcctcggccgcttccccaacggccgcatcgaggagttcatcaacgcgagggtacgcactctctctctctctctctctctctctctctctctctctctctctctctctctctctctctctcccccatcactcctctgctcccaatggcaatggctcattctcctcgtgttctgctcagacgctctccgcggcggatctgcgcgacgcggagatatcctcgctgatcgccaagaagcttcgtgaattccacgatctcgacatgcctggacccaagaacgtgtcactgtggcagaggctgaggtacgcatccccttcactatttctttatctccattaatggcgagaaccacgagcaatccccccttccagaggctaatttcactgtgcttcatgaatcaggaggtggcttgaggaagctcgtggcaggtgctcgcccgaggaggctaggcagttcagtttggagaagctaggtgatgagatcgcaatgctggacattgcattgtcaggggttgatcagagagtaggattttgccacaatgatctgcaatatggcaacattatgatatatgaagaaaccagacaagtgaccttaattgtaagcgactcagtatctccttttacaaatgctccgaaatcaggcgaacagctctgatgcttgatttaaacataaatttgcatctgggttgcataattgaactagtatgaagcatatgatgttggtaattcttggaatgggagcaattgcttaggtcatattctgttaatattttgctgtaaataactgctgtcttgggatctcttttatccttcaggactacgagtatgcgagttttaatcctgtggcatttgacattgctaatcacttctgtgagatgtctgctgattatcattcagccacacctcatgtgctggacttcacaaaataccctggtcagtactgatgatagccatatctgttaagttctacctgcgcgcatggctgtgtgcatttcactgagaaaaaaatcggcttgtttgacacctctgcatatttcaggcattgacgaacaacgcagatttgttcaaacgtacctcagctcttcaggtaagcaggatgcaccttggcaccgttggcccgatgaaagaaaagggaaaataatgcactttgggactgaatgaatactgatgctgcattttctgtaatgtgccatgagtgattttaatcttgattgttccttctgtttatcaggtgagaacccatcagatgcggaagttgaacatttacttggcctgattgcaaaatacagtcttgcaagccatatcttctggggtctttggggaataatctcagtaagctctcttaacacagcggccacgccaatggcaaatgtgtatagataatctatttagtgatcttacaaagctggttggtatctgtttcttgtctccaggggcatgtgaacaagaacatcgacttcgagtaccaggagtatgcaaggcagcggttcgatcagtactggaagacaaaagatcaaacgctgggatccaaatccaactagttgatcacacagacacacagagcattcttctttcatgtcttgtgatccttttcttttatatagctttgtctagtcttgtgaattctcaattgtgtgtgtctgtagcagcagcagcgtagctgccaagtttttactgtaaaaatctttcggctccttgcaaacatgtccttcgtttccgtatcatgcgattggagtagggcagtaggctgggtgatttttctcggaggagattttctccggtgccatgtgtgcagcggcggcggcagcgcgcctttgcagagtctccacgcactgcaactgctgctgccgtcgtcaggctcgccggccactcccactctcatcgccgatagcacggagcttctgaatctttctatggatctgaattgaaacgaacaaaatgcaaggtgccgaaacgaaatcgctggtcctagattctgcagaattgatgtctttatctgtaagaaagattcagttgaatggcaacaagggcaccagtggtctagtggtctagtggtagaatagtaacggcccaactattcattcttcaaagcccacacagaaaacttcgcctccatccatggacttagctccttactctatatgggccgaataattcggcccataaactctctcctcatctcctccccaccctaggccaatacatccgcgcgccgccgactcctcctcttgccccccctctcgccgcgccgccgccgcctctgcccgtcagacacacctcccccctcctcgaggacaagggactctcctctctcgccggcggcggccgtcggcgacgacgtactagtactccacccccactcagctgtactgacgcggcttgtgtggatccgagcttggattggtcgattccttctgttctcgtgagtcggtctttgccctcgcggttcgttttgctctgccttttttttaggttgctatctgtatattatgtgaacaatggcgcaccgaagttcactcagattcttgactgttttttgttgtttgctgttgctgttgccgctgttgaaggtaaccatggccagtgccaagcccgccgctgaacagaaggctatggaagggggcgagcaggaggctctggatgaaatggagaagaaggtgcacaagtactcgcgggggaaggctgcttaccttggggtgagactgctgctaaactacttcttcttcaaaaatctgcgtccctgtttgattcacatgtgtatgtgtggtttatgttgggtttatcagactcttcgcgacaagaaattgaaagggcagctcgccgcaagagagaagctctatggacactccgccaaagccgccgttcagaccgagaaggtgcggttgttgattcttgtaatgaatgtttctgggagcatatgcaacacaatgggagaattgagaatctgtcgtttgttgatctttatttttgcttccaattttgcagtggctcttgcctaccgagggcggctatttagagcctgatgatgatggtctggagaagacgtacagatatcagcaaacttcgctccgggaggacgtggatcttttgagttcaagaaagccatttgatatgatcttaccttgtaagtgtctaaatctgttttttttgttctttgaagctgtgatatcataggcggcttgttaaatcaagccctaattttttcccctgctacattagatcttgataaatgaaaacccctatctcaagaaaccatcatcttgcttaatttatccattactaattttggtttaaaaaaaactaaaaagaagtgtagaaggaacaccattagtgttttcaattgaattattttatttccaatacacttattttgtagccactataaaactttccctgttcctcttctgtaaattcccccttcttcacttcttctaattgtggcaggggtacactgttctatttatctggatgaatgctgatttttttttgtttaaatatatataaccatagcatttatttatcttcatttctgtatcatcatgtaacaatgtatcttttttggaataattgctagatagcacttttcatctacttgctgctattaacttttcggatgacaaccaacaagttatgagggattgactagctcttctcttatgatgcagtacttggcccttatactctaggatacacgggaaatggccggtatatggtagtaggtggacgaaaaggtcatgtcgctatgatggatatgttgaatttggaactcgtcaaggagtttcaggtcattttttcagaactcaagacttttcccagcatgcattttttttccttatatgagtcatattttttacgtcttcctactggtatttctatccatgcgtttatggcactttctgttgtagtagaggtttctggttatgaaagaacagaaccatctttatcctggtcaaattcctaccatgtcccctattctttcaagttcttttccctggctatagtaatcaacatgactgtttttaatttgcacaggtgagggaaactgtgcgcgatgtggcattcttacataatgagcaactctatgctgtcgcccagaaaaagtaatttccttaatatactcaatctttgcaatatttttccaatgctcataacataggtcaacatgttccatattctggtcttgagtcttgacaaagatgtagacaaactgagaggtcaatgaagcaaaaagtgcaagaatcaacctaggctgactatataaacaaactgagaggtcaatgaagcaaaaaatgcaagaatcaacctagtctgactatataaacaaactgagaggtcaatgaagcaaacagtgcaagaatcaaactaggctgattgctcagaggctcagagctttaaagtttaaacacacataagtacttctagcacattatggtttggtttgtggatcaattaggctatagaataatgcaagatttcctgtatgattcgttataaaaatttgctggagtggtataattctatgctacttccgtgaacaagaagcctaatttctggcagttttttgaactgctagtacatagattgaggatgagcaaattgagcaatgtgcggtaggctggggtagaattgccttctgagttctgattgccctactggagtataagtcattgatctgtccctggaaatgatgatcattcctgtacatggcagggaacctttgtttttttttttggccagcccagaggtggagccacaccaaaatttggtttttaaaatattttctatattttactttttttttcactagcgtgtaatacatagcttatctccacagttttccacgtctatttttgatgaaatttgtgggcataactccaaatattgtcaaacattttatgttacctttccatgtaatttttagacttcctcatgtgatattcttttaacaggtacccctacatatataatcgacatggcacagaaattcactgcttaaaggtaattatgatgtaaacacattggctttctgaatgaatgtgcctagctattgatgattttgagaaattgttagttttgttgttgtttcacatgttttcagttaacatgcaggaaagttaaaactttatagctatttaatttttactttatgtatgtctatgctttgatgtggtatactggtatctctcaaagttcagtaaagatttgaatgtatatcttatcttgtttaggattctgaatgttttgtgtccacaggaacatggtaaatcgttgaagctccaatttctggaaaagcactttctcttgtcatcaataaacagctttgggcagctccattaccaagatataagcactggtgagatggttgcaaattacaggacaggtctgggacgtactgatgttatgcggctaaatccttacaatgctgttattggccttgggcatgctggtggcaaagttaccatgtggaagccaaccagtgtgaaaccccttgtcacaatgctgtgccatagtggccctgtgacagccattgcatttgacaggggtggtcatcttatggcaacagcaggtgttgacaggaaggtcaagatttgggatctcaggaagtatgaggttataaattcttatgctgcacgtgcacaatccctggatttcagccagaaaggtttgttggcctgcagcaatggatctcaagtagagatattcagggataccgggggacaggattataaaatttatatgaaacatagaatggtaaagggataccagattgggaaggttttgttccgtccttacgaggatgttctggggattggtcactccatgggcctttctgccattcttgttcctggatctggtgagccaaactttgatacctttgttgacaaccccgttgagacttccaagcagagaagggagaaggaggtgcaatccctgcttaacaagctccagccagagacgataatgcttaatccgaacatgatagctaccgtaagaccttcaaggaagaaagagaagaagaccaagaaggagattgaggaggagatggaagacgccgtagaggctgccaagagcatcgagttcaagaagaagaccaagggtaggagcaaagccagcaagcgggccaagaagagggaggaagaagttttgaaagccaaaaggccgttcctggagcaacacaaggaaaacgatgggaggcctgacaagaaacagcgggtcagcgaggagattgagctgccaaaggccttgcagcggttcgcaaagagtaggcagtgacaatggagcacagaattttctttttctttttgtttgctgcaacctcatatttatcactagtgtgcattgtatcgtgtagctggcaaatgtcatatctgcttccttgtgaaccataggcttttgcacatgaggcaatggtgcacagaagtaagcacccaaattttgttctgaatcttttgtgatatgttggtcaaatgtgcatgtgaccccaacggtgtagccgtcggctgttggtgccttgttaatgtcagtgctgaagtatagagtagcactacatttacagcagtattacgtgctgagattcagttcctctggtgaccactctggggaatgctattgcttaatcatcattctggagcacggttgcataaatgcatagctactcgttcagttgtatttgcagcttgcgttttgtacaagggagcatgttggctgatggtgtttctctgtttatcactacagcaataggcatcactacctgatagttaccgaaacctttagatatttgaaagcaacacaacaaatctgtatcctgcaataaggagcaaatgcaagttatcaaactatatgaaattaccagtcagttttatttcatcaagggcgccagtggtctagtggtagaatagtaccctgccacggtacagaccctggttcgattccttgctggtgcattttttcagtattttttgcctttcatatgctgttgttaaataaattttacctttccctattgtttgcctttcatatgctgttgttaaataaattttacctttccctacactgatgttaaattgatgagattttgtttttgcgagaaaaaaaatacatgagcttacacttttcatatactgtcgttatataatttttacctttccctacactgatgttaaattgatgagatttgtttttgcgaggaaaaaaaaatacatgagcttacacgaacgtttctccgggtttactcagtatgaagcaaaatggcaaatgcaccagtggattgtgagcttgagaaagaagagaatccttcacggccatgggcgattagccgattacagtgtttacacatggagcgctacaactacaagttatccttgcagaaaccgatcctctctcgccctcaaaaaccggcgaggtggtccggcacggcgacgacggtgccggcctccacctcggcgtccgtgagcgtcagcgccctctgcagcttcctgctgctgaacacctccacctccgccgcgtacgtcgccaccaccggccggtggtccgacatcgtcagctccgccctcccgtagctcatcagcttcacccccttcccgaacgacagtatcctatcacacctgatcgatcatacacatcatccaaaattcataaacaaacaaacaaacagaaaatcgcactctcatcgcagcattacacacgcaaaatgtgcgaatttgagcaaaagaaaattgtaaaatgctgctatgtttttttatcattttaatcaaacttaaaaaaagggagaatagctactttagtccctaaagtttctctgtagaatcagtttagtccctaaccttttaaatggtccaaagaaatccttaaattttatcataaggcatagaatactccttgggtccaccaaaatcatcatatggatatgccatgtcatcattcatgcaaaatctatgacgaattgtccaatttacccttacgtatataatagaaaaataaatataagggtgaattagacatagccataggaaaaaaatactcttttttttcacccttttgaggtatatttttgctcttacatataccatgtatttttttttaactttttccttttgttttttattttcctatgcgtaagggtaaattggacaaatcatatagattttgcatgaatgatgacatggcatgtccatgtggcgattttggtgggaccaaggactatatcagtccacatgataaatttaaaggacttgtttggacaatataaaatattaaggactaaaatgatccaggagcgaaactttaaggaccatattagctattctcccttaaaaaaattaacttaagaaaatgttaaaacgacttataatatgaaatagagtgacgtgcattttgcagtgagcagctgcacgaacgtaccacgccggcgttctcctgccgccgcgctggtcgtcgccgatgtacttggccgagttgagctcgtacttgtacgtcggcgcgaactccagcaccccttccgtccacccgtcgaacgcccgacccttccttagctctcgcttcagctgatttattattcagacataataatcagagagattcagatcaaacagcaagattcagatgtgccacacagaaactttagggcccgatcgattgactatgagctaattataagctaaaatggtttattagcgacgaaaacaaaatttatagataaaacttttatacatgtagaattagtcacttaaaacccaatgctagaagaaactatttaaaatattttataatcaactttaaaattaagttttagaattgaactttttgttgtaacagacgattctatatagggcaaacgatgaggctctcatgctaattattcttgttcttcagatgtgtacctgatctttctctgccagctgagtccaatccatcgtcgaaatcagctcgtgtgctctctcgtacgcgacgtcgatgcgataattcagatcacccaaccaaaaaatcctcctgcagaaaatcacaattgacattcaaattcagatcagatatgatttggatgcactttgaatctttttttaaaaaaatgcggattagtagcttcttactcatggtcatagatgtttctcggcatgccgacgccggcgaagtgcgtccggcggtggatctcctgcacgtcggcgttccgcttgtggaggtcggcgggcttctcgccggcggcgaggtgggtgcacacgaagcagaacatggtctggtacaccgacatgctcaccgacacggcgcccttgttgccgatgtagcccatggcgccgacgccgacggtggacacccccacgttgtggacgcaccttctcagcccgcgcctcacccacaccgtcaggaagacgcccaccatctgcttgctcacgatcctcacgtacggcgaacgcctcttgcgcgccgcggcgaggtccatgacgaggtcggcgatcatggcgaggtcgtcgttcgactggtcggcggcggcggcggcgcgagacggcctgaatgagttgtaggttcggaaggatcttgacgatggcatggtggtactcgccgtcgccgtggcgtgcttggcgagcaggtccagcggctgctccggccatgccaggccgaccctgtccgacctgctcagtgtcttgagaagcgtccgctgctgatgctcgtcgccggagtcgtccatggcggcggcggcgtcggcggcggcagtgaaatggttcagcctggtcagcctcctcggggtggcggcgacgttctgctgctcggactccgccggcgagctgaagagcgagtcgtcatcggtgttggtgtccgtgtccgtatcggtgccagggaagagctcgtcgtcatcggtggcggcggcggcggccgtcgcgtccccgcgcgacggcgagggagggtggctgtagcacttgtaccggggccgactactcgccggcggccgcgcccgccgcagcgcgctgcggatgagctcctcccacgcctgcgccggccgggcgtcctccgcgccgaacacgttgccggcgttcagcggcaccacttcttggaacccgagcacgtagacgtcggcgggctcgccggcgccggcgccgagccagtcggcgatgtcgaggtcgccgggggggaccttgccggcggcgttccaggtgccgacgcagagcttgagctccttggtgttgatgtactgcgcgcgcagcgtctccgagtttcgccgccgcagcctgtacggcgcgccgccctccacattctcatctgggcatttttacaaatggttagggtgtgatgagcaactctgtacaactttttttttctccttatttttgtttgagacctcctttgaaattgagggatttttgaaggattaattttttaatcatggaataaaacattcgggtctttactcaatgagttacaaccaattattataaggttcacacaaaaataaactcgcacagtgagtatgtaaccaaagtaacaaaaccaaaatcagatacaaactaataaaaaccaaacaagataaagacctcacaacattttgaaggatttatattctattctgtaaaatccatgcgtttcaaaagagccttgagcttgaaaaaaacgccaattctgcaatggaagtttttctttaaaaaaaagagcaatggtggaatgtaacattttctcaaaaataattttttaattcagtttcctaatgttattttttggagtacaaaatgttgatttgtttggattccacattttcattggccagacaacacagagtttgtactagtagcttcttttcccttctagaaattgaaccttttttttactgccaagaagattttgggacaaaacccaactttggtactgtcagttgaatggatcccaaaatccaaaaagaaaaggtgccactttgagcaattgtaggtaagccattgttgtgattggagacaagatttgatggaagcttggtgcaaagcactaaacaacagcactatcactctgaagactctgaacagtccaaagctgcacttttctcctccccatcttttttaggataagagcaacacgcaaacatgggaatgtcatcaaaccgtcacatagacataagactcaccggcgagatcgccgtcggcccgccgccgctcctcgccgccgtcgcagccgcagttctctgcttgaaaccgaaccaatcagaaggaggaaaaaatgtgactcctgactggtaactaaattctcctcaagaacacttaaattcagatggataatttgatctgagaagaggttttttgtttttcagaaacagtatgtaccttgctcatcaacgtcgctcccgtcgtcgtcgtcttcctcgtcggcgttgaactccgaatccttgctcttgaggttgagccatttcttcagcacaaccttgggccaagaagcctacaaaaacacacaaccaattcaccaaattagccaaaattatccctgttaattaagctgccagatgaatcaccaagaacaacctgttctgaactgaaccaagcattcacctacctctcctggcttccgctgattcttctgcaccaccatcttactcctcgtgcctcaaacacaccaaaaattcagacaaaacggactagaaatccaaatctacactgcttctgtttctctctgaatcttctctccttccctctccaattctgaatcactgaatcttgatcagtctctgctcctgttctttctcgcacctttcttggatgcgttcttcaatggcctgagctagctaggtgcctgaaaatggaggggcctcttgcacgagcacccgtgagttgagcagtgatatgtttgttagatagataggcaggacaagagaacggagcacatggtggtttttaagctctgaaacaaacgcattgccatctgatggcgccaagcaaaccacaagaatagaatagaataatagaatataatattatcaatgggaaaaatgtgggcatccgacaaagcaggttgcctcccggctgcctcatttcgcctgttcactttgatgccattttcaaccttaccaaattttggtaaagttgtcaaaaagtggttacatttatttttctgtcaaattttggtatctatataagaaatcctataaaaattctggcggcaactataccaaaattttggcattagtaaggttttttttcatcaaagtgaacaggcccttcatccgagaaaattatcaaactgaccactttgttttcacgcgcacgttacagtaaacgatgtattatttaaaaaaaattctatcaaaagtaactttaaaaattgtagtaatttatttttcaaattatttttgctgatagttaattagttatgtgctaataaatcgctctattttttaaaattttccagccagctatgcctaacccaagccacgcgtgtgcattacttcttttgagttttgaccataccagtatttgatgcaactttcaccgcgcaattaccactgaatcactgatgcctacctaatcatttccataatactacagctgatgtttctggatatgaattagtaattgcttcaaagaacttgtctttttcttttttgattccgcgtgttctgcgctgtttggtcggcagtgttgacatttgttggtctgtggaactgattatcctgaattgctttatgataacatatcgattcgtagaattatattagttggagctaaatccaaagaactctgacatcaacagtagaaatggtattttgctattcagtgtggctctgacatttcgaacggtttgttataaagtttggcatcacaatcagttggttgcaagtccattagttagctccaataatgaaatgagtaacaacaattttgtcacaaatcgtggttaattaatcattctatgatctgtcagtgtgattttgagctcgccgtattacgtgcagaatccactgttaatggctcgatcagttaggtgacaacactgatggggattaataatgacaaagagatgacatattttagaacatcgtattgacacctattgtcctggggattttttgtttaatcttatgtttgctatgcgtgtttgacttgctctgctggacactggagacaagctagaactccagccatgttcttcgtaccagttgagttgattgctgccaacctcaatctatgatctatcatcatctatgcctcatcatggacagaatcaatcaggtcactaattgtgtctttttgttatgtttaaggtctaaatgaactcctaagtatatattagtttgttatttgtgtttttgttgcggttgctaactgcagcatctcatgatgcatagttcatactactagtaactctctaaagtttcttcagagaaaatgttgcgaatacgtcttcagatcagaaacttagaagtttaactgtctaaaagaattattgcaacgttctttatgctgaaattaacctataacttacttgtaaaaacagcttttggtatcatattctcttaattataatatccctgagaccatgagtgaaacatgcatgtaatgtagttggatggaaccctttttgaaatatttacaggcagcagaatctccaagaaatgatgggagggtagatatcactatcattctgcatgattttaacacgagcttaatctgtagtaattaccttttttttccctccgatcctctctctactttctatctccacgtcactttcttcttaattgcgttcacgaaaaaaactttcttcagttcttaattatttttgtctcgctcaaagtactcaataattacactcaactagtgattctcatcttggcttacatgcatgatcaaaattgccactgtttgagaaaagcaagtaatcaaacgctaaacaattattgtcccaaaatatataagacatgatctattcagatttataatagtactaaaatatgtcttattattaggaattatttagattcatagtactacgtgtgtcacattcggtaccaattataagtttttatattttgtgatgtacatgatattccatttttatactcagtgcagtagctgcttctagctcagtgccacctggcagcctactcctttcgtcccaaaaaaagataaaccttggatttccgtgtccaacgtttaattatttgtcttatatgaaatttttttttataattagtattttcattgttgttagatgataaaacatgattaatactttatgcgtgacttgtctttttaatttttttttatatatttttaaataagatgaacggtcaaatattggacatggaaacccatagtttgtcttttttttttacggagggagtagatgtcactgccacgcaacagttgactcggcaacgcacatccgcgcgcgctggactcactgatccctgggagacacgtcacctgacggctcgtttctcaaaggcgtagtaggcaatgcaagcaaccaatatagatcctctgtagtactggagcccatatgtcagtgagcagcggaccctcacttcaggcaaccacgttgctaccgttagaacacgacactggacgagccaaaatgtaacggctcgtcaattcaatcgcttttgcgtaaacacggtgcaaagttcagcgcacgtgcatgattgtttttgtttttgagggtaaatagctaggcatgtgattctatatatagtgattaaataattaaggatctgattcacatgctaatttcgaatttttaaaattcgatcggtttctaagaatggtactccctcgttccataatataagagattttgagtttttacttgcactgtttgaccactcattttattcaaaaaattttagaattattatttattttttttgacttactttattatccaaagtactttaagcacaacttttcgtttttttatatttgcacaaattttttgaataagacgagtggttaaatagagcaagcaaaaactcaaaatcccttatattatgggacgaagggagtagtattattagatattccttttctgtttccttttattagtcatgaaaaagagttagtaataaaaagtgaggacaaaaattcttttaaaaccaaattgtaaccttttaaatgagtttcggcctttgagctgaagtatagagccaaacacctctaagatcaagattgtagtcacatataaatatacttttttcactcaaaccctaaaccatatcctgagtagtagaaacacatttttctggacgtgacgagtactatatgaaatatgagcaaaatttatacagaaaaatatatctttgcaggaattctcacgtacattctatgtactcgaaacagtgtctccagaactatccataattttggagacacataactctcgtattcgatccataaataaaaccgtgtcttcaaaaccatcgtcacattgcacaccgtcaccttcctacgtgagagtttcatacgtacgtgtaacgaaatgttggttaatttccctactgccctttttgtgaacatgcaatatttccatgaattctccttacacattgttcacacccacctgtggctcgatcgtgtggtctctctccccttggtcattttcttatcttttttgtctttatgattttggtttttttcagaaacacgtaatgctatagctacagtagcagtgaagcaaaaccttctcagctaattccaaggagtctccatcacgcatcaggttcgtcaggcttggagtcgttttgcattgcagcacaatttctctgatagttacggcctcgatgtgacaataaacaggacgaaaaagacagtggggattgttgattccaaattcttgcaagattagatcagctcaaatggcagattattaatccgtgcatcacaaaactaattaattagactggagccatacacgtgtacttcaaccatattctactaatcatatttgttcctactattagaccgtgtcagcatggtttagataaacaaagggtcggtgaagcttactagtgacaaaatagtcatcaacaccctgacatttagttaaaatattgtcgttagaacaactcaacaacatatggatattgcaggcaatgccagttcacatgatctatctctcggtctctccgatatttgaaacatgaatatttattttctcgaacgcacaaaaaatttgcacgtcaatatattagcaggaaatgagtttttgttatacaaagcaatcagccagactggcttatgcctaaaaggggggacttgaagctaggaactactacgacggttaaaaacgcaactccaaacagcgggagggggcagagccacgctacactaccaagaaatcccccaaaaaaagcaacgccgactaaagaccacagctggccctccgaacggatggactccagaaccactgcgaccgaagcgagcgcagagtcgaaaaccctgaagtttcgttcctttctatatatatatatatatatatatatatatatatatatatatatatatatatatatatatatatatatatatatatatatataatcttcaagatgttgctaactactccctcctttctcaaaactttggtcactacataatgttcatatttaaattttaagcacttgtctttttctttagaactataaatactttggtgttcataaacgtctcaggggttgttcaaattaatgtcatttcaaatcataccattttttaaagttgtcgaaaattacctccatttagttttttttaccaaactctagtaaatagtaaatacataagaaatcctgtcaaaacttagcaatattgttaaattatcaaaatttggtaagatttattttggctacaatctgaacatacccttacatcctaaacttaagcactaacttttcgttcattacagtctaaccaataaaaaaacatcaaaattaattaaaacgatgccgacaactatttggaatggagttcgtagcagctagctagaacgttcgcgcgggtgcgatttaccgatcgatcgatgcccaaaacacacgttgctttccatgtatcgatcagcgaaatttacgcgcatcgaacgtcacattcggcgttgcaggtttgcatatttgcaagagagccgcgtgcatcacgcacgcatatatgcatgtgtatacgtgacacggtaacacagattattggcgaatccaaaaattgtggcgcgcgtgggaaatggcctgaccatacatgatatagggcgtgtccactttactaccattttcaatcttaccaagttttagcattgctaaattttagtaaagttgacaaaatgttaacgaggttgtcaaattttggcaagatttcatatgtgcttactaaaatttagcaacaaactaaacgtagccaaaattttgacaactttaccaaagaataatatggttgaaaatagcatcatagtgaacat

SEQ ID NO: 82274 - DNA, 41544 bp, Oryza sativa
tatatatatatatatatatatatatatatatatatatataaccttcaagatgttgctaactactccctcctttctcaaaactttgggcactacataatgtgcatatttaaattttaagcacttggctttttctttagaactataaatactttgggggtcataaacgtctcaggggttggtcaaattaatgtcatttcaaatcataccattttttaaagttgtcgaaaattacctccatttagttttttttaccaaactctagtaaatagtaaatacataagaaatcctgtcaaaacttagcaatattgttaaattatcaaaatttggtaagatttattttggctacaatctgaacatacccttacatcctaaacttaagcactaacttttcgttcattacagtctaaccaataaaaaaacatcaaaattaattaaaacgatgccgacaactatttggaatggagttcgtagcagctagctagaacgttcgcgcgggtgcgatttaccgatcgatcgatgcccaaaacacacgttgctttccatgtatcgatcagcgaaatttacgcgcatcgaacgtcacattcggcgttgcaggtttgcatatttgcaagagagccgcgtgcatcacgcacgcatatatgcatgtgtatacgtgacacggtaacacagattattggcgaatccaaaaattgtggcgcgcgtgggaaatggcctgaccatacatgatatagggcgtgtccactttactaccattttcaatcttaccaagttttagcattgctaaattttagtaaagttgacaaaatgttaacgaggttgtcaaattttggcaagatttcatatgtgcttactaaaatttagcaacaaactaaacgtagccaaaattttgacaactttaccaaagaataatatggttgaaaatagcatcatagtgaacatgcccatatactcacttggttttttaataggtgacacatttgacttttaaacatatatttgatcttctgttttattctaaaactttgtgcaaatacgtaagatataaataatgcttaaagtattttaagtgataaaacaactaacaataaagtacatgataattttaaaaaagtgaataagacgaatggtcaaacatgtatcagaaatcaatagtgttatctattactcccttcgtcctaaaatataagtatttttggacttagatacaattttttagattctactttgaccaacaataagtataaaaataagatgtcttaaataaaaagagttattatgatattttgtttaataataaatctagtaacatcaattttacatgattgatctttttaattatttttgctattaattatcaaagttaaaaaggttgacttgacagtatgttataaattttatgttttgggatggaggcagtagaaaaaaaaaggtagtatatgtacttacatgcagtatgcacattattggtaatttggtattacaagataaccgtgacaacaaataactgtaggttttgacattgggttatatatcctacattgatcaataatattttcaaaatattctaatagtttagcataaaagatgtatcattagattttatatcaaaattactatactaatatcttatatttaaatttatctgctttcctatcggttaaaaattaatagttaaagttctccggtcaaccaataaacatgcatgtatgaacgtgcagggagtaaatgtatttcacctagcttttagagcaggtttaatagtatcgccggctacaagctataaatgtgtaccatgtcatcttatagttagagagtacaataataaactgttgatacgttaaacaagtaatatctttattaattttttaatcacctcaatctctttcttctttacccttccctctctcactccgctgcaacactgacaaaaagcaatgcacagacgtctaggagctcgtgtgcgctggcgactaatttaccgtccgctcgcaccctctttcctcccttctctcgcccatatcatcatcaaatctgacgtgtagctcatatcactggctcaatctaccttattaaacctgctcttatgtggggaatatttcggatatacatcacttgtacttagttgcgaaaagcctaattcccgaacacgcgtgggcacctcacgaatgcgcccagacaatggattggtgatagtggcaggggcaaagtgagacgaaagagagggggaggagatcaactgccggggccacagtgcatgcttggtgcctttcgatgctcgcgaggctggcggttgcagtggaggaggtgagaacaccaaaggggagagaagggagttcgccagagaaaggccatctttgacacatcccgctcctatcgctgaacttgtacgctcgttcacggtcaagtttggagaatactaagatggagagagagagagagagagctggagattagggtaatgggatgctgggctgtcagtatgcgtttgtaacccataaatgctcgcctattagccccacccacttagttgtatggagttttgttcaaactctaaaaaacttcagtcttctacgataattaattactccggtgcacgtaggtcaattaggcgtacagtcaccggtgtgtatgctcttttgggaaaaaaaaacattttcctaacttgtggctaattgcacgtgcagtttatcatcaagttttacttaagtccatacggcttgctagcatgtcatttggcgttaattatacctaccacacatgcagcatgccacattgcctctgtcagaagaaaatgtagtagtagcttcgagacaacaaagacgacagttttttctccacaacaatctcgaggtcaaatcttgattaattatgctaattaacgcgatccggatatacaatctgcagatatattacttaattacactaatgatgaaacgctaattgcctttttttttctccaccaagttgatgaaatgatcgatcacctgtcttaccattaccttaccgaaagtccctttatgagatagagacgctaattaaatatagttttccatgagaaaaatgctgtcactgatcaattatgcttagagaaacagtaaccataataataaataaattcattccctgctgtagcaaggaggcacgtgacgcaagcatcaacgtcagaccgctggcccattatccgatctaagcccacggccccaggctcgaaatatccggcccatatacttacatgggccgggatctgaaacaaacatcaggcctaactacgtaatgggcccagatttaggcctcctaacgaggccttgatgggctaagcgccatcatgggcctccgctttttttcgaagcccacggcgaattcccttcccagcgccgccgtagccgcctctgcgtcggggtttgcgcgggaaaaaccgaggaatttcccgccggttcgcgccggccgcggttcatcattctttggcctctccgaaacctagatcccaaatcgacccaagccatggccgccgccgccgtcgccgacgaggtcaccgaggcgatggagcaagtcgaaggggagcgtgaggaggccgacgcggtcgctgatgaggccgccgaggtgatggagcaagccgaaggggagcgggaggaagccatcgatgcggtcgccggcgaggccggcgaggtgatgaaggaagtcgtcgaaggggagcgggaggaggcgaatgccatggccgatgaggccgatgaggcgatggagccggaaggggagcgggaggaggaggcagacgccgtcgccgacgaggccaccgagccgatggagcaagtcgaaggggagggggaggatggcgacgccgccgcgcaacggccggcgctgccgctggggagggtgaagcggatcatccgggtggaccgtgacatcaagaaggtgaccaacgaggcggcgctgctcatcgccgcggccacggagctcttcgtcggctccctcgccgcgggcgcccacagggccgcctcccggcgcggccggcgcgcggtgcgtgccgtgcacgtgcgggccgccgcgcgcgagcaccgccccaccgccgacttcctcctcgactgcctccccgccgccgaggaggcggcgcctgctcgcgcggctgccgccggtcccagccgcggcggcggaagaggagaggcaaagccgttgccacgtgggacccgccgcatcgacgcgttcttccagaagaccacctagtggtgttccctctctgtatgtgtctaatgcatccgctgctctaaatgtttggagaaaaatttcactcgcagatgaaactatgaatttttatcatttcgttagtcaagctcgtttccaatgtcttgcaatgatttggtatgacctgctcaaatcttgattccggttgccgtgaattttgcgatgcagtttcggtaggaattggtctttgtaagatgatctagctaatatatttctaggtcctggttcaaacacatgattctcaaaagaatatataatgctaatactaagattgcgacttaccttagtttcagtgatcctctgtgattcacctctctgatagattacacttattctgcaaacagtttattgttttggtcttcatgcagtgattcggtaattatatgctgacgctgtgacgcatactgtgataagaaacacaaaacaaggttgtccttagctactttgtcgctggttaggatgccgagccgtgttggtttcatctgaggaagtagcttgattccctcttgccatggaacatgttagcatcacaaaatttgcatgagtggaaccccacacttttgaaagaatcccacactttttgggtgtttacctgggaaacaagtaaggccttagtttttacaccagttttagaaacattctgctctctttcttgttcttatttgttctcaaaaaatcatgttcattttacctgtctaaacaggataaggatcagaatcagcatattaggatggttatttatgtgtaaccactaattccatatgaattgatgaataataaaattgttcttttattgcataaattcagaaatgtcaacacactgcttgcctgatgagtgacaataatctcatatcaacagataatacaaattcgttagagattttctgctggacagaactactcctggtaaaagactaataatatgattttcagatttttggcatctataacatatgaatgttgtgagtccctaaactttagggcactgacttctgatgccacaaggcatcaatgcacataggcagcttctttatatctgcacaacgaagctatgcaggaaatccaaaggtgaagcttaggctcatttgctgcatgcacctcttccctcagcagctcataacgctgcacaaccatgggccccctttggaccttcattctgctatatcctgagatcttcctagctatcatctgcttcttctggttttcactcttccgtcccatcaggcagcgccagaagagcaacctcccagtgaactggcctgtttttggtatgcttccattcctcgtgcagaatctgcactatatccatgacaaagtcgcagatgtgctccgcgaggcggggtgcaccttcatggtcagtggcccgtggttcctcaacatgaacttcttgattacctgtgacccagccacggtcaaccattgcttcaatgccaacttcaaaaactacccgaaaggcagtgagtttgctgaaatgtttgacattctaggtgatggactccttgtagcagactctgaatcatgggagtatcagcgacgcatggcaatgtacatatttgctgcccgtacctttcggtcctttgcgatgtccaccatcacgaggaagactggcagtgtcttgttaccctaccttgatcacatggctaagtttggctcagaggttgagctggagggtgtcttcatgaggttctcactagatgtgacatactctactgtgtttgcagctgaccttgactgcttgtcagtgtcttccccaatccctgtgtttggccaagctacgaaggaagctgaggaggcagtgctgttcaggcacgttataccaccaagcgtgtggaagctcttgaggctgctcaatgtcgggaccgagaagaagctgaccaatgcaaaggtggtgatcgatcaattcatctatgaggagattgccaaacggaaggcgcaggcaagcgatgggctccagggagacatcctgtccatgtacatgaaatggtccattcatgaaagtgcgcacaagcagaaggatgagcggttcctccgtgacacggcagtgggtttcatctttgctgggaaagatctcattgctgtcacactgacttggttcttctacatgatgtgcaagcacccacatgtcgaggcgcggatcctccaagagctcaagggccttcaaagctccacctggcccggggacctccatgtcttcgagtgggacacgctccggtctgccatctacctccaagccgcactccttgagacactaaggtgacacatctttgatctccccattctcccccaatctcactaacaattaatctccctctcttcatcttctgacattctgaccaactattacattgcttgaattgtgttccaggctcttccccgcaaccccgttcgaggagaaggaggcgctcgttgacgatgttctccctaacggtaccaaggtgagccggaacacgaggatcatcttctcgctgtacgccatggggaggatagaagggatctggggcaaggactgcatggagtttaagccggagcggtgggtgtcgaagagcgggcgccttcgccacgagccaagctacaagttcctgtccttcaacaccgggcccaggagctgcctcgggaaggaactcagcctcagcaacatgaagatcatcgttgcctccatcatccacaacttcaaggttgagctggtcgagggccatgaggtgatgccgcagagctctgtcatacttcacacgcagaacggcatgatggtcaggctcaagagaagggatgcagcttgataaccatgctgtcagcttagctatcctgctttcttgtgttatgtatatctgcatgagactagatgtctatatgcagagttgatgagatggaattattattagaaagtgtaaaatgtctggttggattagtgtcagaattgtaaccatgtgaaaggaacaaaaatgttgtggtgattggtatatgattgtgtgatggtctttgggttgatttattcaagtatttgtgaagaacagtgtacttaacatatcagttaagacttgagagtaagtatcgggtgattattattatctggtgaccacgtctgtatgtgatgggctttacaaacctgcatacgagaataggataattcttgtttcgttttcatgaccagttcacaagtaaaccattagactgcagaggctccatcatttcttcacttttaaaagaaacatttggctgggcccacttatatttttcgtgtaaactcagaatcgtcaagcgaattgtattggttcagctcatcgaaaagtttgatggtctcattgtcgccgagtagttggtgaaagatgccttcagcttgtggtgaaatgtgacctctggatgttttttggtgtttttgcaaatatttatccaaactataattttatttttgaaatggtctagaacaaaggaacaaaaaaaaaaacagaagtagcacatcgctgttcagtttcaaaaattgtactacaaagtaagttcaccaaaagacttcaatagcacgtttaccagagactgcaaaactggtctgctttcttaatggaaatgacgacttcagacataggtaaaccttagtgacatatatataagtgaagtaaataatatttctttgaggccattaggcaaactttcttaatcacaagaaaactcttttggtataccagcaaggcctaatgaatcatatatagagtacaggagtaccttatctgtgggcagttttaacttgttgcactagaagagaacttttggttggagaaaccagaagtttgcctaatggtggcaaaatgatcagcacaaatggtagcactactgacaatagtggattgtatgatcctcttttccaaccctgtctgaccagaaactaatggccagctaatcttgatgtgatcagtattcagtggtaacccttttatgtctactagaacgaacttgctatacattacatcaatttggttcaagcaaagaaaataaatcacatacttcctccagacacaaaaagagtgccatatttaaattcatgcagttaacataagttaactttaatcataatgattattcagaaatatgaaaatgacacgtgcaagtttattataacaaaatatctcataatatcacacttatatcgtaacacttttctatgtatttatagaaaggagaattaaatggtcaaagtcataatttgtgactagagggagtaacattcgggaaactattctaatccctcgagggaatgttccctcgtttgctcaaaaaccatctaaacggttatgaaaaattctggaaaaatttgaaaacattcatacaacacatatatacaactccacaaaatcttaagtccaaactcaactcacacgtcgagatataaaaaagacaaattcagcgtatgaatagtagcgtactgtttatatctaaatttgtcttttttgtttctcgatgtgtagatcgaatttaaacatgaattttggtggactagtaggtatcattatactctacattatcaattttttttagaatttttcacaactattttcatcgaatttggaagaaaaaggtatacgaggggatatcccctcgagggattagaatccacactcgtaacattctgtttttttatttttccaaagtaattgcaatacctacatgttcataggtggttgcatttaggtcaatgttgatggtgaatccaatataatacttcctccattttttttatatttaacatcgttgatttttttacttacgtttggccattgttctcattcaaaattttatacaaatatgtaaaatcataaatcatgcttaaagtactcgtaataacaaaacaaatatcaacaaataaatgatgattagataagttcatcgaataagataaatagtcaaacttagatccaaaagttaacggtgttaaacattttaagaaaagggaggaagtttttttttttttgaaaagggtagggactagggaggaagtaattgatgtggaagaaaagataactcatttgttttcttgattgaaatgaggtggcattgcctacttgccgtgcaccatatgactcctccctcctcatcactccctttcacctaatgacctaaacccaaaccctccacaatttttatcatctatataaccacacgaaactccatccatggcggcgagcgagctcacaagtccacagagacacacctcaccagcttgatcaagagctagccaagccaaatggagctcctgccatggcttctcggcttcgtggtcaagtacccggagatcatggcgtccgccgcttgcttcttgctgctcttctgcaggtttaggaggaggagcaagcggattccgacgaactggccggtggtcggcgcgctcccggcgatcgtggcgaacgccgggcgcgtccacgactgggtgacggagttccttcgcgcggcggcgatgtcgcacgtcgtcgagggaccgtggggctcgccgggggacgtgctcatcaccgccgacccggcgaacgtggcgcacatgttcacggcgaacttcggcaactaccccaagggggaggagttcgccgccatgttcgacgtgctcggcggcggcatcttcaacgccgacggcgagtcgtggtcgttccagcggcggaaggcgcacgcgctgctgtcggacgcgcggttccgcgccgccgtggcggcgagcacgtcgcggaagctcggcggcgggctcgtgccgctgctcgacggggtcgccgcgtcgggcgccgccgtggacctgcaggacgtgttcatgcgcctcacgttcgacctcacggcgatgttcgtgttcggcgtcgaccccggctgcctcgccgccgacttccccaccgtccccttcgccgcggccatggacgacgccgaggaggtgctcttctaccgccacgttgcgcccgtgccatggctaaggctccagagctacctcaagatcgggcactacaagaagatggccaaggctcgggaggtgctcgacgcgtccatcgccgagctcatcgctctccggcgagagcgcaaggcggccgacgccaacgccaccggcgacgccgacctgctcacggcgtacctggcatgccaggacgagatcggcatggacggcgccgcgtttgacgcgttcctgcgcgacacgacgctgaacctcatggtcgccggccgcgacacgacgagctcggccctgacatggttcttctggctgctctccaaccaccccggcgtcgaggccaggatcctcgccgagctccgcgcgcacccgccgtcacccaccggcgccgagctgaagcggctggtctacctgcacgcggcgctgtcggagtcgctccggctgtacccgccggtgccgttcgagcacaaggcggcggcgaggccggacacgctgccgagcggcgccgccgtggggccgacgcggcgggtgatcgtgtcgctctactccatggggaggatggaggcggtgtgggggaagggctgcgaggagttcaggccggagcggtggctgacgccggcggggaggttccggcacgagcgctcgtgcaagttcgccgcgttcaacgtcggcccgcgcacgtgcctcggccgcgacctcgcgttcgcgcagatgaaggccgtcgtcgccgccgtcgtgccgcggttccgtgtcgccgccgccgcggcgccgccgcggcccaagctgtccatcatcctccacatgagggatggactgaaggtgaaggtgcacaggagacaagaggattgaaccaacttcctttggacactttggaacgaaccatacagttcgaggtttcgtattgatatagcagaaaaacattgtttggtttcatattgatatagcagaaaaaatattgtttagatatgggtgctctgcaatctacaagagctattagggcatacatgcactgatgatactgtgctccattgattaattaattcgtgtatgctaattaatacaggtggtgatcgatggtacattacgttatatataggggaataagagacattagtcacagtgattataaatttacatggttagttgagcgagtggtctgtgatctgatgtgatgtacataaattctattttaaatttaaaggaattttacacatgaaatttctgtgaaattcatgcgttcaaagaggccctaaagctggtgcagtgatggatgcatgtgtagtatgcaaaaccatttttcctccttacgtaaatctatgactactgtctatatgctagataaataaacaactggtaaagatagaatatgtgctcatgtgcacgaagacatgcctatgtaacttacaagaagaagaaaaaaaagaaacaagaacacatacatatgtgcaatgtgtcactcccccgtttcgtgcatcatgtatgatctgttgcaattgtggtgtgtgaatattaactttgatgtgaagatgcatttcattcccccaagaacatatgcatttcatgagaggttgatttagtcagtaaatgaaggtttagtactggtcaatctgttttgtctcaattcaagatcaggaagggtgtagagcagagtacaagtggattatactcaacaaaaaagaaaaaaaaggtccacgtgattcaagtcagtataattttacagtggattttatcatcatgtcacaagattcagatcatgcatttggatgggagaaagaataaactctagacattaattttacatgccatttgatatctgaatatctggtcgtgacacgcaaaattggggcaggatgctgcaggggtgtataattgttccatagaaattttgacagcttgtgtaaaaatgaagccgggcgagctcagagttagtgacagcagtaacaataataataatgaacattaatacagtataaccaaaaggtagcagcagacgaagctactaccgtgtttcgatcaagtacaacgttgtggtatatgatgggttaaaattggctgcaatcactaaaatcacatgtccatcctgaatgtctcaagtctctcaatcgaggatcctccagccctgttttcgcaagcttcagatgtcatttgtatacacagattatcagcattgtggtgagggtgatgattgtcgcggttgtgaagatagccgcctacacatgtggaatggattgaagacattagagaagaatcactgtaactaaaatgctcgggtaatataccagaacaaaatgcaaaagacttatgaattgcgtagattagctgccatgccatttaataatatctcttgcatcatacaaacaatactgttcatatatagtatataccagaacaaaatgcaaaagacttatggcatatatagtcatatgggcccttaagaaaaaaatagggtacatctgaccatacctcattttctttttctatataccaaacaggcaagccccagaatgattacataattaattacagttcaacgcatcacaaaactattagtaatacatactcttaacatgggactccagatcaacacaattacatcaaccaccaaggagtttgatgtcctatacagaagaatcatggacttctttcaggaaaccgttttgatccctggattcttgctataagtaattgtagtgaactagtattataataatatgttcagggttatcgtgaaaggaatactaaccgcaaccgccgatgcagcaagaccagggcgctctcggggatctttgttgtagtacttacagcagtaaagagttgctgcatagtaccagatcaacggacacaagaaacctaaaaggaaactgcaacaagaagatatctgatactgccacatgaagaattttagtttggaaatttgaaccaaagttgatttgggcagcagagaatactcacgaggaccatcctataccacaaccaaagcaaggaagtcgtctttcaaacattgccagccgtgggttttcttcatctctgagcaatgtatacttgccaagacagccctgacaatggcaaaattgatccgagcctgctgcaagatggaaaaataggattaagctaacagaagaaatattctcaacaaaacaaagataacgccactgcatttatgatttatgttaaagctctaaatgtttgagtcaaagtataacttggaagttggaactacagtagtttatgtcatcaatgtttatatactgcaagtaagccagtatcatgacataatctcctactaaaaaaacatgtttctcaaaatgtcagattcaaggattttgtgtatagtacaaaagtgaaatgcttcccacatgtcttaagagatctagcaaggaaaagctaagcttaacttcagaaaagaatgagagagagagagagagagagagagagagagagagagagttggaaacagttaccttcccccatttaatttagagcagttcagcaaagaagcacccagtaatcttaatgcaatatctccgttgcagattcctctgtgccgtagcaagaatcagtcataacaacatgaagataaggacatcaatgatgcaggttgtctagaatggtcatgttgctgtactggagagaaaacaatatgtatcagaattctgctcaagcacacataagtagttgataaaatactttgtgcaattgcaatttgaaaaaagaaataccaaaaaaagaggaaatagcaactactgacaacaagtgccatgtctaaatttctgaacatgcacacaacacacaaatgatgaatatggtgaaaccgcaattagcattagaaagttttaactctagaaatcaatttccaagttgtaatccccatactcccaacccagaagggaaaaaaaacaactccaaaacccccaacttttaaaaatgtgggaacaatcaaaccatatgcttgagatatacccacaaagccatcggcggccgcttacagcagagtacaccctcatcttgcacgcctccgaagaagcaggagccgtgatcaacacgagcatcttgtcctgctccaccccacacagtgacgagtctagggcacgacgaaggcgcgctcctaaaccgtgggctcggggctccggccagaccggaggttcagaatgtgctgtcctaagatacgtagaagcaaatacaatccagaggcatcaaatcctgatatagctctctacctcctcagataactccggtcagtaatttcgtcgaacacttcgcgttcatcgtccgtactccctcatcgcattggcagcaaaaccaacaagaactgaccgtcctcacacagtcccaccaaaaaatcaacaacccagattcgagtattccacccacccagatcatccttccaatcgaagttgcaggaaatcaagaacggacaacacaaccatccaccaaccaagatccaagaaaccgcaagagcaagctagaaaaattcctgcagaagaatgaactcaccggagcaagacgaagcatgcgccgccgccgatcggaacagaggtggaagcaagatttgtgcgttcttggatgggcaacagagagcagcagagccctagcggtgggattccccttggttgagtggaagaaactggagaaagcgcgaggccgttttgtcctcttgctttccccttcttccccctctcaatcgatcgagagcaacagacaaatcactcccaattttttttaaaagaattgaaaaaaaattcaagagcgcacgacagttcacgtctcgcctcctcgatttctttctttacttcgtcgctcgcttcccttccaaggggagatttctctggttcccctctctggtttgttgacgtgtgatagactagtactgtgccgtttggacttgcttgtattgatcttgtccgtccatggcgttcagcatcgaccatctacgtctgagattccacgccacgcacgtgtccgcgctcccaacctaaagaccgcagagccaaataaaagatacggattcttcgtcagaaattgcacaggcatcaattagggcgggagctgaggcacggggcgagcgacgtgttgagagaggcgtgaccccgtgcaaggcggtggcggtcaccggcgaggccaccaccacgagatatgtcgctgcccccaaagcggatctggcgagctcgataaggcgacggctatggcagcggatgaggaagaggaggtggcgcctaacctcgtttttgtcaccattcagctgccgccgagctcgtcgtcgtccccgctcaaaaccacgcaacagcttgacggagagggagaggagcttatcggtgtccagccaaaggaggaagaccgccggttggaggaggaggaggggggaggggtcgccgccgatctcgccgtctcccgcggtccaagccgtcaagcttgtcggtgcaccggccaggagagtagggccgtcggtcgggggagaaaacaaggggagcgccgcccggaaggagaggggatctgccgccggtagggagactgacggagatgggtagatggcgagagagagagaacgggtgaaggggattttttttattatttttttgattctaggggttcaacacaaattctagaaatatgagaactgaacaaaaataatttcacggctaaaatataaaatcaaagtcattcctatagccactgcactgtgagaaatataaattttggatccgtgactctagcctacaaagcacttcgaggcggacgggtctaatccttgaacgttcgcatctcgcgaacaatttaataggttttgtaattattcgttctaatgactgtttatgttcgcatacagtattttattgtttcggttaagcgaccaaccaatcacttttccctattatcagattagattttatttcttgaaaaaaatccggtgatgcttagatttttttatttgtacatgcaaatataattcataatataaagtttataaataaaaaagtctaaaatataaagtgtatatacataaagtaagattatatacataaagtctatatatagaaagtttatacacataaaatctatatataaaaagtttatatatataaagcatacttgtagagaggtccatgaaaatactacatataaaaagtttccattagaatagctttaaaaatgactataaagaaaaaaagtaatttgaagaaaaaaagaatggaaaaacagaaaattgatacatacctctacaggagaattaacgtaaaaataaggacaacgggaattgaaaagaatcacataaaaaggaaaaactggaaattaggaacaaaaacggtatcgtagcgatacaccgcaccggcctgcggaaaatctaatgggtgaccgcgatcgggtagcgatcactacccctccaccctctctccctccacgtttcctttttttttttttttgcaccgtattacttttctattttagtaaatttatgcatctaaagtgtatacacctaaagtttatatagacccaaagtttataaatcaaaattttatatatccgattcaaatttaaatttgaattcaaatatttttatatatagtatttctatacatctaaagtttatacacctaaagtttatagacccaaagtttataaatcaaaagtttatatacccgattcaaatttgaatttgaaatatattcgattcaaatttgaatttaaattcaaatatttttttatatatagtatttagatacatctaaagtttatacacctaaagtttatagacccaaagtttataagtcaaaattttacatacccaattcaaatttgaatttgaatttgtatccgattcaaatttgaatttgaattatatccgattcaaatttgaatttgaattcaaatatttttatatatagtatttctatacatctaaagtttatacacctaaagtttatagacccaaagtttataagtcaaaagtatacatacccgattcaaatttgaatttgaattcaaatattagtttatagacccaaagtttataagtcaaaaatttacgtaaccgtttcaattataaatttaaatttaaatatttatggtgtagtaggaagagaaaaagggaaggaggaagcgacggtatagggaaggggcgggtgatcgctcgcgtcccccaccggtctgtcgctcattaccacgtgtctttgatcctccccagcctgatccgcttcttgtcttccgagtctcgcgcatgtttgcgtagtagacttcccgcttcgaggcttctcataagggtaatgtgtgctttttcatgaagaaatatgtctaattctcaatttctgatgaataaaaattccaaatgtaattgattaacttgccttagtacaaccaagatctgatcatgcctagccattccaaaatccaaggccgagtttagttccaaattttttctttaaacttccaactatttcatcacattaaaacttttctacacacacaaacttccaactttttcgttacatcgttccaatttcaaccaaactttcaattttggcgtgaactaaacacaccccaaattgctcaatcagtagtacgtcctagtgtatgtttagttcatgtcaaaattggaagtttgattgaaatcggaacgatgtgatggaaaagttgaaagtttgtgtgtgtaggaaagttttgatgtgatagaaaagttggaagtttgaagaaaaagttaggaactaaaccaggcccttgtacaaaagaacaagtgcgaagcatcttcccgactgctacttcccattcgggtgtgtgataaatctttgaatggctaattcctcgttcttcatgagcacgcttcataaactgttaaaggatatgttttgtgcaaaagttttatgtatataatgtttataaaaaataaataaatccattttcaaatttatataataattaatgtttgattaatcatgtgctaatgacttatctgtttcacttgctgaaaaaaacgctaccaaaccgctgatccaaacatgtcaaatacttatttgagaagctagagatgagaatataaaagctaaaattagcttctagccttctacttacttagggggtgttggccctctcccccaaacacccccttattcattttctaaattttgttactataggtggtgtttgggggggcactttatttttattctctctcactaaaattccataggaacttatattttatatcttagtgagagggtttagtccctcccacccaaacaccaccttaaaatccaattgaatctaattgtttcaggaagcttacaaattccgtgagaaaatgcaactgacaaaaactcgtcaaaacagggcgttccaccagggattggattgagcataacctgtattgatgcaaagaagccatcaaagaataacggcctcaaaataatcaattatatatccctgccacgatagactgagccaaaataaaaatgacaccggttcagatttggatgacattatatgggaacatggtgcaagtgctgggaagaacatgttgttatcttattgccatctaagttacccattgagattattaaaacagtcagattatatcaaaataactctaggaagagaatttaagaggttgtcagcattctctattcaattcaagccgaagaacgtttgtcagctgaaagtaaaagagaagtccgagagaagctaagaaagaaaggagggtactcaccaaccatatacacgaggaaaaaaattactcacatctataatatgatgtactcttatttattaataatgtaataatattattaaaattgtatatatttcaacaaaaatttgtctttaacacagtacaaggtaaaactaaaaatttgtttttgaattattctgctattcaatctttttcttgttatctcattcttctctagtttcaataataacattactagctccagccaccaaattttgcagctgaacactgctacctagttaagtgcacacgttatgtaatatatattattgataatttttatgtgagttagtaataattactgttaatgtccgattttcagattcagagagaaattcggccgaccgcaatagttcgaaggaggaagggggtaattcgtactttttccttgaaattttaagaggctgtcaggcactgttgtttataggattacaatgtccttgacagcacaagcatattaagaaaactgaaactgccaatttaaaggtgccagtttagattttactacctagtataatcgttctggtgcagtcattagatcaacggagaaagatgatcatttgtccacatggcatcacatgaacatggcttgattctcttgtgaatagttgtcaccaaatgaagacatcagaaaacaatgtttaaaattcagacatccaatatcgtgctttaatcatcagaatggcaaacaacttcgacatttccacatcatttcaaggttggcatcacaattcaatagattgtttgatctaagcaagctgaagctcttctgcagaaatagataccaattcttattccaactaaaaagtaactagtcccaatttcatgcacaaaacaagacaatactaaaattcttctgctggtacaattcagcctttcacaaggcaaaaaaaaaaaaagaagaaaagaaaagaaaagaaagaaagaaacaaatcctaatgaaactgattgtctggttcttccattccatgtcatttctgccctcttgacacaatcttgtacttgcctgtcaattgttgctgcaacaataaacacaaacaaaaatctcaaatcgcttaattagtttctgcaaatttcaaccaaaccactcctgaaacgcagcagcaatgaaaatttcaaaaatgaaaaattgtgtaccttttcccagagcttggtgtgctccaagcagaagccggcgacgacgccgccgccgccgccgccggccttggcctcctggtactcgatgcagaggccggcgtcgaggccgcaggagacgtggaaccctaggccgcacctgggctgcgagcactcgagcgcgcagccgccgccgctctcgcagacgtagcacgccgtggcgaagcggtgcgcggggacgcgggagcagtcgacgccgtcgcggccgtcggggtcgcggaagaacacctccggcaccagcagcgcgcacgcgatgtgcgcccaccgcgcgtccgtcgtgcgcttcatcgcgccgcccctcgccgggcagaggcagcagcgtggcggcggcggcggcggcttgttgcccttgctcttcttggcggcggcggcggtgcagacggagcagaaccagtcgccgtcggggatgaacgaggcgagcgggttgccgtagcaggaggcgtgcaccatgaggtcgcacccgtcgcagaacacgatggggtccgacgggtcggcgtcggtgctcccgcacaccgcgcagtgcacgccgttgttctactgttccacctcctcctccgccgccgccgccatggcctcttgcgttggctctcgcgccactctctctccatcccaggagtcttcttcccgtgctgcttcgttgagatcaatcgctttgcaagctttctcgagtgcttcgacttcagattgcttcgcactaatagcactgcaggattgattgcattcctgatctttcgattctctgcaagtgtttgatctttgtttcttcgacacttgctccttgatttcttcatgattgataggcttctccggaatcttgggcttctcttgaatcttggatgcttcagctcttgcataatcatcttccacaccatttgccacgctcgaattggtggtggcgccacgtttattggatccttgaggcttggcttctttaacagcggcgacgcgagctccatccgactccttggatggaggcggcgatggcgggagaaacggcggcatcacgcgcttattgctcggtaggcaaaccgagaccggagcggcggtgtccttcggggacggcggcgcgcgggcgctcttcttggccgggatgctcggagaaacggcggcgtctctcggcggcggcagggtgttgacgagatccttgaacgggacgcggggagaagcgtcagtagccgccgccgccgccgtcgcgctgacgcgcttcttagcagggaccgggatgctcggagaaaccgccgccttctccggcgccggcgccggcggcggttgcggcgcgtgaacacgcttcctgaccgggaccgggatgctcggagaaatagcagccttatccgccgccgccggtggcagagtgtcgacgcgcttcgtagtcgggactgagggagaagcaccactatccggcggcggcggcgccggcgcgtgaatgcgcttcttggccgaaagacacgcgggcgcgacggcatcatccaccggtggcgcataggcgcgcttcttagccgggaggcacagagcgaaaccgcccccctccaccgccgccgccgccgcataagcccgcttcttcgccgggaggcaaacggggacggccgccgccgccgccgccgccgcctccagcatcggcgggcacaaccgcttcctcgccggcaggcacggcgccatcccgagactggagccgccgacgtacttgaaccgcttggaaggcggcagatcacgcacgctcccgctgccgacggcgaactccatggacggaatcgagaccggagattttgctacacggggaagaagaagaggaggttcgcggcgggtgatttgggatcgaaacgaaccgggggtttaaatgactgaaaatttcgcggtcgaatcagcgagatggcgcgcgcgcagccgcgcagcgaagaatctgacgaaattttggctcggtgggaagcgaaatgtttgtaatttttgtttgaaatttcgaatttggggcgtgcgggctgcgggaaaattttgcgtttcgtttggatttcgcggcggcggcggtggcgccagcatttcgctcgattcgggccgtgggcttgggcctaattaggttgggccatgaaaccctaggtgggctcactttttttttcgccgatttataattataaaattattatcttctttttcgtctattgaaaaagacgagggcctagtagccatcgtcgatccccaagtctccgcggcggaggcgctcgcgtcgcgaccccgtcgccgccgccggcgatccgctccagccgaaccccgccgcaccgccgcggtagctgccgtcggcgaggtgcgtctcggcaccggactccaggaatcgtgctgctgctggaacgccgcgcccgctcagccggcggccgggcgtcccgcgtggctcgctggcatcgatcggggatccctcctacgggctcgccgtcgcggaggtttcaggggaccggcgcttggttggtaacttggtttcttttgattgtttaatttctctggttgtgatgtgtgctctagggtttaagccgagttactgggtcaggatgggtcaggatgatatatgttctgcttgttaggttcgatgtattgggtggatctagctacagaagataatcttcgatcttctgaaggggtggtatagagcacgaatcaaccccaactcatcatcatcaatggttctatagtagtgtttggtggttatcctattagtagtcctttataatgattggttggattgattcatgtgctcataattcgtgtatggatcataattttggctcttttcttttctgtaagaatcatgtgaaaatattgttaggcatctctaatataaggtgtttacgcatgggcgcttaaaataattaatcatcggacaattgaaggctcatcgaacatcaggattagtaccaattctctcacaggtggtaagaaaattgattttcttttgctacggacccatccaagcaccttaattggagatagaaagatagaggagaaggtgtctatttgatatttaccgacgagtccattcttcatgtggttcagtctgatatacttctcaggtgccttttaaaaaattgatgctctgcatgtgcattcacatttaccctgtaaacccaaacatgtaagcttggcgattgagattgttactgttctattaactgtttcatgtcatgctgtttcatttatatgttgtttcatttttgtttatgtcactaaggaatgtccacttctcacatttgtcactaattcggttcaacttctcatatatgccatcattccgttatagcacttctcatatttgccactttaaattgctcaaaggtcgaccatcattagcatatgtaagaatttccagcaaaccccaaatatccttcttgctactcacagttgcgcttccacagtgctgtcacccatgcatgcctgctgcttacaagatcagcaaaataccaagcctctttacagtaggaaggatagaggagtgtgttggagatgtcatatccttgagcactttcagattgtgcttcaggtgacagaaacagagtggccagaaagagcagagctggggtggctcagatgatggcatcgctaactgtggatgtccatgatctagcttcctccttacttcactctttccagcttcccacagctaacactgcatggatcctgcttgcaccatcccaatgctatggctatgttgcatgacaaccagtagtcggttggtggagaacaagcaggatttcaatcttttaaaacatcatgaatagggaaattgacagaatggcaagaatgaaatttggtttaacggaatgatggcacaaatgagaagccgaaagaggcataaataaatgtgcagtggggcagcctatatttcttcctttctatcctttgactaatggattgctcaaaaaaaatttgttatcccctttcccctatttaatcatttcgaccttttggcgcatttactgactctacaaatcaacaggacacgctctttcctcatcaatctgctgacgttttgaaatattggaatgcttctgtcgtcgaatttggttatctacagcatctgaattggttataacttataacttataagtggcatgtctgcgaaggttccaaggtactattatcacttagcagagttactgcagtgcatgcataatcacttggtgaaatacttaaactgtgttttaatttatagccagccagcatggttatagggcattcatgttttcattcatggtttagcactgcttttgtttaatctctacttgtgaagtaagaaagataaaattgttgggtgatataacattgtgatgggttgataaagttgccttcgtcaaacaatacttctttacgtctggcctgtagggcatcatctaacttgcttcacaaatttgaccataaggattaggcttttcataactgaaattggttgtctttcttacttctgttctcttgaccacatcccagaattaaatgaacatggcatctcatacgtttccactaggcatcatatacttatttttagatttacctatcagaaacacatgttatgcaaaatacaggttatgcaacttcataatcctgtttaagcattttcgagtacttgctgcagaaagtttatgtttttactgttttgatgcatgatgtgatcatgccgataatctgacatacagatttgctttaggcgcctagaagctaattccgttgggatggcagattgggctggtcttcagactgatatccttggtgtaattgtaaagaagcttgccgtccctgactatctgagattccgtgctgtatgcacatcttggaaccatctctgtagggatgtattcaactgtccaaggatagacccatggctgatgctccctacaaatgcgcttaatgattctaaatttttgtgtgtacctgaaaggaagaaccaaaccattcgtctcccgagcactgttacaatctttggctccacctggattcctgttggttcttcccatggttggctcatcttttacagcccatctcatggaaccatgcagctggttaatcccattagtggcatgcagttcaatcttcccccaatcggacgaagggccttctccaaggccatgttgcttgacatgaatgacacaaacttcactgttgctgtcatcttacgtgaccagaaaggatataaggtaacgcgtaaaggaagcaacagctggtcatcagtggaatcaaagcatgatctagtggatatcttcaagcacaggagacagctttacaccgttgatatatatggcacagttcagttgtgggcagaaccgccccgttcatggccagatgaagatgccccgcaggtgaatgacccgtatcataacctcattcactatccgcatcaacatggaaagcttaactgtttggtggagtccccagctggtgatctaatgagggtgaagcggcaatcaaatgataagtttgtggtctggattctggacaaggggacattttcctgggagaaggttgataacatcggggactttgcgctgtttgtcagctactacagctcggtctgttaccgggcgaaggatcatctcaacctgaagtcgaattgtgtctacttcattgactcctacagcaacctgtgcgcattcaacctggagaacaggacgaaggagctcgtcgaagctcttgagcccgcccatgcccacggtcatccagagcctcacgctgtccggcgcaggccggaaggacagaggtacatgtggttaatcccttcgctgagataaaccaatggaggatgaaagctacggtacacatccccgttgtctctgaacttactacagtatatgtgactgtcgctaatttcataaaagtattgggcatatctatagcacttctgtagataaatcaactgtctgaactttggacaactcgtggtttgtgattatcgtgtattttgtaatatatatatatatatatatatatatatatatattatataagttatccttgtccaaattgtttaaattatcatcacccggtcagaaattcagaattgtagatgtaaccgtgttcatgtattgcgggagggagggacgcggcgagagcgtcaggccgtgcactgcagcacgcggccgcgctgtttcgccgtgccttccgtgcaattgcagaggcgcgctcgtctcgcttgctcgcctcgctatatgaggctcgaacgctcgcgtcgagctcaagagcgaccaagaatcacctgactacactcactgacaccaacgctgctgccgccgccgccgtcgaagccgatcacgagctctcccgttccggcgagcagcggcgcgttctcgccgccgccgttcatggagccttcgaccgcgcagggaacatcggtggcgccggtgccatggcagaggctgggccaagagccgcgccagcgggacgggcggtggcgcgcacggtgcgcgctccagctcgccgccttcgccggcgcgaccgccgccttcgccgccgtggcgtaccgcgtgcgccaccggccccgcgacatcgcgttcctggccgtcacctactggctcgtcgcgctgctgctttgcctcgtcgagaagctcgaggccctgcggctcgacgcgtccccgccggcgagggagaccgagctgcggcgcgtcaggctcggcgtgtgggcggtcgccgtgacgctgggcaacacggtggcgtggcgcgtctgcgacgcgatgccgttcctggcgctgaagctgggcgtgtggggcgtcacgctggtggtactgggcttcgcctactacttcgtcttccgttccaaagccggcgagtgccacgacgaggagcacggccatccctcaagctgacgccggcggcagccggccgccgccggagaaagctttccgcgagttgcactggaggtctgaacttggtaggatatagtactacagaaattattgaacgtgaaggatgaaataattcttctaaacatttctaaaaattgaaatgaaatgttttgtttgattgaaatttgtaacgctactaaataatactataatgtttaggccgtcaaagcccaacgtaggtccccatagtttcgcttattcgtgaaataaacaaaacggcatatttgcaaacgaaaaataatttatgaataaaatttttgtatacgtgtttttagcgatctaaaatcaatggttgaaaaataaactttgattaaaaatttaaattttgactgataagcataagtgaaaagatggggccatgtttccctagaagaaagaaattgtaagattatccatttggaaaaaaatatgtattgacagttttcggaagctgtataaccatcgttgtctctctgcaaaagcaattgagacatggtgtctgctgatggcgatgtctcgctctcatgtactttctccgtctaaaaaaaatctaacctaaacacaaatgggacattacatagtacaacgaatgagcatgtccagattcattgtaagatggaacattacatagtacaataaatttgggcatgctcattcgttgtactatgtaatgtcccatccgtatttaggataggcttttttttacggaaggaatagtatctattttttaggaactgaaaccaaatgaattgattctactatcatattccttttcccacaatccagcttcagaggagcgagccaaactgccaaaaaggtacaaacaacgcgtcaacgcgtaatatttgcgtaagttcgttgatagatttgaatttaagaagagcacaaagcagtagctataaacattgacaaaacattcagaaattcagaaaagtcagtcccatctagagtagtacatgtcaagaacagtaaagttcctcctggcattttcgccttcaatttgacaaaacctcatcctagttgttggattattagttgaaaccacatgcagactatcctgaaaaaaaaaccatgagtaggcgagtagcagatcagtataccatagatttttcgtgaccatcacgcgtggtactgtctctacgtgtacgccaagcagatcacccggaattactcttgagttcccgcttgtgtgaataagacgacttaatcatgccggtactttttttttacccacaggttaagtcatgcccacagagactcattaatcacaaaagctataattgtatactacaaggaatgtgtttgttttcctctagaatcaaacgctccacgaacagttcatattgtactttagattcaagctgtagttgtaaaattcaaagagcgaactagaagctaaaagtttagaaaatcagtttttacgtattcttagaagttagctaccaactaatttctcagaatcttaaactcgcaaaacagactataattctcctatcggtttaaaaaaaaggagaaatgacaaaaagtcttcaaagaaaaatttttaaaagtgatttacatttcaaaaccctgatggtattatgaaagtaattttataatttaatttacatttttgctttttatgacatataatttaaatttataaggtattgatgctaaacgttttattcgacctatccccactacgctatttttaatacagaagattaagaaaaaagagagaaaaaactatgatgcctctttaaaagtggtagggataaaatttggtgaaagttaataaagaggtaattgggtgccataaatcttttccggattagtacgctgattctcatctaattcctactacatgacttgacctgctggtcaatcatatttatcgatcctttacattttcaattttttttccccagtgaaacatattctcgatctttgcacgacaatttcctcgcaaatttttttgcagagaagacgtcaagcaagagggtagtatatataacacaccttgttcattgtggatcaataacgatcgggcggaactaagcccgcccctgaacctgaacaaaagcctatcgtcgtacaaagtcgtaatacatattatccgagtgtgacgtgtccaatggacgatgacctgtcgaagaaacctcagcgggagcaggacggcgacaacgcgctgctcccgtgcgtcatcgcgggcttcctcgtcgccggccacgtcgccgcgtgcacctaccgcgcggcggcggaaccgcgtgacctcgccttcgtcgccgccgcgtacaccatgctcgcgctgctcctctactgcgtcggcaggttcgaggcgctcgccgccgacggctcctctccggccgccgccgtggcgagggagcggctgaggctgcccgtctgggcgctctcgacggcgctgaccgtcctcttctcgtcgcgcgtcgcgccgatgatgccgccgccgctgaacgcgctcgtcgtggccatgtcggtggtcgtcaccgtcggtggcttctgcttgctgttcctcggcaatgcaggggaagacgacgacgacgaggacgaggcagcttctgatcaggatgaggaagtctgattcaaccacattttcgaactgtcctttgtaattacaggaagaaacgatcgaataatcaatatcaacgtttgacaaccgtgtgtgtataagaatctgaacaactaattaagttcgcgttgcagtagctgtttgctagtagtttctatgtgtaaatttttttctagtttaggcgtgcaagcactttggttactgcggtagaaagttatttacatatgtataaaggctgttttccccctctgaaatcaaacgaaattttatggtagaccacttcatcgtgccgctgtgaatcttaggagtaacttttagttttacatatttcccttctcctctttaagcaaagacttgcacgcctagattccgattatctagaaaattgtctcccgcctatcacaacatcatagaatctaagtaattcaaaatttgatcaacaaagtaactatataaaaggtacatatttccctcgtaactttaatatttgctagacaagcctgaaatagttataccccctctgttctctataagcatttctagaattcaaaattatacaacataaacattttgggtcagtcaccctgatacacggaaatccatactttcaaatcatacaaatttatattgtggtataaattttagatcatagtataaatttgaaacagatggagtaatacatttgatacattttaagaaggtttcatacatttgatctaaacattaaaaatatatatcgatgctttttattatataattccacttgaaacatgtcagaacaatacgttttcgtgaggacctatcatgtccgagtgaaggaaacatgacacggagagatggacgacacaagcttgctgacgtcataccaaatcggtgttgtgacgttgtcaacctgtttgctgaactgaaggtttgctgttcgcctagcgagaaggtttgttgttcgattgaaggggagtaatacaacataggagtagcatttttgtggcactaatttcaacaaatggattttcgtcctagatttgacacgggtgtttgcatttacggctaattattctttcagtggtaggcgacgtacccgccgacagcgaggcgcctgtggtgacttcgtcaatctcaaaatatgccggtccagtcttccggaggtgctcatagggatagggtgtgcgtgtgtacgttcgtaggggtgagtgtgtgcacgttatgagcgcctgcgtttgtactgtgtttctcaaaaaaaaaaagaatcagaactagaaatgtttatatcatgatacaaattttaaactctagaaatatctacacttcagaaatggaaggactaatacatttcataaggtattcacacatttgttctaagtactaaaaagatgtatcaatgttttattattttttagatttcgacttgagtcatgttcagaataatactcccttcgtcctaggttgagtttcgtatataaaagttaatttattttaaaatgaaagtagtatgttttcatgaagaaatatcatgtctgagtgaaagaaccaaggtttaaattcatgtatagaaaattgtttatttgaagacggagagaatacgttttcttgaagacgtatcatgtccgagcgaaaggaacaggccgtgcatgtcacgatgagagatggatggcgcaagcttgctgatgtcgtaacagatcggcgctgtgactttgtcaacccgtttgttgaactgaataagcagacgaattgcacaatgcacatgtcacatgcttatgctcccacagagaaggcacgcagattgctaaaatgcagccttgtaaaatactacaagtcttcaagagtcaagaccatctttcgtttacttcactttgttgggacactagacttggtcggatcaggatttatgactcgggtcatgtctttgcctatgcatttcccatacccatagctttcaggttccaaccaaacggcttttagttgatctaataagttctccctttttctcttttccgtcaggcatcagctatataaacagagatccaacgtaagtgctaggaggactcgagtctcctctatccctttggatcaccattgataaaatgagagggacggaagaataaggagagaaggaagagtagggggttgaaggagatgagtcccctttaatcatattctatatctgcctaactgagggcatgttctaaagtgcgatagatgatgaatgatgagtcggtgactgaaaacttagtttatggcaactatttagagtacaaacgcttcaattcaatactagaaaactaccaccttcagtagtttgactattcaatatccatcttattaaaaatttagtataaatatgaaaaagtatatgtcatacctaaaatatttttaataataaaataagtcacaacaaagtaaacaatacttttaggatcaaatgtcaaccacgtcaaatattttaatcggaggagtaaaaactttatttagaaaaaatattgctccctccatccaaaaatatgagcatttctattcgttttcgtggtaaggaagtatatggaattgagtgatgtgagattgtggttggttgaaaagagaaagtaggtgtagggactaaaagaagttaattataattaattgtgataagaggatagataaaaaaataattactacattttaagataaattaaactctagaaatagatacattatcgggatggagggaacagtgtttagaagcggctgtgtttggagtagccgattggaagaaaatcggtaatttttcgtgcacgcattcctgaactgttaaaaggtacatcgttttgccaaaaaaagaagtaaactataagaaagttgttttaaaataaaaccgtattaatcatatgcatgtaactcaacttgttttacatatcctctcaatcctctattttcccgtccttccaaacacattcttagggcctattttttggaagaaaaatcaaatgatctggatttcctaaggattaactcctataagtataagtatcattcggttcataggaatgtaggtccggaaaaaccaaaggaacattttctttcctaaaagttgcagagagaagagaaaacataggaaattttccatccatccaagtctcttgaaaattcctatggattgaagtgtgtaagcattcttattctttcaattatttctattctattggtggaatttctcccaaaggacattctcttgtgactacatgtgggctcacagcccagtcatagccccataggttgtccacgaggcccattggatgatagctggattgagagccgtcggatcgaatccaacggatcagattgagtccaggaagagagacacgcgggtttgcacgggcgagctcgccgtctctctcgccgccaccgtcgcctgcttcgctcgcgagagaggagccatggctggagcctcgccgtcggcgcgcgccgaggtggtcgtcccgccggaatgggcggcggctaccgccaccgccgccgccgcctcctccgagcccgcgccaccggtcgtcgtcgtctgcgggcccaagaacgccggcaagtccaccttctcccgcctcctcctcaactcgctgctccccaggtaaaaaccccactctaccccccaaagccctagctctgcttcgtcggcgaggagctttgttcgctgacttggagtggtgctccgctccggtgagtgtttgtaggtatgggagggtggggtatctggacacggatgtcgggcagccggagttctcgccgccgggatgcctctcgttccacgtcgtcgacgaagctctcacaggtgacgagatgagatggcatctgtgtgcggggatttgagtgttaaactggagatgtttctcttgagtgattggttaattgggtggtttgagtttctcacagacgtgttgttggcttttgtgcagatttgctcaacccaactctgcgtgagtgtgaaaggtgcgtgattttcccccttttgtgactgtatgaattgcgaagtttgctgttccttgcggagtggtcataccgcttgattgcttcggtttagtaatcttcccttattgtgttcttgttttgagccgaacaacattattattcctattcaatgctgcaataagttcaagaagttacttagtgaaaccatttgctattttccttgctaggcagttttttagactgtggatgtaaagttcttccttgggtatttcgaaactattatgttcagacaactttttacctaacgccagtgtttcttttctttaaaaaaaatccaccaggtgttgcttcttcggtgatatttcttcaaagcgagatccagaaacatatctgaattgtctatttcatttgtatgactattttgttgaaaaatatcgatctggtgccagtgaacctctacctttaattgtcaacactcctggatgggtgaaaggtatatattatgaattggtcttttatgacaggatgccacacgtttttttttagtttgttcactaggccctcctttatttgttttacataggtgctggttttgatatgctggtagagatgctaaggtatatctgccccacaattgttgttcagatacgcatctctgcgcagagcaagaatctccctgatggaatgttttggttagattgtgggcaaacaggaccaaacatgatcaatattgatgctccatttcatgatgctttgaatagatcgtgagtaacatttcatttgtctcagtttgaagttcaagttgatgtcaaaagatatttccaatcgattagttgaagcccagtgaaatagcctccttaatactttgatgaatatttttatccattgtatgcttgtaggttagagcataaactgtgggtcttgtatgacttgattgctactgaaacttgaattggcaaacagtaatgaaattatcatccaaagcattcaggaatctacgagttctcttctgtgtggaatggggaaaaatagtaccacaattagcgcctcttttctgcctatcaatctcttctccatgcaataagagattagggatccatctacctgaattgataatgaaagaatgcttcaagttctttttgttaaaatgtgcatacgttggtaattatgatagtgcatttcaaatcatctgaagctattaactaaattatatgctatttgcttggtgcaaaaatagcaatgaacgttcttttcctgcagtgctctaatttcacactactctgatgtacccgtttcaagtaccacacctgctgcaattgtcgaattaatacttgcagtcatgtattctacacatagtagcagcaactgctttaatgcatggcaattggcaagtactaatgttgtttatgtatttactaggttgttaatccagaaagattcttatggaatgcgtgagcgccggcttatagagtacttcaagcaatgttttccaagtgacatatcactgacaacaaataaggagcttgcctatggcctaacttcacttccaccctatgaagtatcaatttcagatgttatggttatacatcttcattgccaggtcttttggctccacaattcttttttttttctttcgaattataagctgaggttggaattatgtatgtgagatctcaaatctaggtctttgtatgccctgaatggtaacaagaatccactcacgcttattattttgtccctgttcaggtacctcctagtgaggtatggcatagtctaaatgctaccatagttggtttggccattagctgtggcacgatcgaggcaggccgttcaatcccttggtgtgctggtcttggtacttcctcgctcttctcacatgcatattctcattactatgcatattctatgatttttcagcaacctagtcatgtttcattacacccatgatcaattagtgtagatattgcaaattattacgacaatggcatccagcccttatattgaacttggtcacttgtctgaactttcttatccaggtattatcagaggcatcgatgtgcaaagaggcattttatatgtaataactcctgttcctctagagcatcttcaaagagttgatcttttgcttcagggactcattgagatcccaaagtctcttctgcaggtgacatttccgttttcttccatgtcccctgcttggtttaacgagtgtagaatccatccgtagtatccatgcacagagattcagtaggacaacccttggttccaatatataagcttgtccagatgcatagccagaaatgcttacattttggaatggagtacatgtgtagtcgcatttggaaatgttgcttgatactcaattttctccttggccctaactttgttctgctgcatctgaaacgcctcatgtttgtaacgagagagaagcaaatttgcttccccattactaattaatttgcctgcgcaggtccgaggatgcgtctcaccatacatgccaacgaatgtgctgcacaggatttcggagagggacataaacacctgagttgacgtcgaacgcccttctcctttgccaccaccgttcggggagatgatcctgaacctgttcagaacagagcagagcagttctgacccacagatggagacttgtaacctgtgcagtactgccatgcttgtttgtagcccttgctggtggaaacgatgatatatcattatctgcaattcgttggagacatcggaaaatcaaaattttgaccttttcttgtcctctgcaaaaattgaccgtcaaaatttagtaatgtcaaatattggcgcatgttagattaccaaaatttcgtagtgttggaatgtgtaggtgtagccttatcaaatgttcacatagggttgggttggtttgagatctaaattgaccttttcaatttttggcaatgccaaaatttagcaagttgtggcatgactaattttgggaaggcaatgttgtgtttggattgaagttaaaataagttaactattgaaatggcctaagaaaaggcctattttcttaggcatgttaagatttggcttcaaactaaatagacaataaatactattgaaattgacaaatattggtaagccgtatttagacctcaaaccaaaccagcccatagttcttactccctccgtcccaaaataagtgtagttttgtactattcatgttcaacgtttgaccgttcgtcttatttgaaaattttttaaaatttttttatgattagtatttttattgctattagatgataaaacatgaatagtactttatgtgtgactaaatattttcaaatttttcacaattttttcaaataagacggactgttaaacgttgggcacggatatccacggctgcacttattttggaacggaggtagtatttggttcggttgccttaacaaaattatcaaaatttgatagtgccaaaaggtatttagaccaacaggacatctgcatcttcggtaccaaacatcaaaggaacaatcacactgcttatgcatacagaccatggcaaaacgatctcacacgtactactagtctactgcccgctccaccccagctcactcaagaacatttgcatatccacaaacgcagatccaaaaatacagaataacttgcctgttcgtttaatctctcggcccaaaaactcggaactcggcttagaacgaggatttaagggaaatttgaagggattaaacgaacaacgcataatttgcaggcgagacaagagatttcaaaagatgcagagtatatttattcagataagcagcagaacatccccatttccattaccaaacatcaaaccatccatcatcatcacatcgcatacggcatacagaccaccatgtcctcacattctcacgtagcaaacgataaagatgaacactctactcatactactagtcacaactcactcaactcaagcttcgattctttgatccacgcagcgacgcagatgcagagagatgcggaatctcatcacgcgaccttgacctcgatggtcttgggcttcttgggctccggcggcgggagcttctcgacggtgacggtgagcacgccgtcctggcacacggcggagatcttgtcgacgtcggcgttgtcggggagcacgaacttgcgcatgaacttgcccatccgccgctccatccgcaggtacttgcacgactcctccttctcctcctccccgccgccgcgccgccgctccccgctgatcaccagcagcctctcctcctccacctgcaccttgatgtcggaggacttgagcccaggcatgtccaccacgaacgcgtacgccccgggcagatccttcacgtcggcgggggtcgccgccatggcgcgggcgtcgcgcacgtacgcacgcgtcgggccaccggtcgcgccctgcttcccggcggcgccgccctcgccgtcggggatgtcgagcaggtgctgcagcgccgtcatcagcggcgtctccagcccgaacatggcgctctccatctctcgatcgcctcttcttcttcttcttcttcttcttcttctacctcggatcgcgctggggtttgtggcttctcgatcttgtcgcttgattgctcggtgggaggaggggtttaaataggggtgacgtgggggtggagtctggaagggagtggaaggttcggaaaggtggtggaatgggcgcggcgaggcgggggcggaagggcgtttgcgacgagaaagatctagagaggtggatattttcggagcgaggggggagcgggtttgggtgggggggccgtacggttggttcgagtgggacccacttgtcatagggtggtgtttgacaggtttcctcctttattatttttcttttttcctttgagaggtttgccttgttcgctccttttctgctgcgatctctggattctggaagcttctcaagtcttcggcttacattttctttgagtggagcgaaggtgctacacttataccccggtttaacttttcgactagaaaatcagcgcgccaaaaggcgcgctgttaatttatatcctgtacatgtaacaggaaaacggtataattttacatgagttagtttattttcaataaaagtttaattttccaaaatgatcttttaatggattttagtattttctttaaaaatgatgagatggatcaaagtagattagtaatttatatttgtcattaatttggatgtgttgtttcactctgacaaatgattttatatatgctacttcctccgtcccaaaaatataacaacttatagcatttataatttgtcccaaaatataacaacttctccaccaacattctcttctcaaccaatcataacccttcactatttaatttttctacctaccttcacttcttctccaatcacaatactcccccatttaatcataccaactttcttagggtgtgtttaggtggtggagaagttgggaagttgaaagaaatttggtagtttggagaaaaaattggtagtttatgtgtgtagaaaagttttcgatgtgatgtgatgaaaagttgggaatgtgggtggaactaaacacggccttaataactgtgtcgaactctaaaaatgcttatattctaatacatgaggattagggagaaaaaacaatctaatagttttattcttaaaattgcagcgaatttataaaacctgaaagttttgcaaataaatccacaaaatttatagtattagtggaaaatgattttaagaaaaaatatgaggcttataatgtttgatcgaatcgtttatattatttctatcaattaatttttctattttttaggagtattttatagacatacgtgatatcgatgtagtaagatatacttgcttccattcaatgtacgtgatatcatactcctaataatttcacaaaactatttgtgtttctttcttttttaactcttttcttcttcgtatgcctgctcctgcacgtgtgatactgtgattagccgctggcaaggcctgagcatgcgtgagtgcctagctagatgccagcccgtgcgtgcaccgatagcacttcgacctttaccttttctttcaagcggtgcgtcctatggatttatctagaactagcagggatcccgcggcgttgccgcggacgccaaaaagcaaacatcaataaaaatatctatcacaacaattactcaaacattaaaagaaatctatcacattaatctcaatttcaggtgatggaatattgaattgattacatggtgtatgaatagatactatggaaaatattggtatatgaagatatttattggtgtaacttttattgatgtcagcttaaatcaatcataggtatatgagcacatggtacaatttgatagccaaaagtaagatagaccaaaccttctatacaggcaacgttgccactagcagcttcattgattcagtcaccaatttctttcttccaaaccaaagtggctgggcagaatcacagacaacccctaataagatacaaaacaaaaccaaatgtattctaatgttaccaatagactgatttgctaaaactgtaagtttgtaatccaagggagtaagaccatgggcatatctgtggtgacgcaagatgaaaacatatcatattaacgtaaaccaacctctttctttgccacctaagaagttagagcaatgcaggtaccttcgttgaacctgtagaaaacaaaagaaaaaacaaaaatcatttagaagtgaatgttcagtacatgccaaaacagcgcgagacttttttgtgttacgtattgcatagatataactcagaaaatggtggtaatgaactgctaggaaaaaaacaactctattttatatgttatgtcacacttctcacttgctacctccgtccctaaaagatgaaagcaacttgtaggttgatcactaatgcatctggagatggtccagtttcacataatgatgtgtgacatttttatctgtaaagagagacaaaaatcacttgcaaataagaatggtaaatcacatgtatcagaagccaacaggccaggggaagaattaatttcttgctaaggaaaaaacaatacatacagtcgtaaacaatattaacttaaactgaaaatcaataaaatttgtaataacatattatcaatataattgcccgatataagcagggatcaactttgaattaacccgtacaaccactgcacttaattccaaatagcacctgtatataaacaaatatgacaatctagtttgatccattaagggatatccaaacaacctataagcagcaacccgtacaatgcgtgttccatatccaaactgattgatttgcaccatggaacggttgcaagccagataacggtcaattcattcctgaagatcatatactgaaagctgaaatgttctgaaaatgaaaaccatgcaaaagaaggatggacatcgatcagatatcgtatgcatgagaatgtatagaagcaaagaatttcagagataatatttttaccatgtttgttgggaacagctatatattggttggttggtattaaaataggcaacaacttgtgcatgcactgtaaagcaatctgaaagtacaataagcagtcacagtctcacagagacaaatctgtaatgctactgattagagaagcagggaaagctgtagcaaattaaaagatcgaagcatagatttggcatcgcagatcgatgaatgagaataaacatatgttttggacgaaaactgattggtaccttggttgggtggtcaatgctcatcaactgaatgcatgtctaataggtgtaactgctgcaacaataatcagtggcgaagccaagatttagagatggagggtgccatctacgagacatggcaactcacttaaggtttagtgaacagtgattttgtagcgttgatgtatgatcggtaactcgatatcatacatattatagcgattagctacaagagagaacaagaacccatatatcatgatttgccaatttaaaattcagtaatatttttaatatatggatgattgaacagtttgtttcattaattggagtcttgcaatcacttctaaaatgataaatcatttagctaagtcatttcataagtcctatatatatatagctaggcaggtgtgtcgtgtcctatatagttagtctcatcctgcaactaatgatataattaatagctagattata

SEQ ID NO: 82275 - DNA, 19584 bp, Oryza sativa
aaagattcttttttcttacaattttcgagattttatttgaacgagacgacataagacagcggccatgtcatacgcatgagggtgactattggaacgattttggaatatagtgcaaatttttaatgctaagatccacacaatcttgataagaatgtgagatttaggggctgtttggttgctaccctgagagaaattgcctgacctaaagccagcctgagactaacacaggtcttgtttggttggtgcccttagattccaaacccttcgcctgccctgacgcagcccttcccgtcattagcgtgagctaggcgaccgaaatcgatcgcctgagctccaggcagcaacagcgatacatacttaccatcctaatctttatccaaagcggccacgcgacgtagattccaggagcgaagctgcgctgcttccgcgaagccgccgccgaccgccatcttgccggatccttgcgaagccgccgccgcccgccgtcttttgtaatccctgcgaagctgtgctactctcgctggcgtgcgaagccaccgccgttttgccggatccctgcgaagctgtgttgctcccgccggcgggtgaagctgtcgccgtcttgccggatcccagcatagcagcaccgcccatgctagatgctgcccaggctgcctttcgtgcaaaatagtaagcagatcgatttgcaggttgccagatgcatttgcacatctgggcagaatcatctgaaggttgtgctcctgatgcacggatttgggatctatttgactcttcgattgcgttctcctctctctttttttccctgcttttttttctagatttttatcctcgttatgtatgcaagatttgtgcttgtacatgggaagttgggttcataaatggatcttggcaggaggtttagatgcaatttgtggcaagatttgtgacggccattaataattgatttagctgtataataattaaaggcgtaattgcatatttgtttctcaggcagcaacaaacaaccaaacaagcatatactcaggctacctgaccaggctagatgcattgtcttctcgcatgccactcaggcgcacagaaatttcaggcatgttgctcagggcagcaaccaaacaaccccttagagcactaacagggcaaactacactaagtttcctcataaaaagagaactacacgcaggagaaatcactaacaagacacaccttccatagtgtaggtaccccgccatctcctcccctcccaccgccgtcgtcaggtggtgcggtggagggagagggagcgagagagagagatagctgagagaaagagagagacggacaggggaagggagggcgccgccgccaccttaagccgtaggtccgccaccatcttatcccctcccaccgccgtcgccgggtggtgcggtggagggagagggagcgagagagagaacttagagatggggagagagagacagcagagagcaagtcgagagagagtgagcgagagagagacagagagagagaggcgagaaagagacgtgcggtggagggagagtaatccgtggtagataaggacaagaaggatgtaggagagtgatatttagccttggttggtatcaccaatcaggattaaagatatgatctttagtcctggttggtgataccaaccggaactaatgttcgttggggacctcacatggcctgacagctattgaaaagggactaaaactgattccaacccaaactaaagatcaaaaagtaccgctgggtatttgaactcggttcctattcgatctgggactgatgtaattttcgtcatccgtgtaaagattagttctccagtagtgacacctccaataccatctagaattggtccggatattgtccactagccaagcatggcatgggaagaagaaagtgagagatggagggttcaaatgatccaacgtgcaacaaaagatattatacctagcccaaactgaaaattttcttgtgatggtccaaggtgaaaccttcgtagcataggtagatcaatgtactatttactcttatatttatagtaggcactgaaatatgtctttgtaatccaggtatatcatttcctatgacaagcgtagctagccttaatgaatatatacatgactcatttttataagtttttaatagctatagctctcaaaatctttagcttccgtaaatagtctagatttttaactagattctaccggttagtagttagaaaatccatcaaataaaataaaagtcaaaagctagaaaacttagtactccctctagttttttttgtttgacgttgccgaccggttcgattaaattaaggaagctgtgaattgacttgtttgccttcacccttatccctttgcactgatacgtttcatccatgcaggggggaagaggggaaatttgcgtacgggaggagggcttctgaactgcgagcgtcaaacaaataaacccttttgagtatgaactggaacgtcaaacgaaaaaaatgggagggagtattttcatattcggaccagctaactactcgttagctatctctcaaaatatcaagctacctaaacagagctatagcatgctattcgcttataagattgattttgaaaaggcttatgacaaagttaaatggccttttgtacaacaaacattaagaatgaaaggcttctctcctaaatagtgtgagtagatagcgtcttttattcaaggtggccatgttggtataaaagttaatgatcaaattggtaataattttcaaacttacaaaggtcttaggcaggggatcctttatctcctattctttttattattgtagctgatatgcttgctttattaattaagatggctaaagaggcggaacttttgaatggggtaattcctcaccttgttgatgatgatttgtctatcttgcaatatgctgatgataccattatctttttggagcatgatttgcaacaggtaaagaatctgaaattgattctatctgtatttgaaaagttatctggcttaaaaataaattttcacaagagtgaattattttgttttggctaggcgaaggaatgttatgatcaatattctaatatctttggttgtaaattaggttcttttcctgtcaaatatctaggaattccaatgcattttaggaagctttctaataaagatcggaaaggtattgaagaaagaattgagaaaaagcttagtagttggaaaggcaagcatctgtctgttggtggtagattggttttgattaattctgtacttttgagtttacccatgttaatgatattttttttgagataccaaaagaggttcttcgaaaattgattattatagatcgaggttcttttggcaagaggatgatcacaagaaaaagtacaggctcacgagatgggatattgccaacccaaggaccaaggggttcttgggattcataatttggaaattcataataaatgtcttttaagtaaatggttttttaagctaattaatgaggaaggggtttggcaagacttattgaagagaaaatatctttataataagtctataactcaggttgaaaagaaacagggtgactcccatttttggtttggacttatgaatgttaaaagtactttcttaaatatgggttcctggattgtcaatgatgggaaacaaattaggttttgggaggataaatggttaggcaacttggccttcaaggataaatatccatctttatacgctattgtctgaaggaagtcgtcttctattgccaccatcatgggttctgtttcgcttaatgtttcttttagaagagctttagtttgccagaatcttgcttattggcatgagttttgtgcttcaattgtacatatccagttgaatttttcttcggatagctttagatggaattttcattagaatggtatgttctcggtaaggtcaatataccttgcttttaagtaataatggctatgttgaaaggaataagtgcatttggaagcttaagatgccacttaagattaagtttttcatgtggtacttgcttaaaggagttgtgttgactaaggataatttggcgaagcggaattggaatggtagcttgagatgttctttttgtatgaacaatgagtctattcaacatctttttatggattgccatttcgcgaagttcatatggagagcagttcagttctcttttggttttaaccttccttctagcatatctcatatttttgatgggtggcttttgggtgttgacaagaaaaagagtaaactgatacttgtggaagcttctgccatttgttgggcaatatgtctaagtaggaatgatatggtatttgataaatcaccgtcaatttcctatatgcaggtcattttcagggcacagttagaaagatgtgatgaagatggagagttactaaaagttacatgttgcaagttggagactacgattatgcaacttttttgccaactatggatggagattcacaaatagactacaataaatatgttctccttatgtcagttttggttttcctttatccttgtttggtgtgttctagttgtttagatctacactcttttctcgagcacttccttataataattgtctgtagctctctttgagcaaaggccgagataatatattccattatctaaaaaaaaattcatcctttcttcattccttctgtgcagccctttcctccagcgggggccaaccggcgagctcaagctcactcaagcatcggtggagtggcaacagaggtggcaggtggtggctggcctagggctcctccctcaaccaaatttagcacctaaagttagagcattgccaaaatttggaaagcgacagatttccttcatggggccggtctgatcaccgcctatgggacagtgtaactagcacatagggttggtctgactggtggcatgtgaccggtcggacttgcagagtctgagtccaagccgattgtcatcatgtctcgggtgtcacgccctgataaatccatcccatattaaaaatcacttcctaaaaggaataatagaaattattaaaagcttaaaagaaaactcaaacactaaaatacatccaagaaaaaaattaatttgagctttggattatttttattaaattctcaatgctctaagaaaaaatcacatgacagacatgtagctaaaacgaaatgagaaaactaaaaataatcctctccctctcttttgaccgaatccggcccaaagagctctcctcctctttcggcccgccgatggagtcctcttctattccctccctcttcctctacctctccctcccgggcctctctctccctcttgggctgcagccagtcagccacctcggcctaattccccttcctctcccacgtactgaagtgcgttttatgtcctcccgatggtcacctcacctccttcctcttgggacgtatctccccgtggcccatctcagcaccacgcggcccagccgcgggtcgtctccctcctccagccgagctgccgcccgttcttctcctggccgaaccctaccgccgccggcatgccgatctcactccccggttgatttcttttccatttgaatgcaaaaatcggttcctctcctcctcatcatcaattaccccatgtttccccttcttgattcggcctttaatcgtcgaatttaatctccggtcaaccgctgccattgatggccgggccggcaagctctccggctgttcccctcctctcctccagccgttccactcttccaggcctataaaatggcggcagcatctcctctccccttacctcttaccactgcccgtgctcccttggtctcccctcatctcctcacgtcttcctctctctccaccacaccggcgaactcagccgccccctccctatcgaccggagcagcggcaaaccacaccaccacctcccacggcaccgcagagacctcctttagtcctcttaggctgtgttcgataccagccatttccaactccctcttgttttacacatgaacgctttttaaactagtaaacggtgtttttttaaaaaaaaatataccaaagtggctaaaaaaatcatattgatctatattttaaaaaatagctaatactttattaatcacgcgctaatagactgcttcatttttcgtgtgtgggtgatgggtccaacacccaccaccgaactcagccaactcctcttcccaggtctcatctccgctttgccgaagggccgccggaaccagaagcacgtcctcgtattcataatcacaatcacagtttttcttatgtgaagaagagatgaggtgtggccgtagtcctgcatcagcatatatcatatccttatctttgtagaattaagggcttatttgtttctaaggaaaaccaaaggatttccaaaacagaggatttgaatcctgtatacagcattcggtttacaggattgagctataggaaatttgaagggaaatttccttttgtgccagctgtatcggtaaaacacaggaatttttgcatccagtacgacctcttggaaattttcctggcgcgaaaagagcgcgccacgagcgcactgcgcgcgtaatcttttcgctctcacgacaaaaaaggtaggtaccgctgaaaggaaaataaaaaaaaatcacaggaggcaaacagactcgcatagaagccatcgcctttgatcccatctcctctaccacttcctctcctgtctccacgattgggtactggacctcctctcccacatcgatcgccggcaccggatgcaccttcgccgcccaggtgacaggacgcaacggcaacaacgggaagagccacggcagagatcggcaaggacgctttgattgcaggtttggtgcctcctcttccgttgttatgcatagatctgatgccccctgctgcttccttgcatacaccttagcatttgggtcgctgcggatggggtcgtagctgtaacacacaagggttcatagtgtctgcccaatggcaatcttgtttggttcagagaagttgttgccggcgggcggcggcgatgagcagcaacaagtagtaggcgagctaaccctgtatttgtggtttgtgtttgatgaatcacctaacggtgacgattggatgatatggttctttcatccatattctgtatatgtttatgcatgtaaaattaaggtccttcttctagctacttagctagcatcttgatgagcagaatgagcacatcagttatcagttcataattttttaatagcatccaactttaatttttgttctgttttatcctccctgtactatttatgatttattacagatgtctaatcgtcggaactatgagcaacaaggccatcgttcacaatcacaaggagtcagtaatgttgaagctgatatttcaatcacatggagctagaaattgcggtgtatttgcataaccagcatctacgagataaaatttaccaccaggaacttgaaaaccatgattaagtgcatcatgtaaaactcttgcatctgaagctgatccctcccatccaggatgtatatgcacaaacttcaaatcaaaatcacaagcaaccatacaattttgagagattgattgcttcctatttctatatggctcttgctcatccaatggaagtttcatagggatatgagtaccatctatagcaccaatacaattctacacaagacatgtcaaagttatttttgtccagttcatgaaaaaataggatattcaaaatatgaaatcagaacaacttaacaagtggccatacctgaaaaaaggggtaaaattgtggtttcctcaagattggatgtgggtgtagggatggtgcacgaatgtagacagatgtgagatttgtgattgcttccagcactgctttgaaatatctatgtattgtatctggactatgctgaaaccaatcttgaagtgtttcattggttgcattttttgccactgtatataagaatatagcaatctgctcttctactgaaacatatattgtgtcagttatgtactctttctcacgtaacttattgactagtgcatgaaaaatgtcgacctccatacggaagtttcttttgcataatctttcatgtcctgttaaaatctcatgtacacggcaaccccctgtaagttttgacgtgtgcattggtctcctaatacaagatgattgtgatgaatctcctaaagtaggcagaacaaaatgaatgaactcatcatcactttctgatatacgtcggtagcttggattcatggtgtgcagatgctaccaaactgatgctgtaaactcaaatagaagagagctaaaaatcaagacttttgctgaggaaaaaacaattttggtgcaccagatgaacaagtagtaccttgttgttacacgagcaagtaacgtctagctatggtggctagacgatgagtaaagcttctggaaaaattatgcagatagtgaagagaagaacaaaggatcagcaagtttcttccacagttgatgagcaaatagaaagaacaggggagaatggtgcacaaggctaacgagggctatttatgcacttcaaagctaacggctagttgagggccgatgtcagttgatgcaaacttaaaaaaatatatttcaaatggcagatttcctacacttctcctgtggtgtatccgaatgcacgttttttttcaattcctgaggtttagcttcccataggattgaactccacaaccatctctattccttcatttttcctaatcctatgaatgaaaaaatcctttaaaacgaataagccctaacgttcttggtaatcaatcgaatgatctatagctgaaaattaataatactaatttcatgtagtctttgttgatgtactacttctccaaatactcctaacttaattacgagatggtgattgctaattggtggtactagctagtaataatcagaattaattgcttacaggccggctggtcaaagacgaacacgaccgatcatatatatatatcctctggcggtggtgggtcgagctagccagccagccaattttgacttgttctaatcaatcactcgttggtaattactacaagtcagatgatatgatgaacaataagcgaccatctaccttctactaggtggtaattgcatagccagaaatttatttattttaccacggctggacctgggcgcttccatcaactcgaccagttggatcgacatgtcgtcgtcgtcgtcagatgtcatatctggtggtaacatcgccgtagccatcggtacgcgccatggatcatttgatcgattccctagctctagctcctttttgatcgatctgatcgattcatatagctagctagctagatagtttgattattatttgcgttttgcagtgtccgtgatcacaggcggcatagtagtcatcgttgttgccattctcatctacaagtgctgcaagctgcgcatgtggcgcaagtacggcctctcgccgccggaattaccggcatcgcagccgcccaggcccaggagcgacgacgaccgtgctgtggccgcgctgaccacgacgacggttgacgtcatcaaggagcggcctgtgaggttcagctcgccgcagttgcgggaaatgactggcgactacgcggagaggcttggcgccgggggtttcggggtggtgtacaaagggcagatccccggcggtctggcagtggccgtgaaggtccttggtagcgacatggggaggcgcgcagaggagcagttcatggcggagatcggcaccatcggtaggacgtcgcatgtcaacctcgtcatgctctacggcttctgcttcgacgccgacctcaaggcgcttgtgtacgagtgcatgcccaagggctcgctggagcgctacctgttcttcctcgacgaacaggagcagggcctcggcttccacaagctgttccgcatcgccgttgggactgccaaggcgatccggtacctccacgacgagtgcgcgcggcggatcatccactacgacatcaagcccggcaatgtactcctggacgaggagttggagcccaaggtgggggacttcgggctggcgaggctgtgcgacagggagaagacgcacctgacgatgacgggcggcgggaggggcaccccgggctacgcggcgccggagctgtggaagccggtgccggtgacgcacaagtgcgacgtgtacagctacggcatgttgctgttcgagatcctgggctacatgcatggtatggagagccaggagcagtggtatccccggtgggtgtggcagcgcctggagcatggcgagacggaggcggtggtggcgcgggcgcgggcgcagggaggcgccgccgccgccgacaaggcggagcggatgtgcacggtggccctctggtgcgtgcagtacaggccggaggaccgaccgtccatggccagcgtggttcagatgctagaggcccatgaccacgtcgcagcgcccaccgtcagcccctttgctcatctcgacccccaagtcatcatcaccacttcctctttctcctcgctgttacacacggatgacaccactggaggcaccacctccactcacatctcacatcacatcacttaattacttcttccaaaaattctttgctaactactccctcaattccattttaagtgcaaatattagatttcatgcacaactttaattattcgtcttatttaaaaaaaatatgattagtatttttattattattagatgataaaacacgaataatactttatgcgtgagttatgtttttatttttccaaaaaaattaaataagatggacgattaaaattgggcacggaaaatcatggctgcacttaaaatggaactgagggagtaactgctgtatgcacaataaattttaattttagatcgtgccaaaatctcctgacctttctcatgcaagttgttcctcctacgttatgagcctcactacagtcctccttactggtagtagaaactaatctgaaccattgatcttatttaatcaaaggattcagatgtatttatactactacccagttaggtcttgttcggtttggaggggatcgaagaagactggagggccttgtttggttaatccccatgagggagggattgtagtggatttattccacacctattgtggtgtggaattattcccctatcaatcccctccaattctcttcaatccctttcaaattgaacaaggccttattagtagtagaaacctggagggacattgttctcaaggcgccctccttgccctctcggtgttgccatcgtgctagtcgtgccattgtcggccctggtctcttgcactgacgacaatagtcgttcatgcagtcttcgcgtgcacgtttggtggctatgttcgtgtgcccttgtggccgccacattgttccgcatgcgtgcattcgtgtggcattcgtgtgaggcccgcttgtctcccacttgttacggttgacgcgtagggtctcactcagttctctccgtggatcatctctgggaacctggtccatggtaatctagctatttgatccatgggtctctgctgcagacctgcagtcgttcgattctctctctccttgagcgataatgcattacacataatataacggtataataataataataataataataataataataataattaaacaacttggaaatatccgctttaactgaattgcacctaaaattcggatgttcgtttctcggccatacgagctcctaattgatcggtttagattgtttaatttttttttcataacttcaagaatccgtttctgttgttttattttgttgttttaatgtattgttatcgtttctttcttagagttgtatagctctgttttgttgctcgtgtagttgtcgtcatttctgaagttcccaaggtgcatatcaagttgtcagaagacctgctcccttacttggattcaacacataatagctgaacaaggtggcaagaaagcaaaaggaaccagtctatcaatgcgcgtggtccatcaatatgttgaatttataagcacataatgatttaatttatttcataaataatcatgatattgcatatgtaaactagaataatcatatcatacgatctataaatatagattagactgtaaagcatgaacagatcgaatatgcgaaacatgttaaatatgtaccgaggagggcacgcgagcgattgtggacgatcaggtatggcgcgcagcacgcgagcgattgtggacgaacagggaaaataggcaatgtgttactaaactccctctgcatattatcctatgagatgggctttttcgattttctgtaaaattaatttttaaatagaataaggtctatctattaattccaacccaatcggttttggggatcggttttttcaagcatggccacttaggagtatggtactgctgtaacctaatggtcctctttaaagaggaaaacgattcagtgattattgctgctgcattcgttttatcgcttgaataatttattcggcggcgacgttatctggtcatcattgaatctttttgcctgttatccaaattaagcaccgtgtgtatcgaagacggattgctttcgtaggttcgtttatgttacgaaactattatcttctgccagagataaatatagactcataccaaatatatgtaaacgtatactaataagactcttcctattatgggtatatatactgagagagagagagggcttgagaggttggttgatgtatctatatataagaaagcaataaagctgtgatgcctctctctatatctgtgttcattgtttatttactatatgattgtgtgcatgagatcgtcgttttctactccggatcagcgaatatgccactagttatttaacacgttatcagcacgagttcactcgttccgctgatccgataagcgtttttactagatcaatttgttttcgtaataattagattgatctattgtgtttatacatgtgtctgccgtcggccgagacgatggcctctgtacgtagccgcgcaccgaggcagcccggagcagcagccccgccggtcgtcggcactggagcccccaagccatctgacacatgcgcagatcgcagttgcagcagccatatgccaagcacaaaacatgcatgcccacgcatatggacctatccaaattcaattcactaatgcatatgcatatgtatcggtacaactatatgatctcgtatctaaccacagattgatctattgttttgcatgtccgccgtcggcttgctgatctaccgcctgcgccgccgcgcgaggcaccgcggtcaggcgcctgcacgtccggcactcgtgccggagattgctgtgtccacgcagtcacgcacggagatgtggcgcctgggccgctcgcgcgcaagcttcgcgtacaagccgccgacgcatgcacatgcactagtgcagattgcaaccagccgatgaaccaagaaagcacatgcgtatgggtgtgtgatccactctacgttcaatgcatgcacggatcagcatgcaagatgcacgtagtgacgtaccaatcgatcttcaccaatccatcgtattcttcaacaaccggacgtcatcacgccgatccgcggcgatacgctatgcattggcatccgcggatcggcgaactttacgtcggttaaacgagataagttatcgatttaatcaattctaaaaattagcagcagcgagattaatatgctagatcatgcctctagtcgttttattttctcgcatgaatagatgtatttgtccggcctttgcgccgactcttctcttgttatattgccgaccacgaagttcagcaccacgcgcccgaacgcgcttaccgtgtacacaagaaggtgcacatacataatccgtttaattgaacgacggagtgctatcccaaacgacgacacctcacactcggtaacacacgacaccacctagaagttgtcgtctatctggctaacatagtcgttgatctacgaatatattaatacacttgtcatcgccgatcttatggatcagcgcgcttgggacactgtgtcggttgtgacttgtatgttaataatccgtcatattgttatctgtatgaagtagatggtaacaaatccgagtcattggcacctgcatgcgccgccgccgccgcctgtacgtagcgacacccggacgccaccgcatgatgtcttcccctttgtcaatggttgccgaatcaatccagagacttttcctcgtcgatccgccatctgaaacgtcgactcgacggcctttcgaggccatccgcaatgcaattgacggtcgccgcccgtagcgacgccgaggagcttacgcccgcctcccctcgccaccggtacgcacggcatgcctcccgtgctaccacacgcggccgggacgagggtcgaagccgccgtgagcacccgccgtcgatagccgtccgccatgccggcctgtatgccgagccgagtttcatcgacacgtaacatggagctatgattgtcggacgccggtcacggcctgatgccaacgaatgccggtgtcggtgctactagatgttgcaccgccgctccgcctctgaccatggcaacttcccatagtcgtccatctctaccgagggctcactagcacgtttgccattggttccatccgttgtctccattgaagaatgacaattagatcatacctcacccacttcttgtgggggaaggtcgtaatagcccattaggcaacatctgagatgggctggccaggttttaaagctagccagtataaggaggtgggccaagtagaaattggcctattaaaaggagtcgggcacgaaccgtgatttttgtccgaaaacgatattttatttcaaaagtccttggtttccaaggcattatgcggaactcggaaattatgcggaaaagtcctatgggacattagaaattacggggaatatacattcgccatttatactctgaaccttcatgaattaggtttacgccaaatagagaagaattaaggatttataccttagtcccgtatttataagtatttgctttaactatttagttagtttcttgaataaccataatcaatcctagaaacattgtttttaggcaaaagagcttccatgaacttgtgaaacctttgttttagcaccccttttggaagcattatattttatggtttatttactagcaattgtttgtttggggtaattgattgttctgtgggttagtagttctgtaaattacacatacctttgaatagtagaaaatcatgttaattgctaggattgtaataaaaggtgtgtatagaaaaccattatttactattttatactcgttttgtgcactttatttactagaagtaaaccggtagaaagttgcatagaaggacatcatgtaagtagttgcatgtagcaaatacatttattgcgtaaatgagtaatagaattattcatatatcttctctttgtctaattgtcgccacatttgtagaaggcacaattatatattctccgtatagaataaatatatacacttttcatgaagagagtatacttagagatatttattagtgcataactatcatagaagataagctacaactaatttatattaattgtgtccaagtagatacaatgtcatcgaatttgcaaatatatagacgagaagtctatatgccaatatgccctgcaccaaaattatctatcaaaagactatgtacctatgcagtgtctatagttaatttgattgataatgttatgtgcatcttctacgtataaatgactttacaaatgaagtattgtttttatggatgtatgtacattattttgaataaattggtcatttgcatttgaagcaattttgacctagatgcaacatgtttagttgttagaattgatacacaagaagttgtattactgtcaacatatgcatttgcacgcacatatatgacttatactattaatatgttcatgaagaacatgcatactcaaaatttgtggaaggaaaggaatttggtatatttgaatttgatgttcaactcagggggagacgaatagtaatgacagtaatcttgcattcgttcttttgagatagtattttacaatacacgagttacattatagtttagattaagttcaatatgaagaacatggttaagctcatgtagagcatctttatcttttgctttagtcatagaagcttctgcattagattactgaatttttttttatataggtcatctcaccttacctatattgccttttttttacttgtagtaattctttaaccttttgtggaataaaattgtgaattgtatgtctaacattgaacgtaaatatttgtcttgcctattatttgaagtttttttggcgaatgtattcttattatccactaagcctcaatcaaccatgtaggttgatagttctaagtgcattgacgccatattggcatacatgtaaagtttacttatgcacatgaacaattagaatatttatgtttaagcattgaagcttaaatatatccacccgcaaccacattatttcttttagaaaagttgtaccatgaagttacaacaaatatgtgggtttcacgataactattttgtaaattttcttatgattggcgtgaaaagggggaggaatatgtgtattttgcaaattaatttcagaatatttgcaataaagaagcataagaaattgtggatatgtggcaggcaaattggtgtgttataggtcaaatgctagaagcaaaaatagcccaaactattagcgaatcttatttgggataattatgaattattgtcacacaacgaagtgtgttatttattggccattgaaaattgcatattcatcgaggaagtatgaaattgcatatagctatttgaaagctattggtttacttgtagtaaataatatcctaaataaataatgaccttttggattcgaatgattctgaatgatcaaatgacaccacatttacttaggcgtaatgaataaaagttagatatgtcacccaattaatttattggcatattcaagaagaataaatattctcgtagaataatgtttgggtgatttgaaaagttccatgatggttaaacttgttcatagattaatgttttagtgttatagttatgttcttgaagacatcgtgaagttatataatactaacgcatccatcttatgatcatatctatgttgcataaatataaacatgaagtttattgatccaacttaattcaagaattgagtatagtatgagtaattggatcaagtcttgggcaaataataaaaaagctagaaaatagagtaattttctcgactagtggatatttgtttgggcttcattgtcgcagaataataaccctctatgaattgggataacctacagtattagggatgcgcaatttttcatgccattgcattaattcttatgttagctcactgcatataatatctttaccccctttattttgtattagtgcatgttcaatgaatgaacatttccctcatatatgtaatggactcaaattttcagggaaaatttttttgcgaaatattttaattgcactcttctcgattcttctattgaagtgatcttaccttctgttaatttcttttaacttggatttaaaactttatttgcaaagttaatcgctctcttttaaattttacaaaacctctctatttattttctttaatctctaactttggctctagattatatttcctttgattccattcttgaacatctccaacaaataccctttcaattcccattcaaccatacctagagtacatgaaatgtcgatacctttcatttggatccccacctaaatattcccagagttcataaaatatccttttcaatccccctttgagtcaacatacccaacctttagaatttatcaatctaccaccaatcctgttcgtgtagaaattcccatctacatatacttccaagtccagatctatactcccacaaatatattcccttgaaatcccgttcctccaaattatccatttaagattccacagtctacttgggccaatattttcccgattgacccgactctttgttatatcccattaaccatttgtatccttggggttaaaccaatataactcccttcttgttgtaatttattttggatcagacctctatctaaacctatccccagaaacctttatttccttttaatcgatccaaaatatcctgtgatcaggttcctattttgatccatccaccaatttgattcctatgacttgatcacattcttggcacaagaataatattatcatgattgctcttgtgctaagaagaatatttttccctcttccaaattaatcccctattagccacaaatatttctccaaatcctccctaaaacctaggtatccaaatcttctttaaattcaaattctatccaaatctcctttaaatcctagccaaaccaaaccattcaaattccatccaaaaattagaaaaacatttatttcaatctgggccaaaatcccatcttttcttcccttcggcccattggcccagccgagccccgccccccgcccgaattttttttatttataattttttttattaaaagttttacaaaaataattttccattttgaaaattgacggaagtagtcgcctaccgccctctgggagggcgatttttaaaaatcgccctctcagagggcggcgaaaatgacgtggcagacggccgttcgctctcgggcgacggccgtcaacgaaatttgcaggcggcccccttgccgctctccgctagggcgattttgtactgtgcggggggccgcctgcaaatgggcggcggggggggcatggaattttgcaggcggcccccttgccgccctgggggagggcgatttttgcctctccctctataaagcccagtccctcctctgtgaaatttcattatattcactaaaaatccaaaaaaaacgaaagagagagaggggagggcagcagaaggggagcggcgaagccctgctggttcgctcaattcatcacaagtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacgatgaaggaaatattagatttggtccagatggtgttgatctgtcagattttgtaatgacatctaagggcatcgataggcctgcggagagaacatttcagtcaatttatagttggttgttgagaggatttagaatagaccaagaagtatacacaatgtcagtgtcagttgtagtgagtcgtgcaacagaaggttatttttgggaactaatgccgatggacagcactgatgcttggagacggtatgtggaaatggcttttgaacggtcatggcc

SEQ ID NO: 82276 - DNA, 3640 bp, Oryza sativa
aagaaaaacatgtgcagctgacatgtgggccttacgtgtttttttaattttttttgttaactaggatgccacgtcagcaaaactgggcaaaaaaaactaccgagggtcctccggtgaacggtttgagtgagtttaggggtacatatttctggttttgtggttaatgaacatcaagaaatctcgctgttaaggtgagggacctctggtgaacttattccgaaggggaatcatctcttccttatcgtcttcatcgcatcagttgagctgccagctgagctatggcttctctccgccacggccacctctctccctccggcgccactgcaccaccctcctccttcgcccaactccgccgcccttcctcctgcctcgccggaccacgacctctccgctctcgtctcacccgtatccttccttcatcctttctgctccccctcccattgtcccaatgctgactgcctgaatactactgcttgttcctttctttcttgcaggggtgtacgcgctttccagcaacgatatcagggtgggctccaacctcgaggtcgacggagctccctggaaggttcttggttcgtaatcgtatccactcacaatctcatcttctttggcggtgtttagttcagcgcaaagtttggattttgattgaaattggagatgatgtgactgaaaagttgtgtgtgtatgacaggttgatgtgatggaaaaggactgaagtttggatccaaacgttggatctaaacacagcctttcttcctttctgctagtactaaacatacctgattcctggttggagtctcccagtggatacagtagctttgttgaacatacctcatgtagccacaaatttcattatttcaaggcacattattatctgcatatataggaccagatgggggggacgaaagctgctaccttcatttctttaacacattttaggaagaataacaactcccttttatacaactgcaatccatgttgttcataagcaatgtgacactctagtgctataaaaaacaactattttcttggttgttgcatccactgtttcagaagaattacctcctttcatacctttcagtgtgtacttgagcaaatttgcttctgttggttcgatttttcaaacttcacatatagcttagcttgccacaatatgtgaatgttatttgctttcccaagtattccctgcttttcagatcactcactgctatgtttctttcagttgctagaatggaatggtaaagcatactctagtacctataaaaggagctttaagagttccatttgttacgtttgatttaaataaaattatgtgtttttcaataaattccagacgaatctatatctgtgaaaaaacaaatgttgaaatgtcatagagtattctgacagatgtatatcatttcttgccatctattgctcatctattccattttactttagatgctcgatataagaaatatcatataaaactttctgtcttcatgcaacaacagaatttctccatgtcaagcctggaaaaggtgctgcttttgtaaggacaaaaatgcgtaattatatcactggcaacacagttgacaaaacctttcgagctggaagtacggtaatccaagcagaaactcacctttctaaacctgtagaaattactccctccgtttcaggttataagacgttttgactttggtcaaagttaaactgctttaagttttaccaagtttgtagaaaaaagtagtaaaattttcaacccaagacaaatttattatgaaaatatattcaattattgatttgatgaaactaatttagtattatcaatattactatatttgtctataaatttagtcaaacttaaaacagtttgactttggccaaaatcaaaacgtcttataatctggaacggagggagtaccattctgtgactgtatcagatcatgctttagcttatgtaataaaaaacaactgatatgatactcatcaactctccttcaatgtgttctaacaaagaagagcacttattttgtcacttttgttttagatcccagaggcatccatttcaaaggaaactaagcaatttacctacaaggatggagcccagtttgtgttcatggatctggtacatgtttcagtttttcattcaaacatatcatgaaaagagtagtcgctagctgtctgtatgcttcagtaatcagtatgcaatggaacacccatgtttgaaatttaagcacgtgctaaccatatggtatatggtactatagaaacatatgaattgaactcgctgatttttacaatgtagaaactactggtagaagtatcgtttaaagttttacggacagtcggaagttttacagacagacagtcaagttttagaaacatatgaattaaacttgccgattccttttgtttgcagcaaactgctgccaacaaagaaggcaaagagaatgaatgggtcttttatggtgtgttccccaagtgcataatgttacttatctttataattttcctttccagactacctttgaagaaagtcgcttaaatgagtcagatgttggcgacaggcagaaatggttgaaagaaggaatggactgcaatttgttatactggaatggacgggtatttcctgttttgtttttacataatctgctgtccaaatccaatcaattaattggctgttgtcagttcatatgttcctattttgtttcaaactcttgataatgtgctgtttgattagttatgtattcttgcacagaataggatattggtcactgacattaatatgtcctgcagatcattgattttgatctccccatcaccgttaggctgactgtaactgatactgacccagggcaaggtgacagtgcacaaggtataactgcatgtgaatatcacaattagaaaaaaaatgttttcttattaaagctgacacgatcagaataataatcttttaactgtatattttgtaggaggaacaaaaccagcaaccgtggaaacaggagctgttgtcacagtgccctcgtttgtgaacgtaggcgatgatatcctgattgattcaagaactggcagtatatgaacagagcatagaagagatgagagactagacatcaacagagcattagtttttgtctccccatttttggcccattccctcccctcaccaggtttgactgtattgtttacagcatttgaaccctcgacaggatcaaaatgctttctcaaatttttgtactgcatatgtgcgtacatatttcaccagagcagatgattaatgagccaaacacattgtaagatccatcatccatctcatggcattttcacatgtctgcacactcaagccggggttccgttctgaataacatcacaaggaagctagagttttgctaccgatgtacaccccgaaaatggcacgtgacttggcgacagttgagcaagcgaatctgcagatggttagtgatgaaacagaatgagaagctgttaccaagaaaattctctctatctcaatgcacacatttctgacccttaagattttccatgtcctctaatataagtgactgtatcgtacaaagaagaatgctcactctgggactaccttgtgtgatattggcattgtagtatgaatcctgaagagaaatcctatggcctttccagtgat

SEQ ID NO: 82277 - DNA, 651 bp, Oryza sativa
aaagcagacagatatttggtgctgagacaagtatggtgtatttccctctaacataagaaagctcctttcatcctaagtggattgaaatttatgttatgatgatgttgcctctgatatccaaatagtatgtgaacaaactatacagattaacaagatacacatattgcagaagtctcttgatcttccgtgttcattatactcaaattaacatgttaactcaaaactacatgagtaacataattctcccaaaaaaaaattgatgacataatttttttattaacctcttgctaaaaaatggtcaatgctctctactaaccttgcttgaaaaaaacagataaggacattgttgacccagcgaaaggaacagaaaaaaaatccttcgttatcttaatggaggcaaagaaattctaggcaagcaccattgttgcttgtgtaggttgattgtgatgctaacaaagggaatggggacttcattgtcaagaaaggagatacatattcttctcatttttaagaaagtaaaatagtaaagggagatcattatctaaaaatgtaagagaggcactgaactgtttgtttaacaaaatattattgtaaaaaaccctccccaggaaatcaggataaaaagttatagagtttctgcatatattcgtt

SEQ ID NO: 82278 - DNA, 11849 bp, Oryza sativa
tccttctgtttctttaaaacgagtggattctgcttcttttgttaaacagtttcctagacagttctctctaggcccttctactcccaagcctgtttcagttatgtctcctgaatctcagtctgcttttaaagtcagagctgataagttggctgcattgaaatcgtatcgcagatctaagggtctttgtttcacctgtggagagagatggagcagggagcacaaatgcagtccatcagttcaattacacattgttcaggagttattggaggctctacaacaggatgattcacatcaggaacttgctgactctgattctgttgagacagttgtgatggctttgtcacagcaagctttctctggcactgaatctgtcacttctttcagattaagaggttgggttcagggtattgaggttctgatgttagtagactctgggagttctcattcctttttggatgtttctctgacctccaaactaaaagggattagacctttactcaaatcggtatctgtcaaagttgctgatggtggcattttgtcctgttcttcttttatcccagcttgtacttggtgtactcaaggccaatattatcaaactgaattcaagatacttccattgggggcttatgatgtgattttaggcatggactggttagcttccttggggcaaatgcatgttgactggtttgctaaatggatggaatttgttaaagatggccatccagttaaattatagggtattcaggctcttactgatcaatgccattctatccagggagatcagttacaggggatgcttaagttgggctctattatgcatgttcttcaaattcatcaagtaattccttctcctgcagtctcttctgttcctggtttgcagtctgtgttgcaggaatttcagtctgtctttgaagaacccactaccttaccccccaggcgagcttgtgatcatcacattcctcttctccctcattttaagcctgtttttattcgaccttatcggcataaccctgctcaaaaagatgagattgagaaacaggttaaagatatgttgctttctggtgttattcaacctagtaacagtgcttactcatctcctgctctgttagtgaaaaagaaagatggaacttggaggctttgtattgattataggaagttgaatgctattactgttaaagggaaatttccattgcctgtgattgatgaactcttagatgaattgtctgggtcaaagttcttttctaagttggatctcagggcaggttatcaccagattagattggttgccggagatgaacataaaactgcttttcagactcattctggtcattatgaatatagagtgatgtcttttggtctcactggggctcctgccacttttcagggagctatgaatgatactttagctcctgtattgaggaaatttgccttggtcttcttcgatgatatattggtttacagccctgatctttcctctcatttgagccatctcaggcaagtgctgcaattactttgtcagcatcaatggaaagttaaactctctaagtgctcttttgctcagcctcagctttcttacttaggtcacatcatcagtgacaagggagttactactgatcagtctaagattgaagaggttgtcaattggaaagtgcccacaactgttaagaaattaaggggtttcttgggtttagctgggtattacagaaaatttgttaaaaattttggcatcattagtaagcccttaactcaactgctgagaaaggatgttccctttgtttggtcccctgcagctgaccaggcttttctgtccttgaagcaagctttagtttcagcacctgtcctagccttgccagatttctctttgcctttcattgtggagacagatgctagtgatgggggcattggggtagttttatctcagcagggtcatccaattgcttttgttagcaaggctttgggtgttaagactaaaggattatctgcctatgagaaagagtatttggctattttactggctgttgatcattggagatcttatctgcagcaaggtgaatttgttatattaactgatcaccatagccttatgcatctcaatgaacaaagattaaatactccttggtaacacaaagcttttactaaactgttagggttgcagtttaagatttgttataggaaagggtccagcaattcagcagctgatgccctttctaggaaatataatgatgactccagtgaattgcaattggtttctagctgtgctcctgtgtggcttaaggaagtcactgatggttatcttgaggataacttctctgcccaacttttgactgatctttctctgaaggccaatgctcgaccacctttttctttatgcaatggtgtgttgaaatataaaggcagggtatggctgggtaacaatcttgagatgcaaaataaagttattgctgctcttcatcacagtcctatgggtggtcattctggctttcctattacttatcagcggatcaaagctttgtttgcttggcctcgcatgaaacaacagattcagcgttcgattaaaggctgtcaaatctgtttgcaagctaaacctgacagatccaagtatccaggtttattacaacctcttccagtccctgatggtgcatggcaaattatttctatggattttatagaaggtttacctaaatctggtcgatttgactgtattttggtggtggttgataagttctccaagtactctcactttgttcctctatctcatccattttctgctgtggatgtgtcccaagcttttatgtgtaatgtgtataagttgcatggtttgccttctgtgataatttctgatagagataagatcttcaccagtcagttttgggattagttatttactcgttctggtactcagttgcatctcagtacggcttatcacccacaaacagatggtcaaatggaacgtgtgaatcaatgtctggaaatttatttacgctgttttgttcatgttgtgcctaccaaatggagctcttggttatatcttgctgagttctggtttaatacttcttatcattcagctttgtcaaagaccccttttgaagtgttgtatggctatcctcctggtcattttggtattcgtgaagatgcttgtagtatccctgatttgactgaatggctcacagagcgaaggttgatgactcaattgttgaagcagcacttgggcagagctcaacaacaaatgaaacagtatgccgacaagaagagaagcttttgggaattttcagtgggtgattgggtttttctcaagcttcagccttatgtgcaatcttcagtcgctaggagagctaatcacaagttgtgctttcgttattttgggcctttccagatcctgagtaaagttgggttagtggcatacaagttacagttacctcctgatagcaccattcatcctgtttttcatgtttctcaacttaaatctgctgttggattctctccttctgttcaacctcagcttcctgccttatctcatctgaaggtgccggtggctgtgcttgacagtcgtcagtctcatcgaggtaactctgtggttccacaagttttagttcgatggtctggtgatgttgctggacaggaaaccttggaagatcatgtggagctgcaacagcgttttcctggtgctccggcttgggggcaagccttgtctcaaggggaggggattgtcagctctgctggagtacctgatctgctacaaggtgctgctctgaaggagggtgtcaagcagacttccaaggacaggccagcaagaatgattaaacgtaatccaagggtgtttggaccaaagtgggcttaaggcccaggccagctgtaagggtgtgagttgcatgtggagtgtgaattggtgagagagcgatataactaactctgtaatattctgtttcactcggtaagaaagaaggcggtgatggcggcggcggtgccaatcctgtcggattagtagacgatatcagttcttgagaaagtttgtgtgttcttagttagagtagctaacagaggaaatcgattcgacgaagagagatggcgaggaggattggtaatacgagtttgaatcaatccgcgtgggtttttctcgcgtggtgctgtggagagggtagagaggccggcgtgcagcgctggagaggaggattggtgatcgttctctttttctttttggcagttgccgttttggtgtctgcagagaaagcaagtcgtcgaaaggcagcggcgaaacgcccgaccagctcgtgtctacgctacgctcctgcgcgcgatgcaacctagtccgaccggtgtgtggcagcgtggggaatcaggcgcgtcggggcggtgcgaaaagagttcgttcgttcgttcgatcgtgcattcgtgcgtgcgtgagccgagcgagacgtgactcgtgtagccacatgagctttgccggtgccggcgtgccgagctgcttcctgcgcaccgagctagtcggctacgtgagtgggacgtcgcggcaggcagcaacactgccacgccagcggccgctctgcttcgaccagctgaacacaaatgagcagcgcacgaaagcttccgctagctaggtccacgaacaaaaaccaaatgagatgcatgtggtcgcaggcaacgtgacacgaacaaaatactttctactaggcagtaggcatagcatagcttaacccttaagatttcttaataacatactgcaatgagaattacttcgtactccctccgtcccacaatataagggattttgagtttttacttgttacgtttgatcactcgtcttattcaaaatttttttaaatataaaaaatgaaaagttgtgcttaaaatactgtggataataaagtaagtcataaataaaataaataataatttcaaaaaattttgaataagatgagtggtcaaacgttgcaaacaaaaacttaaaaatctcttatattatgggacggagggagtatgatatgaaaaatacttcttcaccggatacaataaccactccagaaaaattcaaacaaatgcatgccttagtgaacaatctaatgttttcgtaatctgttttttaggagcgtttagtattttttttaaaaaaaaatcagaacagtttatctcttattgtcaagatgtagattgatgaatttgtggcttgcaattttttttctgaactacacgggaacctgccttgttggggatcaaaaagaagagctggaaatggagaccatgtgtgcaggcagggcaacttgacaagtactgagtgattttcactcaaagttgattccaggttccaactttgaggatgcaacagcagaaacaataatcaagaggagcataacaaaaagacaaattaaacctgcaaagttaatttaattatccaggcatgctattaacatactactcgagtactaccgcaataagtgcaacattatccgacataagcataacaaatcatgaaaaggaatagcagcattctacagtcattctcaagaggcaggcgaagagaactccaaaatgcgaacatttgaaagatccaaaatgcctacatccaactggttatcacacgcagaggtagcaccctccttagacaaacctttaatcaaagaaaacacaagttagtcaaaatactaacgaacatgcatgtttgagtgacaggaagtggtactaataatcttgccctaaaagtgcatttgcatggtttgataaaaactacacaaatttctgttattataggataaaaagaagaggaagcgataactgatagaacaacttgatttgagtgataggaattgaagtggtaataatcttgccctaaaaagtgccatatggttatcaggaaataatattcacatatatgaataagagaatatgaagagcaagaggaaataataatctgagactgctgcaagaagttggtgcaaatgtcaggaataacaggatacagcaaaagaaactactagcaggaaggtttaagtgatgaatgtaaaagaaaacatgaattgatgtttttatatgtatccatcttcaataccatgtgtacaattgtgcatattgctctcagtgataggtcttagtgtcttaccaccttgttagtacattcagaaaaattcagggcaacataaatgttctttacatgaacaaaatgaatgtattgcaatttcagcgtatggatgcaagatgcgtaattatacatgacacatattacacggttcatgcggacagtgggtatgaattaagcagcagaactgaactttttatcataccgagtaatgcatatatatatgtgcaaatgtttatgcaaacaaacaccataaataaaagttctagaccaaatttgtcaaaatttaatgaatttcaggaaccatcaagatcaacatatgaatggccaaataggtaggcaagaaactcaaatgaactccaattatttgggattaaacgcaaactgaacacaccaattcatcaaaatttactgaacgcgcatactgctcagaattcacaacaggtcggtaccatgaaaagcagtcttatatacacacggcacagacacatcaatcaacatggaacactgaacacaaaaactagccaatcaaaccatgagatcaaatgcgcgcaaagcggacataatagctaggacatactggtataaagttgctcaatactgtcactacacgaccaataggagcagtacttgaaagttgaaaccacactaccctagtactatgtcccgttctaattagcagatttaagaacattgacaagatgagcactagtagtatcaaggaagtgttgagcgcacgaaacaattacctgcggagagcgcgggcgggagcaccattggaagaaggccgtaaggaaacacacgggcgttctccggcacggtcatcttgtgggtctcatactccaggacctccttcgcgcgcaggtcgacgccgacgagcggaagaaaatttggtgagactgaagtcttacgctcccgcgaaaaacttaatctcttgtgcgacacgtgttctgttacaatctcaaagcagataactccctcaaaccctcttaacgatacaacctaacgccgttagcacgcgagaagacagacgcagcgcgcgcggctacggggagatggacgagcgcggcgcgggagatgaaccggtgctcctccatggagtgctggcggcccggcgccgatgagttagaaccattttgagttttcactttgtcagacacaagcatcagcttctctgcaagttctgttgtcttgttattttgtgtttttgcatatggatattataagacatcttctaatctaatctgatgaaattctgaactgagtgctcaagtttgttcttcttgttctacttcactgttggagcttgttatcttaattcccaatttatataatcaccaatagtcaagtttattatcggagcttcaatagtagagctctgtacttaatttatctaatcaccatatgagctcactgtatgtatggtgcagatgcaactgttaggaatcattgccgtatcgttcaatgtcttaggccgctgccgcagccgcggcatatgccaccatgcactgtccctcaggcatcgccggcgtgggagcttcagcctcatgtcgctaccctagctaccgcagggccaccggcgtcggggctttcaccgccaccactattgttcctcaggcatcaccggcgtcgggccgtcagcactccatcgaggagtcatatctctcatcgtgctcgtccatctccccgcagctgcgccatgcccgtcgtcttctcgtgtgctaagtgctaacgacgacgtgccgtatcgttaaggaggtttgagggagttatctgctttgagattgtgacaggacacgtgtcgcacaagagattaagtctttcgcaggagcgtaagacttcagtcttaccaaattttcttccccgacgagctggtcctccacgaagaagtacaccacgtcggggttcttggggtggacgagcgcgagcaccggggccttctccggcagcccagccgccttgtagctctcgctggcccagaggtcggcgaagctcacggcgtactcaagcgtccacaccttggtccctgcctccctggatcaaccagcgtgtgcatggagaccttggtagtagcaccggcaccgtcgcttgcagagcctatgtccacgcacctgaacttgccgtcgctcagccgcacgcagcggcgggagacgaacgctctctcggcgcagtagtcgcagccgtggcagtcctcgtcgtgttctggcgggagctcgaccctggggagcgggacgtactccatgtgcggctcgtcgacgaacgggtcgcagaagaggaggcccgccgcggtgtccacccagtagagcttgccggcgtaggaaccgacgtcgaagcatctccagatccagcggggcagggggttgttgacgggcttcttctcccacaggccggtctcggacgagaagcagaggagggtggccttgtcgccgccaacgatgaacttgaactcgacgaccaggtactttcccccacctcctggcgcggcgatgatgctcagatcgttgttgaagacgcatccctcagggtcggggaggtagtaggcggtgcgggcggcgatgtcgcagacgaagtagcgctgggtcggcatggtggtgacgtggtacgtgtgcaccttgccgtcggcgtcggtgaaggaccgcagctcaccgggaccaggtcctgggggcggcggcgcgaggaggaggacgagccccgcagaggggtcgatcgcgatgacgaaggacttccacttggcaaaggggctcaccttggccggcgtgatgcgccgggacacggcgagcttcgagacgcgcggcggcgcggcgagctcgagggcgaggtcggcgccctccggtagggggatcccgccgccgccgccgtcgccgtcgccgcacgcgtacacctcccggctcaggatcacccacgacgtcgacggcagaagaggaggccccattcgagctcgctcagatgacgccgcacagctgcttggtgcgagctccgggagatggggggagagagagagagagagagagagaggagaggagaggactaggactagtagaagaggcggaggagctagggtttttgaggagagaaggccaggaggaggagcggtgaccggcgagctttcgcgattgccgtttcgtggctgcgtgcggagaggggcggagagccgaagaggagaaagggaggcgacgtgaacggaaagattcgcggcgaaaggtgtggcaggctcgccgcagcctttgtcagttggtgattgaacgcgcccaaccaatccgcgtcgtctaccacactactactcctgcgatgcgatgcgagcaaggcccggcgctgcgtgcgcccggtgcatcagtgcatggcagcgagaggaccgtggaccggtgaagagcgagcgagacgctcgcgactcgcgagtgcacgaattcgcaggggaaaggcgcgcgatgcggggagttcgtgcgcgcgcgcgggcgggagaggctgtcgcggtctcagctagctccgcggcatgcgtgatcgcctgctcggcccagtagaaatcttcccccagttctggacctcgtgtcaggacaccggtggccattgtggtggcccatacaacatggcccgcatggcgttctggatcaatctcagcccaacgccgaacagacacggcccatgttcaacgagcagcccacaccacaacgccttctcggttccgcagcggcgccaagcacaacagattcgccgagagacagcacggcgtgccacggagacttcagggtcactccagcacgggctcctacaccgaaccaaacccatcccaagcatctggaacaccagagaccccagatggcatcgtagaaacaacagctcaaaacacggtcgcaacacaacactgctctggtttccatctccacatgacctcttcgatgcgaacaactcgaaatccaacctccaaagcgcctgaaccgaaaggcgacgcgctggccgagacaaaccccccatacacttgctgctgtccaatctaatcactccagtaaacaaaaccctcgtgccactgtcgtatccatcgcgcaaccgacagcagcgagccccattgatgagcgcccgcgcattgaaaacgcatagaagctcttgacacggcgccaaacccggctcctgtgagattcgaacagcttgccaaatgccaatccaaactgcgacgtgtactgtaatggtacagcaacgggcagcatggagtagtcgaatgattgatccgtataaaaatggcgcatcatttttgttgaggataaaaggttcagaagcaaacagcaaacatggattagtactagtagtactcgtaataaagaggtcagattcattcattcactcgtttgcattagtatttccatctctcctgctgagttgaagagcaggaaatacttgatccaaccaccccatgggccatcaccatgagccttgaacaatactcctagcttatctcaggagaaaaggcaaagtagcagtactaattacagtacacacctacatttgattccgtcacagacttttcttctctcgatggacagcagacgagcgatctgccctaccggcatcaatggcacggtccacatacagcaaggacaaccaagaacaccgggcacccaccagcttactgtcctccattgccggactggagtgcacagctccagagttaaccgtgctgtcggaggccggcgtcggcggcgagcaaattcagcgctcaaaatcagcaactatagaattttggacacgactgggttatgattgcagctttcctacctagctacagctctacaagccatgggagaagattcatggaagcagctattggcctattgtcatcttcttctcttttgggggtttttacctttacacgctgctcccttgatcggaggtgtcctcgtagtagtatggcgacagcttgccgtccttctccagccttggccttgtggcctcggcgcgcacttcttgcagcatcttgaccaccctgcgcatcgccgggcggttgatcggtagggagctcgagcagaggagggcgatgttcagcaccctgttgatctcatccttgaaggtcatgtcgagtttgctgtcgaggacatgttctacccccttctgatcaattgtgctgcacacccacttcaccaggtccttctcgccgaactctggatcgactggcggtttccctgtcacgagctcaagaagaaccactccgaagctgtatatgtcgctcttctcattgacgcggagtgtgtatgcatactctgcacaaaacaagtacatcagattcacaattctaaaggactaactgaaacttacatctaaaataattagtgagacttaccaggtgcaatgtaaccacatgaacccgcgatcactgacatcgacttggggccccggacagtggcttctaccactttggcaaccccaaagtctgcaacacgggcaccgaattcagcatccaagaggatgttgttcgacttgacatccctatggacgatcgcagggacgtagtcatggtgaagataggataacccctccgctgcatccagagcaatcttgtaccgcgtcgaccaatccagcaaaccagccttgctgctgtgtagcacatctcctaggctaccattgggcatgtactcgtacaccagcaacttggtgtcattgtgcgtgcagctacaccagagcttgacaatgttcttgtggcgaatcttgccaagagtcttcacctccgcctcaaagctgttgtcagctgtggatccttcacccccgttctcaacatccgtccccttctttaaccccc

SEQ ID NO: 82279 - DNA, 5353 bp, Oryza sativa
gcatcatccgacgaggaaggtgatgtaatgcccactgattggacaaatgaggacttctcgggacttgttatctcagaggaacatcatgtaccctaggaatacaaggataacgaggtaattgagggtgctacgtatgctcataaggaggatatgaaggaggcagtgaagcattgggcggtctcattgatgagagagtttagggtggtcaagtcaaccaattatgtgtatgaagtgaggtgcgtgaaagaagattgtccgtggcgtgttcatgcatataagggtacatggaaagattattggaaagttagcattgtgaccgagcaccagtgccacttacaagatgtcaagaagtatcactgcaacatcaccgcaacaacatcactccagccgcaccacagccgcgacttgccactgtcagggacgagtaccccacgcaccgtgaccgagactacttcatgggggtatgtcgaacttctactcacttctggcaatagtttctactcagttccttcaattattttcctactgacatgctgtcttatgtcttgaataggccgacacggcacgagctgtgaacgccgatattacctcgataatagtgaggttggacgccgggctatacttgagtgatgctgagcagaggattaccttcgaccggatgcaagagaagatgcacgctgtcatgcgcgtcttctcttgttgcagcgccatggacgcggtacctccacctggtccagtaccaccatgtccacgcgcccctagtaccggagttgtgcgacctacagctggttcttcgcacggtactgctccgcccagaggttagttcaagtatatatgatttattctcggtaacatgactacgtcctaactaaatacgttacgcgcaagtccccgtctgcccttccgcgcccttgtcggaggcagcagttcgtcacagagatcgctgatccctcgtcctaacacgcagacgcgagggatctttgctagtggagcctcttcctcacacgccggtggcacaggtcctactgtccggttctacgatgacgacttgcacggggcgccagaccaggagatacttgggtcctcacagcttggtggagctccgaaggcgcacacccaggagcagccactggtcacaccagtgcaggagggtcgagcaggccgtgccgtaccaccggaccgtctgacgtactcccagggacacgttagggcgcagggcaggagggaccggggtaagaggcctcggcagtagtgttccacctattgagtggttgtgtgcacttttctttaggcttacttttgctgtgtagaccagtattacttttgctgtgtagaccagtattacttttgctgttagtactacggtaccattgccttgacgctctgctatttcgttccttccacatgtccactgctacaactattccatgcgtacgaagcctaactttcggcgcgtgacggtccagtccattatagacaaagcgttttgtcgagttgtcagcatcaactttgcaccacagattccgcacgtgaattaattactgcatgctcgcatgtgctcgtgtcatcaatacactgcatattaaaactacttacgcatacgacaacaaactttcggcgcgtgaagattggctcctttaggtagcgcagcaaaccacagtacacatataccttggtagttcgagttgtcactatcatctttcagccctgttctcggagataaagtgaatgatgctcacgcgtgcgcgtgttgtcacatcaagtgggccagatgaacaaaattaagtccagttatagcactagttgcggccctatataatagacaagccgaatacaagctcttcaaatcatctttcatcttcccacacatctagagagaatggaagctccatttcttgagcgtctcaactagcgaagcgatcctttcgccggttgatttccaccatggtgtgaccggccgttatgcacttgtggggatcgatgcatacttaagtcaagcctcatggtagaaactcggggcaggagattcttccaatgtgcaaaccttgatcaggtatcattcattcgttacaagttcaattaactatactgaacacatcaaaagctaacagatttctactccatcataacatcttacacagacataccgtacattgtgcaactacattgagtgggtagatacagagaacccacaaaatgacagaacacgtccatatgcacgtagtgaatcaagatcggactacctcaggcggaaggatgagcatgaacgtcagattgctgcggaagctttagaatggcaagtaaaccccctaggactccccacatggcgggaacgtccagagtgtcgttgtggtgaccgttgtcaggtgataaggtccgtaagacaacgaactcgaggacaaagatgcttcgtgtgtcctaacattgacgacgacgatttcgtcgtaagtatcttttttttgggtaccactaatcactactttcatgcacttacctctatttacacaaattttaaaataggaggaggttaggaaatgtcaattcgtacaatggatcgatacggtcagagttacttccattggtcaaacgataacgcaacctgagacgaccacgcaattcataacaggcatggatggagtacgaacgtcaggtacaaattgcaagcttagactggaggaacaatccattaggtttacctaaatggtcggagcgtccaaagtgtggttgtagatatcgctgcctggtggctacctcgtttgcagaacaaacaattggcaggagatactttgtctgccccaatgtagacgacgatttcgttgtacgtataacaaattccaaatttaagtagaatctgcttattattactatcctatctgaataactatgtttgtttctcagggcaatccaaggaggtgcgcattcattatggatcgacaatgtcaatcctacatatgatggccaaaagataactgagtctgaaacacaggtagagtactagcgagagaaggaccatcaaaatgcaatacatgttgaacgacgcggaaggagtcggtagataagctcaggctcaatttgtcaggaccgacaaatttgtatcttttatccatgctatcttgtcattataatgtttaattactatgttgtgctgttgtatgtgtcacgaattataatttaatgtgactatatcattccgatttctaaagtttctttgacgccatgatatgttgtatccttataatttatatgtacctgcttatatttttataacttccaccttcaattgtgtacatgattcaacatacatgacaattatgcgtaacttgcaatttataggtaacaaaccccctcatagccctccaatttatatgaaaaattgagttattaaaattttgtcaaaatgcacgtactttgttcgtttcaaaatgatactttacctaattttaactgctaaaaatcaggtttatgtaaaatacctatttcgtaaaattttaagtgcaaaatagttagatttatgtagtttgaaactattccttcttcgacttcgaaacaatgatttatgtagtttttacagtaacaattaaatatttcggtgtaaaaacaccccttgttgggctccaaaccgccgaaacaacgtaccattcaattctaataatattttttcttgtttcacaattttaaaagtgatgatttactaaattttctaaatgcaccgagctaaacacctaggggctactcttaaagctggcggcacccaacacagtaccaaaccgcccttcataagggcggcaagggggccgcctgcaaaaaaaacagggtcctcgccgccttttgcaggcggccccccgcacagtactaaaccgccctccgtaagggcggcaagggggccacctgcaaaaaaaaccagggtcctcgctgcccttttgcaggcgccctcccccccccccccgcacagtagtaaaccgccctccgtaagggcggcgagggggccgcctgcaaaatggcaggccgcctatagacggccattagtcgtgcgctaacggtggtcagccacgtcacgaaaatcgccctttgggagggcgatttttaaatatcgccctcctagaggacggcaggcgactagttttgtaaaattttgaaacacaaaattacttttgtgaatattttaataaagaaaattaaaaataaaaaaattccccgggtggaagtgaaaggaataagttcaccggaggtccctcaacttaacagcgagattttttgaggtcccttaaccacaaaaccagaaatgtctactcctaaacttactcaaaccgttcaccggaggtccctcgacagtatttttgcccggttctgctgacgtggcatcctagtcagcaaaacaaaaattaaaaaagtatgtggagcccacatgtcagctgcacatcttttttcttctccttctcttctcttttcgcttctctcctctctattctcctccaggctggcggcgggctcagccgcgatggccgagcgcggatgcgggcggccggcgagcgcggcagcagagcggtggcaggctgtgggcggagtggacggcgggcgagcgcggcggcggagcggaggctaatgggcagagtagccgcgtgccgtggccgccgtggtcgtcggctctccaccgtcgtcgtcgccgtgggcgaggctacacggcgcggccattcggcggcatcggccaggcgtcgcagtggccgtgcataggatgctcaaagtgccggctgacgatgcaccctagtcgctcgcactcctcctgtgccgcggcagtggcagtggtggcggtggcagcgccgctagcctgatcccatggtcctcccggacgcccagctcgcgcagctgcagcaggagcgtgtccacgctcggcgtgccatcggcgtcgtggacggtggtcggcgcgggcgcggtgaccctcgtcgtcttcggcgacgtcgcggtagcacttgacgtcgtagctcatacgcatatacgccgggtacagacggccgcgtgtacatgcgtcttcgtacgagcatatatatgcatgcatggagacaaccagctatagcctagctagcttcttgttggtttgccgcccgataacatgcaaccgtatatattagccaagcatgtgtatatggctgagcacactcacatgtatatatgccattacgtgcagcggaggagcacggatgcggggggcgagcgcggtggccagcgagtttgggagggagggggaggtggccggcgaccaagaaacaatctcttcctctgcctcttccccttctcccgccggtggtgcctctcctagcatcatcggccacccgcgggggcacagcggtggtggcgg

SEQ ID NO: 82280 - DNA, 18615 bp, Oryza sativa
ttcctgcagccccgcaagtgcgtcggaagtattcaagaagattaattgaaaaccgattattgcaaggcaagtcacacagatcccaaacacaattcctttgagcatgttgatcctatatttaaattctctatttatttcaactgtgcatttattttcgaatgtcaccgggtggtgtgaacctattcctttggtatggccactttgtattgattaccctattcttcgatacctttggttttaattggactagttgtacttatataatggttcaactagatgtattagacataattgcttagccacgcttagaaacattagcacgcaattaggataactaatgtttcactattacttaatgatgggtatttgatgatagctcacgatggttaatcgtgattggttaattaattaatttgccaactaaaacttgataatggtgggttgtgggcacatggttttgatggtcgtgctcatgacaattaaggaccagttcacgagtttcgattgtgaaacattaaacgtgccaaccacaagccagcatgggcaacggctttaccttctgtatagcatggttcattgcggagcaccagactgagaagtggtggagataagcccacgggggtcgctggggagtccatgccttgtttgtaagggggtgattatgatccaggaacggtgcgctgtggtggattgtgttgtgcgaggggtactgtcacagctcctttctgagatacccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtcccacacttctcaccatagtaaatgatgctataattggtaataatttgattagctcctggtttggaatggtacattcctggtttggagatagaactgtgcagccgggatggttgtccagaatggttgggcctatacaacagggtatgttgtatagcgttggattaatattgtttaatacttaactgttttattaaattctcaaatgtttgttaaatgctgcttttgcaaatgaaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcaccgtttatcttatttttccactgcttagatctttattgtttgagaggaactatctacctctgtaatgacattttattcgcttattaattagagtaataattgtactctattatcaatttgttattgtgtgcctcggctgattcctggacgagggtttacacacatgtaagcgtttggaattttggatagaaattccgggcgtgacagttcgtcgctaggatgggagagcgtggacaacctttcttcgctctgctgaagaaacaagataaatttgtatggacacaggaagccgaagaggcgttcatcgcactcaagcgctacctgtcaaatccccctatacttgttgctccccaacctaatgaagaattattcctctatatcgctgccacgccatattctgtgagtaccatcattgttgtcgagagagaaggtgcaaaggccagtttattaagtcagcgaagctctccacaatgcaaagacaagatacacacagatccaaaagctgctttacgcagtaatcatgacatcaagaaagctacgccactacttccaagcccacagggtcatagttgttttctccatccctcttagtgaagtcgtgagaaataaagacattgtcggccgcatcgcgaaatgggtagtcgagctaagctagtttgatgtccactttgtaccacgaacaaccatcaagtcccaggtcctcgccaatttcgtagctgactggactatgcctgaaaacaggctggacagtcaaaccgacagcgaaacatggacaatggcgttcgacggtgcactctacagccaaggagcaggggaagggttcatcttgacatcaccttcgggagaccagttcaagcatgcaattcacctcaacttgaaggcgaccaacaacacagccgagtacgaaggactactcgctgggataagagcagcagccgcactaggagtcaagcgactaatcgtgaaaggagattccgaactagtcgtaaaccaggtgcacaaagactacaagtgctctagccccgagttatccaagtaccttgcaggagaaaaggtttgacgggatcgaagttcgacacgtatatcgcaaggacaacatcgaactcgacgacctagcacggcgttgaagcatctaggcccccggtgttaattttggtaattaatgacaagcgctaattgtggactaaccgttgtctttgagctatacattttaagttaggtccacgtcatatgtgcgcatggatgattattgatggattaaaattgacggcgcaaagcaaagggaaagaagacggtaaaactagcacttttatttagaattgatcgaggtgtagggcgatcaaatttgctagtttatttttagtttcgccgtactattaagaggggtaatgacctagcaaagagatgatgttaattgccacattaggtcattatacatttagacttgtgctcacttttcacacacacacacacttcactgggtttggcctgaccaggggcggtcagagcagccacatagtggcggtctgaccggcgccacaatggcggtctgaccggcgcataaggccagtctgaccggcaggacatgcgcggtcagaccggccccctggtggccgggatggtgctgctcaggatggccgatacagagccgagggaaccgtattctgtcagaccgagctgatggcggtctgaccgagccgaggccggtctaacaggccaccccttgtcggtctgaccggccaggccgatggggccctctgacagcactacaacggctagttttctagccgttgctgagtagcacggtctgaccggtcacatacctccggtcagaccggcagagcacagagttgggggatttcgcccaacggctagttttggtgggtgggagtataaatactcccccaccagcagcaagggggctcttttggcacccaattcaattgcatacaccccttgcacctctctcacacaccattgagcttagtgttcatccattgtagtggttgaggttgatttagccaagagtcaagtgcatttgcttccattgtagagctagtgtggcacttgatcatctccacgccgggtcattgcttgttactcttggaggttgccgcctcctagacggcttgtggaggagttgcccggtgacctctccgagaagattgtggaggaggcacggcgccggtttgtgattggtttggagttcaccaccttcggagtgaaggaagaactaccctagtgatcgaggcttgggtagtcctctccgtgggccggctgccgccgtgcccaccccttgacgaagggggcgtgcggtggcttcgtggttgagcggtggagttgggctcacctcaacggggagtaggaaaccggcgagttttcgaacctcggtgaaaaatatcttgtctcatcgtctcatttgattgtcgcatttacatttgtgcaatttacatttctagagacattcttgagatcatatcaccctaggattgctaaacattgacataggagtgtgatttactttcctagagatataattgagccactatcaccctaggtttgcaaaatataacttagttgcttagttagagttgaccctcaccaagcctagcaacttaggttagttttgattaggtgtcatttaattttaaatcgcctattcaccccccactagtcgacatctcgatcctacaagtgttctcagagcttggtctctcttgattgggctttccgcctagagagaagatgtcgaacgaggtgaaccatgtagggaaggctcccatgtttaatggcacaaactactccacttggaaaattaaaatgtctactcacctcaaagctatgagcttccatatttggtaaatgacgaagatagcacagtcgtccccgacatcagctcgggggctacaaaagcagaacgcgccgttgccgacattgagaccacagacgattggcggaccctactcatcaagttcctgagtagtgacgagttgccggaggacgatgcagaagccgaaaaaataacccgtcaagccaaaaatctactgtatgattggcgacgatctatacaagaaggcgccaaacggggtatttctcaaatgcatttcatcccacgacggcaaacatcttctcctcgacatacacgaagggatctgtgggtcacacgccgccggtcgcacattggtcagaaaagcttttcaacaagggtttttttggccgaccgccgtcaaagatgcttgcgacatggttcagcggtgtgaagcctgccaattccacagtaaacacacaaggctaccagcacaggcgctccagactatccctcttacttggccgttctcgtgctgggggctcgacatactcggaccattcccacgaggacagggcggatataggttcctattctgcattaaagggatattctgcatcataacagacaacggctcccagttcatcagtgtcgacttccaggattactgcattggattaggcgtcaatatctgctttgcctcggtttctcaccctcagagcaacggacaggtcgagagggcaaacggcatagtactacaagggatcaagacccgtgtctacgacagactcatgtcacacgacaagaagtgggtcgaagaactcccctctgtcttatgggtcgtgcgtaccacaccgataacgtccaacaacgagacacccttcttcctcgtgtatggctcagaagccatgcttcccacggagctacgacatcagagcacacgagtacagaagtactccgacaaggatcaagaggggcagtgaagcgacgatgttaatctactcgaagagcatcgagaaagagttgccgtcagagcagccagctaccaacaggccctttgccgataccacgagaagcacatcagagcacgcacgctttcgatcggcgattacgtccactgacgggttcaaagccaagcagggcgtaacaagctctcacccaagtgggaaggaccatacacgatcacgcaagtcttgtggccaggtgcattcaagattgcagacggcgatggtcgcgagttagcaaattcatggaacattgatcaattacgtaaattttatgtgtaaatcaatagtatccatacttgtaagacatcttacgacttcaaaaaaagttgattttaggtaaagactacaatcaaagtgttccttcccgacgatcccttaccacgacgacacatagcgttgaaacctatcctcatgtccctttacgccgtcttgacaaggcctctgaggaacctaagtgaacttcggctggggacgcccaaagcgggtaaggccttgtcggatcatgtagggacaaacgactatgtaagatctgttcatgtaagagctcttgccgtgcgtattaaccaagccgtgtaatcggaaactgagttttccaacttcacggctaggggctagtgtcggtgacatgggaccgggggtatcgtgactagaggcttgggcagccgcggtcacccacgtggcctgaccccctcggggggcgtcgggcccgagggtgacgtggccacccctccctctgtctccccgaggggtcgggccgctcccgtttcggccccgagggctggggcgccccgaccccccgtggtattggcgccacgtgtgcgggttaggtgagcacagcggcgctcacctaaccgcatttatagcggattgaacgagcgcgtcacgccgcatttaatgcggcgcagcgcacgtttatccggtccgtgaccagtcgcggtgtgtgaccggtcacagaccggtcagatcgcgggttaggtggcaacaggcggcctgtcacacgcctcgccccgtcccgtcggaatgatgggagcttcctggctctcgtccctagccggagccggcgtgctaactcctggagttggtatgtcagtcccggtcagattcattccaggcttcagcgcaagtatggcaaagggggcctgcgcggtctcccggtgaggagccccaagctccgtcagctaggattagtgctttttttcaaccaaggcaagtcaagggtccaagagccttatcctccaagaacgcttctccaaagacaaggctgggggctagggagagtgtatgactcaaaaccctaaacctaaaccctagtcagatagattccttttctatttcacgagtacttcttacaatttataactactccaaaatatattacatgtctccttgaagataatttttacaggatacaaagactaccaggatggctaacgccaatccatggattgaaagactttctcggcaagcggcgccattgacttcgccagattgtctatctctgcgggagtcctccgagaacgtgaaaacccttcttggaggaactcgaggtgcagctgcgggcggtgatctcggacacaggccagcacgtgccctccggcatatcggctcaaccgacgacactcctgtttcagggcctcgtcgatatgcttgccgatgacttcaagctgagtgcaggccccatttaaccatgagatgtatccagccgccgactcctcgggattcccgcgaggtactcggagctccctacagactccagccatcgccatgcagcagctcctgaggtacgagttgaaccacacctcgcgacctcggagggcttccacggcctgctctttcttcacttccaccatagtcctctcgagttcggccaccttgaacttcatcctccaatattggattcgatgatctcggtcggccaacacactctcgaggtctgctcaaacacggaaatgactaagtcgagttgttctcctctttcgagaacacggcaaattaagtcgatccgaacaaaagagtaaaggagatgaagaccaaagtaccaacctaaggaagtcatcaccatgtccgcctccacggacaggctttgatcgacatcgtcccgcggcacgtacggcttaagcacaagtgccggaacgactaccggcaactcaagctgcccgcgttgctggacatcctcgatatcaacatctctacatttacaacaaagtactcggaatcaacatgctaaagaaaacgaaggaaacaactgcatacacaaaagcagtttgaacctacgaaagttttacaagcataatcgattaaggagtacaggggaaataaaatcctactcttcaaaaacggggagaacagactaccccaagtcaccgaattcgtccatcacgcccttgcgcgtgtcattggcggccccctgatccaagatcctctggaggtcgatattagggtgcgccaacctcatgcacgcgaggacgtggctcgccccggtgtagatcccgttaaacatctcctcgccgatcctggccgcatgcttgcaggggatctcctccatcgccgtggctagttccgtgagtgaggacgtcagcgagaactcgtcagggttcaccgtaatggtgctcgtgacgccgcactccccggcgagctggtgtaggccagtgtaagtcatccgcagcgagccgcggatctccgacaagttgttctcgagctccgacattcggtgctcgagtccttgtcgctgccttttgttgccggtcaccagctccctcatctttaggaggtcctctcgaacctccgccaggtcacgtgctagtttgttggcacgctcgttcgccgacgacgccgctaccctggcctcctcgatttcatgtcctacgccgcgagcacttgccgggagaatacgctccatctcggattggagctccccccaggtgaggacatcagcaggcgcgccccgagcgggtaaaaggccaccggcgaggccgcttggcgtcacctcccgctccctggccacgaccacgacatccgtcgaggccgctgcaggggatgcaatggaggctgcactggacccgtcttgcgcagcctttcgcccgcgccgccctgcgcaaaattcccacgatttcatgaagtcaggcaatcaagactttgcaaataggacgacttctaaagcatctacttacttttcgccgagcgtcaccagcctttgccttcgctggggtgggggagatgcatccatggcctaaacaagatagcacgatatgaggtcaaaatattctgactacatgaacgaaagacaagagaggcttaccgacggagtaggtgctttccgacggttcccgagtacggaggagaacatcctccccttcttcggaacattgctgccactcgtcgttgcagcagcagcaatgtcggacacctccttggcgacgccctccttcaacgacgccgccgcctggtgatccgcaagcggtccgatgacatccgttagagggagagcctgcgtacatgaagtcactatgcgctcccaataagacagaagtaaaggagtcaacgagtacactcacgttgatcccagcctcgtgttcgaccgtccccttctctcaaagggggacggggatgtcgctcgctgtcgtggggccgctgatcatcacttgaccgacgcggcgctccacggtttcgctattcaaacctgtaagatcgacaaacagaactcgataagtcaggaggaacatgcaaaggccgggtaggctcgggcctggagcggttggatccacctaccgatgaagtcggcagcaacttcataccccgacaaccctcgtactcggaggtcatcaataatgtcgattaaagactgaagggagggagttagggcgggtttggcggtccactctagaatcttgtctggttgctcctcaggaacaacagaggctggatccgagttctctatctgaagatagaaccaccttgcccgtcatttgctacgagaagaggggcactggaaggggatgtatcgcgacttcaggccatcccgaagtcggaaaccgagacatccagataccttttttggttccgtccagcgcaactcgtagtaaaagcgaaagagatcaagaaatgactctaccccaatgtaggcctcacaaaggtaggagaaaatgctaaggaatgcgatagaattggggttcagatgaagcaaggaaaggccgtagaaattcatgacaggaagaagaaactcggagggcggaggaagaaaaccacaaagaatgtaatcctcaaccgcaaccatgcggcccaggacaggttcgggttcagtacctcctagttcgctctccatgatcccgcgaccagggagggcaccgtcgtcctgcagcttcttcagggacgcgttggtggaggtggacttgtcgaaatccatcaccgccgaagatcgccggagaataagaccgagatgagcaaactagggttttttttgcgggagcggagaagacgaggggagcttgaaggctagaaagttttgcggcaaacggacttcaaaatggatccctaaaacccctttaaataagcgcactaccgacggtgcgaattccaaggaaaggagagagatggccgccgaaaatttctgggtccgttacgcgcagcagttttcggactacaatttaaatttactcatgaccgttgaacttcgtacaatgttatcgataactctatgtctctacggttctcataccgagatcgaccagttgagagcgataacgattccgacatccgaagtcgcgatcggtcacatgagttcatttaagcagaattcgggggttactgttagggttacggataaggtatacactctacccttggatgcatgttgtataccgatacggtatacctgcgcatatactgatgtttcctgtacatgttaaggaaatccatcacgtaaaagaaacggagtccacggatggaaggagtcctactcggacagaattgggtcgttactatattgtgtgggtccgatatctccgagttctacttggagatcgactgacccgtggtataaaagggaccccccgggaagaccaaagtgatcgaatctcaccgccaacacaaccgccacagcctatgaagtcggagcctacaggagccaagtcgccgggtgatctagtcgaaccaactcgactacggtcttgtcggtatcatcgagttctactattccctttgtaatctgtggtttccatcatataatcccgtaccaactgtattagggctattacctatcaaggggcctgaaccagtataatcgttgtcttttatttgcttgatgtcgtattacgtagatcctcgtaccagcgtaccccaataccctctatatccggtctacgggtatccccgtcgacaacaagaatagcaagagagagatgaggatacgtacgaggaggataaaaggtgggatgctgacctcgggcggttagtaggagccacaaattggatttgttccccagagaagcctagcctggctgtctagtgagctggaggacatgaacggctaagaccctgtttagatgggactaaaacttttaattccctatcacatcggatgtttggacattaattataaatattaaacatagactattaataaaacccatccataatcttggactaattagcgagacgaatctattgagcctaattaatccatgattagcctatgtgatgctacagtaaacattctctaattatagattaattaggcttaaaaaaattgtctcacaaattagttttcatttatgtagttagttttgtaagtagtgtatatttaatactctaaattagtgtctaaacatagagactaaagttaagttcctggatccaaacgccacctaagccattgttgtcactattgccgttgttaccgtcgtgttgtcctttaggatagctgcgcattgcagaacccaacgtgacttatgttatgaacatattcttcaagccaagcgttggagccgctgtaggttgtctctgtagagccacctgctgttttccatacctctacttaagtagggggagagtgagaggcaaagaaatagatcgagagagagagaaagaggagaaaagatgaagagatttagagagagaactttcatatatttttcccttgctaggttcggctaggctaggctttgtgtcggtgcatttgaaaaaatagggcgacatagtgttggtttttaacacggaccgtgacctatcacattagtaacagattttttttctataaactggcacttatataatcttattaatgtcatttttttttaccatccaatgcacgctcgtgtcctagggatggacacctcgtgacttttgtccagtcggcattgattattgttgttgcttcattattttccaacatttcgatccaagtggatacaataatcgtgcttgctatatccgaggaccgtacgtgaccaccaatcatccactggggcaaaacgtgcagatttatatagacgacaaatactacgcttcattgtgataagatattattgctcctgcaacaatctaacgtgatccaaagaatcaactaaatcatattatattatacatactaagtacgctacgttgtgataagatatttctctgcaacagaagccatcgaacgtgatccgaagaaacaactagataattaattgtatcaaggatgcactccatccgtagaaaaaatatatatttctcgagtatcgtcaatttatcctaaaatgtagtaactggttctccccctacctccaaatctcaatcagccataaacatctactatttaatttcttcacatagtttatcttctgaaccaatcacaaattttcacgattcaattaaaactgcttatttaattatcctaaaaacctatagaaattcttatattttagggagggcttggacttctgatctttgttctcctaacgttattggcaaggtctccagatttttgatttgcatgttgaagatctgagtagaaatttggtttgcatgttgaagatatgagtagaaaagttcttataattttgttgaaagtacttgattttgaaatcttaattgtaatgtttttacttaaatatttgatgttttgagtactagaaactatacaaaaatttgagttgataggttaaagttacatgtagaatgtattgaaattataagttataaaattttggaaattgaaaatgtcaatattttcaacatagtttttaaaaatttcatatgaaactcagatttttgaagataaatatgtattgttattcaagtaagagtttaaaagatgttgaattaaaagtgtgagtaagcaagctttgaaaatgaatttccttgggaattctaagcgcacagcgagcactcatgaaaaggggaaggcgatcaaatgaaaaaaaaaggatgaggtcattcgcaagcaactactactcatcctaatcatacgcatatcatttcttcatatataattggtgcgcaataaaggtcatttttgtgctataaagctcaaattctgtgaagccaagtcatccacgaaaaattaaccgtcggatcatttgaggaagttattctcaaccattcgattatctccaatatgcttctttttatggtccattcatttgattaggtccattggaaattcttattcttctcagcccatcaaagaccaggcaacgaggtatggagttgttcgatctccccatgtggggctacaagtggtcactagggacgtaccaatactctgttgcttcatctccatattagaggatcggtcgacatctactagggcaatcagcggtaataactatttgtaccctgagaaaaatccctcattcttttcactaagctctttatctgttacactaattctgctaaacaccacgatgctcataagtcataacgtctcgaagggaggtgaagcagcctgcggcggaggcgtacgtagataccgctggctatggcgaaatctcagccgacatgccttgccttcaggaattgacggagctgctgtaacagagagatcgatcaatcttgtttgtttctgacttttgcctaatagattgaaaaaatatggttatataacttacaagagtaaaaattccacaggtgcttttcctatctaatcagataaattgaggtgtacagatcagctaagttcctcctctctctcgctctctcttttccatttttactgattagtttatctttacagtgtcagaggagtaagattattaaggaatgtaagatcaggcaccattgtgcaatcatgcaaatacatgtgtattcggtaaaagaacaatgatcattggcatcattttccattacattacaagacattgtgcttaaggttcagcgctgtacatctaaccaacccctacatgagtctttttttcctttctatttaattagttattaaacttttttactaaattttacaactagagggctgctaccccatgagattccattcaaagtggtagtcacaggataattaaacaactgacagatttaatacacatctccttttccggtccgagccccacgcgattacacgacccccacctggctccgcgtccgcgtagatacatcacctgcggcaccacctggctcagcatcgcgccagcggcgcggagcaccactacaactagccgaagcagtagtgctctctccctccatgatcctcctaggtatcgcacttcctgcgtcttgaaccaatgcttgtggagacaatgacgttggttgcggcagtagtaagaaacaaggaccgatctgaggggaaggaagaagaggagaagagacgtgtggtgcttgatacttgatacctcacagccatcatgatacctgatacttcgcagccagccatgatacctcgcaggtaccgagtatcaggtttgatacctttagggtatcaaccatgataccataggtaccaagcatggtacctagtatcagccagccatgatacctcgcaggtaccaggtatcaggtttgatatatatgggtatcaaccatgataccacaggtactaagcatggtatctacaagtaccaggtatcaggtttgatatatatgggtaccaaccatgtgttgacagaaaacacgaggcctgggagatctgcttaactacagttcaggtccaaagctcgccttcggatgtatgagcgtgccagttgatttgatcctgcaatcaacaagaaacaaagacaaagaaaccgtagttaaatctataaatgatagcggatcggctgtttgccgatgacatatcatttatctctgagccgatatcgtatgtgaatcgatcggcgatcatcaataagtaacaaaacaccaaatctactagatcggctgtagatatcaacaatatataatctttatatcaatatacacttaaatcaagtgattggagtagatcggtcaccataccgagacagtataaatcacttaaatcgaaatatatattaataacgagattatatatatatgtttgtagcatagccgatcaaatagatctagcatgtatcggctaatactccgataccgctttatattaagatattgaagcagataaaatactcaagcagatgcttaatatacttagatgtgacaagatcttaatataaagggcagatttaacatgtcaatgaagcatataaagcaaatatggtcgaatcagattagatcggctaaaactccgagactaccctaatcggcaaccagaaggcaggctagagattgtaattctaagcacgacttaatagatcaaactcaactgatgcagcattaagtatgaaaagaaggacaatatctagacaatcaaaccgctggatgtttcatagggtggtagatatcttatataatctgaattaacatcgaaatctaacctaatcagctgccttccttgatagatgttagccgattgtaggttagatgacgatattgccagagatcacgtaagatatacgataactcgacgaatcacataaacaagattagagtatcgtaaagatggaagcactaatcccgagaacgcatgtcatcataacaagttttatctcttgttgaagatcgaaaccgatgcagctcaacccgaaagcaagaactcgtcgaaataaaattaaagcaaaaggtggcgatgtgccgaaattgtattgaacgtgtgtgttaaaaattacataggtctcggggtctatttatacccgagaattacaagatatgcccataccggacacgactgttatctctaacaaactctaagatatcataagtctttgcggaagacttttgcccacctttatctataaggaatttacataaaatatcctaattaatagatacaattgcctttccaggactctatccgtgcgtggcaatcatattgaagtacattaatttgaacccaatgtcgtatacaagtcgtattgtcggaatcggctgaatcacttaacccaatctgactcagacttagccgatcctaaccgtagccgatctagactccagccgatactcattctgtttccacgacaatcctcatcttcgattccgcttcgatcccatcttcctctccgatgctgacactaccaaatttggttgttaacacatgccccccaagtccgggatatttggtaatgttccgaatttgtcatgtaccgtctccgagtaagtttcgcactccgccattattgaccgttattccagcgctttaaatactaaccgttcccctcgagaaatctcacgccgtgacttccgttttcaccgctcaagcaaaacttcttcctctctcttctccggcgattcctccggcgcaaaggcgatttccaggcgacttcctccccgacgagatttccgcccgcagcgatgtcgtcttccgccggcccatctgatgcgccatcagccgagtacgctgaggtaagttctcatcggctaaatcccttttcccaagagtagattgattttctcttgtctcctattgttctcttcttctcggtcgctttggatttgtagcacctctccaacctagttgcgattcccagcttatcgcatgaaaaccactactttctcggcccaatcggcaatcctgatccaaccgagttcattatctgtgaaaccaataggattctgttaagattaaccaatccagatccaggtcactggaaaaacacctttaaatcttggccgtctctagaaaaaacttccctcgagaaaagttggactacatggttcatgcgtatgtcggctagcaaaagagttcactgggacgaaattggaatcggccaagcacttgacctaaccatagcaaactcagccaaggatgaacctctcatggcagctgcctcttatttctggtccaacactatcaatgccttcttattcaaccaagggccgatgaccccaactctcctagatatcatcatgatcacgggtctggatatcacctcatcggctaaccctatgagcttgaacataaagaaccaatatgacttcaagaccaagagcataggcggctggtcaggttatgtagcagtatatatgggccaaggttcggtcaccccccgagaaccttttcaactgttgatcctatttaaagctattgttttgggccgactttcggcccaaagccaaaaaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttcaagacttttaaaattatttctaaaaattccatttaaacaacaatttatatattttgaattttcagggtgtgacatagatgtacagtaccgataacactggaataaattttaaatgagaactattaaaagatattatgaagtgcatgtgccattagtttggtttaattaaaagagaaagggaggagaacagttctacttttccaatatttttagagggcttctatgagtaaccatttggcataacctagggtcaaggaggctctgataccaacttgtcacgcccataaccacgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattacagggttttagttggcacattaattaattaaccaatcacgattgaccatcgtgaactatcattaagctatcattaaataatagtgagtcataagttatcccaatagtgtgctaatgtttctaagcagggctaagcaattatatctaatatctagttgaaccaatatacatagcccaactagtcaagttataataacccaaggtatcaaggaataaagtaatcaagaacaaatgggctataacaatgaataggttaattccacccaatgacattcgaaaataaatgcaatagttgaaaagaaacaatagctttaaacgggatcaacatgctcaaagggttgtttgggatctgtgtgacttgccttgctggccttggaactcttcaaactcttctcctgcggaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttgaagattaaatcggattaaaacacttaaattgattttaattgacttatgacgcaataatgaattatttttgaaaaggaaaagaggatttattgcgtcagcggctagggtttcggtggaccgggcgcacggcggcggttcacgcgaacggacggccgagatcgacttgatccaaaacggacggctgagatcgatcggtccacgaccggctcacggcgaacggccccgatgacgtcagcgatgacgtcaccaccggcggcggcggctcggcggctcgggcttgcatgctcgctggcgaacgacggcacggcggcgcaaacggaaggcaccaacgggtagagcgcgacgcgacgaactcaccggtgaccaaaagagcggcggaagatcaacggacggcgacggcgacgacgaagaaacggtggcggtct

SEQ ID NO: 82281 - DNA, 9260 bp, Oryza sativa
ggcttcgccgctccccttctcttcctcctcacccctccctctttctctttttctggattttgagtgaatataatgaaaattctgagagggggaaggggttttatactcggaggggtaaaaatcgccctccctaagggcggcaagggggccgcctgcaaaattccaggccgcctcgccgcccttttgcaggcggccccccggacacccatagagcggccttcgggagggcggcaagggggccgcctgcaaaaaaccaggccgcccttttgcaggcggccccccgcaccgtagtaaaccgccctccgtaagggcggcgagggggcctcctgcaaaatggcagcccccctatagacggccgttaggcgtgcgctaacggtggtcagccacgtcacgaaaatcgccctctgggaagaaaaaatcgccctcccagacggcggcgggcgactacttttgtaaaattttgaaacacaaaattacttttgtaaatcttttaataaaaaaaattaaaaataaaaaaaatttctccacccgggttggttcatcggtacatgaagaagcccatcggcccagcatcagtttaggcccaaatgatcaggcggcccatcaaatatgtgcacatgtgctcttcagtggtagcatagggtatagattatttgactgtacgattggaggggacaactcctcttttttatattactatatagaatatagattattttgtgaagtcactcgcataaatacattaaatattataaagctaataaataactttgaaaaagaagctatttaaaccatgcttaaaaagtttgagaaaacatactttcggaagcgtgctacctacattagctgtttaaaacgccaccgaagtgatataagacgaggacgtcctaacaaattcagttttaatttcctcgtctttgcatatatggaaggaaccgaagaacttcacctcaaaaaaaaaaaaagaaactctgctcttaacagattaaatcttgttaaactaggattagcttcggtttaagctgagactgcgtttggtgaacattgctacctacccatccattagcaatttaggtctcattttttcttgagttgcagcggtttgggactttgggagtggtaggtgtatctgacagtctcgaatgtgccacatctcttttcttctctcctgtctccttctccaacctaacccctgcctgcctgcatcaaccatatatgttgtccttcaccaataaaacacattgccctactcctcacgctctttcgatcttcctcctctcctctctatttctctcatcaacaattaccgcatcacaaggagcaaaagcagtttcagtttcggctccattgcttattaatttacctctacagaagaagtaagttgatctctctttcttgcttcaatctgattgtttccttgctagttgaaaactactattatatactctgtctttcgtccatcttgagtgatatcatgaattgatacacattctcatgaatgaatgtatcaaattccatctgaaactctggtagtagctgcacacacatttcagaattcagactttgcactagctttgtgcattgagatagagaaattaccaaagtagatgtaagcatgtaagagttgttgaaatatgcttacatacaaaaattgtataaaaaatatgattatgaatgtactagtgaatagtgattacaagatttaaactcctaatcaattaagtttgcatcattgatgcaagttcagtgggcacagagatggccaccgtggaggtggagggcatcccatttcctcaggagatcaccgtcagtaagccgttatcactgctagcccatggtaattaattaatctattaatgatttataagtactccatttgactaataccagattatgagtacaacacaagcctctaaatgcatttgaaacaacaaattgcaggcattacagacattgagattcatttccttcagatcaaatacaacgccatcggggtgtatcttgaaaaggacaatgtactagggcatttggagagttggaagggcaagaaggcagaggagcttgtgcaggatgatggcttctttcaggccctagtttctggtaactaaaatgactccaccattcaggttttgcatttcagaaatatgtaaaacggatttggaattgcttgtctatagtatatcaataccattctcccatttccagttacagatcacaaatagtagtattatctctgtagagtttatagaacaatgttctatcctacaaaataaaacagagtaaggttcagtctgccgctcctgcataactgcaagaaaaaaatgtttcattttttcatttgagtcatgctgattgatgctgtgcatgtacgctagctcctgtggagaaactattcaggatcgtggtgatcaaggagatcaaaggatcacagtacggcgtgcagctggagagctcagtgcgcgaccgtctcgtgtcagtggacaagtacgaggatgaggaggaagagtctctggagaaggtgactgaattctttcagtccaagtatttcaagcccaactccgtcctcaccttccactttcctaacacccctggaattgcagaggtataatcttgtagagtactccttatattcagctgggtttggttaagatatcaagtgatcaaatctttgttcttgcaaacctaattgaagcatgcatatatgtgtgcagatatcatttgtgacagaaggcaagggcgaggcgaagctgacagtggagaacaagaatgtggccgagatgattcagaagtggtacctgggtggagaatctgcagtttctccgacgactgtgaagagcctggcagatcaattcgcagcactgctctctgcatgaggcatggagtaataaactactgtagtaatgttgcctgtttcccattcatttttaactcgatcatgctttgatttgtccagctgctctcatgtgcatgctacaattgataatggtattggtttccctactacttcaaatgcatgatttacttgctccaaagcagaggaaacatactcaaatgtatatgtttcaactttacctgtgtatctggtgcaagcaacctaagacagtgatagaagtgaaggtaggaatctgtccctgtactgctcatgtgttggaattaagtccaccagtggttccaacttccaacttgtgtattgggcttgcaaaatgaagctggaaaaagacaccagaatatctttgagagcaacatcatgacacaaattcatgaatagtactgtactgctatagtttggtgtgcagtcttcagtattgtacatcctttaaaacctcctttcagtgttgtactcattttggaatcaaccaacccatacaagttacctactccaacaaataaataaattagagatgttctgctttaacttcttctaaggatgatctaaaaaaaagattcttctaaggggaagttaggatgcatgttgccaacaaaacgtagatactagtccacagtcaagtcagttcttcattttgttttacaaagaatatagtactatatttggatagcaatggagataagatagacaccacttcgaataaaggaacaaattaagggaggaatctcataggatcaaaatcacagtggattttttatcacatatatatccattgaaaatttgaaattgttgggtttagtcccccattcgtaattgttaatggaggggtacaatttaaaaggtaaggacggtcgttacttatcagactagtcttttaggttatgtaggcccaggagctaaagttgtggcaccaattgagtttgtggtggagcagacccaatgtgaccacggttggtgggccgggctgcacactctataacaagtggtatcaaagcccacgtatgaaaacccaaaacattttttataggtcacatggtgggggagctccagtaatgtggcgggaaatattgttgggcctcggctacttcagtggaggcggcagatattgtttggccgtggcctgcacatcgagatccaaacattaagaaacgtcatagaatatctaaacgtgatgacgacaccaagatataatatttgttaacgagattcagccgaatcctatatctccggacactgattatgaacactcgtactagatgtagcataattacagcgtatcagaggtacaacaaacttccgtcggacaccgtcgacagccattccctctcgcctatgctaagtcgttatgtggttaattataataagtttgcctctctatttaagaagagctgatagagtttgattctaactctatcctacccctattaaacttcaagttctaaactgaaatcgactttatatacatattcacacaaactctaacaagaagaaaagataatcaattagaaacctatattgaatggcttaatatatccgtagagaattttagaggaatccaaacatatataagatttgacatcaccgaagacgtattactatgtgccaccccaggcaccctctccccaaaatcctacgttattttttttgaagcattatttgaacagaacaattgaacattttctgagtttttactccaatgcttgtgccataaatcgagcgcagaacgctggcatggagcgatcttattctgctactagtactagttggcaacgtgaagaaaagggaattgaaaaggaaaaaggtctcaggcatgggaggtgattagatgctggacaacaccaatttgagaaaaggacttgccacttgggggaaagtttggccaaaataccaatgcaattcctccaaaagaaaagaccaattcaattaatgctttctctccttaatttggttttgctggtgagtggtgacaaaattatgcccagaacaaacgaacagcgaatctggggtaaaaaaatcatgtgctagcacacaaattaaaggagaaaactcatagaaacagctaaacagataatccaagtgagaagtgacagtgacactgcaaacattgtgtccaaccccttgcatttacgcaatcccaatttatattctattcacattgtagacctcttctgttcgagaaattacatacaaaagaattaattatattactagctatgtttggccgccggtgactccggcatggacggagagaatggagtcccggcaagtagggcaggacgtgtgcgcggcgagccacgtgtcgatgcagccgacgtggaagccgtggtggcacctggggagcacgcgcaccttgtcgccgtcggcgaagtcgcccaggcagatggcgcactcggcgtcggggacgccggcctgcttggcgccgtacacctccaccgtaatcctcctcagctccttcttcttcagcccgcccgtggtggtggcagctgccggcgtcgccatggcgggtgagggtgagaggccgcgggcgcagtggagcgcgcagcggatgagggagctgaggccgagggagcagatgacgacgcagagcagcgcggcgaggacgatgaccatgttggcgtccaaggcgccggagctcccgccggcctgctgcatggaggccgtggccgcccatgccggcgtcagcaccagcgccggcgcctccacgacgtcaaccagccgccgcatggctggctggtacctctagttaagctagtatagctcaagcatatgcaggaggaggagacaaattataagatgttctttttaattttgttgtacattgaatttcctttggatttggtgattggattgggtgcaccagcagagtgagattattctggttcgtcgctgcagccaaaccacacattggattgagctctctcaaaaagtggactctgaaagctagctagcggcagcgctacatatgtctctatttgttaaattagttttccctgtttcgttttcgtgtaagaaataatgtcgtatttatatttgtgccactttcgaggatgaacaacaatgcccttaccagtatctggcgcacaatacaggctatgtttggcaccccttttcccaacctcctctctcgtttttcgcgcgcacattttttaaactgctaaacggtgtgttttttacaaaaagtttctatacgaaagttgtttgaaaaaaatcaaattaattcatttttttttaaaaaattagctaatacttaattaatcacgcgctaatggaccgctccgtttttcgtgcgtactgttagtgttgggaacagggctgccgaacacagcctatatatggtttagagaagtccacattaattaatttaatcatcaactattgcaatattgttccaactttgatcatttaactctatgaaaccgtttatttttgtctcccaacacacttatagatgcccaatttcgttccttggtctaaatttcatccttggggtctattccaggatgattttcgattacgtggagttgcagagggtataggtttcatgcccaagtctatttccaatcagccaacgacaactttttacaatctatatatgaaaaggaaattaatggatctaccatttcaagcaatagatagtgcgcttatctattcattagctcatgtcgatcaaattaattttaggtttagacttgtagatagggattgggctccctatcattgtcgaatattcacaatgtgaacatttaaattatactttaaaagacagtgtcaatgtgaatatgggtgacaatgtgaattcttaatgtgtgaatgtaaatgtattgccacactagtggagaacccatttctaacaccagttgggaaccgtttttagtatcggatgtagaaccggtactaacaaatcgagactaaatatctcgatctttagtaccggttgaaataactggtactaaagatgcatacgaaataaaaaaaatgtgtaggatatgtgattcgaactcaagatctctcacctcagccctcacgcgtgtaaccatccaccaactccacccatcagacatggatatggatgctttctttttaaactaaccctgtagacatctttagtaccggttgtaacaccaaccggaattaaagatgtttttgtacttggacttttagaaccggtacttaaaaatatctctagtacccgttctaaatctaaccgaaatgggtatcccgataaaatatcagttgtgtagtagtgccattttgtacgactgtgcatagtgtggtgcatcttttttgacatactacgataatgatacatgaagttgtcttaaggaaccgctcgtaaaaaacgattttcacatacgggtctattaagacaaccggctgcactaattgtttttagagtgggcttgttttatgcctgtaaaataatagagatgattttctatatatagcaagatcacattaaacaattttgttgcgtatcacaacgagggagtactactactgcagatttcctcagcaagaagctggagtagctagtagctaggaccaagacatttggacaacatgcaattcataaaacgtataggattacacgtacgcacagatcgtgtacatactgaagaaaattaagatagaacatgcacacagggagcgtgcaacataaagtatacagctgatacagagagagaatggagcgctgcatgtctgccgcagctgttattttaattactttgttcatatatgctgtagcaagtacgtgcttaattactagctgatcaactccgattgagctagcatgttaagctcgatcgatcgatccaagcaggattgatttaactgaccctgcaccaaagaaaaaaatgcacatatatagaaagttagttattttatgggaaaatgtttcatatctcgagaaatatctcattgttgctttcatgccccccacctaaatagccattaaaaagtaaaacaaaatgataagctagattaatattaatatacatgtccgtaaatatacatgtttaaatttaacttgtacttgcaacaaaaataacggatataatagcgaaaatacgttaagtagtgttagtttagtttgttgtttttctaattaacttgtataagttgaatttaatcttttatgtctatgaagtgagatatatctcacatatgataatctattttaacttgtaaaagtttttattaactattactccgtttcaggttataagacgttttgactttagtcaaagtcgaactattataagtttgactgattttgtagaaaaaaagtagtaacatttttaacccaagacaagtatattatgaaaaattattcaattatagatttaatgaaactatgctggtattgtaaatattattacttttctatagaattagttcaacttagagtagtttgactttaaccaaagttaaaacgtcatataacctgaaacggaggagtatttagatagcactaaaaaataaagagatatatgtgtgtatatatatagagagagaggggggggacgtcataataaagagagatgatatacttgttgcagtcggtggagaggctgatggggaagccaacgttgacgccgcatttgccggggacgccggcgacggtgccgaggttgagcgacttgatgctgccggcgaggctcttgaggcagcggcaggccgcctggcggtcggcggtggtgcgggcggcgttgttcagccccttgacgccgttgcagcatccctgcgtcagcccgctcctccccgtcacgtacgagatgcacggcgcgatcgccgatcccacctgaccgcacgtgatcgccgccgacgctcccggcgccgccaccaccatcgccaccaccatcaccgccaccaccaccttaccgttcaaagccgccatattcaagattactgatttgatcgtcggatgatcgatgatctgatgatcgagtagctaagctagatagctaatcgtcgccgccggtgatggatcgtcggtcgatgggtggagggtataaataggaagctgctggcaacgagctgagatgcggacgatggaatcatacatccattgatggcagtcgctgctaggtcgttgggagttggactcagatcgacctaggtactctactagagtctgaatgatgtacgtactacatcacatgtgttccgtgttctccagtactacctccgtcctaaaatgtttgacgccgttgacttttttaaacatgtttgactgttcgtcttatttaaaaacttttgtgaaatatgtaaaactatatgtatacataaaagtatatttaacaatgaattaaatggtaagaaaagaattaataatggtttaatttttttaataagacgaacggtcaaacat

SEQ ID NO: 82282 - DNA, 541 bp, Oryza sativa
acaacctgtatataaatgttgttagccttctgaacgattacatgaagagaagtgcaaactacgcaagaacaagttggatcaaaccttgctggcttggtctggagtttctggcattgtagctacacggcattgctgagcatttaggacttccatcagctcccagggttttgctttatcgggcctttcttctgaaattctaggctttatatcgatgcttctagatgctggatcaccaccattctattaaatccataattaagtcagattgtgtttcaattgctaacagtaaggtaagcaaagaggcattaaacagatgaaactttgggaaatctttcgtctgtggattaccataccattataggagatggctttgcaggagaattcctgtcgatgtgatccatccgaccaatattaggagaaatgcccgcaacaacaggagcaccagagacctgtaaatgcaatattcaaggtcatggattttctaaaactagacccacaacaataacaagcagcaaagagtgtgcaggaaccttcatagaag

SEQ ID NO: 82283 - DNA, 5229 bp, Oryza sativa
cactggcattgtttagcttcttctgcaagtagttcatcacacaaataaaataaataataatttcaaaaaaatttgaataagacgagtggtcaaacgttgcaagcaaaatctcaaaatcccttatattctgggacggagggagtactaaccgtggcagctatagaaagcattacattttgacctttccattgttcattccaaacatttaccagggcctggactacccaattactcatccaaccatgtggttggaatacatctacaaatgcatcttcagtaaacttaaatgtgcctaaatccactaccacccttttgctgctttcatctttgtttatcttggacaagataaacttgcatagaatttatctagtttatttacagtattacgggcttcaagtccaaataattcctccaattcttgggcacaatgcctcatttctttcgaggttatgtcttcaacagcatttctccacgacaactgatatttttctataatgtggtcgactttgatagccatatcagttggaaggtccaggtcatccaaatgagaagcaagcatatttctcatgttaggaacacgcacaaatgagtcattttgttcctcgaaggggcacttctccttcttgccgagcttcccaatcttatacctctttgcattgggcgccttatgcttgtgcttcttcttaagctgaaaaggggcacaagcgtaagggtgaacaagtgcactgcggtttctttcaatggcatgatccggtttttcctcaatatatcacatatttgatcggggacttgcaacataaagtagatgaattgaacgataaagtagatgaatttaacgaggagcttgctgcatgcaagaaggaagctggaaacacttatacttacatctggaatgaatgaatagtcaatcttgtcaagttgaacatctgggatgccattttttccatacactgtgtgtgcccaaggttttacctaaaaaggggcaaggaagggaaatgtatagttagatgttagtgggtagtgtagttggtagcagcactcaagtatgcctgtactagatagttgacatttgcttctataaagtaggagagcagctgcagctcaaattagttcagcagcaccaagtgtttgtgctctctgttctctcatcttcttccacctctcatgtgtgagctgtgtgcgtgagtgtgagtgtgagtttgagggacctggtgatcaggagtgaggtagtgctagcatgcatatgcatacatttttacataccttgatgtcttcaccaagacgagtaaaaacatcatccaccattgatgaagtatagtactgcagtcttggggtcttcatggctgcattgccagtttcatggcaatcaaggttgtccaaacaaaaaacctgctagttacttttagtcgtacaacatttgcttttgtaaaaaaagaaaagatttcaaagatgcttacaagaaaggtcaccgggctccaaatggtatatgattcaacgaagttttgaaaacctgccttcaaatgatccattaattgcttacaccaatcaattgtagccactgtctttaggtccaagactgatcccaaacattcgcgaatgacataattagaagaacttgtgaaggaagaaaagctgaacactgccgctaaaaaaagcctgacttccagcatagtgttgctagcattcctagcagttgcacatgctttgtcaacatcaaaaacagtaatagaattggctgggcgagttttcgcatcaggattggactctttttccatcaaaagagcatctagaaggtcatccacttcaacattttgacctacatcaatgtcctggggcatctctctagcccttggaagcccatgtatgattttcaacacctctagtggctagattttgtctttagataacccactctatgcatctcttattcctgatcattgtttgatgtgtcatctgctactgtgtctcattggctagttgagcataacactatgctactctctctttttgtttacttaagatcataccttgtcctcataggctcatacgctacacggctgttagttatctcatttagttactgaacaccatgttacttttcattcagcaagcttttaatttaaagaattttctgatgctaaaagacaaaaccaagaaattttagctacttatatcgaatgaaacaagcgagcccacttcttacttcttgcaggtttttgggaggcggctaagctacagaacttgtagttcaagtttacgagccagattggacggaaggagtataagattcagatttggagctaacaagcctagcaacagcttagttcttttgtaggtaatcgatcgaatctgcctagaccggggaagatttctaagaatgcaggtctagcattttaaacaacatttgccaatgcacaaagtatggtaagtaaggtaggcttagctgactgatgcttactaaatcgaaactttgacttctatattcaactcagtctttcaattaaaatctctgctgttggagatagggtgggctttcttatcggttcactgaagtcagcttgctaaatccactttgtggatcatgaatattcttgctgcttgctgggtcatgaatcctcgtgctactgtatttcattttcatctgcagaaacagttctactaggatttgcaggcgtaagaacatcattcaatgcacttatgttttaatatagttgaccatatgcagccccgtttctaatagcggcttatatttcatatgtttcagtccaagatgttgatgaaggaagggctgaaggtccatacttcacttacctttatatgtttctagttttctatcagcattgctgagattcttttttcataaataggagggttattctatgagtgcgactacgactgccccgactgctgtgagccaggctgtgagtacatcatgtatcatgtaagtgcatacagttggcatacattgcttcatatactgcaatttctaatgaacttttgttttttttcagccaaggtcacctcaatgaactgcgcctgccttcctgcaactgaagctaatgaactgtgtgtagagtacgggtgtagaggactaatgaactgttatgttttagcagaacaaaggatccttctatgaaactgtcccataaattgtctttggatttggtgatgtttacttttgttacatcgtgttatgaacccaaaactttttgtgtttctcacttctgtttatagtttaatgtaaactgaattattgaatgaatattatcatttcaatagtgcatctgtttttactcaattttttgttttcttgcgaaattagctatatgtgcataggttgagcagtgcaaccatctaagcttaacatgagatgagtttgatcccatccttcaagagcagtgtaaatttctagaaagaggtaacacattttaaaattatatgttatgttagtatttctagatttatcaatatatctagatttatcaatatatcttttaatttgtttgctatgtattccagctaaagtagaaatatatatactccatgatttattagagtatgttgagatgttggcccttgtcttttcaaacattttctctgaatatagatttctttgtttggtttattcaggaatgacagaggtgacgactgggtggtctggtttgctcatgatctagtgccccaaatgcagaaaagaacgcgttatagagcagactagcaaaaagtgaaatccaagaaatgatggaaatgcgttcttcaagtgtatggtgaacgaatgttagtcaagattgatttttttgatactatgttgattacatttttgctattccatatgctgcagtcttgtcagaaattcatgtgggaagatgagtatagaaaagagttgcttaaagcttgtaaagagctggagatcctacgatctgagaatgctcaactgaggagcatttttgccaatcaacaagtttagatagaggcattggttgtcaacgaaggtcagctttattagattctcgccctctcttaccctccagtcctctcttcctctctccggtcctcgcgtttcttgttctacaaatggccgggaattgagatctgcagcgttgctggatatgatcttggttagttttttcttgtagtgtagtggacgatctggtcacgattcagttattggtttttttggatttcagttattagtttttttggatttctcatatttcttcggcttttgttgcctaaacctaaccaacacttgggacggatgctgactggctcagtggggctctgccgctctgatattacaattatacatgtttaaacttgctgatcaaacactaaagcaatcactatagatagatggactatagtgaacaatgatcccgaatgctaattaggaactaaccaagaagtaattctctctaagcaaatcttaattacttagaatgatatttctattaaagcagagtgataaacaaagttcaagagataagagaggattatcgatactccggaattcttccgacttcttctacttaagtctcttcctattctaatatacaataaagtacactagagtctcttgtaattcagctcatgctttggtgtgtgtgaatgaggaaaagaagaggggtatttataggtgaagagttgccttgggagagtggagatgctccaagcatcctatgagcatattccctctagcttcatgtcctcttgacaagtgtcctcactatgacggtttccaccggtagaaatggccacaaccgtcattgggatgaggagtacaaccgtcataccgaaaatgggctggactgggccagctaggggttcggccgaatcctggttggcttccctggcccacatctttcttcaggatgctgacatatgggccccacttcatgatgctccatgttttggctccaaatgattgcacattttatatattgtagctcaaaaccatgtgagttcatcagagcaaaatatatttccattctttatgctcattctctcccaactttggtggttgatcacctgcatacaaatatacaccaacactcgtggaaattgttagaaataaatcataccactatgttggatgtttcacatttatggttttatcaggtattgacggcgttattttggcacttaacagccgttaacaataggctcatacgctacatggctattagttgtctcatttagttactgaacaccatgttacttttcattcaa

SEQ ID NO: 82284 - DNA, 18621 bp, Oryza sativa
  unsure (1)..(18621): unsure at all n locations
ccactttattgtcatgatggaacttaaccttaatttcctcctgccttgcctcctttagtactacaaattactttatggttctgctgatgtgggattttaattattatattatctgtagttacaggctagtgttataatcacccaaatagtaatttgttttggtaccaaaatcattaaacacccacagcttactatgcagactagtaggcattcaatcataggagtttttattagacatgcccccccccccccccctgggcatgaatcacttcacagacctctgccactataccgccctcaataaatctagctaacatttttttatttggggtacaaaccatctccaatacttaccaaacatcagccgaatgggcttttacccttcattcttttgactgcctgtcaacaattgttcaggaaacaatcatgtttattaatgactctatgagtttaaggtgaactttgaagcacctcttttccaccctttctaacctgcttctgaactattcaggaaagtacttgcctgtgttgtgtgtggccgtctaaaaagtgcattccagatagcctcccgaagtggaagtgttgctgatgttcaatatgttgctcatcaggtcagccaccttcacaggtctacaaatgtttcatgcttgatgacagaataggtttatggttgttcctttgcaagtgttcactataaccagagatcagttaaagccccatgggccaaaatctggtttggtagataatgggcatatgccaattggatcccttctttttaagatcagttctgtactgttttattggataaatggtggaggaaaactgaactagaagtctaatattaaatgattattcaggccttaattttaagatcaggtctatactgtttttatggataaatggtagaggaaaacccaactggaagtctaatattaatgactattcaggtctatgttaggccctgaattttgaggttacttatttggcacgtttgtattaagcgtattaccacagtcacgttaggaaatggtggagttcattgcattttcaagatattaacaggagcctacctatcagttagcccctttgtcttgttttgaattttagatctgttctcaggactccagttggcaatagcatggttcaaaatgttagggaaaatcgaaactaaaagtttagagactaaaaaaaggaaggctttttttcccactagtaatgttttagggaaaagatacaagtaaatgaagcaatatgtagctgaatatcccctcatcctctattcaccgtattttgttctaactgatgtttcatgtttggtaggcattacatgcaaatgcgttacccgttcttgatatgtgcaagcaatggttagctcagtacatgtaattccatgtgctgtgccaccccataaatgctggagtgctcagaactacacaaaagaatggtaacatcaggagacatactccgtagttctttggtgaatgataacatcaggggacatactacgtagttctttggtgaaactgccctgagaatgctgagagcaagatcaaagaccatggtgtacagttttccttcctcatgtaaagcatgcgtgcacacccatgcctctatatatatttgttcttgcaagtggccttttttgtggctcatttgcaaagggaggtgcttgtggcttcctctgtggcttaaaattttgtagttaactagtagtacaaagggaggtgcttgtggcttcctctgtggcttaaaattttgtagttaattagtagtagttccgttgcctcttattaaagttggaaaatgtggcgttttttttttgtataatgaaaataattttttttggcagtacaaaaccacagcccatgtgtacttttggtgtatctgggtttgcctgtgcacagtctgccaatctaaattgaataaatattgttggttaaagttaactttcgtatatcaaaaaactgaggtagtaactcagtcagctcctgattcatctttattgcacgagaaatatggagcctttgccagtccagttgatagtttctgtttccaaagagaatatgttcatctgaggtctcttaattttacaccgaatccgatttacgcccttgaaccctaaaaccagatacaaccggtccctaaattgttaaaaccggtgcaaaggaggtccgtcggtggttttggctgacgtggcgtcgacgtagctggtttgactaggtctccgtcccacgtggcattgatgtggcaattatgtctaggaaaataataaaaattatggatccatatgtcagctaaacaaaaaaaaaatttaaaaatgatgggtcccacatgtcatgttagctacacaataaaaaataaatatggtggggcccacgtgagcaccatatgtcattcttaaattattaaatgaccaaatccaatcctcttcctcctctctccggctctctcccctctactccctcttctcgccggcggagataaggacagcgtggagaggcgcggcctcctccactcccgcccccatgggcttaacgccagcggccgccgcccctctcctcatcgctcgccgtgcctgcctccgcctccaccgccgcacacaccaccaacaccatcacacctctccccattgatgacgagcacccgtttcggtgggagaggcggccagctacgagcggccgttcgagcgggagaggctagcggaggtcggcgggagaggcacgcggtggatgggggctcgacggcggcgggcagcgggcgctcgttgtttggccttgtttggcctagcagctttcgatgatagtgtgtgtgaccagtgtggaggctttcgatgatatcctcgtctccgcaaaccacctggatggcacaccacggacaagaattgtgtctggccttttcgctatcttcctcacaggattccctgaacaaagcaagcatcaatccaaactccacctaggaagaatcacaactaagagcagcattttcattttaaaaaatgaattccatactgctactgaggagctcggaggcgtagaaattctcccaagacttcttcattgccctgaagtcatcggagggcgggatttcgacgctcatccgaaacttaaccctctcgaggttgagctcgatcccggccagcttctcgaccagggagctcctccactgcaagtacttctcctcctgctcacgggtcatctcctcggtctcctcatcatcatccccgttgtggctgcgggggcggaggaatgagaggtcgcggacgtggaggatgcccgaagtgacgggctcattgcggcgaagcttatgcaggtcggggagggacacggagaggtcggagttgggaaggacggggagggagaggggcgggtcgcggagggaaggcgaggtgcgcggacttgagctgccagatggcaacaagtgcatacccattgggtttccttgccccatactcacacccatgatggttaaataaatacccacacctatcacgggtacaaaatcatccccatacccacacccacgcgggtaacgtgtacccatacccatataattgacttgtatcatttatagttttgtaccacaattagctatattagaactgtaaaccctcaatattttctcttgtaacaatgctattaacattagcgttcaaaggcgagtaaaaaaattctacaactacattatatgatcaagaaatcaaataataatttcatataactagactagaacaatgattaagatgtgaaaggagttttatgttatgatttagtagtcgttttgacttatgttacttatagttttaggctcaatctacaggtttttttaccacgggtgggtaaagaacatacccatacccacgtacctaatgggtaagagttttcacccatcaatagacccatgggtataagagttagaacgtgaataactcctaatagagtaaaaacccgtcgggcatcgggtcatgggtccccattgccatctctagctgccactcgtcgacggggcggacagataggtcggcgcggaagaaggtgaggagaagcttgaggcgcagccatgtggggcccaccatattttttggctgacacgtggacccaccatttttaattttttttgctaacatgtgggacccaccgtttttaaattttttgtgtggctgacatgtgggcccataatttttattattttttcgagatataattgccacgtcatcaccacgtcaatgtcacgtgagacggagacctagtcaaaccagccatgtaggcgccacgtcaaccaaaaccgccttcaaaaccacttaggggcctcctttgcaccggttttaacagttctgggaccagttatatctggttttagggtttaaggatgaaaatcggattcggtgtaaaattaagggacctcaaatgaacttattcctttccaaagggctcgtttagatatggatattaatcttagcccatcttatatttattcttattttgatttctccggcctatatacctggttggacttgattgaaatccatctttcgagtttttttccagcaagcactgcattggccgagaattgggccactgttcatcatgtacagagtacagactacagcggcgtcgttcattggatcttcctcttttttctaacaggacgtcttgtggaaaaacttttttggcctacccgttgtatcgcctgtactatgtgtgtacgatttgaggtcgcattcatagccgaaggaaaaggtcctgcgcataacctgtctttttccctggtccattccgggctcatctttttgcttgtgttttagtggcggttaaaaaaagggtttgtgtcgagtactacactgatacatcactgcctcaaatgttacgtttcccttgcaacccgagccaggtgagaatcgattctcaacctgccaaatttcactggccggccggcactgtgataatatatctgcagcgtatggtttggagtttggactatttatgtgaggtctggtttaggtaccaactttttcttcaaacttttaacttttccatcgcatcaaagttagtttggagaaaaaattagtagtttatgtgtgtagaaagttttcgatgtgatgtgatggaaagttggaaatttgggaggaactaaacacagccaaaactttcctacacacataaacttttaacttttccgtcacatcatttcaatttcaattaaactttcaattttagcgtgaactaaacacacacaccctgaatcctcaagatttcttcgtgcggcatgttccccacaaattgtccaaaagagactcgaatcgaacagtgatcaaactttcattaagcgaaagggctgtacagtatttctcgtcggtgcctcgtactgggatttgggctcgacttgaatagacgagctcatgcgacaatctatataatatccgacaacttatataatatccgatgtgacaacctatataattaactgacggattctgtaattagtttttttattagtgcctaaacacctcatgcgataacctatataatatccgatgtgacacgtcaaaattttacacaatgaatctaaacatcccctcagtcatcttgcaaattcctttctgggtggagcgacttatgaaatggatgccttacgttgcgtgcgcggagaaaagctttggtttggatttcgccgcagcgcagtgcgcctcaccgaatgatggcacggtgcacctcactcacctctcaaagccactttctttacccttcctctctctcaaaaaaaaaaaaaccgttttctgatgcccttttttgccatctccgtggacatatttctcctgcaaagatgaacccgtcaaggttgggtccagccggagtagcaccgaccgagcagcttcgagtttccacggcgggcgggcgggcttgtggtgtggtggttcgtggtgcaaaaattcacggatgtcatgtgaaggttggttgggacttgggacttgggacagcgagcgtactacgccctacctgtacctgcctggtggtggacgtggttggttgaatggttggcgtgtatcttgtccagtaccgtatgttcccgtctcgagacgagacgagacgacaccgtcggtggaccacgaatcccatcagttttttctcttgtcaccacggcgcgacacaaataaaaacacaacacggagtggcttgcgacaccggcaggtgagtatttagtaatccctccgtttcacaatgtaagattttctagcattatatatatgttaaaaaatctaaacacatatatatctagatttattaatattaaaatgaatatagaaaatgctaaaaaatcgtacattgtgaaagaggaagtagaaaagtgtgatcgccaagccggagggagggcttgtgcttctctgatgcaccgtctcgtctcgtcggcgtcctacctgatgcaccgtgatccccagtgaccataccagcgtcgtcgtactatggtacaggtcgcacaggctgagcagcgagtacagacgcagacacgccacctgcttgctttgctgctacttccagggggtaggaatagttactccgtaaagaccgtaatactctctctttgtaaaaaaaaaaactaacctagatgaaaatgagatactccacattggctgtgttcgggaaccgtcactccctcgcacgaaaaatgaagcagcgattagcgtttgattaattaagtatttactattttttatcaaaaatagattaatatgattttttaaacaactttcgttacagaaacttttttaaaaaaacacaccgtttagcaatttgaaaaacgtatgtgtgaaaaactagaaataggggtcgcagcctgacggaggaaatacatctatatcatgtacagacttactctctttaaaaaaaaatctcaacccaagtaaaaataggacaacataaaacaatgaatttagatagcccttaaatttgaacagatgactatccagatttattgtcttaggttaggttatgtttcatcctcatctatattaaatatttttaagacagagagagtaagtttatactagtatacgataaaagacgtactattttcataaaaaaaagtaaatctgagattgagtttaacacagtatggtattagtacaatcaatctaaacaagttgatgggagtatgggacggatggagtactgtgtaagggtgtgtttagttggggaaaagaaaatttttgggtgtcacatcggacgtttgaccggatgtcggaaggggtttttgggcacgaatgaaaaaactaatttcagaactctccggaaaaccgcgagacgaatcttttgagcctaattaagccgtcattagcacatattggttactgtaccacttatggctaattacggactaattaggctcaaaagattcgtctcgctatttcttctataactgtgcaattagtttttttttatttatatttaatacttcatacatgtgtttaaagatttgatgtgatgtttttgggaaaaactttttggaactaaacgggcccttaaagtgcatcgcttccttttaagaaaaaatagagggagtagagtggagtatatcattaccaaccaaccagtccggtcctctgcggctctgactccttaacgtatagatcgtaaagagcggccaccgacaggcacgggccgccgcgtgtgcggtgccgtgcgtctacagtctgcggacgcgactcgacgccactctctgcgtcggttgatcgtcccgtttgtgatcgcctcgccgcaggcaagtactacaaaagtcagctataaacccacattaatatatagtcagctgtaatacaaagtcttaaacgttaggtgtatgagatatgggtctatatattaatactaatgatatagtatatatttatattacatgtatagataagctattaaattgattatagataatttgaagttagtagttagctacactgctaaacttgttctaaaaagcattttttaggtgcccaaccaaacaccgtaccgagccaccgggcgcatgggcgagagcgacacgctgaggaggcggaggcgcgccgcgccgttggttcggatggacgggcgcgtcacgggctcacggctgcaagcaccgcaccaagttaaaaccagaggccggtcgccatcgcggaaaatctgtcacgactcagcgtcgcgtccacccaacgatctcgctcgctttctccgcctccttcgctttttaatctctcatctcaggatgaggagtactactgtacagcaagcaggtcagcctcccctccaacgaccaccactcttgtgtctcctccctccccatttttttttcttaaatccacacaccatcgccaataatactactaccgttttgtatcgtcttaaatcaccggcagcgagtttcaaaaaaaaaaaatcaccggcagcataggttaacacattgttcctggttcatcgcaccgcgaacaaactgcaagtcatccatcaataataataaaaagaagctgattttctttttgagaacaaatacaaagctgattagtagttgattgatcgaacagatataaaccagttggatacttggattgatgtctctacattgctcctttgctttctttttctccagcgatgatgacggtgatgataatgatgatgatgatagctagatgcttcggttgggatcgtaacaaacagtggtcgctcacaaggcaaacaagacctcatcaaaatttgtttttatcaatcaaaagttattagtactgctcctatccatcatcacattgctttctctgttaaaataatcaatcgtcattattatattgctatcagagcaagtttaatagtatagcccactactagtttcaaatcatctatagccaatgtaatagccaattcatacaatacttgcttactatactattaatacttggtcccacatgtcatacacacattacatcctggagttcgtgttgtagctggctacagatctgtagcccgctgcttttctcttcctttttttatctctttaaaatatgtttatagcaggcttatagcctgctattgtacgtactcttacttgtcaaattattgcttaagccatggatggcagtatggcactagtactaccacagtaccactacaagtaatagtactcgaaggtaagcaaaaggcagtgctgattccacgcagggaggccggcagcagaggcggattcgtggattggagctcacgtcttcctcccctaacccggatggggaaaaacaacctaatccttcggttttttgggggctgggcggtccttgttccacgccacaacttttttaggttttccaccccgctgtgctgcgtccagaaaggagaaaagctggcttttaatagcagaaaaacatcgtgacattttacaccactacctattgtgatctcgtcgcttacgtagcacgtctaaactgtgcaaccaattttgtactagcggttactgaagtacacattccttctcacgaaaaaccaacttctacaacaatacgttcggattcataaccaaaggttatttttttatgtgacagaagtagtacttaatacttatcgtctttttttctctatgtgttgtatttatcttgaaacaaattctagtttgttgctgagttattcttaatccgtttcatgcctacgaggttttttctgtttttttagagctatcagctgcttcatgcttcttaaaaacacgttttctaaataaaatcttttactctattacttagataacttattctgagctatacgttaattttatttcttaaaatatttaatttatttttatagtaaagtagttaatcagtaagaataatcgggtgaaataatccgcattgtatgcctaaacttcggccttgttcgtttcttcaataaaattttaaattcttgtggcacgcttttcaaagtgctaaacggtgtatttcgtgcaaaaactttttatatgagagttgctctaaaatatcaatatcagattaatccatttttcaagtttgtaataattaaaacttaattaatcacacgttattaccactttattttgcgtgaaacacttaatcttcatatcttcatcttcaggagattcaaacaccaccttcgttcctaattttgtaacaatttaccttgcctaaactttgttctagtagatattttgtcacagaagtgtatttctttatacatacatgcagcgaatacccgcagcatttcaacacagaaaattacctgtgcgcacatactgtatcacagtaacattacacaaagaatatacaactactttattatcgcgaatcttttcagatactactcctacatacaatgttttaacttgcaattaatcaagcctcgtgacctgcaagttaatgccgagctgccccgagtaaattgaggtcatgactcatgactcatgagtacccccagccacctaacagggaagcatgaagccacgatgaacacacaaaataccagcaataaatcataaatgtactatcaactgctagtaaattcactacattctccgtgactaaagattgagcttctaactgaagattatcaccgacacgtagcgagacaaatcatcagcatataattaatttaatacaactattataacttgaaaattagatttgtttaaattctcaaagaaacttttatatagaaaagttttgtataaaacacatcgcttcacattttagaaaacgtgctaataaaaagctggagaaaatctcggcctagaaggtgaattgaaattaggccgaacttctaacttttatatcacagtaaaacttttctatacacataaatttctaacttttttctttaaacttctaattttagtcaaacttccaattttggcgtagaactaaacacacccttagcctttttgtggtgaagctggaaatcatcatagatttttgtggtgtatggttccatgtatcattgaatacgccatcatttactagtgctggtacactgattttcaacataggatgctttttttttcaccttccacagtcaaattttttgacttcagtaacaggtttgtttatgacatcaggaaaccagtaattcaaaagcatgtgaaacacaagtgattctgaaaaccttaataaggctactaattttcaacattggagtagtatttaactaggaccaataagcatatttacaagaagagctttcaagtatactgctaattattctgtctctcaagcaaagaaatttagggccctcaatgtaccagacttctgaatgtatagtaatcttcaatttatagaagaattaatttgataagcagtaaaagagcatattcaatttatatgaatatattactcttaattaacttcaagtttaaatgtatagtaatcttttctttcaagggatatactaactccgtctagaaaaataatactataattattaactttgcacctagacaacctggacagtgtccatgtacatagccaaaattgtcttattttaagaacaggttgatacaagttttctaatgttagcgcatatttttttcttataaaaaatatatttaaattacacgtcttttttttgggtgggggagatatacgcgttttctaatgatggcactaatttctttcttctactaacttgcatgttttgttaggaaaactctgaatgacttcctaacaaattctctttttacctctgcaaaaataattctttttttatttctcaaaagaaaaagaagaaaagagattatgcggatatgcccttgcaaaccggggcagtggacgaaaatttctctggcaagtggactggcgagcacactctccaccagtagaaaaaaatgccaacctcaaaccaggtcaaaaaagcagatttgacagcatgcttctttggtgcctccaccgcctgcatgataaaaaaaattcctccagctaaagataaaaacaatttaaaaaatttactgtatatcacaacaacaaaaaaagtcacaaataatatccactttccctttttttttttccaaattctctctctctacagtctaacacacatgctgacaaaggagatctccacatcaaagaaacatgacatcataatcttggcaaacttccaaaccctacaacaacctttctccctcaaaaaaaaatcattttaatatattttaatcaaccaccaaaagtaaaaaaaaaacaaatcagcaccagcatagctgccacttgtcctgcacctgcaaaatctactaccccattattctcaatcaaatcagtgcatgatcagtagggacaggccccccttgagagagaaagtagagagagaaggagaaaagtgtgcactcctagagagagaaagagagaaaagtgtgtactgctggacctactagtagggtccaacaactaccattttagagagagaaaaagagttctctctcccataaaccttctccctctctctctctaaattctctctcctcctccactatttcttcctcccctttatctttccggggcgctgccggcctcaagtctcctcttccacccctccacttgctggtgcggtgctgcgggccgacgaggccgagaagggtaggctgcttctcgatccttcacgcgtcctggtgattgatttttcttttcgttggggaatttttttttggacctgcattccgtaggagggagggatagattggaagagggagttcttgattggggttttaatctgtgtgttggttcttggattcttttttttttctttttgttctggtctgggttttctgatcggttctatatctgggttttcttttcgatctcgttttcgattttttttttgtttttgcgatttatagggtttaatctccgctcgtttctgtgttcttgagggcagaaaattcctcgagttttctttttgttcgttgtaactgaccttccgcgttggtggttttcagaattttggactttgatgagggagctgctgattgtgagtcaagaacagttgtgaagaggtgagaatgggggtgataattgattaatcagtaaaggcatatctttttcttgtttttgtttagattctctgtatggtgttgcttttattatgttttaataatcacttctcaatatagctaggcgtacaagctaaggaatctataaaaaaaagatcatatgttgccttgcacttgaatctttagaacgcttctattttggttcatgatgaattatataacaacagtatagcatctatttgtttcttgatgaatactggaattgtgttccatatcaaatccatctgattgctctgttcttgactccatggagtttcttgatactgacactagaataaacccacttcccaagtcgtcgtagtgttaaagaaaaggtggaattatagaatttaagttattgacacaataaaatctgcagtgagaagaaagctagagaagatcaaatggcagctgaatcctccctggttccacaaacctcctctgaatcgattgcgcagaagatgggcttcttcagggtccctgaccttcttgtcaaactgagcagcaaatgtttgattgagctggatgcagtccgcagcccaacatcgcccctagacctcatattcttcccaggcctcggtgccaaatcgccgaggtcgtctttccttggcgacagggttgggcttggactggtggattcacttactgatgatagctccactcccttgggcagcaggaaggttcttcttggatctgagatgaggattactgataatgtaacttccaagaacagcttcactgctcctgtcgaagctggggtggttgatcagaaggatgagagtatgtgtgatgacctgaagggtagtttcatgtctctggatgacattgtcaattcagaggattacacccgtgttgtttgtcgtggtcctaaccctaggacaacccacttctttggagatcatgttttagaatttgaaggtgagcagctgatgcctgatgagagtaagagtgaggagagtttgccccctcgtctggaagagggtatgatgagcttctgttatttttgcggtgagaaactcgaagaagggaaagacatctacgtctatcagtaagtgatccagtattatagtagatgcatcatcgttgtggatatttttgttgttgtattcaagaaccctgtagttgtttcgagggttatccttgtttcgatcctttctttatgtttggtattctatctttcaatcataggggtgacaaagccttttgcagcatggagtgccgggagaatttcatggaagatgagatggaagaaggcgaacccgatctctctgcacctcctagcagcccagtcgccaacgatggttgtattttccaactgatccagtgaacgagcatcagtaaacaacttgatatggtcttatctgaagtgctgtccgaggttaataagttgcagccatggatgtgatcatatttcattgagttgttgcctgaagattttgtctgccgcggcactgatgaatttacctattgatttcttaattttacttacccggatcctcgaatttttggaggagcctgaacggtaactttgcttccggtcatattattattttggtcggaaagggcgtgcgtctgagtttgaatttgtgtttgcttgaacctcatcttcaatcggctgtcatgttgacaccattgatcactatcatgtatctgaatatatgtgcttctgctctttctggcagaaaggaagtgctaatcttcaagtttactaataaatgataatcatgatgtatctgtcatgatgatgatgtttgattctcataaaatccatgatgctcgattcttatgtggcaatcactcctggattgttggcaggatgtaagagcatttatctgcaatcttgcatgatgattttctgtcaaaaaaaaatattgcatgatgatgcgcatatcaatcaggaaatgttagcagtagttttcatgttgctgctaagttagcatttcacgctacttatcagtgccaaatgatgttattcatgtcaattggttcaggggttaccaatcttaaaaggctgggtcgctgttttcatcggctcaggagtatctgtcccttaaaacttcacagtgtggatgttgttttcttttcaggttttgaagtcagttttgttgtgaagtgagcttagtttaacttggtaggtttcttgtaatagaaccagcctatttatttaggttcaagttctagagttaacacgagtactcgtatttataactaattattcttttagtagtaagtgaggcgtccgtgataacgaattcatcaatctcgagatgcatagggatagggagcatatgtactgtgtttctttagaaaagtcacttttgttcgtccatatggccaatagtgccagatttgcttctgtaacatgtaacatttgcttctttaagatcctccctaatgatgattgcaaaatttgtgaacctctcatctcaaattccaaaacctcccaaaacgaatttgaatttcagacagaggagagagagagagagaaagagtgtgtgtgtcaagtccaaattaaatccaaattgcctgatagactgatatcgttaagaaactgatctgaagctcgttcataaccgaatctctctttctttctttttgattgagaggataataatagtataaaaagcgttcgtaaattgctcacgcgggccatctttatatgggccgaaaaagaaaaaaatccggcccaactccaacgccgcttcggctcccttcgactataccttcgccttcacgcgacgcgagactcgccgccgcaaggttctcctcctcgtcggcggcggatcgtctcctctcctcatctctctagcagccgccgccgaggccggcggatggggggagctccacggggagcgggggggcctcgacgccgccatcgccgaacagggctccggctgcgtcggcggcggcgggggtggcnaggtggagaagctcaggcgggagctccaggccttcgcgagggcaaacccgttcctgttcgtcgacggccgcgtccccagagacgacgcgcgacatggtcaagctggacatcgaggaccacgagcgccgccacccttgcatcgacgtctcgggcttgctcgcgcgctacgacgagcgggaggagaggaggcttcgcgccgggaacaagcgggctaagctcctcgccaagtttgtgttaggaaccctaacgaggaatctctcaattaactggaattacgagtacgcatacaatctctcaatccgaagaattgagccgccgccgccgcctgcgccaccgcgcggttccagttcatcgctgccttcttcatcgttctctgtttcacgtactcacttcgaattaaaaatatttatgtcatgattaaagaatatttcatcataaatcaagtcacaataaaatataattatataattttttttaataaaataatggttaaatgtatcttaaaaagttaataacgtcattcgttaaaatacagagggagtatattacaacaagatttgacagcacacactctctcacacgccaaccaccctgccagctggctactaggctcacttggcccattggtccctggtgtatcgagagttgggcttcctccgtcttggcccaagtggagcgaaaggttcctgtagcttgtccggcacgcctcctcccttacgatttgcagcttctagcttgaagtccagcttccctccttggtcctccatgatctcagcttcttcttcttgggttccaccatcttgttcttgtttgtctggttccttggagtggtcgtgtccccccttgagtcctccaggccgccttggtgaaggcctgacaagcacccactcttgaaaccagcttgcccccaagacggtgcatgcggaaatcttgtctgcagatcaaccatgtcctcccaagttgcatcacccgctgcaattcctgtcgaatgggttaacaattgaatagtagtggttttacttttcttagtcaagtgataatcaaggaattggtggggtatctgcaagtggtctagagtggcaggtaattcagtttgaacagggtgagaaaaaccctttgctcccttcagctgtgagacatggaacacatgatggatctgacatgatggtggtaattgcaaacgataagcaactgcttccactgcagaaactggaaagggtccaaaataacgaaacgataacttgtgacttgctttggtggccacatatgattgcacataagggtgcaatttgagatagacccactcccctagctggaattcttcgaaacttcttttatgtcagcaagatgtttcatgtgttgttgagcccggttcaagtgatgttgcaacaattgttgcatcaatcctctttgcttcagcccgtgatttaaagcaggcacaacacggtcattcatattgatgccaaagtggcttgggctatacccatagaaaactttaaatgtggttttacccaatgtggaatgggtaatgtttatgtaccataactctactaaatacaatcaagatgaccatttagtgggtgtagcatgaacaaaacatctcaaataaattttcaggcattaatttactctttctgtttggccatctgtttgagggtgatatgaagagctcaaatgtaattttgtaccaaatctaatgaaaagttgttcccagaattggctagtgaatattttatctctatcgatatgatgattttaggcaagccatggaatttgtaaacatgttgcagaaactgaatggctacactgctagcggtaaaaggatggtccaagggaataaaatgtgcataatttgaaattttgtacaccactacgaggatatatttataatggttagattttggtagtccctctatgaaatccaatgatatggtctgccattcaccttcatgcactggtaagggttgaagtaataccgggtatttagccttgtcttgtttagcctatagacaaatttgacaagtttgtaatctgctctggatcatttttttcatgctagactaagcaaacattcccttaattcttctgtaggtggtaggaaacccagagtggccacctataggtgtggcatgcaaagcatcaattacttgtgctgaagttctgcatcttgccccaaccagattttgttctcgtatttcaaaatgccctgctacagggtaaaacctagtttagctgaaggatcaatgatcaaatctacagccaggtgtgtggcatgagcatctttttcataactttgcatgacttcttgcaaccacagagttacacattttgatatggacactaactcagctttgtcatcatgctccttcctggatagtgtatctgctgtagagttactcaccccctttctatagcatatgcggtattgtagacccattaatttagtataggccttttgttgccatggcgtgtgtaatctttgttcagagagatgtttcaaactatggtggtcagtcaaaattaggaacttcccatgttgtaggtaagtcctctagtgttctatagccagcaaaatggccatgtactcctttccgtatgtggataaccctcttgattttggacctaaggctctgctaagaaatgcatatgatggtgttctgtgaagtacttgcccagtccta

SEQ ID NO: 82285 - DNA, 7264 bp, Oryza sativa
tcatcatgaaaagaaaacggaaaagagagagaaggggttttggagtgggagaggggggagagtgaggcgtgtgaacggcaacagcgttgggcagttgggctgaatggcggtttgggccgccagggatgcttttcagctggatgagtggaacaggcccgtataaggctaaggagcagctatatttatgggaataagttcactttaggtctctctacttgttggtcagtccaattttcgtcccttaaccacaaaacttggtacgacccatcccccaacttacgaaaaccggacatatgaggtccctcgacagtatggaggacgtttttggctgacgtgacgtctaagtggcttctttgactaggtctctgtctcacgcactgacatggcgcttacatggcaatttaacccattgggcccacatgtcagttacacgcaataataataaacggcgggcccgtatggccccacatgtcattttcaatatcatctctatcctttatctctcaccccttcgttggagcagttggagcaaaggtaggcggccgccgaagcaacccgcgaagctaaatgaggtgggcagtggcgactgttccctactcctctctcacttcccctttttggcatgtgggcggcggagggtgcgactgcagagcagcggggcggggcaaagcggatgaccggcggagcggggcatgcggcggaaggaacggcggggaccagagcatgctggcggtgcggagcggaatgggtggtgagcgctccctactcctctctcccttccccttttcggcatgtgggcaatggagggcgcggcacaaagcacgcggggcgaaccggccggccggcggagcggggtgtgtggcggaaggagcggcggggactggagcatgctagcagtgcagagcggaacgagcggcgggtactccctactcctctctcccttccccttttcggcacgcggctggcggagagcggagcggccgaccgatagagtggggcgtgcggcgggcggagcggcaatggccatcggatgactgtgacaggcggggaaaagggcggcgcgcggcggccacagccgtatgaggaatcagcttggcggcggcggcgtgaacccgttgcgcgcgcgaaaggcgaccacggccgtgatcgtgccgtggctgttcgctgccctccgctcctctcaacttgacacctgtgatggctgccactgcttttcctcgttgtcgctcgatccaccgccaccagagaagggagggaaagacagggggagggagaggccgccgctggagatgggggaagccgacgaggcgagaggagaagggcagcctcgacagaggaggggtggatctgtcggcccatcccttgctcccatgctgccgccactgcttcatgggaggagaggaagagtggatctggccaccccgccgccatcgcctgccgttttatttgcgatggggaaaggaggaaaggagagaaaaagagaaagagagataaaaagtcaaaaagattatactaatatgacccactatagataacttgcacggtaaagtatgtggctaatgaggttcttcatttagttggtacgcgaagttcgctaaaatcgcaaggcgcgctgcccttagagcatccacaatggtaaagtaaggtgctctctataaaacatgtacatctcagcaatagattagattaatagtaaaccacctcaatagcatgtctacatgggtatctctagctatctaatctattgcctcgtttttctctagagactatctccaggttagtagatagctttgttctctctcttcatttaatctcttttaagtagaaaaatatattgacattgatatcttataaagagcctatagataaccattgcgggtgcccttagatcatcaggtgtcacggccaaatcacagagctctgtccttatatagatcacacgtgctgttctcagaacgatcacaaattaacggcccggattggcccaactggcgtctagcataagatccaacgacagagatccgtcgatcacgtttccctgaaaaaaaaaaaacgatgacacgaaacgcccccaccacggccgcatctctccactctccagactggccttctcgcgaactcgccttcttcttcctcccccaaggccccaagccgcgcgacccagagcaaaagccaaaagcccgagctccacaccccccaccgcccatccgccgcgaaggcgcgaagccccgtcaccgcgcgcgcgcgcgcgcacagccatgttcgccgccgcctcgtgatcccgaaggctccccgcatccacccacccactcacccctccctcgggggggagggattcttcggccatggcggcatcggagcgggaggccgcgctcctggcccgtgtggccgcgaaccacctctacctcgggcagttcgaggccctgcgagcggcgctcctcagcctacgccgccgcgccgacccgggcctcgccgcgggattcctccgcgccgtcgtcgccgcgggcggccgcgtccccggggtgctctggtccgccccacccgcgtgcccttccccgtcccacctcgcctggctcaccgcgctcgagctcgccgccctcccgtccacccccaaccccgaggcgctccgcctcaaggccgaattcctcgtcctcctccagcacgtcgcggacgaccccgctgccaccggcgccgaggcgcgggggaccctctctaggctgctggatttgggggtggcgaggctcaagcgcgaggtggagggtggaggggaggcgggcgtcggtgctgaggaggtcgcggtctcccaggaagatctgacggggctctggggggtgttcctagacaaggccgagctgtttgacgcgctgtgttctggcgtctcgaggcaggtcgcattggacagtggtttaggcacggatgtgctcctgtggctgcggcggagcgtgcagcttgcacacctggacgcaatgaaatcacttgtagcggcaggagatctcgagggtgccactgggcatcttcgattcctttgcctcgatcatggagtggaggaggatgagtataagtaagctctattgcatatagttggaacctaaatataaatcaagttgatatttattgtggaacatctcatcatctgataggagcgaaaaattagcttcgaggtgcaaattgtgaatttagtggacatcataagttctcagcacatgcgtgaaacggtaggatcggtggtagttttagttacaatcagcatttattgtaagaataccatttgtttaacactaacatatgaatgatgtaacatgtttggttaactccattcaatatcttacagctcgattaggaaatgcatgtttgttggtgcacatctaaacatttgcatgtaaatgacttattggagtgacagtggagatgtaaatatttttagcatggtagttagtatattaaaagatatttgacttgggactatactccctccgtcccataagaaaacaacctagtaccagatgtgacacatcttagaactacaaatctagacatacctgtgttcagattcgtagtattaggatgtgtcacatccggtactaggttggttttttatgggatagagggagtacttcatgttgacagtgagctgttttggagttattgtgtaatctctgtctgattcaatggtcttgctacattattccagttgggtttgtaaactcccaccgtacacctgtcctttaacttcagttgtagcctatgtttgtattgcaaagtacactactgacggctgctttctagtcactgctgccattccattgtaatggacatgggggatttagataatataagtgtgatccataattttgcagtgcggctaactaaaaccgcaatcactaggtgctatctacttatggcaaaaaaatttttctgcaatttgtttttaatatttggtcttaacgccatcatattcatgtttgcagtttaaggttagacataaaacctgtataagtggtttcagattacatttgttcaactagtagtatactatgtacaatggtcacagtttggtggcaaatatggataccttccataaatttttagtttctttatacaggattgcactaggagatcttgtcagaaggggttggccaaaaccatcgaattatggtggaacatggtttgagtcacacgatagaataattaaaatgtttggatcagctcttcagtctagcactccccagcttgttcaactgattcaggtagcaaacataatttttcttttatcatttctactggcatgcttctatttgctttccctttaatggacaaccaagggggaacttggagtcaaataattaagaagaaagggtgagcatgttgagaaccaaacacgggaccacacacccctgccactaggctagcaagtgcaactcatccttttcattttcaaccagccttttcttttgttgtaataacctaaaactgttatgatttatattaccattccttttctttcatgcaacgaatctgacctacctaggtcattcaacatttagttcttaatattatctcattgctaaagcttttcttgcgtttcaggtaaaagaaaacattgtaggtccttgaaatcccatgttcctcatgatcccaccactgtttccctctccactctatttaatatattaatgttaatttatctttttttggaatgtactcttgctgatttatagctaggtggtgcttatttctgttctttgttctttggttctagctcatcttggatgacattctttctgaagaaatcgaagaccatggtgcctctgatgctaattggatgccccttcctttcaaaaagtttatggaaacattgtccttggagaggggtgcttatttggatgacaaaaccatgctgaatagggctataacatcctgcaagaaagatctgtatcattattcccgaatttctggaaaacatgtccttgaagtcgttatggaaactgttctttctttgattaagagggagcagcttcaagaagcagctaacgtatgcattttttttatgggatatactgccttctttttgctactatgagcattgcaggacaatttccactagttatatgcctcactgataccttctggcaaatggctttctgcaggccatttcaatgtttcccctactccaaccattggttgctgtcttggggtgggatattctgaagggtaagacagcactgcggagaaagctactgcagttattttggacgagcaaatcccaagccctacgactacaagaatatccacattaccgtacagagacagatgaggtacttctgtgcttcttggctctcttcatttctcaggtagcatgcataaaaaacttgtgaacgattgtgacagcttctattggcagacatcctgcgaggagtacttgtgtgatcttctatgctttcatctggatgttgcatgcttcgtttccagtgttaattctgggcgccaatggaatttgaggaattcactgttgtttacccaacaagagcaagattctgatgttaacagtacagaaatattagacccttttgttgagaacttgatacttgaacggctagctgtgcagacccccattagggtgagttctaatttatcttaaaatccgattactctgatattatttctccaccaagcattcacatggctacatttttactacacctttccatattttacattttctcttttgtcttattcatttcgtgttgagtgcagagcctttggttttgcagttgatggctcaatattcttgtgaaaccttttcttcttgtaacttccatataggtgctatttgatgttgtcccaggaataaagtttcaagatgcaattgagcttgttggtatgcagccactttcttcaacaactgcaatttggaagaggttcataaccatctctgtaatggcatttcaccaactactccatccgtttcatattataagtcgtttggctttttttctagtaaaacttctttaagtttcaccaagtttatagtaaaatatactagtattttcaacacaaaacaagcatattatcaaaatatattccatgttaggtttaatgaaactaatttgatattttagatgttgctaaatttctattaattttatcaaacttaacaaagtttgactaggaacaagtcaaacgacttcagagggagtaatatttatccttttgatttacatattcaatattgcattcttaacttctcacttattgtgttttggtccattaagatctcaccatctctgtgactctgacctgccttttgcttatctcgataatgccttaacttgtttagaagatttcttaacattattatgcaaataaggaggaggaacttaatcttatttacgtattgttcactcataaatgggcaggatgcatgacattgagctgatgcacatgcgatatgcgcttcagtcagccgccctttctctaggagagatggaaaagagtgcaattgatgggaatgaacaccattatcagatagccttgtcatatttgagggagatgcaaagttttatggaggctatcaaaagtactccacgaaaggttggctttgctgcacatcttttttgtttggccctttgtccttaaatgaagtgatggtttatgtgaagcatgcaatacttctgtgctaattctaaacgttgtttctgaaatataaatatagaaaatcatgggatcgtaaattctaccaaattcttgttatctgaacacatgtatattactacttttacacctctttgtttgttaatgttaaagtcatcagttacatcatgttatttatataaactttttttttgttacatgcacttattttgatgaggataattcataaagggaaaacaagtcaacaaaacaacaacctgattctagattctttctccattctccatagcaccagattcctatcaacaactacctacttttgtctattagcacctcatcatttgaaaataacatacaccagagaatagtcccttgtatgtcccctgtgacttcatccatcacaaatgctaaaaatcattagggctcaggggtaacccgtcatgtagtcctatcttaattgggaagttagcatcctcgctgtcacatttttgaaactttatgatttttcagtgcctaccacagtgaccatttttggtgttctgtaatatccgatctccaaattgatgaataccaagtccagattcttctgctccagtcaaccttacattttgag

SEQ ID NO: 82286 - DNA, 2424 bp, Oryza sativa
atcttgcagcaggaaggaagggtagcactaccagctccacctctcgttctcctgcccgtcgtcggtggtggccggcggcagctgcgagtagaagtcgtagtccaagctgctgctgttgttggtcttggatgatgggttgtagtagtggtgcgcgagggcggcgccgccgaggacggcgagggtgagggcctgcgcgtgaagcctggcgtggatcagccgcatctgcggcgtcttcctccgcccgtacgccaccgatgcgcccaccgccgtcgcccacagccctcctgttcgtcacagatcgatcgattgactgattaaggagtactgtagagatgaaggaattggattgaatcagaaaggggatggatcttgcttaccgatgctggcgagcttgtgttcctccacccacgactgcaccgatgagctcagccgctccattcctgatgaatactactgatttcgacgactctgaatctgaatttgaggatgtgatttgggagtgagagtgagagacagtgatgagaaatgggaagctatcgcgtagaatttataggaagcaaacagataaaagagaacgtcagcaaaactgtggctactgagaaaccagtgggcgggccgtctgtttcactccacctgctgctttggtttcttcttgtgggccgccgtttctttgctacaaggctccccaaggttgttggttttgcttcctcccaacagttggctctatcggttttggactctttggtcttccttgtctgttggctactcacatggtttcttctcttttcttctgttgccatggcatctgcctcgttcatgtttgcctcgcatgtttcacaagtgttgtgttttttcttactagtaacaagtaaaataaaaggcctaatcaatagccattgtattttacatttgctaaggcttgtttatttcacgcaggaacatgatgatttttttttaaaaaaagaaaaattcataagacttcaatggcaaaacagatcattacaaaacatgaaaattaacgtaggaatagccgtttggatagctactaataaaacactaaaatttgagaaggggatgatagatagataccacaaataaaatttcaggtctttattttttattgaatgaggcatttcacaggaattttataggatcatacccattcttcatcgaaatgaatatatgcaaaagttaatgtaagatttaaaatcatgcaaaagtctcttattttgttgttaagaaactcccctaatcgagaatggcatcttgataaatccaagtacagaataatattttaaccaaaccacatcatcaattaataaccctcctacccataccgttttcctcacgtctttagagttatttttgcttctagagaggttaacatgtaattttctacggtttattttaatagtgccataatagcatgggggcagtgacaatttgacaatagtcccacataattcctctgtagtgatcttgaggacaccggaattattatttagatatgtgagggatctaaaattcttaagagggtataatacactacttctacttatttatcttaattaattgggcaattctatgtcgaaaaaattgttggagggtcgttcccgcttgtctctgctatcagctgcacgtagccttacatatgttgggttctctctctttctcctcggtttctcttcatgggagtgagtgttgcatcgtcggcagcagcggcttacgtgtgccgaagcagcggcggccggcgcctcctccaacctcatcccagctgacgttcacccgacgccgcccgtcgcagggccggatatcgatagatcgacaagtgctcgaacggtggcggcagcaagaggggtccgccctctgcggcgctggcaagcactgtcaactgcgccgccgggagtcgccctcgccgccctcctcctcgctcgctcatctccttcggcgtctctccctcccggtctccgcccccaacgcctccaccaccggggctaccgatgacaacgatccactgtcatttgaagaaggaagaaacaggggagaaagagaaataagaaagagagagagggaggaggaagaaggaaggaaagaggatgccatgtgggtccccatattatttttgtgtgaatgataaatgggtcacgcgtatatttttttaattaatacacataagcaccacatcgaacgaaaaccaagtcaacaccgtcacgttagcgaaaccgccctacaaaacctttgagagagccaaattgtaccggttttaatagttgtggggccgaaatatccggcaatacgaattagattcggttaatactcaaggaagtcaaagtgaacttatttccgtggcgtatatcccttatttcgatgggtgggcttgggctgacaaacaatcacgctctcggcccaaaacttgtatctttt

SEQ ID NO: 82287 - DNA, 4946 bp, Oryza sativa
cgttcatcatgtgtttgcagtgatttgttttcctgatagaagcatgatttgcatcaaatggatttgcagattttacatggtttcttctagtggtaactcgattagaatttggcagttactagtaggtaacgatgcatcaattgcggattcttaccatgcagactgcagctctgacaaacaaaacgtgaaacgcactaaataaactaaaagactaaacacgggtctcaagtccttacccatataggaaaggaaattccacctgaatcaagcaaatttcgcacaattgggtaccatgctgatttcggcgagggaagaggaggatcatctgcctgcaaaattgcaggcttagcacgaacatggcagttaaggtggaaggcttactgaattcggggcggggccacattctctgcataattcagtagtactagtaaacagcccaacaaactggaccattgatccagaaaattaaacaacctgcaaattcgacgtgaatcaagctaattgcacataattgtcaccgaggatcaacctctgcaaaattgtaaatttaccatccagtggggaagtttttggtgaaaggcttactctgcatatttgggaacgattttgctagatctttgtcaacagattttcacccccaatatttgtcgtttttctatccgtaggatttgcgccatgattcgtgcatttccctgtgtggatgagaccgtgtggcgtgtgagcagatggcctgggagtcaatgtgggccaacccatgttaaattttggattccgcgctattatgtccgtaaccgttggttgtttcctcgctctctttctttattctcgctctttctctaaatctctttctcctctttcttttctcttctcgttttctccgtcgagagagagagagagctcgccggcgagagagagcacgagcagctccccggcgggagagagagagcgcgcacgctcgctgggggagacaactcgagagagagttttttttgagtttcttccctgatttgctggcatcattagcttgtgttttggttttttcaatgtcaatagggctaggtttagaagattcgggtcaatatatgacgattttttttgctcccaacgtatggatctgattcagaatcacttgttttagttttggaatccgtttagattttggattccctaagtttttagttatagtttgattcagttcagtctagggtgttttgttactagtccattgtttgcaaacgaccagattcgatggtgttctatgttttttttctaatccacgagggtttttgtatttttggttcgatttttcttcaggggtgttcatgttgggggttggattcaggggtatttgatggagttaaaggtttaattcgaggtggttttaggggttttttctaatcacccagatagttgatcattttttggatccctgcatgaattttcttcagggagggggtcagattcatgagttgattatttttgctttgatttatgtgtgatttgaatatagtagggaagcatcattgcaactttatctgaatgttgcatttcactttcagtgattagttgactgatctgttaaactccttgcatgagtctgaatttttctgcatgtgaagcatttcgtttcagagatgatttatctgtcaactccctgcatatatctgaattcttatgcatctgaagaatttcgttttacatatgcatgctaactgaaccccaagtatgttttgtgttgccttctgcagcatatgaatcatttcgtttcagagatgtacggtttgatttcccagtatgctgagttgcttggttaaattaaacccaaacccctacatgcgttctgctttcttcagattgtattctactgtactatttggtttataaaattcctgtacatgttctgaacttttcagtgctgatctaaatgagttagcagcaagccaatacctgaacttggtccctgttgctttgagaaattatgggctattggttgcatctgctctttcttctcttctgaacttttgttcattgtcaatcgctcgtaaatcgtaaatctgtttgaattggcgctatttctgaacttgggaacataattggcactatttctgaattgggaacaggggatagcacgctcgtaaatctatttgaattgtcagtattttttgaatcttggagcaggctattgaacagtttcagtcgacatgagctttttaaaatctcatacttcagcaaactgaaaaataatttggagggtttcagtctaatgttgatctaatgcatttcaatggtagcaaaaccaaggtcacttgggtgcctggaggtattcacatgcctgaaatatctgtatgattttttttcttctttattctgaatgacccatcgtcccatcccaatattgttcccatgttaattatgtgtggagcttgttagtcagttaactcatttgctgtgaaatttaatcgggaggctcaacaacaacaccctgtctggtccattcccttctgcatcagctaacttgtcacatcttgttgtcgagtgattttaatatatgtgcacagaagtttgagatatgtgcaaattatgtacaaaatttaatatatgggcaaatttgtacacaactggagatatgaccgtttggaccacaatgctctgttttttttttatcctaggctctaatctaattgttgtgctttgttaaacaccactgtctgaagatgattttcacttgaggaaaatcttcagtccattgtgacaaagtgactccttttctgaagaaattctttattttttgaagaaattcaagcatgcttgcagttttagcccagttacagtctatatgtattgtagttacatatgtaacttttgttatttctcactgtaactgaccgtagataaatagttctttatatatttgtaacataatttagagcttgttatactaggggaaagtgttttaatgttgctgcatgaatactgaatttttaaagaaatttaagaatgattccatttacaacccagttacagttagatgtacagtagttacatctgtaacttttgttatgtctcactgtaactgactatagatagatagctctttatatatttgtaacataatttagagtttgttataattggggaaatgttttaatgtcgcagtataagtactgaattttttaagaaatttaagaatgattccatttacagcccagttacagtttagatgtactgtagttatatatgtaacttttgttatttgtaactgtaactgactatagattgatagtttttgttacgagtttttctgaaaaagttacatacttttaactacttgatctaaagaaatttcctattccaagcacttttctccaaaagaaattcactattccaagtgcttttctccaatatttttacagaactgagttgtttttgtttgatttaaaagatgactggcagaatatggtgaagtcaatggggaaaggtaaaggtggattttgtgctaggtaatttgttacctggaagattatgtcttgttgatttcaacttcttgacctcaatgttcttggtaagaatttgcttcttcttctttttctcgttctcctcactgtctatggcgtgctcgatttgttttgctcgatctaggggatttgtgcgaactggtgtggtctccctgtgttattttgttttttttctgacctttattggatgtgaagttgatcattatgggccgtgatgtatttgcagttatggcctgtataattttttgtattgttctatgggctagaattcgagtccatgtagttttgtgatctgactagtcagagaaaaaaatatgtagcattttttgtgtcctctggatcttaatctaacggtaggaaaaaatctgggtgattttgacccaaggatttgtcgacaaagacatagctagttcctttgggaaagaataaacggcccaattaacttgcacatctatctatggaataagttcactagacgtccctcaattttacataaagtctgcctgacattcctaagccccaatacctgaaatctccacctctaaactatacaaaaccatgcaatttggatcctatagcgctatgaatctctggttacgctaatgtggtatcatagtcagcaaaaaatgaaaataaagaaataatggggcccacatgtaagtggaaagaaaaaaaatgtggagtccgcatttcttccttttctcttttcttcttctcttctcttctcttctcttcttcagcaagcctggaaggccaccgatggtagagggtgctgagcggagtggcggcgggcatagcgacggtagccaactctagcttgcatagtgcttcgacccaccccatgtcgctacggtagccgccatcagcaccgattccgaggctgccgctgtgatgaggacatcacttcgtcggatacgctcataacttcacacgctccaatgataattccaagtccaagtccagttcggcctccggagacagcactgacttcaaacggacctagcgccttcatgccaactccgatttgagtgatcttggacttcgtggaaagcttatatcgctacctttcaaacgcatctggtctcatgtccaaattcatctcgagtcaacgggaatcgccaaaacaagacagtgctgttgctgaaaccgaacttaggccttgggccttgtaatagactaggctcatctcgaaagtgtcaccctccacctccacgaattagcactgaaccctagctttattttcctctataaatagctttgttcatcctcaaaaacatttgagttttgtttagttgaattttaccaagtgccattcaccttgtctctagtcctcgctcgattagtcggcgactatagattcagagcccccaatagttggtgtgttgatttgccgggtcgattagatctaccacttcaatcgtaactattcct

SEQ ID NO: 82288 - DNA, 4730 bp, Oryza sativa
ttcctgcagcccgtgactgaaaagtgacaacaccatatatttttcatctaccatataactacactggttttttttattacaattggtcaatattctaataatgacttccacacttcagctcttccaagggcttgcgtaagtcctaagcacttcgaagaatagaagcacctccaatttcaacaatgagcggtgttcattatctgcttgcatgttcaaaacaattgatagggacacaagtaaatgctgcttacattattagaaagttacatatagagtcacagcaatgcatttctgtaagtaattgtttggaacaaaatcagataacaactatgagctggaattacgccatacaattcaatttcaagtagatgcacaaattgctgatgctctctttttacattattaaatgcagaacaaagctggcttaacaaacatagataggaaaataatacataccgcaaaacctttgccctttgtgattccagtaacatccacaaattgtccgggcacaaaatggcgaactgtgattgttgttccaagaggaataagtgcatcttcagtaacaggaaactcccttagttttctctttagagggactccttgtgctctgaagtggcccacttcaggttttgttagatgtttttccttcttttggcctgctccaagctgataaataccaggaaaagagttccagaagttaggaacagatcttgcaaaatggaaggcaatggaccaaagttaacgatcaataactctagagatttaccaacaagtttacgtttgggccaataaaataaagtctaagagcacacgtttattacgttatgtatctgaactattcacggtggagaagagtcatctacaggtaaagcaaatacaagacatgtactccttgatgccaaaatcccagaaccaggtgcctgatctataaataagttgttgtgatgaatttcggaagtggcagggcctcagaggtaaaacaatgctactataaaatttcaacattgtcatttctacacatttttctatccacaacgggaatagacatttgcagaaaattgctacatggttttcatttcttttgcagggatatgcttcagttactgtttacagtacatctcaatgaattaccaaccaggtattggagaggccctacaatgtgtgatcagatttatattatttcctccgtttcatattataagactttagcattgtgcacattcatatactgtctagattcattaacatctatatgaacgtgggcaatactagaaaggcttataatatgaaacggagggagtatatatcatttcatgtctaaatcgaacctcaacactcttggaagccgaaaaatctccctctaaattattatgactccaacggaagagtgaagaaacactactttcatttttgaccccagcacttaataatttccagcgaaacgaactcagctgatccactggctcgcgatgtcatcgaaacaagagttcacacagagatcagaaacgcgtagcacctgaagcgcgaagaacccctccttctcggcggtcttgacctggcagacgacgttgtcgtcgacccagaggacggtgatgggcaccttggcgccccacttgtcccacatcgccgacatgccgcacttgacgccgatcacgccggtccgccgcgagtccgggcccatcacccccgcccgagcctctatgatccgtccccctcccgatccctcgccgccgccgccgccgcccccggcggcggcgtcgtcgtcgtcggggtgggagacgaggggctcggcggagaaggggcggcagcaagggggcaggcgtgggcccgcgatggagaggtggcggaggcgcgcgaggaggcccctcgagacggccgccatggtggaggcgggtgcggcggcggcgaggctggagatggtggtggtggtgggtttacgcggcggcgaggaggaaggttgggtagggtttagtgagcttcggaggccgaggggaaatggcccagtgggccggcggaggcggagcacaagcacgggcccacttgcaggtgggcttcttacggcttgaggctttcctctctctgaccgtctctgcgttccttcgaactcttttcagaatcacactacaattttttccaaatgtaggtgttcgcaagacgcgtactctcactaatataaatacaaacacaaacatttttagaagactaacccgacgtatcttgatattgacgaagttatcatgggtgtcttactgtctacaaagacttgttcgacaacgatcttttttactatacagcatcaacaggaacagtgttttgtatttagggcaattgtatttctacccttgctttatgtctcaattgtgattttacccctgctttttagggtttgtgattttgcccctgcttttttaaaacgaagcaaccgtctacctctggtttggacggtagtttggtgggcccgggatttccgaattaaacgaagaaagaaaatgctattataatttgtgaatgactattctaccctttttcaatgaaacaaccaaatccccaaacctttgctgtcccgatccaatcgaaaaccctagcttgctgggttgcaagcggcggcggcggccgcttacgcaacaagcggcgacgcgcggcagggaggagtggcggctcgggccagcgcgcggtggagtcgggcgcgggcaggcgcggcgcggcggccccgaggagcggcggctccgtcggcgcgtcggcgtttgctcggctaaaaactctgggttattacatcctttctataagttgtgagagcaggctgcaaaaacaaatagggcagccagctctgaggtgatctggtgatgtggtcattacttcttccacgaaattgtatgatattgttgctgcttactgctcgatccgtcgatatagatttgagctcttccagagttctccagccagtttacatctgagaaggatgtggtcagatggacagatgattctatcgtcggacaagtctcacagttggtgtttaatatgtttctgaatgcgagccagagggagattctgcaggtatttgggattgctttgggttccagatttgtaagtaaagtatagtaggcagctgaagttgtttgtttctgttgaagctaggaggacagttcttgtattttgctgaatttgatgctccgatagggctgcacctattagcgtctgaagtttggggcaattgtgtttctgcccttgctgtcaaaattttgtcaaaaatattgtgttctggcatcgtttataaactgtgttcaaattattgcgaaaattctatcaaaattgtccaaaatattgtgttatgtcaacttttataaaaattttaaacatttaggtcccgtatgaaattcgcacaaaattaacttgaaacatgtatcctgtgcaagccaaaacatgtccaggggtatatttatctattcatcacacatttaacaccgttaccattagttaacagagtaggggcaggtggttgcttcgtttaaaaaaaaaacaggggcaaaatcacaaaccctaaaaagcaggggtaaaataacaattgagatgcaaagcaagggcagaaacacaattgcccctttgtatttctagctgcagcagcgtagcggctgcatatagcagccgaacatgcccaaatacaatgtctattactgaaggaataaatagctgtaaatgcaaacacctgtctcaagtctagtgttcaaaattttgttagaacccaagttttgtttggaaacaagtactcgcaattttcgactaaaaaaatatagctttttttttaacttgttactaggaaacaactgttaattgcctcactcaacacctttttgggttgatagcaacactttgcttatggtgatgctcaaattttaacgaagcaccaaaaaagatcaaacatgaaacatatttaaattcaaaagaaacagcttactattgtttcgtttatacttataagtagaatttaaattttaaaacctaattttgaaattgattttgtgattttttttaatcgtgatttattttcaacatttgcttttgtatcaccaaggacatgtaaataaaagttttttatacgagtgttttttttctatgactaagtataaggataagcgaaacaatggagccattaatgttgagcttatttctgagaagatttcatttatcagatgtgattcgcatcaacaattcaacttgtaagatagatcaactactcttcaggcctgaccgagcaatcagtggatgaatatataacagacggcattcagatgacgatcacttacatcagcaagtattcttctgatgcccaaagcaagtatgaaacacaactagaaatatattgtcgtcgacacgtattgacttattgcataactacactattctacagaaccgaaacaatctaagaactgccctccgtcaaggctcattgcctgttaaacagcaagctgttttaaccaatgaacagaactacagcctacaagaataacagtcttcaacaggtgaatgcaagacaccgagataaacttgatcacatctacaaactgccttgatgaagcacactgcgtaacatctacagtcacctgacctagttctcattggcaccaatacgagaaagaaagcctttgaaaatcatgtttatgtgatacgatgagccaacctcttcaggtctcaaagaaccgaagctccaccattgcctcctgatgcttaggaga

SEQ ID NO: 82289 - DNA, 14038 bp, Oryza sativa
ggtaccagttcctagtaccgttagctttgccacctatttgtatcatcaccaacctcttcgaaactcgtacctacctgctttttctcccttcatacacaactactaggcagctagctagcaatggtgtggagcagcacaactttctacatggcagagtagagaaaggaatccgatgggttcacatggcagagcaagagggatgaattggatggtgttgtgctacgtgggcatcagcaccaaggtgcacgtagccccgcgtgggtggatgagtggcagccgtgtgccccacgatttatcccgtacatgatcgatgcaacgggataccgtggactagcagtcctcttatatatataatgggttccttaactaatcaaaaccagtcacgcgaggtcctttgacggttttcaacccggttttgtccaacgtggctgctgagttagcgtgagacccacgtggaccccacatatcagctgaccacgtcatcaccctctcgcctcctctccggctctccctttctcctctctctctctccctctcactcttctcgtttgggtaggcagctgggtgcctgggaggtagtgctgcggtttgccgtcgatggaggtagtgctgcggcttgccggcgatggtggtggcgccgtcgccggcgggctcggcatccatgatggtctcgaaggcgccgaggagcgccttcaccctgctgcactgccgcttctccagcagcttgctccgcgcctcctcgatcacgtcgttgctccaccacgccatctcccaccggcgaggctgctcctcctccaacctcttctccatcgccgtcttcaccctgctccccttgaccttctccgggatgacctccagcagatcttgccttgcaccgccgctgccgccatggacgtcgtcgtcggtggtagtgatcccatccaaggaacgcatgctcaccgactcggagaccttgccgttaaccgaggccgactggccgagttgtcgccgccgacgtcgtccttgctattcctccggcgagatgacttgctgctgccgctgcggcggaacgcgcgctgcatgagcttcctcggcgacagcatcgacgagtagtacgacagcgagggcgacggctgcatggctgcttggctgccgccttgtccttgtgggtggtggccggcggcggcgactcgtcgtcagtcctgaccgtcatgcagctgatgcctcaaaccggcatgaaccaatacagagaatatatacggctggttaaggatgttgagctaatttcctaatacaaagggatactgacgctaacatgtggggcccgcatgagtcccatactgattcagccgacacataaactaaaaccggcgtcaaaaccaccaaaagacgttgggtgatctgttttgtatagttaagggaccctgtatatctggttttacggttcgaggatgttttttatgccgataacaaactgagggaccttcggtgtacttttcccaagaatatatggtcttttggtaccgatggatttcatcataggctatcattaactgatctaatacaacctggcccaatgggccacatgagatcggggcctgacccgatgaacccgctgggcagaatttgttgaatctgcatacaaacatccatccatccaggcacgcattaggcattaaaatagatgaaatgattaatgtctacaagtatatcattttatggacgtaactacacagctagtagctgatttgtctaaatcagctaccactttatctataagagacaccatctacctatacttcaaatacaattttctcttaaattactcatccgatctacgatccgattacaccgttgtgttcgtaagaattaaatctttacaacaagatctcacatcattatattttgataaaaaatcacaaattacttttatgatatgtctaaattacttttagatttcactaagttacttcttagatataaaagtaaattcagtaaagcctaaaagtaatttacatatattataaaagtaacttagaacaaaacgaaggtaactttagtttagagccgtcagagccgctggttctgttcaccggttttggttgatcatttaggcgatcccgtgtcatgtagaattgactcgttgagtcggtatctcgtgaggctcgcttgccagatcaattcaagccatcaaatcttagtcaactctcggtcgagattaatctcagccgctcaaaatcgatataaatcccctccttttcaatggcatattattcctttttaatatatatcatctaccaaatatgatctaatcttttccggaggttgctttaatcttttatctccgttataaatcatttgtaaatgatttaattaatttggaatagtcttttctttaataggtttaattggaattaaatcttgtaaaatttgtaattaattcataagaaatcggaatgaggtcgttcaagtctctaaattcatctaaatgtactgtttatttagtttttattagtctttttcctcgttttgcatgttagctcgtcgtttccgtcgtttcgaaggttcgcaagtgcgtcggaagtattcaagaagattaattgaaaaccgattattgcaaggcaagtcacacagatcccaaacacaattcctttgagcatgttgatcctatatttaaattctctatttatttcaactgtgcatttattttcgaatgtcaccgggtggtgtgaacctattcctttggtatggccactttgtattgattaccctattcttcgatacctttggttttaattggactagttgtacttatataatggttcaactagatgtattagacataattgcttagccacgcttagaaacattagcacgcaattaggataactaatgtttcactattacttaatgatgggtatttgatgatagctcacgatggttaatcgtgattggttaattaattaatttgccaactaaaacttgataatggtgggttgtgggcacatggttttgatggtcgtgctcatgacaattaaggaccagttcacgagtttcgattgtgaaacattaaacgtgccaaccacaagccagcatgggcaacggctttaccttctgtatagcatggttcattgcggagcaccagactgagaagtggtggagataagcccacgggggtcgctggggagtccatgccttgtttgtaagggggtgattatgatccaggaacggtgcgctgtggtggattgtgttgtgcgaggggtactgtcacagctcctttctgagatacccgtggtggtatcgaggcgcatggtgacatgttgtggagctgtgtcttgtgggtacagtggtacacctctggccagagtaaaactattcgaatagccgtgcccgcggttatgggcgggtctaacaatgtctttcgtgattagtctcacacttcttaccataataaatgatgctataattggtaatactttgattagctcctggtttggaatggtacattcctggtttggagatagatccgtacagccgggtatgattgttcaggatggttggacctgtgcagcatgggtgtgttgttcagtgttgattaatattgatgattaattattctactgttttacaattctcaaatgtttgttaaatgccgttttcgcaaatgaaccctatattatgccattctttggtatccttgtgcacttgtatatttgttgtgtggcttgctgagtatgtcatatgctcaccttgcaataatcaatcaaacctcagtggaagaaaaaggatccagaataagaagacgtttggcttatacctcatttgagctgcctgtgggagtggagccggagcttcgctagaccgtaattctgctgctgtttttcttttcttttgtaagtatgtaacgttattattatgatgaatctgtatattatattgtcagtttgtgtacctcggctgattcctagacgaggatgtaatgcacaaataagttcggaaattactagtgaatttttgggcgtgacaaatatttcccctacttacttaattaatggattagtactacagtaaagtaagattcttcaagctaacacatatctagattctggataggcgtcgcttgttatgactaaatcaagagtggtctcgaattagattttgcgcatttttatctattcacatcatccaacctctccttcagaaaatgtgagagcttcacacacaaatgggagatcaaccgtatgagggtaattcactactctattttataatttccctcacaaaccgactggttcttgcatgcgtggatctacctgaactcttttttttttttttgagaaactacctgaactcttttattgcacctagtctaataatggactttgtattatatcgtgatgggctatcattagcggatcttatactatttggccccatgggtcacggagtttggccccggataccccaaattagtcccataaaataaaataggttataataatctcaaactaacaagtggatgaaataatcaaaattcctttgttaatgaaagaaaaaaagagaactgtttcattcctattaacatacccggatggaacatatatactgaattgctatatggaattcgatagaaatttctggatgaaatcttacagattttatatcgttggatccatgccaagattcgtacatcgcttcttctcctccaactctggcgagctccccttcttctccggcgctggcgacacccccaacaccagcagggagcatacaggtatgggtttggggttgggattagggtaggaggggttaggggaggaggaagtgggggggttggccgtgggcggtggaggactgacagtgggtggtggacccgggcaggtggcgaggcgttggcagcggtgtcgaagacatgaggttggcagcaggtcgagggccagccttggcggcaggggaaaatacccagactggttaggagacggaggctgggtggtggcaaatctggtggctgggagccataggagatagggaggacggcggggcgggggcactcaccttagggaagagaagggcggaggtggagaaagccggtgccgttgacaccttccgaccagccggcgaggctgggcagcggcgcggcgaggcgacagggtggcggcccggcaactgcgtgcaggatgcagaggcggaggagagctcgcacacgctcgtgcaaaatggtggtggcgacggcgggcaaactgagaagagtcggattggaaaaatggttatggctattgacaatcgatcgagacgatcgatggatggtgtagcgggaggactcatcatatccttgcctccacggaaggggtgccatggatgtcctgccgcctgatggcgtttccatgggatcctttgacgacggcatggtacaagacgatgccacacgcctgatggattgcatcgtcgcctccaactcgccttagagccaaatcagctttgttccctccggataaaccgtagatagcgcaggcttatcgatctgggctagcgagaagtatttagaattaaatttaaaaatatattgttcttttaattttttctcatgaatattcgggatgtaaaattttttgtgtaaatataccttcgatctcgcacaaccgttgcgcgaaaccgagattggtgtgacgtcatgggcggtaccgcgcgttgaaagtgcgagaacgcgcggtctagcgcgacgaaggcacgagagcgcgcggtttcgcgcaatgaaagagcgagaccgttcggtctcgcggaatcaaattgcgtaaatgtccacaggctccatttaattagtgcttaattacttaattagcaattaactaataataattagcaactaattatcctaattagcgattaattaataattaattaattgtaattaattaatcgctaatcaagataattagtcgctaattgaatcagcatggcaccggtctcgctcagtgcttgcgcgagaccgttctgtctcgctgcgccattccgcgagacccgttgttccgcgagaccgcgcggtctcgcgccttcgccgtgcgataccgtccacgacgtcattcccacgtcattctcgcgcaacggttgtgcgagattgacggtatatttacgcaaaaaattttacatcccgaatatttataagaaaaaattaaataaacagtatatttttaaatttaattcgaagtatttatacgcgagatcattagtattcctgttttcccattacaatgcgaaactttttctcgttcaaagcggatccgcctagtggatccggtaacaagcttcatcgaggcttgcagcgatggacggtagatggaaccgggagtacgtactcttgagggtacagaatcattttcatatcttaatcttaactaattaaaagattcatatttttccgttcgtcactttcccgtttcatccgtttttcgttcgtcacttcagccgcgatcacccgtcgctcctcctaaactctttttcatcctcagaatcggattaagaaaaccaagtcataacaacagaatcctcgtatgaatccaatcttagacaggcacttttcaaaatcagtgtttcacagcttccatacaaccaaatcagatgcataacgaaaagcaagatcagaagataaacagcaaaatccaaaaatttgttctacctccagccaccgcttgagagacaccatcgtcattgcgtcatcatctacaaaccgctaaagcctggctcccttcctccgttgccattgccactacctctatgtggagatagcgacaagaagcaggttaggggttgccatggatacatcaagaggagggggaggcaacgccaatggtgatctccgaccaccgcacattcacgacctgcccctaccaccgcatggccgcgccagtgtcccggcctccacatcgcaccgagccaccaccgccgcacggcctcatcctcgtcgtctccctgccgtgcctccacctagccgcgcagccgttgcccgttgcctgaccgactgacacaaaaggaggaaaagagaaaaaatagcatcagatttgtacgaacaaacaaacaaacatcatatggactaaggggtacggggagcgacggagaggaagccacgctgccgtggggggagccggggagggggagggggaggggcggagatggagggcgtggccggctgagagaaggagaaaaggagggaaaggaaagagggaaacgaaggagagaagggcgagcaagaaagaggcggaggcgaggcggaggaaagagatcgggaaaacaaatgaagagataaggacgggcgaaagaatcgaggtgcgtgggcagttgggcacgccgctctctctccgctcttagagcaagtacaatagtaggctataagctagctataaacatattttaaagagataaaggaagagagagcaagtacaatagtaggctataagctagctataaacatattttaaagagataaaggaagagagagaaaagcagcagactacagatatgtagccagctgcatcacggactccaagacgtaatgtgtgtatgacaggtgggacaggtattaatagtatagtaagcaactattgtatgaattggctattacattggctatagataatttggagctagtagtgggctatactattaaacttgctcttatgggccgttaaaaaaaactattataaattatttttttaagaaaacggtgcatatatgtcagtttttatttgaaattaggtgggaaaaggattaggaaggactagagaatctatttttgcaattaattagagaagaaaatgtatatgtagacattttattttgtatagattttggagcggatgttcttttttttacagactttgagtcggacgtttttttattttttgtttacggacgagaagtcctgttttccagggagtcagacgtttctttcctttttttttacgacagaatttttttctttccttttttgttacgatagaattttattctcgccatttttttagttttatactgacaacggaaacatctattattttattttttttatttattatttattttagataatcttttttaattattttaattttaattttatttttttattaggtttatctactttaaaatattgattttctgttcatcacacaaatttctatctttatctcctgcacaaaggcaatcacactgttcgcccattcgttcctcccatatgctacatccatcacgcgtcgtgtcacgagcatcatccacatcccgtaaaatataaagtagattaattgtccaagaacaaacatgactttttgtcattatacacatcgtcaatgccgatgatcatgctcgggtgcttcgataaataattgagatcaaacttcagccacatctggtgcaacgcacgagcattttgctagtatatgtatatatatgtatatctatatgggtaaattaactggtgctacatggagtatgggctccaagattcaaattgagtatatatccaatttgaatgagtatgaatttttttaaaatgtttaggtatgaacattaacttcttgactaccaagttcaaacaaatttgaactgagtttgaactttttttttgttagattttggttctaggtatataacatccaaacatataattcgctaggtatgtaataatgaattgtgaaataaagttgagtctaatttattttgttgttaggtattggtatgaatcaaattcatatacctgggtttatactcacaatttaaatttttaaaaaaaatttgagagattttgtgtgttttatactttggagcccgggcaccatggagtcccatatgggtatcccatatgtatgtatgtatgtatgtatatgaaggttaaaatataatttatttgaatatcctgatcgaacagagttgtatacgagggtaagtgctaaaaggtcaaatttcagggaaatataactatttgatgtgaaatgtttctagatgaggttccaaatccttgggctgagcttaatacaagtggtgtgtaagacattttcatgtgccaattaccaaatgcgataaattcataagaataattgtcgcagaaaaatgttcactaaaattttaatgctagaaataatttctaggacgacttgataaagtcaaccaagtcctgtagggctaaatcagaagaaccacctttcgtagtgcattttgacacgacatcacccatctctctcatcctatctctaactactccaccctctatcccatccatcaacctctcaatcgctgcctgtattccccctctggtcagcttatcctcgacctcaaccctaacacccaccttccacatgtcacatacatacctcgccgtccctaactggtcaccgccacatggcttgcatatcatcggcacggtcctggatatgctctccagcgtcgagttccacccacagtgtgtcaaaaacgcgcctatagcggggtggctcaggacctcctcttgtggtgcccacctgatgatcctccctctgccacgtgtctcctcgagcagctcgctggggagctcgacggagtcgcgcccacggaccagccttggccggaccacccacaggaacggccggttgctggcagcgaggccccaagccacctccaagagctcgtcggcgtcaatggagacgagggtgccgaagctgacgaacagcacggagcctgggagctgcgtgttcagccattccaggcagctgcggtcctcgaggagcaggctgcttttctgcgtcgccaccgtcgctggtggcgagagcatgtggagggggccaacggggaacactgggatggcggtgtcgcgccggatctgctcgacgtcggtgcgctcgatggcgttgaaggtgttgaggattagaccagaggattggcggacaccggcgacgatgtgggcgagcaggctggcgtaggcgacgtgccgagacgtgtccatcatgatgtggaggtctcgcaccaacaacggcggatgcttgtccactggcatgtccagatttgactctgaacaacatatacgattgcattatgtagtcagtattgaatgaaaagtggtttcattcatcaagaggatatcctctcatttcttgtacctcacttagataattataaaaaataaaaaaaattgacaaaataaaataatatcagatagatcactatgtaaacatgcaggtacacaaataacaaatataaatataaatatatgataactagctatagtttaatttgttcttttacatagtgaaatttctatggaaatgtgtgaaatttctatagaatgcctcacttcatgcaagttttaaaagaaactaggaagaaagcctgcgcatgtgcacgggcaatttatttactgtttataaaaataatattaaaagaagccctatctcaccatattcactacaacaccaacttttgggtttgaatgtgggaacccacttgtgggtttgaatatggaagaagtgagttttttcgaatggagagagtagacaatagatgctaacagttgatacactaaacgatattgtcagaaaatttggatgtctttttaatagatattattacatctgtacctataaaaaaccaaatgcgtcattaataccaaaaaacttcagctctacttcatacccatgtctcatagatatccaaatctatatataaatatttaaaaattctgcttctaccaattaataggataaaatcgtatatgaatgcccctctaatagctgggtgaagccaattgtagccactaaggctttttccttggatgccttgacttatgggtcccgtattgatatagtcgtgctcatcacgaaaagtgtgaagtataattttataaaggattgtatttgtatgtaggtcaattgagctctattgtcaacaattataaccttttactcggaccacctcaacttaacaatgcatactcctgtcattgttatttcaacgtggccaattaagattcatgcttgttgccctttaggatatgagtgaataaagatggaggtgatgaaaatagtttttcttatatcttgggttgacttgttgtatagagtagatataatttgtttcaagtgttaatcgatagtacagaaataattttctcttttaaaagttttcatggttgatcattccactctacttaaaaaaaactaatagcttcaatggtgacgaccacgtaaaatttttttttctcaaattgtgatcctttgctaacatacgagttaatataggttttgatttttttttcttgtttacacatttaattcacgtatgctttgttcacggtgattaatattcgatggaatttgtcaaaactatttgtgctaattgttaacacaatttgaataacaatgacgtttaaaacggggatataatgtagttaagtgtatgtttttttccgaatagtattctctcgtatgtttgttttttcattttcttttaatgaattttatctatcatagagacagggtgtacgtatgtgtattcatagtgtgcgtacgcatgcatttataagagctcatgtgagccttttacatcattggtacaaaagaatacttcaaaaaaattgatggcaagagggtgagcaacgggtggcgtgaggcggcgccatggcgtggcttcttttaccacctcgcttggagtggtcgctacgcgtatgctcaatttgggaaaaaccttatagctggtaagaaaaagaaaactaccaaatgggacatatcatatccacactccttttttttctttttatatacgttgcatacgcatgtacataggagttgtgtatgtatgtaagggaagattagacagcctttaggatagaggaactactgtcatagatctaatttatttgttgaaaataatggatcaccgattttgagtgtaaatcgatggatagatgttttgccttttattattttatttcttatattctctcttattagagggtcatgtgacatcttataagcgtttatatgagtgtaggaacactattactcatagccgcaatctatttatagtcaactattatttgcggtggattggttgcgtcctctatttaactactccctctatcccataatataaggtgtggtcaaagttggcacagtctccaaaactaatttttaacttataatttctcatatactataagatttgtagcaacaaaattataaccatatgaatgtaaatttaaatctcaatctaatgatataatttttaactaataaaatttattttatattatactaagtgttggtcaaatgttttaaagtttgaatcttgaaatgcgtccatgtcttatattatgggatggagggagtatcatttgttgaccgttatgcacttagtattgccctttatatttgtgcttgataacacacgtgcttattagatagatacctcataagtaatatgaaatatgacttggcgattagtggatagtggcttatatataaaacttacaaacatagggatcagtcaggacatacaattgatattttaggctaggattgaccaagtatattctaaactacataatatgtgttttattatcgaagtaataaatttaagagcgcgttctaacgtgtatataggattagatactcccttatttgtagcgagcacatttctcgagcggctaaatgctgcattacaaggtgcatgttattcaaatcctttatatatataaaagttgttttttaaaaaataaattcatttttagttttgtaatatttaatactcaattaatcgtatggtaataatctgtatcacttcgtgtgcctggataagctcacttaatgacgaagcctaagtaggacatagaagacatggacacgatatcaaaagaacatacttgaccgttaatttctaataatatatataaaaaaattataatacatgaaaatacattcatgacaaatttagtaatattattttgatataacagtttttttcatagtaaggagtgagtatttttttgaatattactcacaactggagttgttttgtttttgaaaatacaaatcgaattcaacaaaacatgttattaagtgatatacaattatataattatataatgtatattattcattttatttagattatggatatttcgatgacgtgagtttagtacaatacaactgaaaaaaacttatatttgtgcaactatgagctggaactattaatgtggtttttatctcatgtgagtaaaaaaaggaaaaacgaaagactattaatatggtttttatctcgtgtgagtgaaaaaaggaaaaataaaacaaaaggatggacgtggggcactgcgtgagaagtacatactcctatgtactcctaagaactatatgggctggaaattatgaattttgtttttttatgttagtgaaaacgaaaaaaaagaggggcatggggcccacgtacaaaatatgtacgtatatgcacgtacatgtatcgatgtacgggagctgtggttttttaaatataaatattgttggttttttaagctatatctaacggttgaaaataatggatccatcagattaaatcaaaaccaatggttaaatattttacttttttttataatatctctaatttaatagagtgccacgtggcggcgtattagcgttgtacagtgccacgtggtggtttgggagtatttttaggaagtttatttaacttttagtatataatagatagatagatagatagatagatagatagatagatagatagatagatagatagaagatttaacatgggctagaaccttatggaaatttttctttgagtatttatctttacttaaattcttgtatttttttctgcggttcaattaaacgatattttgtatttttcctatattttgcaatcatttattttatatttatattcatatcagaatcttatgttttgcttattcgtctattttttttatttctacgattcaataggccctgattattctaattagtctgctgaaactagttctctgacgaacacattttcgccgggccatttcaaaataatggaaaaataa

SEQ ID NO: 82290 - DNA, 649 bp, Oryza sativa
tcctctcccctcccctcacctcacctcctctccctggccgccggccggaggcggctactgggcggtggcggcacaccccgacgcggtggtgcgcggcgtgtgctcgcccgatggcagctcccctccctccctcccagatctagccggagggggaggggggaggccggtagcggcgcggggtggatagcggcggggcgcggcgtgtgctcgcctagcgatggctcccctccctccctcccagatctggccagaggggggagggggaggccagtggccagcggcgcaggttggacggcggcggggcgcgtccgtgcggcggcatgcagcggcggattgtaggatcaaggaggccgactagagggggggtgaataggcggttttaaaacttaatggcacttaaacaaaactaacctaagttgctaggcaaggtgaggtgcaaggttaactaagtaactaagttaagttttgcaaacctaagtgatatgggctcaaatatgtctctatgaatgtaaatagcacaaatgtaaatgcaacaaataaatgagacaagagacaaggaatttttcaccgaggttcggaaactcgccggtttcctaatccccgttgaggcgagcccaactccaccgctcaaccacgaagcaaccgcacg

SEQ ID NO: 82291 - DNA, 189262 bp, Oryza sativa
gcccgccgccgccgccgcccaacgtcgtcgtcgtcgtctccatggcttgctctgactttggtcgcgctcgctcggctcgcccgctcgcgtttgtgatgcgtttgctgcctgcgagcggccgcgggtgcgtggtttttaagcgtgcatgggagtgtgaggaggtgggcgatgggtgggccgtagcgcgtgtgcgcgcgcgcgggcggcagggggaggcgtagctagcgtggggatcgtgtcgcgttgcggtcaaggggagcgtacgtttcgacgttttcgtgaggacgggaggagtcgcgtgccgcccctgtgccgtgcgccgcgtagatcaccacggcgagtggcgtgatccatccatgcgtgcatgcatcgtcgtcggtactccaatcgatggatcaagggcgtacgtgcccattgtgaagtgaaatgaaaagcaatttttcactcgtgaaaagggccttttccttcgtgtacgcgttttttttgcccagctggccgcatcgatcggaaaaaggagagagtaaagtgtgcgtgcgtgctgttcgacgtgggctctgaaaacaatgggggaagaggaaggaaaggaggctgcggagcggagcgcatgcaatgcacgcagctagcgcgcggccgcacagtgaatgcgtgccaacttgcctttccagaagagaagtagagtagcctagtcgatctagtgtaggaggcgcaagccgtacgaagcatctcctctcctcgtagtcgtcctcgggaatgatgggaattatttgctcgtggcaacagatttttcgttttacgggcgagatctcgtgtgtttagcccctttcggtagaggactagctagcatccatcgcgtcgctctattcatcgcgtacgtacatgtagcctctgcacgtactatgcgctgtactctgcgtccccgtataggctacttttgcaatgtccaagttagatcgatcagattcaatgcatgcacgagtttgggagtgaattgaagcttgcttgactgcttgaggccaaagtagatcgagttgttacatcgcattgcatgctttgactactacgcgatcagatcagagtgccttcaggataaacggatcaagcattttttttgttgggaaatgctcgtatcgtggttttgcgcccaaacttcagtctattgtcacagaaaatgttcgccgcggttctaaagacatcaatgcaggagattcatatcgatctcgcgcattccgttctgtgaaagcttaattcagtatacatcggtgtaaagcaattggttgcaggcttgcagcatgctgcatgcagctgaaatttttcgagttactggttgccgcatgcgtgcccgaacaaggatctctgaaatgataaatcaggtttattttgcaataacaaaagatcaaaccagcaagatacttcctccatctaaatataagtgcaactttagtacagatatgatataaggtgtatttaattctttgggtgtaaagtttttgaagtatacggacgcacatttgaaatattaaacgtagactaataacaaaacaaattacagagtccgcctataaactgcgagacgaatttattaagcctaattaatccgtcattagcaaatgtttactgtagcatcacattgtcaaatcatgacataattaggctcaaaagattcgtctcgcaatttacatataaactgtgcaattgttttttccccacatttaatgttccatacatgtatcaaacatttgatgtgacctttttgaccaaatttttttgagatctaaacaaggccatactccaatctaggaatacaaatctgaaaagtaaggcccgtttagttcgcgaaatgaaaatttttgggtgtcacatcgaacgtttgaccagatgtcggaaggggttttcggacacgaatgaaaaaactaatttcataactcgcatagaaaccgcgagacgaatcttttgagcataattaatccgtcattagcacatgtgggttactgtagcacttatggttaatcatagactaattaggctcaaaagattcgtctcgcaatttctcccctaactatgcaattagtttttatttttatctatatttaatgtttcatgcatgtattcaaagattcgatgttatgtttttgaaaaaaactttctggaaactaaacagggtctaagaagtatgctgtgtgcatgcaaacggaaagttttaaagacaactttactgcttgtctacatgttgtgtgcatggtaatcagctatcacgagctcacaaacaatgaagaggagagagaggccgggacctgaatgatcaatattgggacagagggacgccggccatggcttttactccctcaactggagacggcagctaggctgccataggtagggattgaaatggcgaggcacattgggaaatggagatagaggctgaggctgataccaaagcaggctagtgtagggcgatagatgagacgacgaacactgtatgcatgcatgcatgcgttgtgtttgggacatgcatgcaacgcacggcaatgggagagggcagaccggacggttcaggagtcggattttgagattatcgcttcccgtttccccgtaacgtgatgtgagagaagccgagacgctgcacgcctgcgtcgcattactcctcacgagctaagctagagactagagaggcagggacgaagggagaggcagacgagagggggaggaggagagaacggatcggagacgctgcaaattggcgcttgctggtgctgcgcgcattgggaaatgccatgcgtagctagaggctaaccacgcgcgactcgcctcacccaatcgggctccggtgagcagtggcagcgtgagcgtcgtcgtcgtcgggtgtccctgactagataggacatggattgactttgatcggcgacaaatcttcaagagagatccgaatacccggaaaaccgttcgccctgatccgacttaaaaacttcgacggccggccggttgggcaaatcaaaacaccggagcaggttaaccgcgagcgagccaacgctagcgcgaaaccacaaagatccaaagcccgtgctggttagttgccgtggtgcagtgcaggcgcaggtagacgccggtggaaggcgacgcgagacatccgcgtcaaagaaatcctagaattccgggcacgtagcgcaacggtgcgtgtgccatgatcaggagattgtcaaaaaaaaaaaaaaagacaacacttgagagctgttgagcagctgctggaacagacattctgaacggataaaaataataacgggcacgagaagcatgagtacaacgaagttttctgggcccaacatatattttttccttggttgattagcaccgtgaaatagtgcatagaggatcgatcagaaaaaaacaggccagtgcaaatgtgtgcatgttgttggtatgcatgctcaacagggatgcaagtgggtaatccactacccgtataaaaactcgcttgttagtatatttttcgtatgatagtttaaaatttagaagaaaaaattaactaaaagtgagataagcgggaaaaaaagcgcgcttgcccgccccacttgcatccctaatgctcaaggattctagaggtgaaaattagggatgacaattgtgcccgtttgcccgtttatccatgggtaaaaaccctattagggttgggtttgttctccattttatacccatgggtatcttattgggtcaaaagctatgcccgatgggtaaattggcatgggaatgggtaatcactacccatgcccgctttgcccatttacccgcaaaatctaacttacatgtaggctaggagcaaaatccactagaatacataagccacgtttttattttctacggtttcccttttatttcccttattatttctctccctttactctatcgccgctagaagagagacgacaccgaggcggagaatatttgatgttttaagttcaattcgaacttagaagcttgtagactttttgttccactgcttttgttgtggcgggtaaacgggcacgcccgcgggcataagacgcccgcgggcaatgggcaaccatccttacccgtcatgtagtaattgtaggatcaaggaggccgactagaggggggtgaataggcggttttaaaacttaatggcacttaaacaaaactaacctaagttgctaggcaaggtgaggtgcaaggttaactaagcaactaagttaagttttgcaaacctaagtgatatgggctcaaatatgtctctatgaatgtaaatagcacaaatgtaaatgcaacaaataaatgagacaagagacaaggaatttttcaccgaggttcggaaactcgccggtttcctaatccccgttgaggcgagcccaactccaccgctcaaccacgaagccaccgcacgcccccttcgtcaaggggtgggcaaggcgggagccggcccacggagaggactacccaagcctcgatcacttggggtagttcttccttcactccgaaggtggtgaactccaaaccactcacaaacggtgccgggcctcctccacaatctcctcggagaggtcaccgggcaacacctccacaagctgtctaggaggcggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttacccttgttgctggggagtgggtatatatacccccaaccaccaaaactagccgttggaaccgaaatccccaactttgtgctctgccggtcagaccgccgttatgaggccggtcagaccggactactttgtaacggctagaaaactagccgttacagggcaatcattgagcccactcaacctggccggtctgaccgcagtgtaggggccggtcagaccgccgtcggctcggtctgaccagttgcggctctggcggctctgtatcgccaccaaaaaccagaccagtgcaatagactagtggggccggtcagactggccttaccacgccggtcagaccggctaacagacccggtcagaccggcctaaggcccacggtcagaccgtaggtcacttttcagctcaaccgactgttagtaaaacggtgatatctcttgactcgggtatcggaatttggcgttcttggactctatggaaagcttattcaaagggccatccaacccatgaaaaatccatccaagaaacacaacttaagtcaaggataaagggctcacactccaaaggatatccaccggacatacccacaagatgtcactcactcctattggacatgcccacttctctcttggtttaggacttgagaaaactcatcacacttggttagacaagcccacaaaatgcacctacatgcatatgaactaatatggcataagatcatccacaagctcgcttcatagacccctcttgatagtacggcgcctatctagcaaatccagtctacaccaaacaccaagaccgggaaaagactaagaaaacattcttagctacattatacctttgccttgcgccatccatcttggggtcaagcttgagccgagatcaacacttgtgaccatccggttgaaccatgtttatgccgaggtcttgtccatcctttgtcaagactttattctcattacaagcttgacttcattcttgccaacatgacgatgtccttggcttggtgaccactaacccatggtgtcattcattagcctcatcataatgggacctattccttttcacacctcaaaggagaacattagtctcaacaaatcggttgtcatccttcacttgatgaccaaccggttgcatatgaaagatatagatatgtttgttgagtattcattaacatcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagactaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcattttatctccatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaaaatgatttcaaatcaagaaagaaatcttataataaacaaaatatagaataagctccccctcaagatgtgcatacatatggatatgaaggaacgcatatgcacataatcaataaagatcaaataggaagctcacactatattttggatccacaagagagaccaagttagaatgtgtgaagtttaatacatacctctcatcatttttactttcatatccaaatgagactagtcaaagaaaggctcataaaaatgttagtctcatataattaaatttgtcattaatcaccgaaacagaattaaggcacttgaacttatagtaatgggtatacccacgggcacaaataatctcacgggcatgggtatgggtaggaactacccgtgcccgtcgcgcccgattgccatccctagtgaaaattctttattttgaaacacttgaaccggtgtaccgtccatcctctcccaccttcgtgtgacctctcgccatgtccacaatggcttcaccgacgaccctatttggcgattaaccctcaaggcctcgaatacgaaggagccatcgtggaggtgctgtatgggacaaatagggtctgtttgggagagcttattctgaaaagtagcaagtgagaatctagagaaattgagaaactcatttctggattctacaactgtagattctcataatctaaatgaaaaactgaactgtatggaggagctcgcagctagagattatagaagaaactgcagttgtcagaaactcccctaacagacccataagctatattgggaacaatgtgggcaaggaggatgtgggggttgagcttaacacgggcatgtagtgacggcgtgatccacgatgggatgaccaggggacggcggctagatctagttgtctcaaagtagattcagtccctccattctgggatccttccgtcatctcttgagttcccaacaccgttagagcaggtacaataacactattgaccttgctcttaggacagctacttcgccacgctcaagggccccgagctcgacactgttaacaacagaatttggtaatatcagcgtcggaggtgaagatgggatcgaagcggagtcggagataaggattgttgcgggaacaaagtaagaatcggctggagtccagatcggctacgactagaatcggctaaatctgaatcagactgggttaggtgatacaaccgattccggcaatacgacttggtgtacaacatcgggttgagtcgatatgcttcaagatgatttccgcacatggatagagtcctgagaaggcaattatatctattaattaggatgttttacgtaatttccttagagatatgcttagggcaaaagtctgccgtaaagacttatggtatcttagagtttgttagagataatagtcgcgtctggtatggacatatcttgtaattcttgggtataaatagaccccgagccctatgtaactttaagaacacacgttcaatacaatctcggcgcatcgccacccttttttgctttagtgttatttcgacgagttcttgctttcgggttgagctgcatcggtttcgatcttcaacaagaggtaaaacttgttatgacgacttgcgttctcgggattagtgcttccatctttatgacactctaatcttgtttatgtaattcgtcgagttatcatatatcctacataatccctggcaatattgatatctaacctacaatcggctaacgtccgtcaatagaaggcagccgattaagttaaataccgatgttgacttagattatataggatatctaccactctatgacacatctaacggcttgattgtctagatattgtccttcttttcatacttatacctacatcagttaagtttgatcttatgagtcgtgattagaatctcaatctctagcctgcttctcggttgctgattagggtagcatcggagtttcagccgatcttacctgatttaactactttttatcttatatgcttgattgacatgttaaatctgccctttacgttaagatcttcctgcatttaagtatattaggctgttgtttagtatattctacttgctttaatatcttaatataaagtggtatcggagtattagccgatacatgctagatctatctgatcggctatgctatgaacgtatatagtctcattattaatatatattttgatctaagtgatttatactgtctcggcatggcgaccgatctatcccaatcacttgatttaagtatatatcgatataaagattatatattagtaatatctgcaaccgatcgagtatatttagtcccttcttatttattaatggctgccgatcgatgcatatatgacatcggctcaaagataaatgatatgtcatcggcactagccgatcggctatcatttttagatttaaccgcgatttctttgcttctacttcttgttggttacaggatcaaatcaactggcatgctagcacacccgaaggcgagctttggacctgcactggagttaagcagatctcccaggcctcgtgttttctgtcaacacgcttttggcacgcctggtgggacaactaagaagtcagccaacaatcctccctcatggccgaaaaaccaccaccaccaccatctagcccaggctctgttaaggaaaagatgctgaagttgggattgactgacgtcaatgaaggaaacgtcgtgccgatcgatccagaaaaattcacacctgagcagaagaaagagtttgaagcaatgttgcggcaagcacgggatcagttcttgaactcattcatgcagacccgcaaggggacacttgttcagaagtacaaaataaaagttgttgctgatgatcctggaaccagttcttctaaggatggagatgggaaacaagctctagacggctccgctcagccgagtatcaaaggtgctgccgatggctctctaggaaatcaaggcaacaattctcaaggggtccatggaggacaaggtgacggggtgcatggagttcaaggtgacggtgctcaggggctgcagggaggaaatcttaatagtgacgtggcacaggactttttcaataacttccaagatcaggttgattacgctgtacatcatgctttgatcaatcagtctggggtgatagtcaataccctgtcaaacatgatgaagtcaatagccgatggttcaatagctgaacatcaggctgcaggcccgatctatttgcaaggaggtgtttttccaaattatcggtctttgattaccgacgttcagtcatctactcaggcagttccctccgttacacccacaactcagccgacggcaccggcaacaactcccctacctgctacatcagctatggcgccaggccagccaatgaatcctcagctgttaatgagagagcatccatagcatagtgggcaggttgcgaatcggccaacccaagatcaggttgctgctatgtttttgccgcctcaacatgcggttgatctaatacagtagcagccgattcagcaacagccgattcagcagacaccccaaattcagcaggttgtgcaaccaatccagcaacaggtcatgcaaccagcacaaccaatccagcaacaggtcatacaaccagttcagcaaacaccaccaaggcagcagtctctgcagccgatttagcaaacgccgttgagacagcagatcgtctagccgatccagcaccaaggtttagtgagcgcatcggccgggtttgcaacgcctggtggtcagcctgtacaacaacttttaaaccaagttgtcccagaacatttggttcaccacgtacagccggatggcatagtaatgcctcaggttgttcctgagcacttgctgtgcaatatccagccggaccctcacaattaccaagggggtaacctaaattatcaatatcaacctccttccccacaagcccaatatcggccagggggattggctcaacctcagtttgcatcgcaatatggtcagttcgagcccatgcagcaacagtcacaaggcgcaactcagcaacgaccgtgggccgatgtaattgctgacgtaatgagggaacagtttgggcttaaaccaaaagagatcggaagcttgtatcggcagccttaccctgagtggtttgaaagagttcctcttcccaatcggttcaaagttctggacttctccaaattttcaggacaagatgatgtgtcgacttatgagcacattagccgattcctagctcaatgtggtgaagcatcggcggtagacgctctgaaagttaggttattccggttatctctgtctagatcggcttttacttggttttcctccttgccatatggttcgatcaacagttgggccgatttggagaagcaattccacaactatttctacagtggggttcatgagatgaagttatctgacttgacgacgattaagcagcggcatgatgaacctgtgcacgagtatattcagagattcagggagatgaggaacaaatgcttcagcttgagtttaactgatgcccagttagccgatttggcctttcacggtatgattgctccaattagggagaagttctcatctgaagactttgatagcttgtcacatctgatacagaaagtaaccctgcatgagcataggtctgcggaagttaggaagagctctaagagagttaatcatgtttgtccgtacatgtatggatgatgaggatgatcctgaaatagctgcagccgaatgggtaaggagtaaaaaggtcgtaccatgccaatgggtgaaatgttctggaaaagaggagaagtataattttgatattactaaagctgacaagatcttcgatctgctactccgagaaaagcaaattcaacttcctgctggtcatacaatcccatcggctgaggagttaggcaaaaagaggtattgcaaatggcataattctaggtctcattctactaatgattgcaaggtttttagacaacagattcaggtggccattgaggggggcaagattaggtttgatgattccaaaaagccgatgaaggtcgatggtaatccttttcctgttaatatggtgcatacagctagccaaacaaccgatagggcccgcgcaaggggttttcaggtgaattcggctaagattatcaacaaatattagaggaagtatgacaagcagcaggagaagcattatgaagaatacgatgatggttttgatcctcattggggttgtgagttctttagattctgctggaatgaaggtatgaggttgccatctattgaaaactgccctgggtgcagtgatattgtcgagagctcaagccgatcatataataggggtaatcggctgaggcagacaagagtttctattcatcaaagattgggtcctgtgaatcaagatcatggctaagaagacagtgtggtcaggaagaatcaatggtgtccttctggtactttcacaaagaatcagaagagaagggttcaaagattgaggaacagagaacgccttcaggaggttgaacaagaaattaatcatcggctgaggaaagcaaagccaaggcaggagtggcgtgttaagaatcaggttcatgtagccgatgatgttgcagccgatgaggcaaagaggttggcaaaagggaagagtgttgtgacggcactgattaacatggtctttaccttgccagccgatttcgggattgatcaagccgatgtcgacgaggtggaagaggaatcggctaagttggttctatcaccagaacaggcagtgtttgagaaacccgaggggacagagaatcggcatcttaaaccgttgtatataaatggctacgtcaatgggaggccaatgtctaaaatgatggttgatggtggggctacggtaaatttgatgccttatgctacgttcaggaagttgggtagaaatgccgaggatctcatcaagacaaacatggtgctcaaagacttcagtggtaatccatcggaaaccaaaggtgttctgaatgtggagctgacagtcggcagtaaaactattcctactacgttttttgtcatcgatgggaagggttcttacagcttgttgcttggaagggattggattcatcataattgttgcattccttcaactatgcatcaatgtttgattcaatggcaaggcgacaagatagagatcgtgccagtcgacaggtcagttaatgttgccagtgctgatttagctctttgggagatggatagccttgattgtttatctggaaaagtctgggatagagattttctaaaagtatccgattctgatatacaaccaattgaagatggagaacccaagctattattttgagggcgtcgtggggggttcagtcgtctaccctaaggatacagtagatgatctcgatgacaagcaaggtcaaggtttcatgtcggccgatgatttggaagaaatagacataggtccaggcgatcggccaaggccgacatttattagtaagaacttatctccggagtttagaaccaagctgatagaactcttaaaagagtttagagattgcttcgcttgggagtattatgagatgcctggactcagccgatcgattgttgaacatcggttacctatcaaaccaggggttaggccacaccagcaacctccgaggagatgtaaagccgatatgcttgaacctgtcaaagctgagattaaacgattgtatgatgctgattttattcgtccttgccgatacgctgaatgggtttctagcatagttccagttatcaagaagaatggcaaggtcagggtgtgcattgatttccgagatctgaataaagctacaccgaaggatgaatatccaatgccagtagccgatcagctggttgatgctgcatcagggaacaaaattttgagttttatggatgggaacgcgggatacaatcaaatctttatggctgaagaagacattcataagacagcttttgagtgtcctggtgcaatcggcttatttgaatgggttgtcatgactttcggcttgaagagtgctggagctacatatcaaagagccatgaattacatatatcatgatctaatcggctagttggttgaagtctacatcgatgatgtggttgttaagtctaaagaaataggggaccatatagccgatttgaggaaggttttcgagagaactagaaaatatgacctaaagatgaatccgacaaaatgtgcttttggtgtatcggctggccagtttttgggatttcttgtgcatgaaagggggattgaggtaactcaaaggagtgttaatgcgattaagaagattcagcctccggagaataagacagaattacaggagatgatcggcaagataaattttgttaggaggtttatttctaatttgtctggaagattagaaccttttataccattgttgagattgaaagctgatcagtaatttacttgggaggcagagcagcaaaaggctttggatgatattaaggagtatcttagctctcctcctgttttgattcctccacagaaaggaataccgtttaggttatatttatcggccggtgagaagtcaatcggctcagttttgattcaggagttggaaggaaaggaacgagtcgtattttatcttagtcgtcggctcttggatgctgaaactcggtactcccctatggagaagttatgcttgtgtctgtatttttcgtgtacaaggttgaggcattatctactatctaacgagtgtactgttatatgtaaagccgacgtagtcaaatacatgctatcggctccaatattgaaaggaatggttgaaaagtggatattttccttaaccgagtttgatcttcggtatgagtcaccgaaggcgattaagggacaatctatagccgattttattgtggaacatcgtgatgattcaatcggctcggttgaaatagtaccgtggactttattctttgatggatcggtgtgtactcatggctgtggtatcggcttagtcataatctcccctaggggggcatgtttcgagtttgcttatactattaaaccatatgcgactaataatcaagctgagtatgaggcagtgctcaaagggttgcaactactcaaggaagttgaagccgataccattgaaatcatgggggattctctgttagtaatcagtcaattggcaggagaatatgaatgcaagaatgatacattgatggtttataatgagaagtgccaagaactaatgaaagagtttcggctggttactttaaagcatgtttctcgagagcaaaatattgaagctaatgatttagctcaaggggcatcgggatataagccgatgatcaaagatgttaaagttgaaattgcagcaatgatagctgatgattggaggtatgatgtacatcgatatttgagtaatccgtctcaatcagcttctaggaaattaagatataaggcattaaagtatactctgttggatgatgaactttattaccgaacgattgatggagtattacttaagtgcttgagtgctgattaggctaaggttgcaatcggcgaagttcatgaaggaatttgtggtactcatcaatcggctcataagatgaagtggttgcttcggcgcgcagggtacttttggccgacaatgctggaagattgtttcagatattataaggggtgtcaagattgtcagaagtttggagcaattcagcaagcaccggcgtcggctatgaatcctattattaagccatggccgtttagaggatggggcattgatatgatcggtatgataaacccaccatcgagtaaaggacataagtttatattggtggtaactgattatttcaccaagtgggtggaggcgattcctttgaagaaagttgattctggggatgccattcaattcgttcaggaatatataatctaccgatttggtattcctcaaactattactactgatcagggttcaatcttcgtgtctgatgagtttgttcagtttgccgatagcatgggtatcaagttgttgaattcttcaccttattatgcacaagctaacgggcaagccgaggcatctaataaaagtttgatcaaattgattaagcggaaaatttctgattatccgcggcaatggcacactcggttggccgaagcgttgtggtcttatagtatggcttgtcatggatcgatccaagtccctccttacaaaattgtttatggacatgaggctgttttgccatgggaggttagaatcagctctcgaagaacagaattacaaaacgatttaacggccgatgagtattacaaccttatggccgatgagagggaggatctggttcagtcacgattgcgtgcccttgcaaaggttaccaaggataaggaacgtgttgctcggcactgtaataagaaagtggtacctaaagatttttcggaaggagaacttgtatggaagttgattttgccgattggtactcgtgatggtaaatttgacaagtggtcgccgaattgggaaggaccgtttcaaattataaggttgtatctaaaggagcgtatatgttgcaagggcttgatggtgaagtctatgagcgagcgctcaatggcaagtatttgaagaaatattacccaagtgtttgggttaacgcataatcggctagtattgccgatgcatgacagccgatgtgtttccatcgccttgagatggccgatatggttatatcacccttagttgtttttttttcctggtgtaatcggttgtggtttgccgatgtacaatggccgatatggttatatcgcccttagttgttttttcatggtataatcgattgtggtttctataattttatcaatgcttttgacattgtaaaattagggggcacatatgtatcaaaatgaaatttttttgagcaaatttcgaagtcatattaatcggcacaaaggattgtcaagacagtaaagtactagagcatcttagccgattacaaagatttctaagtcctattacataaaagttattgagacaagtattgctggatagccgaaatagctttttgcctaatttgttcaacttcctcaatagcttgggcaccttgagcatcagttccaggaatgatcttcaaagacttagtcagatcagcaacattcttgatagccgatttaagtcttgctttttgttcttcgacagaccgcgggagatcggctagtttcttgtgctccagatctaattcggcattgcattcctgaagttgtgccaggagctcaatcttgcgagcctcgagccgatcaatgttggatttgatcggaccttctgaaagctgatcaagtttggattttttcctcatgcacaagttgccgattagcttggattgtagcttcaatgtctttacgttctcgccgttcggtcagtcttaacttggctttctccaatttgaattgatgttgctcaagataaacggctggagtaaggatatcgactaactcatctgggatcagagcttgaatttcatgtagctgagtcctaattgaggcgcaatcaactaccaagctatctagtgatgatgcctctagccgatgagaaatattttccagagttttcttcacgtcatcggataaaggggctaaggctttgcttatggtgtcttcttctccttcatcaagataatctttgatgtcaaaagaaaaaagatcggctaagacctgcagcgacgatttaaagagagttaggggtcaaataggcatagccgatctgaatgttttttgtcaaaagaaaacctactgggatagtaggaacagttggttgaatttcttcttctatatggtgacttcctacagctgatggagtctggtcacttgttgattgctgtacagaaggagaaggaggaggaggaggcttaaaaagaaacaagtgttaggcaaaatcggctgagagttaattaatggaaaattgaggttatcttactggtggagctggtttagatgttgtcgcagccaatttctttttcacagcagtcttctttttctgcaattattaaatctttaagtaatcggtcataagatacaatgattataaaagggattaaagggagctatttactcttgaaaagtggactggagcagaaggagttggaggggtttgtttgggtgaagccgatggtgttcgttctgtatcgcttacttcggctgcggcctcgtcaatgtcatcttcaataatttcttcatccagagcttgttcaatggatggatctagagcagatagatcatcagctggtgtggtcttctttgtcttagtcttcttctttggagctggggctgaaatatttatagccgatgatctggtctttcttttcttgcgggcatcagctggttctctgataagcccttggagaagagctgaagacttgggggcattatagccgatgacggggggagatggcccacctccgttggggatcagtcctggggcatactcgatatccctgccgctgttgctttggtgatggggagaagattctgttgtctgtaaatcaggaggaaagttagctaagggctaatcaaccaagtagttattcaaataaaatcaagtgagttaggacttacttgagggacaatatctggaaagagatctatcatatacttggaagccgattgatggaataagtgtagcttccattcaccccaccatctgtcaaataatttgctcctaaaggttgccagctttatggtgtcaatgctgcctagaggaggtccttggagattgagcagccgatccatcattaaagatgatgagatttctcctcggcattggatcttatcggcaaagaataagccaattgggagttggcccattccaaattgtctggcagaactcattggatgataaaactcgtaggaaacttggatggttctcccttgatgaatgccgactggaaggatgcatggggtgattgcagataagaagatttctctgggcttctgatatctgtcattgttgatgtcttcgaatttgaagtcccatggattttctagaagtgttgagtctccatagagaaaccaaactcgagcatccttttggaacccctcataaaagctacaaaaccaatctttgagcagctcggccgatagctttgctcctgcatcagttggggtagaggcgtactctccatatgatgtgcatctccgatgagtgagttcctctccgtcatcgttaacagtcggctctaatcttgggaattcagtttctgttacagatggccgatcgacgaacctcatgactaccaagtttagccaggattgcagcagccaccatggtccacccgctccgactactgagccgacaattagcttagccgatgcattatttagcatttggtacaagtagccgaggaggattttgcctaaaggaaattgtctttttgtctccaaggcttcggctacgaactgccaattggttgtaggaccgcagctagacccacaaaagagaaacttttctaaccacattaataggaaagccacatgttctcgaggggtaactggaccctggcctatatatgctgctacatagcctgaccagccgcctatgctcttggtcttgaagtcatattggttctttgtattcaaactcatagggttggccgatgaggtgacatccagacccgtgatcatgctgatatctatgagagttgggatcatcggcccttgattaaacgaaaaggcattgatggtgtttgaccagaagtaagaagcagctgccatcaggggttcatctttggccgagtttgctatagtgaggtcaagtgcttggccgattccaatttcgtcccagtgaacccttttgcttgctgacacacgtttgaaccatgtggtccaacttttctcgggtggaactttctctagagatggccaagatttaaaggtgttattccaatgacctagatctgggttggttagtctgaagggaatcctattggtttcaccaatgataaactcagtgggatcaggattgccgactgggccgagaaagtagtagttttcgtgtgataagcttggaatcgcgattcagttagagagatgctacaaatccaagacaaccgagagaaagagagcgatataagataggagaaaatcgatctgctgctaagaaaggggatctagccagtggagacttacctcagcatactcggccgatggcacatcagatggattggtggaagacgacatcgctgcaggcggaggtctcgctggagatgaagtcacccgggagtcgcttttgcgtcggaggaatcgccggagagagagagaggataaagtttcgcttgagcggtgaaaacagaagtcacggtgtgagatttctcgagggtgacggttagtatttcaagcacggcaataacggtcggaaaacagcaaagtgcgaaacttgctcgaagtcagtacacggcaaatccggaacattaccaaatatcccggacttggggggcatgtgttaacaaccgaatttggtaatatcagcgtcggaggtgaagatgggatcgaagcggagttggagataaggattgttgcgggaacagagtaagaatcggctggagtccagatcagctacgactagaatcggctaaatctgaatcagactgggttacgtgatacaaccaattccggcaatacgacttggtgtacaacatcgggttgagtcgatatgcttcaagatgattgccgcacatggatagagttctgagaaggcaattgtatctattaattaggatgttttacgtaatttccttagagatatgcttagggcaaaagtctgccgcaaagaacgtatatgctataaacgtatatagtttcattattaatatatatttcgatctaagtgatttatactgtctcggcatggcgaccgatctatcccaatcacttgatttaagtatatatcgatataaagattatatattggtaatatatgcagccgatcgagtatatttagtcccttcttatttattaatggttgccgattgatgtatatatgacatcggctcaaagataaatgatatgtcatcggcacctagccgatcggctatcatttatagatttaaccgcgatttctttgcttctacttcttgttggttacaggatcaaatcaactggcacgctagcacacccgaaggcgagctttggacctgcactggagttaagcagatctcccaggcctcgtgttttctgtcaacagacaccctccgaatgcctgcatgtcgtcgtgcgcgccgcattctgtgctgtccacccacgcccaccgcccgtcctcgccatgcacgcagcatgtgcgagagagaggaagaggggaagtggagtatgatgactggattgccacgcgtgcgccacgttggacaaaaccaatcttaatttggtctagggggttaatttgtccggtatggaaagttcaggatagggtttagggggctatcaaattttagttatttctaaattatatttctatacaaactctatactccacttccaatgttctttattttttaattatgaattttcattatttataagttttactcctatatttcttattttaaattcaaaacttcagttatttctaaattatactcctatatgaactctagacacttcttttaatattgcttattttttttaatttgtgaattttcattatttctaattgtatttctatatgcactctaaactcatcattcgatattatttatttttaatttatgaattacagttacttctaaattgtatttttatggactctagactattgttccaataattttcataatttctaattttagttatttgtaaattgtatttctatatttactctaaactcaacttttaattttattgtttttattttgaattttaattaattctagattcctatatggactatatactcttattctaatattcattattttaattcctaatttctattaagtctaaataggctataaacttacctttcaatatttctttttttatactccttccatccacaaaagttacacctattacttttgtcgccaagaccaaggaaaaattgaatcatcttgaatgttacaaaatcaatgagtgaatgcaagcatgcaactaatgagtatttagatgactccttggattgtactccctctggttctatattaattgacgttttggacaaggttgaggttaaacttttataactttgaccatctataactttaaaaatattaagtttaaagaaactagaaaaacatatatagatttgtctttcaaaacactataataaaagtaaacatgcatttatttattttatatattataatagagaaataaggtcaaagatatatcttgtagagcgtatcattatccaaagcgtcaatcaaaataaaaccagagggagtaatcaaacatttaatttatctcctcaatcatcttgaatgttacaaaattaaggagtgaatgcaagcatgcaaccaatgagtatgtagatgactccttggattgtaatcaaacatttaatttatctcctcatttaagtctttttttttataattacacagtacaacgcatacactcacaacgcacgcgcacacagccttatgaaggcacgcacgcaaaccctacccctatgagcatcttcgaagactaagccggcaaatccttgagattgatgaagtcaaacgcacgctcattcacacctatgaacgcacgcacgcaaaccctacccctatgagcatcctcgaagactaggccggcaaatccttaagattgacgaaatcatcacaggcgcctcgctaccacttaaagcacaacactgttaaatcgtagaaaattcgcttccatggagagtcgaacccaggacctcagatgctactgagactcttgtaactactataggctacaggcattttcgctcctcattaagtattgaatgcaaaaagactacaaaacttatttggaaaaactcaaatgtaaaatatgtctaacttttatggatggggggagtaattccgaatttcaattatttttaaattgtatttctatatggactctatattcttcttccaatatttattattttttaatttcaaattttcattatttctaaattgtatttttatatggactctaacctctacttttaatttttcttatttttttaattccaaatttccattagttatattgtatacccgtataaacttcagtcttccttttctatattcattatttttaatttcaaatttcatatatttttgaattgcatttatatatagacttttttttattaatatgagaattttcagaccatagagcgaacgtggaggcttttttctattccttaaataagttaataaattctatagttttatagtcctccaattaccaaagtgggtggtaggatttgtgggaccaatgaatatacaaagcttattgtgcatcaaccactcgatgagatgagagagagaataatatgtttgtaaacatcagcgcccgatattttggcaagagcattattttggatattcctaaaatatctgtaggatttatggaagccagttcatgtgttctgaatggccatatagaaatttgttcttagtattttctacaaaaagtatcgtcgtccgattatattcccttcaagacccttaaagaaaaaaaaaagcatgagaccacacctcgcgaacgtctgttttaaaatcttccagggttccaacgtaaaccaatgcacatgacacattgacaccatattcttgcattttcccaatcccattttggataatccaaatctaatgcacatgacaccatatttcttacattttcctaatctcattttggataatcctgtgtttcagaggattagcatccacaaatttttggttaatcgttgggccatttcgccattggaaaccaaatagctcccaatcttacagcccaatagaccgttacgatcacgtcaggacacaataggcaagaacagtttcaaggacaaaactccacagaatcaagggcaatagaaccctgagaaattgtgacaaaaccgatgtatcgaaacatgtgccaaaatttcaatgctcctcaatagcattgcaatgttctcaacggcaatacagcacctcgatctagagcttactataggtccatataaatgaattacaataaggattgcaaaaagatcttcaacttgaaacttctatttcttcttgtcagtagtaccagcagacctgcacaacaagagaagggatttagtttgcaaattctctttgtcaaaggtaagaattggccagaaaatgaaaaatgaaacaaaacttacatacaactgaggtaccaaaacaacggagaaaatcatttgtactgctttgaattataaagctataataaataacagaacagaagtatagggacacaagttgggcggacaagcgggattattttatttttcccggttatcccacttatagttcactttttcttccaaaatttgtgctaccatgtgggaaatgaactagcaagaaggtatttatgcaaatagtggtattgtccacttgcacccctacatagctacagaaaaaggaccaagttaatttagagacaagtccaatatttgcagaatgcctcttatatacttgggagtacttacacaaataaatctcacaacaatgttaccgataaagtgctactccctccggttccataattcttgacgttttggacagagtgtagtcaaacttttataactttaactatcaactttaaaagtatttagtttaaaagaattagaatagcatatatggattcatctttcaaagttctataataaaagtaaacatgcatttatttattttgtatattataatagaaaaacaaggtcaaagatatattttgaataccgtgtcattgttcaaaaagtcaaaaattatgaaaccagagggagtagaacccattctacaatacgcacggaaaaaaaatagcaactaaaaaacagagaacatcaacaatgaaattgcagaatgcagtagtaaagacacacacctcatcttcctgatgacacccgccatctcctctctcttcttctttgctctcttgtgggtaccgagctttctcttagcgaccttcagtgcacgcttgtcctttccaaccttcagaagctcagtgattcgtttctcatatggagcaaatcccacaacctccctaatcaagcccctgacaaaattcactctcttggtacttttctgcaataagacaagaaaacatattaatgaaagaatataaataggaagcagctatggtgtatggccgtattcatcaggaagacagcaaaagaaatctctggtcatagactcgagaagcagctatggtggagattgtagttctcctcagtaaagtgaatttttttttcacgtcataggctcaagagatcacaagatcaactaatggtaattcagaattttctatttgacatgaggtgacaaagcatcacttcatcgttcatttgtcatttcaaaatattgaagctgtggaagttaaaaaatagattttaacagaacatcatttttatttgcttttatagctttgctcagaaaggtaaaccaaagatccacacaactgcacaagcaaaaaacattcaatttttgtttacattgcacagaaaccgaatctacattactggataataaaaaacaaaaaacattaaaatatttagaacaagacaaaacagaggtaaatttagtgagatattttagaaacaaaatcatgaggtgattaagcttccacgttagactcaccaaataaatatatgcctccaggactagcaattttggagttgtgttttctccaaattgccaaaggtgagacgaggcacaaagacatcagtgtgcatacacatctaagccattcaaatgcaattttgatgtacagaaaacgataacccattgctgatacttgccattaacacgccaccatttcaggcaaataaattaataaattaaacacaccattcttagtccattataatcaaattgccaggaaggtgattaagcaagcacaagccaccacgcacttactcatgtccaatggtaatttagacaaccatataattttatgccgacataatatataatttaacaaaaaaacagcagtcgctgctccgatgtctagtacgacgaaacgaaattagctagcaaatacagtaactgtaccatatagatctaatcaaacagatgacatgcccatgttgctacgatacgagatgagcaaggatagagaagggaggaaacaaattacccccttgcggtcggacgggcgaggtggcagctcgcgcttggtgacgacgtggcccttgttgatgccgacgaagagccccgacttgggctgcggcggcgccatggcggatctcctcctcgctcctcggacctgcggcgaaggcgacggaacaaaccaaaatcgatcaacaaacagagaatcgaagcggagaggggcgcgagagatctcgagtaaggaagcgctcgtgtgtgtgagagagaggcggcgctcggaggctgcgtaccttggatcggcgacagctacaaaaccctaagccgccggctgcgtccgaggagaaaccctaagcgatggagaggatgttgttatatacacgtcgggtactagggtcacagcccagatcgattcgtaggaggaattaatgggccggcctagtttgccttcctgggcaatgactatgggcttgcttcacttatccatttcgctttttagctcgcgtttcgttgttatctcgagaggctgtaagccttgaaatgtaaaattcttgtacatgaaatctttcgtctgctcgcttttcacttaatgccatcatgtagcagcaaagaagattagtactccccttgttttttgtcgaaatattctttttcctataaccttcaccaatcgctataggcttttgtaccaaattttgatagcgttggtttagtttgatgtttttccaaaatttagtagcatttttatgagggaatcttcggaactaccaaatgttggtaggatggtgttgttaaggtagtgtttagtttttttcccaattaaaatttggtaacactaaaatttggttatgttgaaagtagcggtaaagtggcacatgccctgtatgtcaaagaagagcgtttttttctttttagagatgcaagcccttatacataggtacattcaccctttagcctttgtaaaggcgaatccgaacaccttatcctctatggatacgtttaaaaattggtgtatattttgaggcgaacgaaagtcaccataaacgtcgtcatctatctatctatctatctatctattatctatctatctattatatactaaaagtccataaaacttcctacagacgttctcaagccaccacgtggcgctctaataaaatagagaaaatcctagaaattctaagaaaaaagcaaaacatctatcccttgattttaaattaaattggcggggtccaatattacacaccgttagataaaattgatcttaaaacaaactaaatactatgggtcccacctatcctcctcccgcacattggcaggtggattatatacgtgcgtactgtacatacgattcctccccttttttttcctttttttcttcttttttcaatttatatatataatggatatattttttaaataataataattttacaaacaaagaatctaccatcatataatttaaaccggtgtactctttactttgtactattattttcaaataatgcactattttaaaataaattttacacaattatatcgtgtacctatcaaataaacaatatctatattaacaaatttatacgtgcacttaaactgatggccctattatataaattatcggatctactttttacattggtctattattctcaggtaatgcactgtttcaaaataaggtctactattattaactaattaactaatttaaattctatattaactaatttacacttacactagaactggtggacatattattataatcattggatctattgtttgctaataaataaagcgtccgaaattctctttttgcatgctgcacagcgcacgtctgcaccttggcctttcgcacgtgtgacaaagcgtagtgtctgagacatctaaggtgatcacaaccgctctagcactaccgctttgccacatatcaaatcataaatcatatatgaagatgattaattttgttaataacatgaaaagaaaattaaaggtgatgcaacgagagaataattaagcaccatgggttgtgtttttctcaacactaattagctctgtttaagttgaaaccgagagttgattacataataattataatgtatttgtgttatgtcgtatttggattttgtactatttatctgtacaggtgaaatgaatcattatgttataaatgcgagtacaatattgacgaatatcaatagaactcttagtacgacaagggtgataataggagcttaaggccctctctttttttcccgattccatattttggatttttttttgcacgctttccaagtttctaaatggtgtcttctttaaacaacattctaactttttagaagtcaattcattcgtttataccctcaaatagctatcacataaattatataattcatcaatttcagctatcctaaaccttaagtactacatatttttttcatgcgagtcatggtgatcagtaaattggtgatcaacgaatcatcgaagttgtaagatgaatatgtaagagttactctgaacaattgtaaataggtgttaaaattaattgctattaatcagacatttaatggcttgctagccacaaaattaatttctctctacatatatataaacatagacgaagttggaataaatattaccatacgtcccatacatatatattgcgcagttaatattctaattagtcatttaaaattccttaaaatgctctcaagctgccacgttgtgctctaataaattagggcaaatattagaaattctaagaaaaaaataaagtatccgttacttgattttcacttaaatcggtaggtccaatattataaaccgttagattaaattgatcttagaacaaactaaatactacgaggtcccacctcagcataggtatgcacctacgtgcatgggtacgtacgcctcccctcccttttttatttttctctttcttctttttttcccatgcatatgcttccctccttttattaccatatcatgcgtctttatgagacgatttaatcaaaagaattttgagtatcatgcactcatatttttcatttgtggccatactacacgtatgtatatatagatggactgtatgataattaactagcaatatttttttatttactcgagaaaaaaaacatgattcaaaagttataagtacttaatccatctcctattcaaaagtttatgaatggttttctaaaataccttaagaaaaatagaacccttaatttattataaaataacatcatccaaactttagtttgccctaaatttatgaggcaaaatttctgaacaaacaataatcttacctttcaaaaatatgcccgcgcatacgcgcgggccaccatcctagttcactaaaaaagtaattagctgtaaacataaacacccgtcccaaattagagactaaccagccgagtaaatcgctttccatcaaccggtttcggattgacagcgtcgtataggttacacaatgctgaaaggattcctttcaatggcgcacacgattcaatgccacttaaatcaccgcgtgtggtaagaagaggggaaaaaacgcaaattgatcggttaaccttcgcaagctgttttcgtctcctcgttgggatgacgcgttgctcttccatccatgtacgctcgaatcaacaaaaactgataaagaacttgtctatttttttatcggcaaatgttttactcggcaaagacaaacgtagcagagatcaatgtgaagaatcatgaaagattcgacaatgacccgggttctctggaaaatgagaagaatcgaaatgcaacgcgaaaccgatcaaactcgagcatctctagccatggttccccatgagaatatgagatcataagctacaacgagctgctgcttgctctcctctccatctcgaggaattgcccgagcgacggcgcggcgcggccgttctccaggtggctccggaggcagagcgacagcagcagcgccctgaccttgccgctcttgctcgtcgccctcgcgctccggcgccgccggctacggctctccatggcgtccaccaggccgatcaggctcgccagcgtcatcccgccgccggcgccgccgcctccacggcgggacaatgaccatgccgactgcgacaaaaaacatacttatatataaacgtacgttacgatcagatccagatgtaatctgcctgcactactgttccattgccgcattgcgaatttgcgatacagattatgttcgaactgacctctgtgtcgaaatcacaagaagtgaaggaagacgaagcgcagtgagacgaagtgaaggccgtgctgaaggaggccgagccagaaagatccacgcttctcgtcactccagctcttgcattcatggcgcccagtccaagaggccacccatcctgcaccatctccccaaacaaaccacaagcttgccatgatcaattggtgcgctaaaacagactgagaaaaagcatgtgagattagagctacaattaggcgaaattaagattggcgcacctcatgggccatgatctctcagagccgagcttgccgatcccacgggggacaagagcactaccagagtctagaaagcaggggtaactgactgatgaggagtggacaggcgtgaaggcttatatggtggagtcgaaagcgggcaacacgtgaaaaagccaagcatttgtcagtaaaattatctgacaaacctgcttgttttgcctcgagggttggaaagttgcaggcggataaacaaagtgcctaattgccaacactactacatggattagattcagccttggttagcatcaccatcacgagctcatgagatgtcgtcagtgctgctgctgctgcgtgagctcttgtgcgcgcattttacaagcccattgtggccaaagcacagatcgggaggaggctgcttacagtaagataatggaggaaaagccttgaaagacggtgcgaatcgttggcggtgtatgcggacaaatgtgcgcccgagaccgcggaaagctcgctagctccgccgctgcacgcctgcagcgcatcccgcgcatcctccgttctccctcggtccctcgagtttttcagttaccgggggacttcagtagagttaattgggatcactttccgggctgactgcattgttggttgggcttccggcgaaattctctactccgtcacgggcctaatgtctggcccagatcgttttcgacggggaaaaagtacaccgaaggtccctcaacttgtcatcgggatacaaaatcgtcccccaactgtaaaaccagatatccgacatcccttaactatacaaaaccagtcacaatatgtctctcggcggtttttatcccggttttatcctacgtgactgctgtctcagcgtgggacccacgtgggccccacatgtcagcctcttaatatttctctctcttgccctttccactctcctttccacgggcgaccggcgtgcgcgcttgcgcgggacggagaggctgggcacggcgcggccggcggcggcggcaggggaggagctgggcgcgagggcggtcgctggggagccgcgctatcctcgcctcctgcgcgcacacgccgcacacacgcgctccgcggcgtgcgcctcgccgcgcccccgccgcctaccgcgcgtttggcgcgctcgcggctgccactggcgagcaaggcgaagtggccaggctcggctactgactacagatttccaaggagagagtacactctcatgctagctttgcttaaattaggccttgccatggtggtgatgtggttaattagctggctgagcaagctaacctcttcgagcatggggtaaatgtaaatcttgcccttgagccgctgcagctcgcccccgtccatggactggatctgcgtcggcgcggtccacgacgacgagcctccgccaccgacggcgtcttcttgcgcctgcttgggtgccttgcttgccgacgatgggctggtggtgctcttcatggggaggctgcagaactcctgcaagagctgctgcgtcgggaggaggaacctttagccgcggagatgccacgcgccttgctgcagctgccatgtcgacgccgcgcccgccgccggcgacggctggtggtggtggttgtgctgctacatcagcagcgacatcgccgcctccggcctgtgaagcgagagggacagcggcgcttggctctgcggtgttggtggtggtaagctcgccgagcccgccgaagtggaccgtcggcagtcgcgcctccatcatcgacgccgccgccgccgagcgcgcccacacccttactttgctcgtgcgcgtgcgccaccgtcgctggcatgagccccctcacccatctttggccgccgcagagcttcaccgggctaccgccgtgcttccccactgcggccgctgccgtcggccgccatcgcggcgccgccctcctcctctcccgcctcgccccggcggcctcctccccaatccccagccgccggccggcttgcgatttgcgaagagaaaggaagagaagagaagagaagaggaggaggaagggagagagatgacgtggcatcctggtggggcccacgtgggtcccacgctgagtcagcagccacataggacaaaatcgggatcaaaatcaccgaggcactattgtgaccggttttgtatagttaagagatcatcggtatctggttttgcggttggggacgattttatatcccgatgacaagttaagggaccttcggtgtactttttccttttcgacggtgagcatatggcccgtgaaaattctggcaggctaccatgagggagttgccgcgtgccgatggacatatcggtacggtcgtaattcgtaaagacgttaagtaaacgacattgataaggtcgttaccgttttcaccccggtgtcagtgtcatgctcacgctgtcgatggtgaggctctctcgacctgactgtcgtgcatcctgttggggcggctgctccatcacttgtcgacgctgagcacgcagtttgcaagtagcgatacgtgactcgtcacgacgaaagtgaaggctgcgattaagaggatgaggaaaaaaaatagagaagatactgtcgacgagtgatactcatgtatcggaagaatagagtattgggttacgtcggaatagggatctacgtagtacgacattaaaacagacaaaagacaaggattgtactgtttcaggccctttatcaggtaatagccctagtccagtttatatgggattgctgatgatgagaacagattacaaagcgcaaaatctaaatcgagagcgctcttgatttagtcataacgagcgacgctagccattgtccagatacgattagccattgtccagatatgtgtcttgaagaatcttactttactatagtactaattgatcaagcaagtagaaaaaatattcctaccatttatgcttcaaatataattttctcttaaactattcatccgatctacgatccgattacactgttgtgttcataacaattaaatctttacaacaagatctcacatgattatattttgataaaaaatcataaattacttttataatatatctaaattacttttagatttcactaagttaaatatataaaagtaaattcaataaagttttaaagtaattaacatatattatagaagttactttctttttttataagttacttctatagtatatgtaaattacttttaggctttattgaattacttttatatgtctaagaagtaacttagtgaaatctaaaagtaatttagatatattataaaagtaatttatattttttttcatcaaaatataatcgtgtgagttcttgttataaagatttaattgttacgaacacaacggtgtaatcggattgtagatcggatgagcagttttagagaaaattgtatttgaaatataggtggatagtgtctatcatatatgagacaaaccagctaccattagctgtgtagttacgtccattacagagagagtaaccgaacaggtgataccgacaagatcgtagtcgagggatttgacgagatctcccggcgagttggctccgtgtactccggcttcgtaaactttggtgggtgtgttggcgatgagatgcgatgcccttagcctctccctaggggtcccttttatatcgtgggataccttgactctcaagtaagacttggagattatgtaaaccgacatgatatactagagattttacccttttcgagtagtacttcggtaatcccttaactcgtagagatatctcccataatttgaggtgaatttctaacggcgtatacggaaaccaaccgtatacgtatacgtgagagtataccttattgatatattccataagtcataggacagaggttatccttatccgtaaccctgacagatacacgcgatgaactgaaccattaacccgtaatcaattgggtaatattttttaaaacttgtaacgaatttaaagtaacttttctataaaattattttcaaaaatacattgtttaacaactcagaaaaagcatatatgacgagaatttattctctctctggtccgaacgaacgtagcttacgactggacaaggtggcacgtagaaaagcccgtggaccgtgacacattttaacacagacatcgtctcaatgaaaaagttaaaaaatgtagatgaaatcctttcttttctggttctcctacttcttccacgctttcaccggtgacgcccgtcgactcaccttgggacgctaggaacaatcttgcactgtactccctccgttccaaaaaaaaaagataaatcctgggttagtgtccaatatttaactgtccgtcttatttaaaaaaaatatgaaaaaaattaaaaagacaagtcatgtataaagtattaatcatgttttaatcatctagcaacaataaaaatactaattataaaaaaatttcgtaaaagacggatagttaaacgttgcacacaaatttagggttagtctttttttttttaagtaagtctaacaaaagcgggtcaaatcccttccaacctccacctgccaaacgtcgtaggagtatggctccagaacacttccgtagaaaaaccgagaaaagaaatcaaagtcatcgttctcgaaagcgactactactgccactaccactaccactaccactaccaccaccacaccgcttgtccctgacgtcgctgggcgatcgatcgtgcgatatggagtgtactcctatacgcttcggggcacaggcgcacagcgcgaatgtgcgtcgcacagagaattccagcacggccaccacctgccccccatctgggccgtcctcgccacggcgcgcacgccacgcgtacgtaggccggaccacgtgacctcagccgcgacgcaccacggcggccacccctctagctagtactagcgcctgcgctgccctggctgcgccacgggatgcgggtttcaaaattcaaaactcgcccacccgtctaatagtaccaaacaccagttgacaatcttgtcgcctcgctgcactaggccactagcacagcgtagcgtcgtcccgtccacttttgaacgcttcaaaggggtgatgacaaagagatcgaccggggcgcgcacttctttcccctccaaataagctcgtccagtccaagcacacaagccattccaccgctcgccgtcgctgtctcccatcccatcccatgcatcactagcggatttgtggagtggttgcgccccctgcgagcgagctctgttcgtaccgcgcgctccggtgcggagtggttgctggccggcgaggcgggcggacggacgcgtcgatgcgcgtggcagtagctgcgtgcgggtgacgaagcaggggcacttgctatatccgtcgcctcttggcggatgtgcgggattctgcgcgcagtacgcggcggccatggacgcgtcctcgcccttcagcttccacgagctcaggcggcaggcctcgtcctacctcaccgacaagatccgctccgcgcggctcgcgctcaccgatgttaccccgacgcagctgtgagtggctccttcctcgatcgatccttcccccgtcttgttgttcggatagatgtcaccgatccgttgttccatcgtgttcttgatgctgaggtttttgttggtatggtccaggatgacggaggaggcgacgagcggggacgcatcgccgccgaacgtgaagacgatgagcctcatcgcgcggcaggcgttcgagatcgacgagtacgtcaggatctccgacatcctccacaagaggtgagcgatggacgtgcctagcttgcctctcttaacgaagccacccacacgcacgctgcgtttgtgatctgctcgtttgttggctgatcgattgattcgggggcgggaaatcttacaggttcgcgaggttcgacaggcggcagtggcgtgaggcgtacaaggccctcctcctcctcgagcacctcctgacgcacggcccccgtagcgtcgcgttggagttccagagggatcgggaggtcatcgagcagatggtctccttccagcacatcgacgagaaagggtccgtttcaattcttcgtcccgactcgatcatatcttctcctgatgttctctcgcccttctttctcatcaccgatggtttcttcttgaatccgagttgcagtttcaactgggggatgacggtgaagagcaagtcggagcgcgtgctgaggctgctggagcggggccccttcctggaggatgagcgtgagcgtgcgcgcaagatagcgcacgagatcaagggattcggcagcttcaacctcagcagcgcgcatgcgtcggggtcggcggcggcagccctccgcgcgggggcgatggagcaccagtgctacggccggagcaactcgcggtacgagggcaggtggaggagggaggcctgcgtggacgacggcgacaaggagaacctgctggtggtgtcgatggccgaggcgaaggccgaggcggcggcggaggagccgcaccactaccaccacccgttctacggcttcgggcagcagcggccggaggcgatgctgctcctgagccagtagtgatcgtttgggtggatggttcttcgtcgatcgcatcgttcgttggtttgtgatgcgtgagaaaaaatcctgtaaagtcagtggcttgctggcatcctctttgtgatgacccttttgtaatcgtcgtccttaatttcagttctgatttctgaaactctaaaaatgcctgattccctgagctcataaacacacgaagaaaggaaattttgagaagttggaagcttcaagctggcaattgcaggcaaatacacctgacatgaatccggacaggtacaaggatcgtgaaaagacatgcgaatggatgaaccgatgcagtgaaattctctctgctatactccagagtccagaatgtgatatgctgaactgatcagaatcagacctaggcctggtttaggtcgtgtttgggaaaagtttgggaagaagttgatagtttggaaaaaaaaagttaggagttatatgtgcgtaggaaagttttggatgtgatgtgatgtaatggaaagttgggatttggagggaagtttggtgtccttaggctgtgtttagatcctaactttggattcaaacttccaactttttatatcacatcaacctgtcatacacacacaaattttcagtcacatcgtaccaatttcaacccaaacttctaactttggaaggaactaaacacagcctaagttcccaactttttcttcaaacttctaactttttcatcacatcaaaacttttctactcacacaaacttccaacttttccgtcacatcgtttcatttttaaccaaactttcaatttgtaaaatcaatgtgtgttttgattcttattctgtgataaacaattggcatatgtgattattggttttgatatttggagattatcgtcgaagtggttttggagataatcaattttcaggtgatgatcggattcactgttatttcatgtgaccggtccgaccgggcggtgtatgccggtcagaccggtggtgatcgagcggttagaccggccggcccgcggtctgaccggccgacgctgtgtcggtttcggtttcgagttgtttctttggatatccgtgattgtttcatagttatggcttctagatggatattatacgtatgtaatactgttgtttgctactaatgagtcaagttggggatagcttggtctcgaaatatggtttctttgtttgtttcatgtgtaggtgactcgatgcctcgagagagtatttgcggtgatggaccgggagtcggcttggtggtaagacgatgtccgtggtggtcagatatcatgcgggatactaaggctagagttgatgcacatgattggtgaagattccatatggcatacaatggaggtattatgtgcgtatgggatgcggagtcgaatttggaaggagtccaaatttggtacgattggttatgtaaagtttctttcttatactagagggtttcctaaggtgtttaggactcttagtatgagtttggttcgtggctttaggctgcctacctcatgtataaatagagggggagcgtgaggcttcccggtatcgcttttgagagcaattgagttgctagtttagttagggtttcgagtttagtcgaaatttttttaaggagtgctgttggtatactttgtaaacacagagagaagcaataaagttgtgcttcgatttgtgtttcaccgggttttggcagtctaaccggcgactcaccggcggcaaggcggcggtcagaccggctagggcgaggcggtcagaccggcggcgacttcacacgcggcaggcaatcttcaggcggttgaaccgagtgatcaacatcggtcagaccgacagcgcgagcgcggtcagaccggcggatcaacttcggttagaccgatctacatcgaatttaagggtaacttttatttccgctaaaagtttgggtttttgggtataccaaccattcaccccctctggttggcttagttactttgtttcgatcctacacaattttagcgtgagttaaactcacccctaagcttgctgattaatctgtgacatacgagtatcagaaaactctggttcgtgccggacagttcggcgttcgtgttccattgcattttctttggcccaagtcccactcttaattttattctaacctagtaacatcatgcaaatacttaaactcttcactaaacacatatctacagcttaccttttctctgtcacttttacatgtaaactgttcgtcattaccacttgactagttgactttaccataccatcaaatattccaacaattatcagtgtattcaacgctacatactagcactctatctggaaaaaaaaacactacagagcactctagttattacttcctatgtcccataaaaaaacgaatctagtattacatgtgacatattctagtacgatgaatctggacagatgtatatccagattcatagtactaaaatatatcacatctgatactaggttggttttttatgagacggagggagtactccagctacttgcaaatagaaaggagggcacaaaagctcgcggcagaaggcagctgcggtctataggtaacgcgtagcaagatgacatgaatagattcctccagtgcgtgcatcattcccaactactgtacatccctttttgactctgctatcatgcactgtttaatctgttatcatatcttatcctaccccacaggggcccttcgaccggcaggataggaaaaatataataatagtaaaaacgtaggaattgaagtaatatgattcttcaatcccgttggaataaaaaacacaggaaaagatgaaatgtgccctttgatagtgctataggaaaaaacacatgatttctcttccaaagaggtcagacctttttcttttttttcctgtgaaaatgaactaaaggtatgtaatccttgaatgtttcctttcatttcctatgaatcagaggcatccataggaaataatccataggattgtgaatcctacaaaaatcaaaatcctatactgatcctttgattaccgatcctttgaatcaaagagccctaattactggaaaatggcgtagagagtgtatgcctgaattatgcgatgttctgtacaagatcctaccatgggagtactagatttccctcacaagtacagaattcaaacctaaggttcaataacagacttttcatgtcatggtcaccaaaactctacagcgccacaatagcacgcgatggaacgtactggagcttagcattttacctccgacatcacaatagtgctgtgaaaaccggctatgtaaaacaccgaccctattggttaatatcgtcaatcctcacaagtgttcaatatccacacaattgtttaaaagaaatgaaatgaacgtgccacaaggattcattggtaactcacctattgaaggaaccaggcaaacttctacttccttccgaaacagctactccagtaaatggattttcctcggctggtcccatttatatcattaacaagggctaagaaagaaataggaaaaaataaatcaagcagaaatatcagttctttgaaccctcccacaaaaaataacccctaatataaagatcaccggaagcaggtcacctcatgtacagatcttgctgcagcatggcaaggccattctacttgtacattttcactttgtaaccatcatacaaaaatagacagtacaataatatgcctgcaaccatgtgaccacgaactaaattccactgttgtatcaatgaagagcctctgacatcaaacatgtcctaccaatttggatcatctgaagttgctccatgcttttgctttacctaagaattttaacatgtggcatgtctaagacatctactttcacatcttttcaagtcaatcaaattcacagtacaacaaatctcacaaaaactgtaactgctaatccaacaagaaaacagaagcaactttcagttttctctatgaacatagagttctagactactgaatcagcacattcttgacctaagaagattggaattaatggctagatagcatgttacactacagtcacctgatcttcatttcgacatttagggcatgtaaaaagagagggggaggaggctactatatccactaagaacacttatgtcagctacccttgtattattgatcaaaatttgcagattgaaagaacctcataataactatgcatatcttcttcctttttttttctttttgttgataaaagtacaggtaatcaggaattttagatgcacaatcctttgatggagtatgtataagaagttcagaactccattaagctcatttgcaggaataggttacaagaacttacagaaaagaacattgcatattcctactctaggatttaagttacagagataggttaaatgatcttacagaaaagatgaagcttcagacaaggagcatgagaacaaaaatcaaaaggtaaaaaatattaaaatagatgggcaccttccatttattcattattgctgaaattcagtctcaagactgtacccatccccccccccccaaaaaaaaaaaaactgtagcacaataggtgacaagtgcatgctgcagcgcacaacaaagaacaagatattggtgttacactgttttctacagcatatgccggtatttttctgacaagacttcagaatgtgaaattgaaaacatagatacaaatgcctcttgatttcactgtaggctatagatggacaagtccgcaacaataaactaaaccagtaatttgccactaatccaacatacctatatgcattattgctaaatcttatcttgcccaagaacctaggtgttccaaacgactcattactttgatctttcataaatatcacctcatttgttttcatgacatgaagacactcgagacatatgataaatattgaactttttttagtataaatattctccgcaatctgaacagtatatttcagataggcagggttttctattctgcattcatttcttcactcttcagtggtacagaggatacacttttactgaagtagttacaagtttaatgaatagttacaagtctatgacaaacacatcgcatccagtattaatgctgaatttccaagacgctagtttacaaagaaagcagaaaatgtgcacgtcattatttagaaagtttgacatttcaaccatggctcatctcatggatattattcagaaaagaacttgatgggtcccatggctcatgtaaagtacgcatgagctggcacatgaccaaacgggtccagaaactaatcgaataaagatgggcaacctcaataggtccactttcatggactctagtgaaactacatacaaaagtttcatgcacagtggtccctccccaaaaacccaccagccattatgaacatgaaacaccacagaatgttaggaatagccgcacatataaacggtagctaccagaggcatatacaagttacaacaactcatgtttttggtcgacatgtttggataactgacagactatttggatatgtttagacgttagactagcaatgcatgacaatagcacctagaatttcaaactctttattgggatggtttaaattccctcaaatctctaccaaacacaacaatatacaactacctaacttgcatgaaatgagcaatacctgataggtagtcacaagaatcagaacacctacctatcagtaaattcgcaacctggtatacaatgctgctaaacttcttctcttcagatcttagggctgctaaagttcatataggaagcttttggagctggggcataagctatttaatttaactgcaaaccaacttatcagatttcagttcacacgctacgaaactagccaaatgatcagcaaggagtacgtggtaggccaccctatatggttagataaaaaaagggataattgagcatatgccaccctaaatggttggtttatgtcctcaacagaaatttaacggtggaaaatcctgaccaatcagctaaagggtggacatgtgttcaatttgtcttcagggaatagtaacagcaagcgcaactagagtccgcgtcattagcaggaaagaggagtgagaatcaaaaacaggggtagacaaccaggccacctccaagctggccagctcattcctcacgcttaccacctatctatcaatctccagaaccctgactccaagacttcaggtccttgataaacaaaataccaggcaaatgcatgtcttcaaattcttctgcaccttaccttaatacaaaagacacacaaatcgattccccagtaatcctcagttcctcacaccaattccccagtaatgctagccccaattggacttcagttcaaacacaaactgacctgattagaacaactatgaacatgctgctgttcgttttggaacaagtaggtttcataggtctctctacacatgatattatttcgttaaaactaataaagaaactagacaaattgctactgcttttgcccctataaaattctctacccatcacattcccgtagtacacattctaaaatggggaaaatagtaacagaagaacaaaaattgagcaaaatgaagcgagcaatgggtaacatccggatctcataccagaggtagtagtaagagatgcagatttaggagcaccaaccgtatacaccaccaattgacagcccttgccgttgacaatgctgatgacgactcactatcagcgccaccccgcagtgctggaggtgacgacagtctcgtcggcggcgtccgcacgttctcggcagcatctggcgccatcgcgtccggcggcggcgccatgacgtcgctatcagcaccgccccgaccgaacatttccttgggcagtagaaccttcgagacggcaaacaccgcaacgggattttggtcgaacaccgtgcgggtgatcgaagcctgcacgatgccggtgtcgatggcgacggagccattgacgcgtgtgatgtttagcgtgaactggccggcctcgaagcgctcggtggcgagcgtgggctgcacggggttcacgatggactcgagggagccgagcggatagtacgagtgcagcacgtggaagcgaagcacggtggccttgcgatctgcggggagggactggaggcggtcggtggcggggaggtcggcgaaggcgtcgtcggtgggcacgaagacggtgatgccggcgccgcgctcgtctgccgtgaactcgtccgcgacgcccgatgcctccagcatggaggcagcaacgttgaacccccgcgcgtccgcgaggacgtgggtgatgttgacgccaccggccgggcggctgtcggaggccgcgacgtcgagcccggaggggacgatgaggccacccaccgcgagcacgctgaggttgtaaggcacagcggtgacggcgccgaggacagtggcgctcgaccccgggaaaggcgccggcgaccggaccacgacggtggagtttcccccgacggtgaggttgacggcgccgagatcggagggcgcgcgcccggtggtctggaacagcgtcgtcacgagcttcccggaggcggggaggcgcgcgaggtcagaaggggagaggtactcaagcaggacgtggtaccgcagcacatcggcgatgtcggcgccggaggccgccgcgaacgccgagggcgagcgcggcaggttgttgttcggcacggccagcagcgtcagcgacgaccgcgccgccagctccccggccaccgggctcgactccagaagccgcgcgaagtcggcgaagctggggaaagccgcgagcgcggccgtcacgttcaccccggccgcccgggacggcagcacggcgagaactagaagcagcaccaccccgagcgcgaggccgcctggcaccggaagggctcccgctccgccccgcatctcgccagcggggggagcaactggggtggtgggtgggggactgaggagtaagcgaggagaagaggtgcccgaggaggaaggagacggggaagaaaaatattttgcgcgtgattttggttttagattacggggatttttttgctgtcgaaatgcgatagtttacgcctttctttaaacggtggacttgttttgggtgtggaattaaatggtggcgtcgcagcgttgatgggacgatgtggactcctgctagtctactacgccagccagctctttcccactctccgctaccaggcgcttttgccaactttgtaccatgatgcacgtcgcatcacgtgtgccttggtcctattcgacagaatggtgcggattgaggcgtcattctaccaaccaaacaattaaatacggactttgctcttaaaatacttcgaatcaaaggattaactatatgaactagtccattactgtaaatttcaaaaaaaaaaaactagtccattactgtaccctcaattcaggatcaaaaatatttcgaaactaatggtcttaagattcgacattgttttggtcctgggcggtgtttactctgttgtgtgaaaatggggcacgtgaagggcgtagtgaaatggcagcggttaccttccctgggtggaaatgtagtgtgtgtattacactcaacctgaccagaacagcaagatatggccgaactttcctcaggtgaggtatcgtcttccggaccactacgatagcacggtatgttgtgacgcctgtttgagaagccttgattcattcagtaccaaaaggcacctggccaaaaatgggtaactgaaacaatgaacgggcaaaaaggcgaatctaaatccgtcagagagatttcacgagatgctcgactcaccagcttcctttcacaagttattgtcgtttaacggggatgatgcgagcggcgtacataagctacaaatggggcatgtgacccgcctcgagcccccattgacgacctgcaactgacgccggtgaatgcttgtactcgataagctgaaagcaagacggccgtggaaaacgtaccggttttcctttaccatcacattcttcatcggactgataatctctcatactggacactttggttttgaaagattgccaactgcaatttcagaaatatcctgcttctcagatggcaacatgaagaaccagaactgggaatagaatttccaacttttagctgtttgcctgtttctgactcaaactgaaattggcaaattgtacaaatgaaagaagaaggaaaacctccctcccttgatacaataatcaaaagaatagttagacaaagagctagctttcagatgaaaggatcaataaattatatcagaataagcattgttcctcttctcaaaatttgtatgacaaatttcttcctagctgagaaatgtacaagggaactactattacatcaagcggactggcactacattgtcagggtattagacctagaaacggttagacacatctattgagactcagatcggtgtattgttagccccaggattagcttagctaatatgaatctaatatatccgcaaaatccacctggggagtgtaatagatgagcaatgctgcagtagggtgcttggagaccggacagacatcacaccaccagacggcaagcaaagaatgagcacatgctatggtaccaaaaagaatcaaggtcagtcaatcaagtcaagactagtagatgctatctagcctggatggatttagagtgttctgatttgtttgagcggcacatgcagtcggggcatggaaaggtgtatatagattcatttgctcttttcatttcaatacccttggcatcgctgtgtgttctcatattcaccaactgacgtttcagtgacttccatctgcacaaatgcaactaaaattttaacaaaacgaaaatttgctagttttaacaacgaataatgcaagaacgtccaagatttccagagccagaaggtaatttaatactgagttcatgagccacagtaatagcatacccgatacgtggactatcgaagagtatggctaatcttcttttatcaggcttaattgtcttcgaatgaccaccataaatgtatctcctatgaccaagaaggaaatgaggaaaatttccaccttgggtagtcacgaaaacttcactatgaacacatactgtgtaatcgatagctgccatccttgaagagaaattctggcagatattgcattatgtcagatcatacttgaaaagcaaagaaacttttgcagacaccatttgtatataccttgaatggagcaagttcttcatctgatgccaatgtttcttttgtctgcaagagaggaaacatttcaaggagaggtgccatgttcttctctgatttatatatcctcccagaagccaaatagatcgcggtgttattgctgaaacccatcccgcgaagcattaacccaacctaagcacagaacataaatatgtaaacctatggtgcaacaatcttaagcaatggctattaattaaatcagtgtaaacttgatggaaatatttagacactagaatacacctccaaaggtgtaagtggacatttcccattcatccttattgctccaggccttattacacgtcctggcctagtaaactttcctctccaacccctctccctggctgcatccagttccttcttctccttttcacccccgtcgaagacacaacaagagaatgcaaccatatcctgcaaaagaaaaatcaattggttgacaattctcttgtctgagaaacaggggattcggaccccattattattttggacagaatcagcacccaaaggtatcatgaatagtccagaacgatttgttaacagaagaaagactaacctcttcaaaacggagatgcaccgctacatatttcccattgttttcggcacttttttctctcattcgagatactaaaatgtcagataaagttgtgatcggcttagaaaactttaaggcttcaaaattagccagacatctcaaccgttgaacagctgatggagcatcaaaggacagtcggtttgcaaaaggtgatatccttataagcctataatgtacagataaaagcaataaaatatcatatatcacagtcggtttgtgaaatttactctatcatatatcacaagtcaacattcttacattcttcagaactacaataacaaaattggctttaacctacctttcttcgatcaacttaggaagaacagcttctttgtagtatcggatagaagaccaagcctttatcttgaaattaaacacattactcaaattgtgaccaaacctctccataataaactcaggcaccttgtcaactactcggacatcatttttcaatcgttggacgaagtgttcctcatcataaatatcactaaatttgctgtatcaagaaaaagaaatgttaataacttgatttttttatgttgtaataaatcctcaaagaagcctctctcatccaaacacaaacatagaaccttgtcagtatggcagttaacatagtacagtgttgcagcatgcaaaaaaaggaacattttcatacttcactactaccatttggtatcttttttatgtgacacctttgaacaaaatcatttctcattaactcatacacatatttcataaaaaatggcataagtagagttaatgcaaacaaacttctggttgtttcaaaagaaattcaacttcgtcagagagagagggggagagagagagagagagacctaggatccctccaaatgctgtgatagtggaagtttgggatcacaagagttgcatttagaaaaccagcaaccgcaacagcattgcatatctgcaaaaaaaaaagggggggggggcgggaacaaaaaaaattgtagaaactcatgatgtgtttgtggacagaaatgataaaaatacaaaaacaaaaagggttcattgaaggtaggtaacaaccgatgccctttgctgattcaaaccaccattcgcctccacgtatatgtagccatttaattcaggcaaatctaacataaatatttaactttattagataattccatcaagacataggcgcatcatgcaaaatggtattgctgttttactaagtaactgaaaaaggagtatgcatatagcataaacaagtatggcaaatgcacataagtaaacgacttccagtaaaaaaaacaaagtgccctaggcctaggatgtacagtcaaactattattttactttgaccaataatagcttcatggtagttatattggcacaaaggtgccttatgccatgtcccacaaatatatcggtagatttatcttaaaacatacttccaataatattacaaatttcccggcctttacaaatacatcacaacaaaagtgcaatgtagaaagtgcaccacatatcactcatatgcaaatgacaagtggaatcatttgcatgtaaatgtgatttatctttcctttagatttttgtgcaaaaaggatgtaccaggaagcagcaagccaatggaaggaattaaatgtctgtttgttcagagatacacaattaaccatcagagatgtcatatttggaaactgtgaagaaataataagcattgttcataaaaatcctttatgggcatgtccacatgtgcctgattctaccaataaatgtaaccctgaccaacatgcatatgtagtggtatagtttcacctaaatcacttgtaaagttttgatattttctttcacaaaatggaacttcaaatattacacgtggacaaaggaagaaactaggctgcattggaattcatccaagtcatatcatattaataggaacagttctggcctttgaaatgaatatataaacaaatataagaactgtttgaaactcattagtaaaaaaggaaaggtaggaatggcataccatatgtaatattgtttatgcaaggtcgccaaatgccacccttgtaagcatgtctccatacagttgctagctacaaaaatgtagtaatatgagattataaacatacatcgaaaacatgcataagtgaacttagaaggacaagataaagggtgatagcatgagggaaataataaaccctcaaaccacagaacaatatggatctgtaacatataacatgaaatggtactaggcaacactaaaaattatgtcatataactacattaaagctaatggacacaatagaaggaaaatggtattgataaatcaatcctccattatgttatgagcacacaaagatctatatatgaaaatagcacatattccatctttgataaattcagtgcaaaagaatgccccacagtgctatagcaagcaggtggcaacagttgtacagtacatcttattgtttgctaccaagcaaggtcattttcactgatcaaaaggacaatgcgagctatcacaccaggaaacaggcccataaaacttgaaaggccatcggatacacagaagtttcattaatttgaattaaaaaaaattacctgtaatcatctaaaatgaaattcttttttgcagtcatcatccatatcgagtgcaataattcattaaggaagaaccaactaaggcatttacttaatgtgccacaattcataatcattgtggacaaaaagatacaaatgaggtgtatttcttaaactcccagcaggcagtcacaataaacacaaacatgatagctttttgacccaatgtacaaacccaacaggcttattggcttattgcttgcagcagttgaactgataaattctcacattccaacactctagttctgaccaagcaaccccattgtctgctaatgcccaactggctaatattataggacacccacaaatccacaaatatgaagtaggtttcaaccggtgaaacaccactagtctgccctctaatccaccccgcacatgcagcaagtacaccaaaaacattaactgatacatcacacgcatttctataattttattgcaattccccaacaactgtaagaatacctaacccaaatccaacccagtcagaataaactaaataatctaatcgtttattggccgctagccacagacacagttcactgttgctacagatgcgctaaacttagtacacaatcacccagtaatccaagtaccaccgccagacctaagacatctcaagcaccaagtaaactcgctcagcggtcatcacaaaaaacgaccaaatattttcatcgcaaatataaatttctagtgcaacagacccaggctgcggatgagcaggtgggagacactcaccgcgtcagtggcgttgtcggcgtccatgtcggcgcgcaggcgggcgtagagctgcgggctgcggtacagcgaaccaggcgccgggcgcgagatgatgcggggcacgctgtcgagagagatggagcccatgtagagcagcatcgccgcgacgtacagcagcggagcgaagaggaagaccgcctgccgccgcagcagcgcggcgagcaccaccctcgccgccctccgcacggcgcctccgccccgcacagctccggccgcgcctgcccccgcccccgccctcgccgacccgcccttccccgacgacctcctccccgccccccgccgcggcgaagacggcggcgacggcacggcgccgctcccgccgccgccgccgccgcccaagctccccagccggttgtacgcgtggttctgcatcgagcccctcccaatattaaagccgttagttaatacccccccccccctccactgtagagctagggtttctcccgcgcgatcgatcgcgcgccgcgccgccacgcggcgggagagcgagacaacaccgaggcggcggcggcggcggcggcggagaggaggaggtggcgagccggagcggagggggaaggggcgccgcacggcatgtgtccggcgcgtgaccccgcgcgcgcgcgtgcgtggccgcgtgggtgccggtccgagcgcggcgctagtggccgcgcgctggtggtggactggtgacctcccctaatcggtcgcgctcggattcccagaagttttttcgtgcgcgtttcaggcgcggcgcggcgcggattatggtttggctttggctttggccgtcgctgaccggggattcggatttttctggtctctctgatgtggtgcggccggtgggcgcgcggcacgccaatccagcacgggagtcgggatagattgattgatgtgggaatgaacggaatggaaggtctaatgttcaagattgggagtatggaactagtcggattatctttctatcctcgcgtgggtggtggtggacatttgggtttggggagagattcgtaatgcgatccgatctttgcctcatgatcgtgatggggaagtgaggttgacagcatcaggaggccaggaatgggctcggtaatgaccctttttattcgttagggcatgccaaatgtatctggctcaagtgggcattagcataggcccatgtaacaggaggtagcagtgacatagagagttcactatgtatattttgtctgccagaggtagtaaggtggggccactgaaaaaactatacattttctatataacataattgcttaccccatgaaaatgttgcacatctattatttttttattttcttgctaccggtagtagtactaaaaccggatagcagttgttaccccttgccacaatgtttattacccgataatagagatgtatttatgtcttattacctacttttcaaccatattgtggttgtagtgagtagtgacggctattgatcagagtcatcaggctgtgcttcctgtagtaccgcatggtgactgtgacttttaacacgaggataggatgcaagttgggagtgtacagacagacagaaatgctaccagtattattactaccggtttattaccacgtcatcggtttaggccatgtgagtatgtgacacgcggagcatgtagagagacaaaccgaagacacgcttccttctattccggatctttcaaagaaaactgcaagctgtactcagcattgatctctttcctcgtttcctaagcttccacagctagtactagtagtactacgcaagttttgtgcatgacaaccgaatttcttccagaagatactgcatatgccagtgtgaagccaagtagtagcacaaaattgtttttctgctcttctccgatctgtcaaactctggtagccgtgcatagttggcgatggatattattttcgtctcaagctccccctttttcacacggacagaacttatattgggccataacaccatctttcaagtggttttggtttggtgtggtatttatgccacttaaatactatgccaaataatgcggtacatttcccacgggttattataaatggaattgctatatgttattcgaatgaaatttagagatgaaatcttatagattttagactattggatctatgccaagattcgtacatcggcttctctcctctaactccggcgggctccccttcttctccggcgctggcgacaccccccaacttcggtagggagcatacgggttaggatttggagttggggtcagagtaggaggggggttagggagggggaagagagggttttcctcggggcttagagagatggccgtaggaggcagagaaatggcagtgggtggtgggcggtggacttcagcgggcggcaaggcagcggcggcgccgccgaagccacagtgatggaggagggtggtgggccggcatcggcggcgggggcaaagcaagcgtgtggttaggagacagcggtgatggttgcagattcggcgatggggagccatcggagacggggaagacggcagggcgggggcagggggctcgctgagggagcctcactagcaccgttgactatttccaactagccaacgaggcgggcggcggcacagtgggacggtgatggcaggggatcgcacgagggacggaaggaggagtggtggcagcgcgatctgaacggggggaggaggagaggagttgttgagaatataggcatataatgatttaatatattccataaataaatcatgacattacagatgtatacgggcgagctgtcgcggacgaacaaggagcagtcgcgcgaaacgcttcccaaaaaccttattgccgccttctccggtgcaggacgtcgaaggcgataagtcgcgcgtaacttatccggactccactacgcgaagcgcttcccaaaaaccttattgtcgccttctcccggtgcaggacgtcgaaggcataagtcgcgcgtaacttatccgactccattgcatctgcgaagggtgaggagccaattttgtgaatcattcgacgcgtacgtctgccagaccaggccagcgagcgcgcgcgtgtgttccccctcttctctccaccacacatgcttcaagtggctaggagggcatcctcccctttaaggatgtccccctctcctagaataagcaaggtggtactaaactccacatgcatgccatcccatgaggtgggcttttgtgattttccaaagaattaatcttcgaataggccttagcccatctattaattccaacagaagttagggttaagagctccgcacaaatcttgaagcatatccaatggtccaaaattcgaataatatgatgtgggattttctgtcacaaaggacctgttcagattgtagccaaaataaaccttacaataccaaaaatttggcaatttaataatattaccaagttttggcaggattttttatttatttactagagtttgataagtaactaaatggatgcacgtatttcacaactttgcaaaaaaaaaggtttgaaatggcatcaatctaaacaagcccaaaatatgtagacatccccatttataaacatttttcagatgtcctgtatttattttctggaagctccatcacctgattttaaacataatgtatttgttatagcatgactgtatatgctacagtttgcaccaaagtaattgcatctttgatcaatcctatcaaaaggctataaagaattaagattgtgtgatctatgacatgttgattacggattgatcatccaaagcttaattaaagtaggttgatatggtttcagaaaagaagaaaaagaataactagtagtaagaattatttaaggccagatacagttaagatggtgcagctatatcattacctaccattaatggtggggagcattacgatccgactgataaatttagttttttttttgccttaaatagttccgatcatacaaaaacaaagaccaaagtgcattgatttttttctagaaaaaaagagtgttgttattttggcatgcggtcatgacaaaagaaataacagttccaagggatgaagaaaatcacaaaagcaacagaggactaggaggaagaaagaggaggaagccaagcgctacatcagccagccacattgccatctacaaccagcgatctatataacaatggagagaccagagtggaggaagcaacgaccataagagactcgaagttgagaaggagaccctcgacgtggtcaccattcgtcgaagtggacgaggatacgcagccatcagagacaattaggaggaatgtggctttatctcagcagtatgggcgttgggtggacagtatacgcgcgagatgtggcgtgtgagtggctaggtgtgggactatggtctatgggaatggcgagtgggtgactgcttggataagaggcacctagcttactcaagaaccataacaattactatattgacagaaaaaaaaactagaagatatgcataatttgaccacgttgaatataggctttaacgatgtaggtgtactgatatagttgtgtttatgaaaatggaagaaagggttgaatctcaaatacaatttgttttaaaagaatctaactttgcatcaagttatgctggaaaatacattagcttgtgtcgaagaaagtaaaagaaactaaatcattcccatctttttttctgaatggataggtttattatgttaaatttggaagttttgagaactgtaccaacaaagcccgtctagctcagtcggtagagcgcaaggctcttaaccttgtggtcgtgggttcgagccccacggtgggcgcatttcatttttttcctgttaaagtcctttcctgtgatccagcacatgacacccagctaatgctttctggcactctagatacaggatttttttttttgccgaagatggagaagctgatgaatgcggtagcaaatcgccgatcatctcatcaatattcatcaggtgacaactgacaactcaagaatcccacttagacaagccattctagttccctgtgtggttggttccttatatcattggatatttaattcatggatgagactcccgactttctgtggtttgtagttttgccattgacatgtgggccatatcaaaaataggacccacatgtcagtggcacaaccttaattcagttacctcttttagcacagcctgcacctgcaatgtcgtcgaaaacacagcgcactagcgagcagttcatgctgatacttaacgaccgattgagtgaggatacaacctccgttattaagaaaagaaaccttctagatatggcttctttgccaattttttttattatacgaatgcgtatttgaagtattgaacgtaaactaataacaaaataaattacagattccgtctataaactgcgagacgaatttattaagcctaattaatccgtcattagcaaatgtttgttgtagcatcacattgtcaaatcatggcacaattaggctcaaaaagtttcatctcgcaatttacatgcaaactgtgaaattgtttttttcgtccacatttaatgctacatgcgtgtgtccaaatatttaatgtgacatttttggccaaaaatttttgggatctaaacgcaccctatgtcgaaatatataactagaatttaggactgttttggtttgctgcaaaaatttcctctaacaaatagttggcacttaaaatagtaccttgtagatgtttggattgatgccaaaatttaccaaaggcaatataactcctataattcaactctactaaaaatattggcaatgccaaatcttgcccataatttgacactaccaatgatttggtagggcaccaaaccaaatgagccctcattatctttttaaaaaagagggagtaggcaaaactattggtagttcatatgtaacggggtaagtgtagcgtcttgcttgaaaaaaaaaaacaggtggaagtgacctaaatatatgcagacccgaaatgactagtactaccacaataaacaagatgcgacatatttcgtattttattttttatgggacgaatatagagaactccctctgtccttaaaaaaaaaggcaaacttaaatttccatgccaacgtttgactgtccgtcttatataaatttttttttataattagtattttcattgttgttggatgataaaatatgattaatactttaagtgacttatctttttaatttttttcataagttttttaaataagatggacggtcaaatgttggacacggaaaacagagtttgtctttttttttttgggacggaaggagtacatgctaaggcgcgctatatagtctctagtgttaacaatgattgatttaaggtatggtggtaggtgacaacattcaaccacatatcctgattcctgacattaaacaggagctatttttccaactagactgaatgagctgccggttgaacacgtctagtttcttcatagctccatttcaccaagtacatgaaacggtagagatggtcggttggtcacgttgatctgaaaaaattagcacgagtgggattattcaaggtcctagagatggtcagttgagcgccggctgcgcgcggccaccgcccggaggtcattccatgccggcacttggacgtatatattacacgagtaccccgtatttacaccatcatcgtgtatacacgagggggagggggaactccgatgtggggaacaacagccgcagcagcgcgccgtctctgcgcggccggcgacgtccgctcggtgctcgcgatgctcgcctgcagggcgaaggcgggggacacggcgctggacatgaccgcgtgcgccgcgcttgtccggaccacgggttctgcaagggcggcgatgtggcggaagcccggagggtgttcgatctaatgccgctcttgggggtggcgcctaatgaggtcacctacaccgctttgatgcacggctacttcatccatggccagagggagaatggtttgtccttgttcgaggagatgagaattgaggagggctggagtcgagccaagcctctacacctaaaactgcttgatcgcagagtggtgcacaagggaattcgagcgcgctcgtaactagttcgacgaaatgcctgcaagggtcatagtacgcaatattattagctctcattgccgcctacgcaggcatggcaagctgtggggtaccgccaagctattggaaatgatgcggagggacagtactcgtctgagataaacatcattacctatagcctccttgttgatggctacggcaaagctgggaagatgtccaatgctttgcatttcttcagcctgatgaaggcggccagtttccaaccagtgcaatgacatacaatatgcttattgccggtttctgtcgtgctaggggcaaatagggctttatctgacatgaaggaacgaggcttggaaccgaccaaagtgacatacacaatactaattgattatttgattcatttgccagagaaaatgacatgaataaggctttttagatgcttgcatgggagaaggcaggtctagaggtggatgtgcgcacttatggtgttctggttcatgcactcttcatggaagggcatatgaaggatgccaggaagctgtttcagtcaatggaccagaaaggtgttgaaccgggcaatgtgatctatgacatgatgatttatggctatggaagagaagggagttgatacaaggctctgaagttgatcatggaaatgaggcagaagggtttggttccaaattccgtaaggtatgccttgatgatgacgatttgttttctttgcaatgatgataaatgtcaggaagctgaggctctgctcgatgacatggtccgtgctggtctgcaaacaagtgaaccaatctgccagtttactgaatgccaaggcaagattgagaggttctactgatggctcttttgtgtaagtaggaattcatttcttttcatgttatagtgaattatcctgattcatgagaaattagaaagatattgcacaaggaaatctacgtattgaattacaatataagaaactgtaagttcatttgctgggcatcacagagaactccattgcaagcgacaaagataggcagcaaaatgccgaagataaatgcacccagcacttgctgcaaaataaaggtcagtgcttattgggatcctgtgctttcatgctcgtcctgcacgccggaggctttgccaggtgaaacttggtttgagcaaaacccttttcagatgttatttcatgattcctagtacaagataacctaccttcatactcaggtattagataagaaaactagagatatatagcttcaactattttgtgtccgtaccatatactccgcccatagcgcctgttcatatcagtcaagtagaattaggttttattgtttcttgtttgtcagggggtcaaccatgagtccttgacaatgctgtatgagttcctgctatatgatagatcagcagtcgtcattttcctcaggcaatataaaacctagctttatattcttgctcttatttgcttcataaacgcttgactttaagttataacccatgtttatcatgcacacgcaagttcccagcactctcctacattattaaattggggtgtgtttagttccatgccagaattggaagtttgaagaaattagaacgatgtgacagaaaaattggaagtttgaatgtgtaggaaagttcgatgtgacggaaaagttaaaaatttaaagaaaaaagttgactcttcagggatggagaccccttccatacaaagaaataagaatgtcggcgttctctataggctactgacaaagctatgctacatgagttcccttgcacccccttttcataatataagagattttaggtagatgtgacacatcctaatacaacgaatctggacagaccgtttgtctagattcattatactagaatgtgttatatctacccaaaatctcttatattatgggacgtagggagtaattaatagctctatatggtttaaggaaatgagtaccctatccaaatttctacacctgggcctcctcgtccttttctgattgctatgtgataccggttcccacttgctaagttgccttaacaccgcactttgcaatttttctgataggagaatcaagagtgaccgatccttttcagattcttttgcaggtacttttcagttcatcttgtgtttatgacgaaatgctctttaattcttttgagctcatgaataagtgtcttaaaagaagagctcatgaacaagaataatttaattgttactaatactagtaacaaattactgcatatttactctctcttttgtttttacttgttagtttggacatcaacatagtctacttaattatatttatatatacaaaagaatgctgaaaacatacttcctccgtcccacaataattcaactcctggattcccaatgcaaacttagtacaaccatgaaaataccgaaatgccctcaacaacaacattacacaggattgtactgggttctctgcactgtcctcactgaaaaaaaaggtttaactgggttctttgcacccatcgattacactggtatccagcaaaaaaatgaagttttaaaccgaatatgctaacaaaaattaagaacctctagtctgaaaaaagaaatcataaaaaaaatactactccacaatctgcaagatggtttgcatccataatctgtcaaaaaaatacttctccacaatctgcaaggagtatgaattaatctgcaagaactagaaagaacaaagaaaggtgtttgcatccaccaaggtggcctgtagtcatgtgtgtatttatctagattgaccatgcaaaaagtcatcatcaaaatccaagaacttagtatagttaacaaggtgaaatggcagaaataaacaccagagaagaaagagtgatgaaaaataagtagtagaaaagagtacctgggttcattctaatggcaaagcttctcgaaccacctcagcgctaggagacacaaaatcgttggctccttcatcagatccgccattgcaaaagcttgtgcatcaggctccctgcaacagatccactggcgctggagaccataggcttgcgccttcgccgccgtagtcgagcagcacctacacgttgcgttcgccttctcctgcatcacaatcgcaagcccctacctctgccgccgtgctgctagtgcctcatccgagccatctcaatccgccggggccggcgctgcccccgccgacctgtcgcatccatgacatcacgggaggtcgcagggagggagagatggatggagcgtggagggaggggaagcgactcatcgccgtcgagggatgggcgaaggtcgtgaggagagggaggagatgagaccggcggtggtggttttttttagcgcggctgtgtggtgggcgagaggagagagacgggcagggataaggatcattgaatatttctcgggtgttgcgcaggagttgattttttctgggacaaatcctcacccccagaaatcgcttctttctgagacggagggagtaaataattgaagtacttctgacgacaagtctcttgatgctattttcatgtactccttccgtcccataatataaggtattttgagtttttacttatactctttgaccactcgtcttattcaaaaaatttatgcaaatataaaaaacaaaaagttgtgcttaaagtactttaaataataagggcaaaaaaagtaaataataattccaatttttttttaataaaacgagtggtcaaacagtactaataaaaactcaaaatcccttatattataggacggagggagtaacaaacatttatcttttacgaatgggtaaattggaatcatgccattataattttgtaaagtttgagatctatcggtatctcaatgacacgtaggacccacatgagtcaatgacatgtgggtcaggatgacatatctcaaattttgtaaaattataatgacatggttccaattttccgttacgaattgatgtcaatgttcttggaatgttcactacagcaagtactagcgctgaagcagtacagcataacgacgactataggactatttacctgttcattactcgtcgtaatgtcgtggactcgtggtacgccgcgtacgcttctgcacgctgaccgctcgccatgggccatggcaaatgtgaagccgtgaagcatcggcccagcagaatcacccgtacacaggatcgattaccaacggcgcagatgacctggaggagaccggacgcggccggatgcggaagtgtattccccttcgcaccgcacggtcgcacgcacgcaccgcgagccgttaggggttcaaacttccggcccacaacggtaactgtcgacgtttgcgaccgcggccccttctggcatctagaacccgaaccggggcactcgcaacccgacggcgccgtcaactaaccatggcacgaccgtcgcgtccgctacacgtttcctttcgtctccaactcgtattgctcctctttttttttgtattccacccctctatttccgtaaatcatactatcccatgtgttactgtactactatacggtaggggaaatctcgtttttttcatgcattttgcattgtactaacagcacaattgtgagagttcgtgctgaacatgtccagggttcatattcctaatggaaatcacgattttcatgaaaatagaccgattttcatggaaatagaatatttggggttggttccataacaaaaaccattcgatttcatggttaagcttttcaaacaatcaaactaaaatttaattattttgataacatttttctcatttttgtcttttttgttagtttaccggtagttttcgtgaaaactggatatactgctcgtgctagagaaagttttcagtccgataaagggattgtgaagcctgccctaaacacatgaaaaatgtaaaattcaactttgatttttttgcaagaatccttttccttttttttgggtgcttttcttttgtatagcactgtaccgtatacaacactgaatacaacaatgtaggccgagtttagttccaaacttttttttcaacttccaattttttcatcacatcaaaactttcttacacacataaactttcaactttttcatcacataattacaatttcaaccaaattttcaattttagcttgaactaaacacacccgcaatattagaaatttttttctcgcctccttatctaataaggacaaatctgagggacctattcggaaaaaagagatgggttaataatttattcctctcgctcgtcttccccttccccatcgcttcaacgggcgaggttttttgaaagcatcatcctctctctctcctcccccatcgactacccccgacacccaacggaagccgtagaaggagagagaggggaaaagcttgctattttataccctcatctagggttccgagcccaccggctctctccccccttgctggcttcgcgccatctctcccgccaccgcctccccccctccccccctccgcctccgatagattcgcgctcgccctcctgacccacggattcggttcccacgaaaccgctcgatctgggggatctgctagattcgtaaggcggcgtttcgatcgatctgttcgggggtttctgccgtggggaattttgatctataaagttagttttttgattttgtttcttttttgctttttggtggcggtttcgctgtgttaggtttgtggtggtggtggtggtggtgaggatgtgcttgtgccgttagatgggggccatggcgatggtggagcaggaggggtgcgtcgagaaccggcagcccctggcggcgtcgagctcgtcagtttccgacggaagcagctatggcggcggcggcggcgggctcgcgcagatgtcgccgccggtgtctagctcggcgaattccatctccggtcttaggtaaggaagttctttgcccgattcccctcagttgggatcctattatgggagggatctaggaaggtccgttggttagtacctaagttcgtgtggtagttgagaaaaatggggccttcgtggatggctccccgatggttgtgtggttttatcgctggcaatttgccctgtctgtgattccacgagcggttgtttgtgcgtttgagaaaaaatcttgccacgaggagtgctaccttggcggatatgtggcaccgagagtgttgtggtggctgtttgagtgataaatttggtgtttttttggtatccatttgatgagatacttttttatattcagacatgactttgagtgtgttatgatggatatactgatatgaaggcgttttccttttgggatggctgttgatgttttcatttctgtaattaatttgcttgccttactttaaagtgtgtatattgatgtaatttggataaaaatatgttcacttggaacactaaattggtccggttacatgcagcagtagttgtttaaactggaaatgtgttttttatgccatgacccaaggttttattagatttaatatgcttgggctacagcattggagataccatttacttgtaaccttgatgtgtatattttttgttctgactgctgcgctaaaatatggtactggtgcactatagaaatagttgttttaatgaataaacagtatttttttgttaggccctgtttggaacgtttaccctttgtgtaagattcctgagttcaaaacagggcctgaatagttgcagttacaactaaccgccatttttgtttcccacttttaatttcttgatgatgaattgaatggtgttagtagggttaagcagtatttttttcatggaaatctttcttgttcatgaaaggctccacacatgggaaatttacattgtcgaactatagccttaatgttcttccctatgtaggtctctcaaccaacaattgctgtttttttgggtcatcttatgctagtgtatttagatataccttgtgccttctcggacctaatatgctattgtgccctgaacagaaaatctttcactttatttttgctgataatctttatcttatgttaggcggacaagcgggccaataaggagagcaaagggtggctggacaccagaggaggtcaacacctcactctctattgtacttcataaatactccataagtcctattaaatgcaatacatacctacatttgttacacatatatgctagtttggtttgtatatgtattttggcatattcagtggtaatatcatgcactggaaaagttcttagttaatctttttccattcctgtttttctaaggttcttattttatccgattttatttcatatatgtttttattgttattcatggtctgaccattgattttttgtttgaatcaaatcttctattttcctgcttgaacgacatttccatgttgattcagttacacaatcactgttactaattggtcttaacttatcgcaacaggacgagacattgaggaaggcagttgaggcttataagggtagaaactggaagaaaataggtccggctctcaattccactgcaccagtgtataacttgggcagtcagttatccttgagatgatgctatcattttgttgaaaacaacctgtcaggaggattgcaaatgcctaatggtttgattccattaatatcggcccatttgcatataaatatgcgtatacaaatatgatctcagcaaactaatacatttttgcgtagattatatttgtataaatatatataagtatgcaacctatagtaatattggtgatcttgtagttgaaatagctgtttttttacctttttaatgttgtagtacttcattatatcagttgctccacgtgtactggcatacagcatgccatattatttttccatatctgtatgccaagtacattgagctcatagaatgtatctgtatgcagccgaatgttttccatacagaacagaggtacaatgcttgcatcgatggcaaaaggttcttaatcctgaacttatcaaaggtccttggactcaagaggtttgtcatgtagctgactttgctttgatggtaagcgttgacattatatcttctaattgttatattaatgccatgttttctgcaggaagatgatcaaattattgatcttgtaaagaagtatggaccaacaaaatggtctgtcatagctaaggcattacctggccgtatagggaagcaatgtcgagagaggtaatatttttatatcatggctgtattgttaccaggattcagctcactgttattaataaaacttttaaatttccagttatttttttcacatatgcatttatttccctttacatgagacattaggaaacttttgtaattgcaagaaagaactttaaattttaggatgctcatagttgctacaaaagctcaggatcccgtctattatgaaatatgaattaattaaggccttgttcggttaatccctgtgatggagggattggaggggatttattccacacctattgtggtgtggaattattccccctcaatccccttcaatcctcttcaactctaaaccgaacaaggcctaagaaatgcactacttactgaaagaactgtgaaaataattggctaataattatgctacagtatctcatagctgaattcaaactgttgtccgcatataatttactttctttatggcttcaatagtatttgttatgaaaaaagtgcttaagtttggcatgatacaatacattatacggagctaagtatgaagtcatacaatcttaggtggcacaatcatctaaatccagaaataaggaaagatgcttggactactgaggaggaacaggcactcataaatgctcatcggatttatgggaataaatgggcagagatagcaaaagttcttcctggaaggtacgtttataaagcttacttccctcggaattttttgctttcattagttcatcgagctaggtcaaaatcacgctgccctcgatctcttagcgcgctgttgcaatttagtttgtttgatttttgtttcaagttctactttcaactgcttatatacctgtgcgatggtcttaaactatttaatattggttggttgttcgtaaatcagaattatgagttgtgttattattttgaaaagacacactttacatcaccttcacagtgcttcgtatgttgctttttccaggactgataattctataaagaatcattggaatagttctctcagaaagaagcaagatatgtacaataccagcaataatatggtagttccgaaactgcttgttcatgataagttcaaggataaaccaaagctgatggctatggagggtcatcttgatttgaacaaggcacccattatcaattcaaaagaccaacctggaacagctcatcggtctaattgctcagggtttctatctcgttcctcattaccaactgctcagccacttacttcccgtgaggcatctgtagttgatggttccgctgtcactttagtggcgcaagctctggaaagtgattctgtccgtggtaagggcttggaaattgattctgttcatgagaaaggtcttgaggttaactcggcacctgatcataccgggaactcttggaccattcaactagaagctgcaccatccaaaggtgaagcagaattatctttgaagaatgaggcacgctctcttggtccactttgttaccagatccctaacatggaagatgtagtccctgtgagttcctcactcttttctgaccatcttactgggaaccatacatctgaacattgtggggatgatatattgtcacctgctggctgcactactccccctccaacaaagggaaaattaacaagccagcttagtgttgattcaattttgaagagtgctgctaacagttttccaggtactccttcaatattaaaaagaagaaaacgggataaatcaacacctgtttcagctagtgagatgaagatcagtggatcaaatactgatagattttacactcccatggggatggaacctgctacagctacaccagagtcattcaaaactacatcttttttgtcattgggttctcttgatggttctgtaaagagctttgatgtttcaccacaataccgggcaaggtcaaaaagaatggctctcacgaaaacagttgagaaacagctggatttttcatcagatggattagatacttgtggttctgagattctgaactcttcctgcaataattcccaaagcacactttctattaccgaagccccaaaactgaaagaaaaggaacatgctgttcaattggaaaatttaaccaagaactttgcgcatacaaccaatttggatgtaacctaatcttgaaaatgcaggtatgctgttacaaaaatcttgaaaacccctgctttacaattgagatgcattatacttttcatagccagtctacaaattctacctggtttatctgatccatgttggtagttgggtccttttattaattgatttgaacatggaagaagtgtgcataattgttttaccattgccttgtaggaactgacatcaatctgatgaagtaggacagatgagctgaagtgtctttctgagctgatgagctttttctcaaagtatcacgattaaaccacaacaagatcaaacaaaaccggtggagaagaattccagaattgaagctttgtactgagtacagaaggtccaccaatcattctcccatctcttctaaccaaggtgtacaaaagatgagcgacactctgtagaagaatacattgctcgctgcactttgtgaatttacagttagaaaattcagattgtagaagccacaggtgtgtacaaaacaacaacgaaaaaaaattatagtgttagaacgtcattatagctgaataagagtattcctcattggattgtcagatttattttgtcttgtgctttccctttgtcgcgaaacagccagggtctgctctgtgtaacaataataaaacccgtttttgcaaaatcattgccagagatagtcaagaaaccattttgacagcagctcaggtttcgtttgttggttgttgacaattccttaaattctttagcatcttctgtactcgctgaagctctgttagaacaacgttgcagaggctaatcatatgcttgtgttcgttcttacttgatgctagttgtatgatatgattcagctgtattactggccctgtttgggtgagcttaatttagagaaactggaatatgtttctagattctaattctatatctatagtaactatacatatcagaatatgtatgaaaaattagactatgtaagaagggtgtgttcacactaaaattggaagtttggttaaaattggaacgatgtgatggaaaaattggaagtttgtgtgtgtaagagttttgatgtgatgaaaaagttgaaagtttgaagaaaaattttggaactaaactcggccgaagttttttgtttagagcatcaccaatgtatatggcaaagtgatctatatagatgggacccacataaatagtttatccctatgataatgtccacaatgtatagatacaaggtatcattaggagaaggagaagagagaggagtagagatagataatataatttatttcatatgggtagtccatatgtatatgggtattttttgctattttttttatatggactagttgcacaatgataataggtggctgaatggaatattctattgtttatagactacttttatattgtggatgcccttaggaaaagctaaacccctatcggcgcctttctatgcctctctatcaccttttggtcattcggttcatcgcggatcgacgagaaaccaggttggcccgaatcaatcggcgccggcggcctccgcggtttccgccttcgggtaggcgcctgcggcatcaacaaagcacacagccgaaaccgaagccttttctttcttccgccccaagaagctgtgccacgtgtttcctccttcccctcctcgatttaaccgccccatctcgagtccccccatcacagcttccactccacgaaaaccctctgcctccttcgctcgctgcaccctcgtctcggcgatccatccatggctgccaggaagttcttcgtcggcggcaactggaaatgcgtaagtattccccccagcactagtcgtctcacaatccagattccggatgagccggagacgctgctgatgagtgatgaggcttgggttttatcgatgcgctgcgctgttgctgcgtgcagaatgggacaggggaggacgtgaagaagatcgtcaccgtcctcaacgaggccgaggtgccctccgaggacgtcgtcggtgagccgtcgtcccctcccgagggcgttgtttggagttggatcgattcatgaatcgatctggtgctgatctgtgggtttgtttatttattttaattttttttgggtgcagaggtggtggtgagcccgccgttcgtgttcctgccgcaggtgaagggtttgctccggccggacttctccgtcgccgcgcagaattgctgggtgcgcaagggcggcgccttcactggcgagatcaggtgagcgtcctcccccactcccctgctctgtttcccttccccttttgttttgagagagatgattagtgatttatttggcattgggtgaacaactcggccttacagcgcaatctgagtgtttatcacgagagcgtcgattttagtacggattgttcgaaccgcgagtattgttagtcgattataagcagctctagttccacgaaatctgacttgattataggcatgaatggatttgtgggacagctgaataatgaggcatgagtatgctgctgctgctctattgtggttatcggtgatgttctgcagactgcagtgctattatattaaggggtgaatgacagcagaatgtggaatgctttaagagcaatcctttgccaattcactgacgtatgcttcatatttgcagtgccgagatgttggtgaacctgcaggtgccttgggtgattctgggacactctgagcggagagcgctgatgggcgaatcaagtgatgtgagttctttctacattgtctagaaacataggattttttttcatgtcagctttatagcaactagaatgcgggcagctactggtttagcaaggccaggaacttgccaagaatatctagacaatggtcctattttaaggtcaatctgcaccgtccctaagctagcataaaagactgttgagttactctgttgagttttagccaagttagacctataaattgggttatttcatcaagctgctggaaattctgtttgaagctcatgggattttgatttactatgttgttactaacagttcttttcaccattcatgacagtttgttgctgacaaaattgcgtacgcactttcccaaggtatcaaggtaattgcttgcattggtgagacccttgaacagagagaagcaggaacaacgatggaagttgttgcagcgcaaactaaagctattgcaggtaatttcacttgctattcttcaagttaatttcttataaagttggaacttcacccctaatgttggaacaactgaataagtgcttccttccttccttatgaagtaccttgtgctgttgataaatccagttcttccaccttgaaagctgttaaacaggaatgctagtttatatttgcagaatagaatactgtgattgcttttaccctgctaaatatccaaaaggtatctgtagcttgtgtacaggtttatgatgataacggtgtggtcaaattattaaatgatctatcatttgaactaggaattatgtcatacaagaaacacatactttactactatgagccttttagttattgaagaaaacacatcctgttttgattagtcacatccattttcgtttcatttgttctttatggcttttgtggtccattgtactgtgctgacatagaagtcttctcatttctccacccctaactttttgtcttttttactcgtcatatttttcagagaagatatccgattggaccaatgttgttttggcatatgaaccagtttgggccattggaaccggcaaggttgcaacccctgctcaggctcaggaggtattccttctaacatagagcaattacatcacgattagcatgttcccttcacatttatctgcctcataaaccaatatgggttttttcctatatctaatgtctttcttgaccgatgcctggtacctgattctgcaattctgttcattcgaattatttgaaatatgcatgacattaggttcatgatggtctgagaaagtggcttgtgactaatgttagtcctgcagttgctgaatcaaccaggattatttacagaggtatacctttataactataggactatgaattgaaatgtaaccaagattttgtttagtagtgatgccaattgctaatgtacaaaactctccccacttccctacgattaacctgatcccttgtcttcgcatatttgtcttctacaggctccgtaaatggagcaaactgcaaagaacttgctgctaaacctgatgttgatggattccttgttggaggagcttcattgaaggtcatattcctattcctttattatcctctccatgatattgatagtagcatgtagaacataagcctagttaaacaaaacaccatttgaccagtacaatccttgtgcggttgtgcctagtagcatgccaaatatttgaatttaactctatacattctcacataacatttcaggctttaccgttgtgtatattactgatgattactttttttttctgcagcctgaatttgtggacatcatcaagtctgctaccgtcaagtcttctgcttagtgttctgggttgcaaccagatgatcgtaggagttaatgctgccaattttaagttatgacatgtttgaccagcttgctttgttatatctcgaagtcagtgaactccatatcgttccatagagcatgcagccacctgtggttgctttttttctttttgactttttctcccgagaggatcagatgaactgaaagtgccgttaatgtctgtattatcagaagtttgttgatggcttgatgctataatagttgaacctgatacttcctgagtgaagtactgtcctttgcatgtttgattgatgattacttgttttcgtagtcaaacgggctatcatgaaggatatactacatgtttgttaagtttgttacttcgtgatttaagcaattgttgattaatgcagaataataaccgggtcattcgcttgttactctattacattgtcatgtaaactagttagtgactgaatccatctgtgacgtactgtcctccctcttcctttcttgaatgtacactcccttaaaagcgttttctgggaagtagttatctagtgcacattatcatccagaagaccaattttaaacatataattacatattgcaacagttgcagttataacagattttttttctctatataattgtcaacaaccatagccagacgaagtgtacattacagattttgtactcaccagataaaataaacggtatactagtacttataaaatatcatttcaaagttacaataaaatgtaatatgcgaacatccatactgattcctgcagatcagaggatgtgtattctgaatagatcctttactgccagtgcccccttgcattgttccaattctttaagagaaaatcgagcatgatccggcataagttgaacacctttgtgctacggcgtttgtcaatcacagaagccgtacaagctgcggcaatggcccccggccggccactcgacgacgagtttaacttcactggtgagtggtcccctgaggacgcctaagcggcgaacccagaaaaatttatgttgggcgtaatatgaagggctaatgaattaatttggcaacggactagctgacattgtaatatccaaaaacaccgccgctgcttagcgcctcaaacatcaaataatggggtgtttcgtttgtgcagggcacggactgcagtctgcagctagcttaatgctgataaatatgactacactgatgagtcgctgatcccaggaaatttcacatttcttggggtatgccggtgccctcccggcaccacccctgggtccggccttggaggacgggcgagttgccggcggcagccggcaggccggcagcggcgtagggtgtaacgccggctcgttcctacttcctccgtttcacaatgtaagtcattctagcatttctcacatatatattgatgttaatatatatatagattcattaacatcataatgttagaatgacttatattgtgaaacggagggagtagaaggcaacatgtcaagaaggcaggaaggcaatcgagggcggcgcggaggacatcgctgaggcagaggcgcagaagagcacgccgtccggggatgctcgtcggtgaggtcaggggctcagggcggccatcattggcagcgatccaagcagggtcctttttacaaaatgtcagggcctattcgaaaatgtgttgggcacggatgcgtcaaacgtgggtggtccctggccgttggatccctgtcaacgccggctcacccttcgtcctcgccgttgcaggggacgaccgacgacggtgatcgcatggatgtcggtgccgggagctcatcagcaacgaggtcgtgcgcgagataatcctcgctaggatttcccgtcgctgagcgtgagaagcatcgtggactaatccgcaggtgcagggcgagcaaaaccaataagaattttctttctagttgtcctcgattaagccaaattaggaaccaatcttctcgtcacgctacagagttcaactaattcaccttgaaaagttgatggtcacaaactcactagatcttctgctcacaaactcactaggtattgctgtccaattaattcagttgctctatgttttcggcaattagaatttcggaatctatgctagatttgtcgagctcagttcctcaggatcttgacatgtgaattctctgtctgctttcatttttctctgtctgaggatttcaacttttggattactgcgacactgatccatgctttgttctttaattagttatgtgttgcgcgagctatcgacttcaaaataatatgctttttttttgtgatcgactgatcgccatatacctgtacgtaatgtgagacgaaaccactattcaattttgcagctgacgttgtgatgttgatgcctgatggtgctctactgctctgtttcctgcgttcccgaaaaatactgctctgttaatctgtttccagcgtaaattaaaacaaacggccaatgataatcgtttttaattttttggccgagtcatcacagactcacagtatgtcaacaactgatgtcagtacacccgttctttgttattatgacacatcactgtcatgaaaaccacctgataggttaacaatcagaaccaagcagtttctgattctgagacccattcttcagaaatctggaaattctaccgatatctatctgcctgactatctctatctcgatctcgtccaggattgttcttgcgaactaatggttgtacgcaaattcgtctccctactgcagtctcagtccaagtttcctctttgatgattcttcgaacttatcgcgtagattgggactcgcgcatttagccgaggaaacacgcttagcagcaagactcgatcagctccgatcctcacgttgaagcgatgaaaaaaaatcacctcgaattcgatccaggcggcgagacgtgaccaaatcacgtacaagtcgtcgtcgaacagacctggttgtttaaactactaattctaaactgcagagggtcagagagaaagatcgtacgaaacttgtactgctaatcatgcaataagcatgtgttaatgccaggacgattcactggggaaggaatcacaccgtgggcatgctgttgactagcggaataataccactgatttaagtagggtcatatattgatatatagcataactgctaactgccagttgctagtgcctcttcggctcttccagctgggagtcgaaacaaacaaaagagccgtcgttaagcacgtccaagtaattaaattagtacgtagtagtaatccctaagctaaaaatatggccagttgtagctgacagctaggagtaagagatgggcaagtagagagtatagagaggaaggagagaggaagcaatatgggagaacagtagtgaagcctcgaaccggctcggttcagtccaactcaaccacgtagaaacgtgcgggtttacacggtggcgaccgcttcaaatgtgcgggagctttgactggtccccagccagctcgcctataaacgcgcgcacgctcgagccagctaccacggcatctgcttgagttggagcaacacaccaagaaggccagagagattcagagaactacaccgagaaggcgagattgtttgcgtggttggtaatttggccggccttgatcgatcgagcggagaagagaagagaaagatggcggggagcggtgtcctggaggtgcatctcgtcgacgccaagggcctcaccggcaacgacttcctaggtgagataggtgcgtcctacctcgatccgcggccgagcgccgttagaagaagacgaggccgatcgagctcgatctcatccgcgttcttgtcctgtgcaggcaagatagacccgtacgtggtggtgcagtaccggagccaggagcgcaagagcagcgtcgccagaggtcagctaatactgctccgtgcagattactgcaaacttcttggtttttcgtttcagaattcggattattgttagacgaggcattgacgaacgttctgggctctgacctgaaaatgcagatcaagggaagaacccgagctggaacgaggtgttcaagttccagatcaactccacggcggcgaccgggcagcacaagctctttctgcggctcatggaccacgacaccttctcacgggacgacttcctcggcgaagcaacgtgagtgccattatatgctctcaccaaaacaaaaagccaacaaccatggcagctagcttagtcatagcaaacgctaaacactaaagtaattttccagttcttaaaggagatattaaggaggtaccaaatttacactaaaatttttggaatttctcgaggactataaaatttctctgaacactactataatctcaacgtgctgaccacatagttaggcaaatgaaaacaagcagaaaactttatataccttttgaacatcctgcacaaatctgaatcttgatttttgttgtaatgcaggatcaacgtgactgacctgatcagcttaggcatggagcacggcacatgggagatgagcgaatccaagcaccgggtcgtcctcgcggacaaaacataccacggcgagatcagagtcagcctcacgttcacggcttctgcaaaggtaaacaaatcaccagacgcacgactgaattattgattattcatgttacgccccgttgacctccattggtctctcctgattggctgggatctgaatgtgattcgatgttgatgtccaatgacaggctcaagaccacgcagaacaggttggaggatgggcgcacagctttcgtcagtagaaagattgtgaacttcaagtctataatcagttggggcctgtgggaggtttagataagtatactatagtactagcaaggtaggattttgtgagtaacaacggcatctaatgcccaagattgatgtggttcgaagtgtatgtatgctgccttttttttttctatactagatgtatattcagaacattgtagagtcatgaacctgttaatggatgtgaattatgatactacttcaacctctttttcgcctttgtgtagcgatacatacggtcagactttaccatctctaacctccaatatattaattagaatgtatgtataattcaagtgtgatgataacgagttgatttttcatcaaaaccacttatgtatcgttatattctttacaattttttattaccacattattaggacgtctgtgtgtataagaaatcatctatttagaaacctagggagcaggcttacaccgggaagtatctactgagaagtaccaattaggtcaaaccgtgaaaaccatcacatatcagagtatcgagaggaatgtctgcatttatccactccataattcatgagaacaaatgcaatcaagtttcttgtgtccttggaaaatccattcttagtgatgtcctccgaaaagaagactagttcagaaataaatcaaaggaaccactattctttcatcgtgtcatcatatacaacgaccaaatataaacataagcaaaaaatctattatattattaaaggaatagaaaaaaggagtctccacgttcgctctcatggcctaaaaattctcacattaatcggagaaaaagaaaaatcagagtccatatagaaatacaatttagaaatagctgaaattcggaattaaaaaataagaaatattagaagaggagactagagtccatatagaaatacaatttagaaatagttaaaattcgaaattaaaaaataaggaatattagaagaggagattagagtccatatagaaatacaattaggaaataactgaaatttggaattaaaaataaggaatattagaagtagagtatagagtccatatagaaatacaattaggaaataatagaaattcggaattaaaaataaggaatattagaagtagagtatagagtccatatagaattataattaaggaaataatagaaattcggaattaaaaataaggaatattagaagtagagtatagagtccatataggaatttaaaactaactaaaattcggaataaacataataaaattaaaggtagagttttgagtctgtataaaaatacaatttacaaataactaaaattcgaaattaagaaaaacacgtgaagaagagtttaaagtcaacatagaaatacaatttagaagtaactgaaattcgaaattaaaaattaaagaatattgaaagatgagtttagagtccacataaaaatacaatttgaaataataaaaattcagaaataaaaataaataatattggaagaagagcctagagtctatatagaaatacaatttacagaaaattcggaatataatttacaaataactaaaatttgatattaaaaataattaataactaacacatatataaaatacaatatgaatatttcacatttgtagtttcgtaaagttattgcaaaatttaaaattatgatgttattttaatatatttgaataatataatgagaaaacatatatgctattatatgagagaaaatataatgatgctagccgtataatctgcgcgggccaccatgctagttaacataacagtagaaaatgcatccaactatacagttatccccaaaagtccgcgtttgaacctgaacatagcaaaggtcctacttaactcaaatgaccagatctgttccttcacctgattgtctcggactcaaaatggatgtacaagttagactactggtacctgttaaaagattcaaaatgtgaccatacccctgaactgtactcgtttggtccaagcaatatggacttcgtagttgtaaactgaagaagatggtctcgaagtggagatcgttgcctcaggtgcataggtaacaagtcacctcttgcatttacatcagaatcaatttcttcataccttcactatagaggaaacgacaggtgcaattctgctccttggcaagaccaaatagcaaagctatgtttcctaggtgcacaaagttgctgcagtagtactgtagtattgtccaaggttctaagttcagatcgtgaggcagtttgcataaacaagggattgcatttttactcatcttaaacttctgtaatctctgtgactgataagatgtcatcacgtggatgggctgcttccacaacgacactaacttcatctcccactttcccagttgaaaccacggctgtagcttggatcccaacctgcgaagtatcaccagaattggaatgtaataccccaatgacgatattgagaaagtgatcctacttcaaggaacccaaatatgccattggagaataattgtgacgaactagtgtagtggcaaagtagtctagtacagcagacatattaattagctgtgactgccagtaatcctatatatctgcaccactagcagcgattagtgctattttctcctgtgtaatgaaaccacatcatctatgttttacacagccggaggtctccatctagtaatacaataagattagctctagtcgtttctagcatgatcactgatcacattgttccatgtccagataaaatttttaccagtctggacaaatttagctgctataaaagttgggagttggtgctggtgggccatctaaccctctttcacctcactaaaaaaaaagccgcagaaagaaaacgttgctcttgttccaacaactccctctcttaaaaatttgaccagagtaccagacatggcatcatagctcacactcacggtgtaggatgagcattgcagggtcggtgcaatgctgacatagggtaaagctcagttgatgcagtggattactatgagattcaaactgtagcaaagcatgtgtattcaaactgttcctttgaatgctaagatatttgaatacttaaaatacaaaataaaacaactattgtcctggctaactgctttgcctggttcaatttgtttatacatgaaccatcaagcaattgacttgcatatgttttaccaagccttatccctattccatgtcatgtagattttgtttaacctgagtcaaggtaaaacctggtttaagataatacaaaagcattgaaatcagctacaaaaatagttttttaaataaaaaaccgtgaataggattgaattatcctaagtcatctgggattggtcatactcgggaataaacaattaaaatgaagtgaatacacaataagatggtttttatactgactaggatttgataaactttcccaagccaggttacactggttttccaagccctgggcaagaccactaatatctacagaggtgctcttgctccaaatacaatcccataaaagcaacaagaatactctcatcttatatatatcaaataaaaatgtactggatgaagcatgtttgtgtacctctataacaagcaaagttgccaaacgatccttaataaacttaagaatcagggctttatacttctttccctttggttgtcttctcaagtattccaacaaccagtaacgtaagttgttgctatggagtctcctggcaactttaacatgcatgcttgcaataaaggtcattccttctaggtcaccagctgaatagggtggagattcacctctaagaaaagcctttatctgcaatttaatacatcttccatcagcactcaaatttaagtagaccataagtacgacgctcggatcaagatacaatgaaactagactgcactcataacataaaacacaaggtgggaaattgataataggaaagctctttgtaaattgtaaccatcatgttcctggaaactgttaaagttctccctattagcaggaataacagaggcatatttacctgataatgagctagcagatcaacatatcttcgaataggggaggtgaactgtacataaccaggaataccgaggacaccatgtggtacaggtttttggaaatccatttctgcagcacggagcacactgatgttggcaaaactcctggcaggcccttcagggagatgagtaaatgctgacacagctgtgttagactggggatgccctctgtatggcaaagcaatattgttgtcagaaccaaaagcagccacggcctccccacagagtatcatcatctcagatacaagctgcattgctgggttggattggtcttcaacatatagattaatgtttggttcaggatcatcaggatttgccaccttgatacgtggttctatcatagcagtatcaatcgaaccctgtgaacttcagagtgtcaattttgtcaaataacaaatgcatcgtagtactgatgtaatacttcagaaagtctttgaaaatacaggcttgagctaattggtaagtggcaccagtagtccagtactaatggtgaaatgaacagccgtggcattcattttgtagaccttggtctaggaaaggaatctggaagggagttcccttgtccatagaaaaccatgtgtatctcgctttataagaaaattacagttgcatttcattctgctttcatttgctaatcacagatgactcataaaaagacaatgtattgataacttttgaatgtttatcactcccagctaggcaagggaatactaggctctttgaatggttcacatggctcctataaataaagtccaatgatatttgaactacacttgagaacatgctggatggtgacattgacaaggaggcaacttccgcttatgacttgctaagtcctgctgatggaggagcacaagtcatttggctctcctggtgcataatagattttctagtcaacacaggctagagtgtttaacattctcttctctacaaatgacccattctgaatcaaatgtgctcacagactgaaaataacaaaggcatgtttagtacttacctgactacgacgccactgtgcacgaagggaagcagcttcttgaagaattctcagttcttcctcttcttccaggttcatatacagtagttcagttgcactctcatatgttaacatgtaggtaggttttatgattgaattctctatactatattctgcaatactatgaacaacacaaatatagttctcaacaattttgctataacaagcaagagaaaagcaatattaagatagtaggataccttccatctggctgcaaaatcacagatacagtaacagatttacaacccctgccttgttgcaggctcatagcattcatagcaagcctctctgggaacattggaaaggtagcagttggtaaaaagatcgaggttcctctgtgcattgcttccctgtaggaaaaaaagtaatgttctcttatacataccaatactgatagaaacactagaagaaggagaagaacaagaacctgtcaatgatgctccggggttgaaccaagcttgttgggtcagcaacatgtatccagacctttatcctaccatcaggtaatctagcagcacttagtgcatcatcaagctgagtcaccaaaaaaaagtgtttaatggatctgtcagtaggcacagctgctaaattataaccagtctcttgggatagatgcaatggcagaaggaacagaaacatgcctcatcagcttcatccacatcaatagcatacactttcaaagttgagagatccttcctgatatcctggaaagatgaattgaatgagattttgaattagtatacatcttttaagggaagacagtgagggagaggcttgctgtcagtacaaatcaacttaggctgtgcactatacttgtaaaaaaacaaaaaacaatacaaagggcatcagtatttggtagtagactaatagctgacatattaatttatagttgtacagctaaacttacataaagggaaaaacacaatatgaagaacatcaatatttggtagtaattaaaactaccttgtctgagtcaggacagtctaccagaagttcctctgcagctgacaaaacttcctcagtgtacctgatgcgaacatcatacctgtaaagatcaagattgacatgcacagggaagtatccaatatttataaggatctttagagcagctgatgaagtctttgaaaagcccatagccttgagaatctgcaattacattaataatcacacaggtaaacatcagctacaagggaaaacttaattatttccttcaatgaagaattatgttacactacaaaaacatttggttcaaactttttaaaggacatgatactttatgatggtaaacaaggattatggttattcagtaaaccaacactagtgtaaacaaatatttacttatttattatgcatgacaaaataatagtagtggtatagaatatgttacgtttcctgccgttctcctttgttcatcatcacatgcatcaactgcatatgcctgaagtgactcaatttttcgcttaactttctcctccatcaaccatgaatcttttgaaggtttagcatctagaggcaatgctttggcagacttgattaactggacaaattcttccatctccttctcagctgcctctttagcaagtttccgtcgtaagagttcctccacctactaccagatgagaaatttaagtccaccagccaatacaacaacacaagttcatacagaaaattaagagataagtgcaacctgaggtaattgggcatgtgattaatacagtttttaaccaagaaaccatatgacagtagcaatgtaaagcttaatataggaaaaaatacttcccactcagacactagatactaatagaaaaatgacgagaatatgtgaagtcaagcattctttagttgaccatcaagatatttaataaaatatctagattgatcacatcaatttgatattattgtatatgctactcacaatacaatagacttagcagtaactgtggcaccttggagactacatcgattagcaaaacgacctatattttgtgaaagaaagagtgaaaggcaggtaatttagagtgtgtatcgtgagatgaaaatcatgggtatatttaggaaatatacctgagcaggtgggcgaggttggtacacagaagaatcccggctttcgaccttgacaaaatagactatgtcccttgataacaagaagtgtgcacagtagctttccagagactccttgctaccataaactatctgagaaaacaaaagattagagttacatctgaatatggaaatacaagatagaaaatcagatggaataagggagcttctgacctctgcgaactcctctactgttactgatttatcattctcagaaagctccatccaagcacactccaaaacagtagggtcctaaaaaaaaaacaaattatgcacatgtatctatggtgcagatacatatcatgattcgtgcaacacatcttaccaaaagatcttgtgctttcttgataaattcatctattcttgaatgattgtaattgatgataccaggtataacatatgtaacctgctggggttttatagaagacaatataccattctgtacaaatagaatagctatgtcaatgaaagaaatcatagacaaatagacaatgacaaacatatgctaagaaacatactcattatcaatgtttactctattgaatatagacaaaactacagtaattgtttcttttgatacctggtcagtcaccttccagtttttctttccatcgggcctttctacaacagcaagcaaaaatctctcagaatctttctgaaattcaagaagcaggcctttctgcaatgttctcttatctatcttattgtcagacagttcctttgtcccctgcaatcctatcctgaaaaagggattccaacagcaatctttagtatattgtcaaatggttaaatcaaacaattaattattaaaactaaacatctgtatgcaaaattttcagaactagccattaacaccttgtgataagctaaaagaaaggaagaaagaaaaaaaggaaacactcatttatcagaaaaggccagtgcagcagtgtcacactaatatagacatcacaatcacaatatactaaatggttgtaaatttggacaataaatggctgaatatctacaagtatatatgttaacggattttccgcattacagtataaatttcactcaacacatttaccaataaaaaatcgtgcaaacattatttcaccttcccagaagcacattatatagaaacagctccttgagtaaattatttgattacttttgttggtacataaatagttcacagcaacagctcataagaaaactatgctcacctacttgcatcaataaagaatatactatggccactggtcaccgctcaacggtagaaatgtcaattcctaagaagtttatcataaccctatagtctgtttggtttgatactgatgattgccattgtttgtcttaccaacttttggtaccattgactggatttggccagcatttggtttgctaaaagtgttcggaggattccttccattagctccctagttcattccttaccaaactttggcaaggagtgctatggaaaatttggcacaaactaccaaaccaaacacctctggggcttactcactaggcaccaaccgatgaagttttactaaggaatcaaaactcccttgtgcacaatttaatgaggaaatacatgcggattagtaactcagtgtaatgtataacttggtagctactgccaatcagctccaagtgcacacgcatacaccaaccattacaactcaagcatgcaaattatgggttcaaaatgcataggcaattcagtctagagaatgacaagggcgcgttactttgccgaaacccgaccacgcctctgtgatcggagctcctccaggacggagtcgacgaggccatggacctggcgtccccggcatccgccgtacagggagaagtgccagccggcgcgagcggagtccgggcggacggcgcggccgaggggacggaggcggaagaaggcgagcgtcgccgccgccgccgtggagcagccacccgccgcccgcaccgccatgggcgacggcctcatcgaacccgccgccacgaagctgccgccggggaggagagggtttttggcgataagagcctcccgcgagtggaaggcgaggattcaacggtgcatcgagaggttagcaagagggacaaaaatcccacgaccgcaatatgagccgccggtttcgtgtgctggtcccattatggaataagttcaccagagggtacctcaacttaacagcaaaattattttgagatcccttaaccacaacaccagaaatatgtacccctaaattcactcaaactgtttaaaggaggtcccatggaagtatatatgggtggtttcactgacgtggcatcctaggctgtgttcgttacttctggatgggagcaaatccctcccacatagaaaacggggcggtacattaacacgtgattaattaagtattagcaaattatttttttcaaaaatggatcaatgtgattttttaagcaactttcgtatagaaactttttgcaaaaaacacaccgtttagtagtttgaaaagcgtgcgtacaaaatatgagggagagaggttgggaacctaggttgccgaacacactcctagtcatccaaaaatattaaaaaaaatacgggggcccacatgtcagccaccctctcctctcttcttctcctctactcttttctcacttctctctgcttttcttcggtgagggaggccggcggcgggcagtgcgcgcggttgccggggcggagcaggcgtggcggcacggggcggccgggggcagagggtggcgcggagaggaggagaggaggccggcccgccggcgaatggcgcggattgggggagagaggcggccgggatggcgggagtggcgggccgggcggagggtagtgcaaagagggggagaggaggcgggcgcatctatgggcggcgcggattgggggagagaggcggcggatactactggagccgcgggcggggcggagggcggcgcggagaggggaagagaggcggtcgggacggcggaagtagcggacgagagcggcaagcggagcggtgagcgagagctgatagcagagtgactggcgagcgaagctagccgtggacggcgggcgatatcggtggcgctcatcatgctccagctcttcattgcctgcgtcgtcatcgtgttggttgacctccatgagcgcagcaggcgaaggagcggtgggtggagggcggcgggcaagtgcggcggagcggggggcctggtcagcaagggtgagcagcccggcgccatgctcacccgcctccactgtcgtcggccatcgacttatttctccccctttcctcgtcgtcgtccccgcatgccgtccgccggcgcgcttgcctcctctccccctctccgcgccaccctctgccctgcccgctgctcccgccgtctcggccgcctctctccccctctccgcgccgcccgccgctgcgtctgcctcctttccccctctcccgcttcttccccgcgtgtcgccgcgcccgctccgccccggccgccacgcgcgctacccattgccggcctccctcaccaaagaagagcagagaagtgagaaaagagaagaggagaaaagaggagaggacggctgacatgtgggtcccacatattttttattttttttactgactaggatgccacgtcagcgaaaccacctatatatactgtcatgggacctcttttgaactatttgagtgagtttaggtgtacacatttctggttttgtggttaatggacctcaaaaaatctcgttgtcaagttgagagacctgcggtgaacttattccgttagcttctggaagattcgtgattgggcctcaacgggaaggacgggctgattgggccatatgtgggccgtcactggtaacatttgaatttgctgcgggaattcgagcttgtgtatcgagggtgtgactcgtttgttatacgatctactgcccagattttcgtagaaattgaagtgctctacaaaatggctgtaaagttcaaacgaaaattcactaatcttgatgtaatgtgattgagaaggtccgaattgagttttataccacagtacagagacaaatgcaaaccattggatcctcagggctccatcggtcctgaacctgaactgtggtcaatgctgtaaatttgttcattaattaagtttatgttttccaatgtcaggattaactttcatgtttcagctctcgagctccttgggttccttctaatggcacatgtccccaatagcctcatcggttattcggttaatataatcaagagctgattatatggcacacagctttattagtgattgaaaaataatttaaaaattttatatatatgtgtttttaacgacttaaaaataaatgttaaaagagatattatattaaaaataccataaaatcaattttaaattttaagttttaactgtagctgaatttatttatttggtaaacgatgaggcttcttttgggtggcagccagagcaccgaatcaatctgggatccatggccgttattagcaattaatttgcatccacgggatctggacaacacgtagaccttctagaagataaacatgtgctacgacagctacgtactgtcattgcaaggacgaagacgctttgtgtgtcccctaccgccctgtcagagaattgctatacagaacttgcaatgcgcgaaggctgtaatgcacaatctaaagtagtgaaagaactctaaagataatttcaaacgaagctgcttgattcataaatttgactataaagataattaccaagtgactcaatgaagtgtgcaattaacagtactgttgacgctctttcagcatagcagtataatagtattatctccgtcccaaaataattgtaactctaaattatttagcgtatattaaggtttgagaaagaaaaaagtattgtactctaaatgatgtataggatatagcgaaagaataattatgtagaatactaggaagaaaattaaatgagaagtgattgataggacaattagtactttattgtgacatttattttaggataaatttaaataatagtagaaatacagttaccatgaataagagtgtacaattgagactaattcagttaatcatttttttataaagaaagctttattaatcttagacaattatatcaaagtgatacaattactctaaaatcaattatgacttctgcatagctagaatgcacgctgcctacaataaaaaaataaataaattgcttcaaaattaaaaaggatgacatgacagcaaatattatatcgcagcaaactgcacccaaaagtactttaagctcacgtcgagataatttaggtgcctagtttattctcagtaaaaagttgtcttttttcttttcaaatttggtcctatttggctggggaatagtgtattaccacctccgtaaaaaaaatacaattctaacaatacacctagtattaagggaaaattaatgatgtcataattaaagaacagtgcgaatgcaactgatgtccttgtattatgtcatcaaggcaacatgtcatggtcaaacccaactcttctcccaaactgatcaagaaaattttcgttatctgctcgagctacgtgccccggacaactccgagaccgaagctgcaggaaagccaagtcaaaggcgacatctccaagccccatctaacctcgctcgtggtcaatatgctactttctgctatccccaggaaaaaaaaattgcaaagcaaagcacccttaaagcttggggcatacgagtacactgcaccgggacgctgtttggtgcgcctaattaaacaattcttacatggctgcttagcccacaagacagtcggcggtcagctgacggtcagtgattagcgattaattatatagaacgggtttgtgctttgttagtgcgatgtttcatggatgcatagaaaatagaaatgattgtttaaatcaaggcagtttcttcactcacagtctcacacctgcatgcaaggacctgcagcaaccatggtaccaaactaccaggaaggtgcttaggcttcttccaccacaagataacgaaacacatgcaacgaaattattgagactaacctgatcaggtttcactgtttgtttcaggacactggcaccaacgctttattagcaacatactttatcattactggatcgccaattagcgtttagcgatgacagcatgatctgaagcaggtagatcagaaacattaatttatgttttggataacgtgataattaaacagatccgaaagtacaaacaacgagtgcacttgtacgctgtcacagcatcagaacttcacaggaagtcaagaagaacagagcgctatatgaccagatttttctgacttctgacggcgaccgtagttgcatgcatgatcgaccagtccttgctggattatggacattgagcatgtcatttcgtacgtgctgtagtatacagtatactcgtgtggtctacagagtatatcagttcgattgagatcgatggatatatcagagagatcaagacttaaaaccgcagctagcaaagtctggtttcccggccagctagctgatcaaactaaatgacgacatcaactaaaattaagtgacgtttttctgatggctgatgcatggcgttatatataaaatatactcagtgggcacatgacagactaataattatataaattaaagaggaattttcaaaggcgtgcagtttttctcgtgttaaaattgctgacagtgaagtgttgacggtttgtatcggaccacgtattttacaacaaacttctacggtaacagctagagctagctgtccatgtagatatccaactagccaataagcgccgtgtgtcaattatctgaattataccctatttgtcgtggcatacatggagtgatctgaccaaaaaaaatgccgaaagctagggtgtgtttagttcacaccaaaattagaagtttgattgaaattagaacgatgtgatgaaaaagttgaaagtttgtgtgtgtagaaaagttttgatgtgatggaaaattagaagttcgaagaaaaagtttgaaactaaactcagccctagtagtattaattagctagctttgtctactactccttctgtctcaaaacaaaaaaatgtagagttatatgatacatattttaaaattacatacacatttatagttctagcatatgtcatattcagttaaaggtttttatattttaaagagtaaattacactttggttcatgttttattacctaagttgcacattaggctaggcattagcaaaacttttcactttagacaagattttatcaccaaattttgcaagttggaccagtggcccacgcgtcaaccactgatgtcttcttcctcaatcctcaatcccctacgtgcttccctgctccctcccgattcaatcgaatccactgtgagctcctatggttaatcccttcgagcacgcggacctccactggtgagctctttctagccttacaaactcaccactcatcactgcgccaaagcagacctgcttgagcatataccctgtgccctacatgcagtgaggagtgagaagcccccacatatcccatgattatagctcaagctagccattgccggtaggtaggctccctgacctgagttagcgctagagctcaagatcaaactctaacagagctgaccccgtacgtatttcatctaaatcttcctgtttgcgctacgccatcccaagctcatgtggcagtatgtctaggacaatttgaggtagcttgtcgtgatgggcaatgaggaacgtaggtggtggaggcatgcaaacctgttgggagtaaggaattgcaggttgagatgcaattgcaaagatctggagctcaagctttagctttaatggtggtgtggtggtagctcgttgccgatggtagccaagaaaggatcaacctagtccattgtgaaacatattgtaagaatacctggtctcaagtgaaagcatgaggtagaccctggttcatagtgcaagttgggtaaaataaccttgcccaaagtgtaattcactctattttaaaacgaatggagtatatatgttgtttaaggataagacagtaatatcgttatttctccattttatatttgacagccttctttgtttattttacaacctttgtagattattttaaagatatattccctctatcctaaaaattattcaatccgatgtgtgtgtgtgtctatacacacatacatgctatctagatacatcttcacgattgatttttttcttttttgcaagaggagtagtccctccatccaaaataataacatcgcttttttacccatttcacacataccaatataaattaaaaaatatctttcactttatcaaatcctaatataatttcactttattaaatcctaatataattgttcctcactttatctagttcgaatgtatttttctcacttttataaactctaatgtaatgattacttaaaagatacaaattattttcaggacaaataagatggtgaaagataggttagtttttatgagggagtaagtctagacttggggaagcaactttaaatggtctacgtggttacgagtgtatatacgattccaatttaaaatagaacgtttccatgctgatgtttatgtatttaattaaattcagtgcgtgagaattttgtgagcttctcgcggatttacactgccagagagtgtggtgtcacgatgaaacgacacgcatgggtgtattagtacatatatgagtggtgcttgatgctacgtcgtgtaacgtacgtgtagtaggttgctaattgagcatgtccatgctgtcatttcgttattagtagttgtaacaagctttcttcagccataatgcacctagcacacctttgtttacagatgaagcaatcgtaactgctactgtactagtactatacgtacgattaatgcatactgtacgtgatgatgaatgacacgattgtttatgtccgattgtccatgatcacacataaaaagatcaacttgctatatataaacaccaaaagaagattgccccatgaattaaaaaaaccttaaaaacaaaagaaaagcctgaagcccctccaaaatatagtactaacatcctcatgttgatccgaaaagattcccacctgtcagtgttgttggtcttgtggctcaggtccaatgtaccaagaccttctagaaggaatctatgggggctcgctccacttgcatctgcatgcatgtgacgcagctcgcatggagtatataggagtaaactaacgagtctcaagaaaactaatcatcgccatataccgagattttgagaaaactaatgaacaaccaggtttatttggttatgggatataatcgcttcttaatttgctcaaagcctgcaatctaaccaaactgcgagaaggtctttgccacacctgggacccgtttggttgacaatcataagttgctatcaaactgtcaaactcaaattaagattatgtgctcaaaatctaattagcacaccttagcaagattaagataatcttgtcatcttttcggagtcattagtaatagtatgtactgtctaattcgctagaaggaataaaaatcatgatatttaaacttgattaatcttaggtgtgacaaaatcatgagaaattgcgtccggcaatcaaacagacccttgaccacatcagcctcttgaataaaagtatttcttcttatttattggatttattagactttatcttcttatttgttgaaattgtttagttgcttgtaataaatgatgggagaatggcaaatataccactacttaattttacctcctaacttggaatagccattaaaaaaactgcaaatttaccactagaatagcttccatttaccattgttgtttgatgtgtgcaattaagaggctaaaaataattcataaaacaaatgtgaaaaatcaagggaataataagaccgattccctatctgcctctcttcaaaccctggcagcactcatttgttccctttgcccatcccctcctctcttccttgaggaaacctagatcccaaatccccttattacctgttcttttaaatcgagagcaaattatcggatagatcggtcataataaggtacaagatggcgatggaagagttacaggatatgtattttagccggtagcaaatcgagcaggcggcggtggcggcttgggtgacggactgcggaggcacgcgcaacagcggtcgggtttgcagcggcttgggcagtagcagcagcaggcgactgcagcttgggcctaggtaggcgctgaggcggtcaattatggaggtagctacaaataaaaacgacgatggcggaggcgggtgttgcggcggtcgattatgcagtctattgcggctgagaagccgcaggcgcagcagctaactatggtgatagcagatgagcagcatggactacatcaacaacaacaacaacaacaacaacaacaacaacaacaacaacaacaacaacaacaacaacaacatgaggatggctgttaatcttgcaaagttgtggcagctgttactgtggcttttataattttcataaaaccaagatttctaatgatgtttgttcaatctgtcaatccgatggcagatagtctaggttcatactgtattttaatggcaatgcaatcacatttttcttaatggcagattcacaataacaattcaaaccaataacaaatatgcaattggcccataaaaaacgaacctagtaccgaatgtaacacatcatagtacttgtccatagtactaggatgtgtcacatccagtactattggttttttatgggatagaggaagtaagggggtgtttgggaaggagagactaaacttcagtgattgagcaaataccacccaagtaattgagcaaataacagaactcgtttcattgtaaaaaaaaaatgcggcggtatgtggtggtaaccactggcactgttccccgggcctcgctcgtggtagacgacggatgccgctcagctgggtgcacgacgtactccacggtgtaattcatgtgccgtttcagatgcgtgagtgcgtgacgccgtgaccccgctcatcctggacgcgtcctgtctgtccttcgtgcgtaataaagtgcgtgtgtccacatgccgacgtggaggaagggccccgcagccccgctgcgacgcaccacgccgtctgctgatgtgtcgctcgcgctgcctcgggccagcgtgcggccggcgtgcgggagcggcgtgtctggctcgggaccaccacgtggggccgtgggggaacttggtggccaaggcaattctgtgtccgtggccttcggtgaacccggcccatgcgccgtatagtataatccacacatgacacagcgcaccgcgccaatcacagtccaggaaccgcgagaatttttttatttttaacttggcgagatttctcgctgacacggtcaatcggccactgcacacgggagtgtacaggaccaagcgggtcaattacggctaatcctaaatacagcgacgacgggcggttcgtgggtactacgtactagtagcatatatccatcttagagtaccatctaaatctatgcttctaatttatagtactctggatattttctcacggtaatcatagaaataaaacgcataaggtaaccaaatataacttaaaacagatgaagtttaaaagtcgcaccaaaaagtccaaactttaggagacatcaccttctgcatccctcgacccttctcttcctcactcaagtctacttttccttttgtgttctgtctgtacatatctaatgctcttgagctgtgttatttcttatggcttcccaacctatctctatcattttttcatatgcacgcttttcaaactgctaaacggcacatgttttgaaaaagtttatataagaaagttgctttaaaaatcatatcaatccatttttcaaatttttatagctaatacttaattaagcacgtgttaatttatcgctctgttttccgtgtggtggggaggggttccaaaagaatacagccaagtgtgtaaagcgatatactcaagtactcaaccctagtacaaaggtatgcgctttacaaattatagaaaagaattaaaacagttgaaatttagaaactccccaaatttaaaatgttcacgttaataaaaaaaacaaattatcaaccctagtataaagatatatacacgctatttgcgtattccagaaataaaattaaaacaactgaaatttagaaactccccaaataaaaaaatgttcatattaataaagaaaatcaaattaccaccatgagttaagaatactactatacttgatgtagatgtagctcgtgcatgcaggcactatatgagctgtctgccacagttaggggatggccatggatggaccgatgccttgttttctatcgacgtcacgatttatatctctgcgactatgatcacatacggatgctaatgtatgtacagtacgtaaggatggtcacatgtacaggttataatatggagcaatccatgtcgagtcatcggtattctatatgccaattggtaaattaagtagtacggagtagtagttagtcagtcactcagtcttattgcttagttgcttaagacattttgtgtggagttagctgattaattaaatatctcttgccaagggaacagcgaattgatcatcgaccaaatacttggttatttgctagctactcaaatacactcaatacttgatcacaacgtacgtctacacttgtactcttcgtctacgctcgtctcccgagtttatagtgcagacaactaagtttcaaaaaaaaaaaaaaaccaagttcgtctagaattggcctttcgatgtgtaaaataaatatgcgcatgacctatatacttcaacctgaacgtgtcagaaagaacatagattgaacacgcaagctagtgggtgttaatggcgtgcatatttcatcaaattcagtgaggctatccattttacatttccccgctaaaaaagataagggtatgaatagagttacaaagtctagcattttagcgacccacttactctctcctagaataattagatattttattactaaaaccaaggagaaataaaacttcgaccgtaagctacttggttgcatacatgtacgtgggttgctctcgctattattaacgacacgacgaaattaaatgctgcatgcatgtcctccattcaattaaacaccgcatgtatattttcccattcgtaagatgctcttttttttctccttatacactcatcatccttgtatagacttaaaaaggttaacaattcttaccctaccaatcatctgttagactatttggctctgtaggttgggatcttctactcactcgtttttcacagacacatttctcgaacggttaaatgatatgtgttttgcaaatattttctataggaaagttgttctaaaaattatattagtccattttcaaggttttttttcttcaaatacttgattaattatgggctaccttatttttcgtgcagaagaaataggttgaacacactttcgaacacaaccttaattttgaatagtacctgctacctatatgaattgaaaccaattcttgccaattcgatagagttgaaacaatacaacactaccaaaattttgatagtaccaaaacttatttaaaatttagtgcggcaagtttttgatacaacttcaaaccaaaaacaaccctttctatcaaactgatgccaaatttgatatgtttgcagctgcacgctgctatcacacccatctggctagagtcaccaagctgctcaatcagtcaaaccgtcaaagtatcgaccaccacaacaaacgtccccggtgatgatgtggatcaccacaacaacaaaatacttctggcccaagtcggccagtaatcaacaatccggtctacggacacggtccaccccccgcacccagctctcggcccaggaggccgctcgcgctcgttccacgaaccttccccacggcgcaacccctctccgtgaacccgcccgcatcccacctccgcggccgtggaccaggcgcagggaaggtgtcgacacttcggctgcgcgagcgcatagcctcggttttaatagtcggcgaacggctcgggccaggccaacctgcgcctctcgaaaacactggtccgcctccgttcccctctcctctcggctctcttatctcacccttcgtttcgctcgtctccctcccgccgcagcaggtacgcgacgcgagctctcgtcggctgcgatgttgtgcgtgctgtttacgggtgacgggtcggactagccggcgcgtgggctcgacgaggcgctgctccttcgtcgccgcgggtttctgatttttgttttaattttcgtggtgttttttttggcgcatttgctaggtggggggattcgagtgttgggaggtttgcatgctctgtggtggcggtagagttggtggtggtggtggatacagatggtcatggatgctggggtgcacgacgtgtgcacgatgctgcccggatccaagcgcgacgcgcacctgccgctgccaatctacccccaaatcgccgccgccaatgggttcgcgacggcggaggagttcgacccgctgctgttcctttcgcccgatgcggtttgcggcggcggcggcggcgactacctgaatattgtctccgcgcagcccatctcggcggcctccaccaacggcgcgtcgccgccgagagatgtctcggtctctgcttcggcggcgtcgtcggcggcggcgcagcatgacgactccgaggctttctcggatatcgtcctggggtacatcaaccgcatgctcatggccgaggacatcgacgagaagttcgagcactacccggtgaacgccgatgatctgctcgccgccgagaagccgttcctcgagatcctcgccgaccagtcgccgtactcgggcggcagctcggtcgagagtcccgacggcagcagcgccgccaactcctgtaacagcctcagtccctgcaactgtagctcgtcctccgacgggcttggcgccgtgccgcagacgccggtcctcgagttccccacggccgccttctcgcagacgccccagctgtacggggatctgatccccacggggggcatggtggaatcgggcggcgcctggccgtacgacccgacggaattctatcagctccagaccaagccggttcgtgagaacctcccgtcgcaatcttcgtcgttcgcgtcttcgaacggcagcagtgttactttctcagaaggattcgagtcgttgctgagcccggctggtgtcttgcctgatgttagcctgaatgattttgttgtgcagaaccaacaggctttgcagttccgccgcgggtttcaagaggcaagcaagtttcttcctgatgagagcaagcttgtgattgatgtggataagctctacagtggagatgaggggagtaggttccttggtgaggttagacaagagaagaagcttgtgaaggtgaagacagaaacctctgatgttgaatcagcaggtcaccgaggaaagaagcatttctatggtgatgacctggatgcggaggaagggaggtgcagcaagcattccgcgcaagggattgacactgaccaccttgtgagggatttgatggacaaggtcttgctatgcaatggtgagacatgctcaaaaggtgttaaggagttgcgtgaggctctgcagcatgatgtggcgaaacattcaggcggaggccatggcaaagggtccagccatggcaagggtcgtggaaagaaacaacccaagaaggaggtggttgacctggagacccttctcatccattgtgctcagtctgtggccactgatgacaggcgcagtgcaactgagctcctgaagcagatcaggcagcatgctcatgccaatggtgatggtgatcagcgtttggcacactgcttcgccaacggcctcgaggcgaggctggcaggtactggtagtcaaatttacaagaactacacgataactcggcttccatgcactgatgtgctgaaagcgtaccagctttatttggcagcttgcccatttaagaagatctctcattactttgccaatcaaacaattttgaatgctgtggagaaggccaagaaagttcacattgtcgattatggcatatactatggatttcagtggccgtgtcttattcagcggctatctaacaggcctggaggcccaccaaagcttaggatcactggaattgacacacctcagcctggtttccgcccagcagaacgcacagaggagacggggagatatctaagtgattatgctcagaccttcaatgttccttttgaattccaagctattgcgtctcgatttgaggctgtccggatggaggatctccacattgaggaggatgaggttctgattgtcaactgcatgttcaaattcaagaatttgatggatgagagtgtggtggctgagagtccaaggaacatggcattgaagacaattaggaagatgaacccacatgtgttcattcatggggtggtgaatggatcttacaatgcaccattttttgtgacacgcttccgggaggccttgttccactattctgctatcttcgacatgttggagactaacattcccaaggataatgagcagaggttgctcattgagtctgctctatttagccgggaggcaatcaatgtgatctcttgtgagggactggagaggatggagaggccagagacatacaagcaatggcaggtacggaaccagagggttgggttcaagcagttgccattgaaccaggatatgatgaagcgtgcgcgggagaaggtcaggtgctaccacaaggacttcatcatcgatgaggacaacaggtggttactacaaggatggaaagggcgcattttgttcgcactgtcgacatggaagccagataatcgatcatcttcatagcttgttcagctctaattattgcatgatattgtaaatgtagacctgttcatatttttttggggggcatttggaccgattgttcctggtaggcaatatattgctaggtatgttatttgaacaaccaagtaatgggaaacttctgcttaggaattgtcttatatgatgatctggttcatctctgtccgtacataagatgaacccgcctgttcctagaatctctgcacatttgttgtgatcattattgttgcttccgacgggaacagttggttcaattttggtggagctgctagatatgttgaagttgtagaccttgggttgtcttatgtatggatgagccttgtacagtatttcttccaaacattcagtacttgtcactaagttctggttctggataatctatcatgcacgtgcattctctattcgtacttgttgaattgttcgacctgtttgttgaattggctggcatctgttctgttacattacatctggggttgggaaaggcaagtatgccaccatggcaacttgatactgcattagcgccgtgtcgcatataggcaatgtgtttatccatagaaggatagtcggcaacgtgtgaactgttgcgtttgccatatcacacgaatgatctggcgcctactagctactgctggaatggaagaaatagcccgccacgcgcatcactctctcctgaaaatcacggcgcatcttctaaaatgccaaaattagagcagccatttttttgccgtatgcgtcgtgctgatctgtctcgtcacgaatagcaggaaaaataagatcagtccaactttgcaatgaatctagacgcgcctgcattgcaaggaagaactaccgctcaaaagtgcaacagcgatggatgctgcctgcagggagagtccagccgtggtagtaacacacacacacaaaaacctgtggctacagtaaacgcaacaaagacacatccacacaacacgtccacgtataagaagcaaacatagcacagcaactcagcaagaagcatcggtcacggcagaaagttaccgcccagctcggcgataaacaattacagacaagccaggtcgtcgtcactcgtcacacacattggcggcttggcgcgaacaaatcggcaaatctgtcgtgcgcggccaagacgctaaaccaagatgataaaagccgcggacacccagccgctacggacgaggagtacacgtggccgtgctcccctccaaaaaaagaaaaatataccgttcacactaggtcaccactcaccacaagtgcaggttcagctcaatacaggttcactgaacacgactagcagcagtacatgttggcaggaagaaatgaacaatgcgatcaagcagaaagatatactactccctccgtcccataatataagtgattttaagtttttgtttataacgtttgaccactcgttttatttaatttttttttcaaaaataaaaaacgaaaagttgtgcttaaaacactgtagataataaagtaagtcacaaataaaataaataataatttaaattttttttgaataagacgagtggtcaaatgttgcaagaaaaaactcaaaatcacttatattatgggacggagggagtagtactttggtgtctgccctgggtattatactgctcaactggattcggttcgcatcagatgggtatatacaaaactcgcaactgcatcagtttttataattttttttatgtacggcgtgacagcggtggtactgtttgtgtgaaggccaagttgagaattttgtttgcagcataatgttccctcgagtcgtctccgtgcagtgtacacgtgaagaaagtagggaggcagcaggatgtacaagaatgccgtcatgcaagttgtggtgtcaactcgcgcctaagacggaaaagaaaattggttttgtctgcccataggcgtttgacggagcaaacaggggagaaccgattgatccatttggattagtgtcaatcaagtgtcaacgtctctgggaagcctagatgaccctgctttggtcaatgttgatagcgacggatgtggagagattacagtgttgagttgttgacgaggcgaaattacatttggaattcgcaaagagtacgactggctaaaggaagaagatgtgaaactcgtagctgggccaagtccgggtgagccacaggcccatagtcttagatgctgtggcccgcttaggactatgaagcccaaatgaaggcccacttaggaccatctgattagtcacaaacgaagattagtcaccgttgcgctgcattcacttcagatgaaaatttcctccttcaagaagtagatggcaatgcgacatgtgcgcttaaatgtccagttcttctttcgcaagctgggtcggctcaatttggcgttagctgttatgtagctatctccgtgtgtatcggaaaattgtacagcccaatcttctttgtcagcaaagacatacgagcacctttcagttatgctgtccatctacctagaatcctccttgcctccttcgctatgtatatttctcaatagcgactagaatccgcataattgtcacgtctacctagaaatcgctagattcagaccgaaggtacatttgacatgggcatcgattgtgacatgtttatgagactagtttttgttgatttttctgctgtttcaggtcatattgggtgatcactgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataagattataccccaagaatggtcctccgctggagtttgaggcagtattgcctccgtaggtctcttggtccatgtacatgtgtgaacctgtaatgcagagttaccatttatcttggaaatcatccatatcttcaatcaattctctcctagtagtttcaaggcggttcaaaaaaaaaaaacaagtgaaatccacatatttatctagtttggaacaaagtgcacaaccatgaaattgagaggttccatccacctgtactattttatttattccctcacctcagattagactcatgctgtaactaaggtatttgacatctacaaatggagcctttcaaagttaatttctactacctgtaaagactgttgtcaggaaaaaaattcaggtttaaaaaaataggaaaaagattcagagaaatacagattaaatgtaaccatgttctgatgttctgtttcctgcgtctaaagaaacaacaattcccagagcaatgaactatgttcaaaaccaattcgcgcccgcatttggttgatattgtgttcagctgtgtatcaatgttatcgcctcatctcacctagtagtaaaaaggcaattaatccagagagggaaaaggtttagttacgatgtgcgtctcgcagtcgcaggcgtataagagatagctgagcggcgaagcacggcggccgtcatcgtcatacggcgtcttctctggagacttgattcgtgaactcgaagaactacaggagcaattttctggatttttccctccgtaatcatgtgtaacatccaaatctggatagggtgaattggtgaaatccattagatgaaaaattggtggccaagcagacattttttttggataccgttagatctaaactgcacggtccacgtcgctcactaggactggatggtgtattttcttcaaaaaccccctttagtttccgagtattatatcgctcttacatcgatcgtctctgcacctcgtccccttcctcgccagcgccgagcacaaccaacctctgacagtgtggtcattgcgcaaagtgtaagctattcacttcgcgtgaaggataaagcttacctcctccttcaaggcgaaaatgacgtgttatgttggatgccagattctccagttttgcaagcagcgccatcgcaattttggactagctaatgtgcagctttcccagcctctgttccaaaactgtgtggtagctggagtctctgctttgtcagcaaggccagatgaacacacctaacccgtctctctgcgttgtgctgctgaactgcggctatctgtacagaatcagatataatagcccatctaccttaacagtcactagttttagaactataaagcttgttatatggatttccaggttattagtactatttgatagtaccttttcttctagttggagtacttgattagtttttgtgccatgatccgtgcaccggacttgttttggttggtcttgttgctgtctcaggatctgtgagctgatccatgtacctgtctgtaatagtatttttaattgccccttttattcttatgtaaatacagcatcacctttctttaggagttaaaaccatcgtttactctttaacttatcagctgtagccaaactttaaattttacaactcaatttttgagttgatttttccatcatagtttatttgttttattgacttctctgagaatacatatataaaaactttacgaccaaatcattttttattggtaataagtgttacgcttataaataattaactgtaggtgaaatgatggaagtaatatattttctcttgattttagatagtttgaattcaagttgtgggaaacaaatccacagatttgtttaattgggaaagaaaatggatactcatgaaagaaaaatataggcaaaaaggacaacgtacaaggagtgttctggaacagtttcatgcaattaatgcccatttttttattcaaagaagcatcaaaacagtgtcattgtatagttgtacacaaataaaagaaaaaagaacaaaataatgtcacaaaagttagctaagaacgggctaacacactaaaatctccttcaggagaaagcaatcgcaaattggcgaacaaatgaaatgaggaaagaagaatcaacggcatctgtggtaaggtcccgactagcatttgggcagatcggacggcggaggaagcagcttctggttcggatggctcccatccaacactagccatgccatcctcaggccccacgtcgtgtgcgcctccaaatgacagtgcatgaaccatacacctgcacgcacataattgcacaacaaaaattattagcagggtagtactatatctaagacgaatttcacgtacactaattgcagagataactaactaactaactcacctgggttgtcagcgaggaaacggatggccacccatccgccggccggcacgccgacggtgttgcgctcgacggggtcgacgaggttgaacttggccgggtcgttcacggcgtcgtagttgccgaacccttggccgatcacgaagaagttgaagccgtgcaggtgcagcgggtggctctcgatgcccaggatgctggtgtcctgcatcaccagctccaccgacgtgttgtaccgcagcaccagcagcttggtcccggtcttcacgttggtgttgttcggcggcgtccccgtgtagttgaacggcgacagcggcgcgacggggaagtccggcgcgtacacgccgctggagagtccggtgaagtgggactgcagcagcgccctcgccgggagcacgaaggagacgttgttcatggacgccgccatctgcgtgttgttggggccctggcaggtcatgttcgccgggcacggcagcgtgcccagcccgaccgtgaagaagaatcgcttgtcaaccgactgcggcacggccgccgggtactccggcgtcgcgaggctacggagcttgtcggtgaagttggtgacgaagtcggtgtcgttgagctgcggcagcgtcggcttgaacagcggcaagcccttgacgaagctcgccgcggagggcgacatggcggggttctcgtactcgaggatgccggcgacggtcgtgttgccgaaggtcccaggcctggcggtggagtagggcgcggcggacatgtagaagttggcgccggggtagtacggcttggcggtgaggagcacgttggtggtctgccccggcgagatcaccagggtgtcgacggtgaacggcttgacgtagacggcgtcgacctcgacgacggtgagcgtgtggttggcgacggcgaagaagagctcctcgttgagcgcggcgttgatgaggcgcagcatgtacgttttcccgggtttcaccttcagcttgaacgtgtctgcatccacgcgcacgcacgcatgccaacggtaaccagagtcagcacgtttcaatattcactaatcaccagctaaattcttcgacggcgacgtgcatgaatggaaagcgcacctagctcccctagctatgtcgcaactaagattttgtttacgtgacaccagccggacccaataacagagtttgcttttccaatggaccaaaaatgttaggtcgagtaccacgctcagatcccacgacagtgacacaccgcattaattcggagcaacaaatgcacaatcccatgcatctccgttacgagaaaggaacacggaatcttctccgtccacctttggtgatttgatctgttaccaacctccggagccgaattctctcacgcgccaaaaaagatgcaggaggaagcacagtactcgtgcacggtaacgtttgtctctgttttttttcttggaaacaaaaaaaaaaggttattaatttgtggttaaccgggcgaaatgcacgtaccttgggcagagcagttgtagagagggccggggaggccgttgatggtgaaggcgtcggagacgttcgggcctccgccggtctggaccgcctggttgaccacctcctccgtgtccgcgttccaccactcgcctacgcgacaaacgcaacaatcaaattaaaaggtagcgagcccctgatcatgcaatgatcagtaagtatgcatatatgtcgcgacgttgcgtgcaaaccgacgcgatgcgcgacgtcgtacgacgacgtaatgcgtgcagcgtgcgtacgtacgtaccgaagatgacggggacctccttgtgcggggcggggaaggggtaggggacgccgagcttggggaggatgacgagggcgccgtagacggtggcgcggagccaggagatgtgggcgtgccaccacagggtgccgcgctgcccggccaccgtgaagttgtacacgtagctctgccccgtctggatcgggcactgcgtgatgtacgccggcccgtccgcccacccggtccgcacctgccggacgccgtgcctgcacgtacgcacgaatgcaccatcgatcggatcaaaaaactaaagcgtgaggaatcgtatcgatcggtacggtggcttaccagtgcaacgagatgttgtgcgcgacgttgttggtgacgcggatgacgacgcggtcgccttccctcgccaccagctccggcccggggcactgcccgttcaccgtcaccatgctcttggtgttgcacagcctcgtcgcgttcgccatttgcacctgcatgcagatcgatcgatcgatcaatcaatcaatcaatcaattaagtttttcatcaaggcgagatcactttgcattggctatgcgtgtgcaggcatacattgaattcgtagtgcctagtgatgccctgagcttggacgatgagaagcagtagggaagccgccaagagtagagggctaggaagagcagaggagatagccatggtcatcttaatttgtgtagcctaagctttgagccacaatctgtaatggctcttgatcagctagctctgtgagactttgagtgggagatggcctggcaaggatggaatgaatgttgggaaaaagcactcgagtcgtctacatatatataggacatgccaagtgtgtcgcaaccaccaccgccatttctttgagggttttttttttctacacgcgcggccgtaggcgaggagatacgcagcttaggcgacacctcttgtttggtgattcggtagatgaacgatcaagggaggagcttgagcttgagctagctagctagtgctctgtttttggagtgtagccaaagccagcggcaaccatgcatctgtttttcagtcttttgaccatgcatgcgtgttttgttgtatgtaccatccatgcaatggatcgatcgcctgaactgtgttgattaatttgcatgcatagtggcacgtactgtttctgatatgatgcaaaagcttgctgaaactgaaagttaaaactatgcaaactaataaaataaagaagttggtttactgcgaattggttacaatgcaagaatcgaccttttgagattcaaaacatagcactgatatcgggatgtagattttaaaggatgtactcttgttttagcgccatatcgtctagaaaatcatcaaaaacatttagagagaatgacaaaatatataaatatgtggtatattatgtattccactaacatatgtaagtttaaatatgacttgcataaatataatacaaacacatcgttaattttttttacatgtacaagttaaatttaaatttggatgtttctgaagtgatatatcttcattgatctatactgttaatttgtactacctccatcccaaaatagctaaaaatacgtatattttgagatagatggagtatattgttaaaaggactttttaatgactttttcgatgacatgtaaaaaacgaggggacgttctcgagtgccaaatagactttccacttgtccaagtaatgaaccagtgaattaagtcttgcactaaacatgttggaaatgaaatatctttgggggcatacattgtcagttgtcaaaactgttgaatcaatgtgatggttactttattcagaaactaaaacgaacggttccacatgaatgtactctttgtactttctagctgatttggttccacataaatccattcgatcaagtgccaataagtcaaacatgatctaatatgcaaataacttcgagcatgtattaggtgtactccatacatataaaatcatgacaacttaaaccaaaattcatataggagctgacatgtcagaagttattggccctatattttgataaggtacttcgttctctattcttctagataccatactatcttatgggtacattcaaggttaggttgtgcagcttaatcgaattaaacatcacacgacacacgtaccatacacgcagtgcagggagtacttcccctgttacatcgagattagctccttttgaaaagcacttcgatcgacggacaattattttgtcaatcaccatcagcaacctacatatatagtggtagtagtatagcaagctaggcatgcagtttaatttcgtcaatgtccattctgatataccttcaaagttcaccataatcatatcgctaagcggtaacatcacttcctgatatgctcgtcccttgttttcacctacagtacaatgaacctaggctttttattttttatgtatatataatatatgctcaacaatggctaagttgcatgatcacttgacatggatcccaagatatatatctatccagtaggtgcaacctgcatggttggtgtagtctagggtggcttctttccttgtactattcccaacggggagaaggatgcttgacccaaccagaccgagcgctgcaacatttttcttcgtattatattgactcgaacagaagcatgatcaacagtaagatggcatcgccaaatgcatctcgcagttcgtaccttttcagacacttcttccctgttgtttgtttatttggaatgctcaaagcatataccttaaaggcttttataaaattgcaaacttagtatatacttcatccgtcccacaatataagagattttgagtatatgtaacatatcctgaagtactacgaatctggacaacctaaagtcttttacattttagatggaggaagtaatatagtatataggaagtggattttgatccctcgagaggatatcctctcgttgtttgcaatgccattcaaatggttatgaaaaatttgaaaaaatttgagatgatgtattaacatgtgatatatcactccacaaacatgcaagtaaaaattcaacttctatatcttgcaacgaaattaacaaatttaactctaaatatacgttaactagctacggtttaatttgatttttttcgttacttataaaattaaatactactagtaaaacaaattgaacaaaaaccagtcattggttggtaggttccttatggtataacccattcaactaatttcaagccctagttacggctctaatgtttatcacatgacaacgctatattgttgtatctatcgtatattattaagataggaagaaaagtaaccaccacacttttactctaggtccagaaattaacgcttagtagaaggaaaagaagaaaaatatgcactatttgataatgatagatctagattataacggctaatcaatatagttggatactactactgtatttgtgaaaatataagcaatatttgcatgtcaaatccagttgtattttgaatataaaatctatagctacataaaaaattgcccgggaaattctactagttaatatatgtagaataaaaataagttatatagttcttaaccaaagaatacgaatatataatagctcatctgaaacgacatgctttattcagaagcaaaatgtgatatattatttgttattttgttagtagcatcgtggaaatccatacccattacttttgaatatgaattgcataaaagtagtgagatatagggaaaaaggcaatcaagattttccattcgagtatcatctttcttcaacatgtgtgtcagagttatggataccatatacctaatagtagttgactaaatctcggcaggacccaccacataccatgtcttctacggaaacaaccttcggatataggaggagttccgcataaggaaggatgaatagagttctacatggaaacgacaaggactactcggattgtatccatatggtttccttagttctactagcttggacaaggggacacctatgggtataaatacaagaccctctaggaggagaggggagacggaatgtagcgcccgttccatcgtggcgcctagcgggaaaactatctcttaaaaaaaaccctaattgcgaaatctgtttctttgcttgttgtctagtgtctgtgccatctcagatctcaaatccccgatctatcgtcaagttcaatcccgaatccaaatccttcccaaatcaaatccctccgcaaaagtctatttcgcctccctcaggttcgatgggccgaattcctctcggcccatctccccctggggcggcgtctctgtctctcgcggtgggtctcgctctgggtcggccccggtctgggggtgcgctccagacgctgggtcggggatccggccgagccgagcgccctccgccctcgctgccgctttccgccgacgccgcccaaatcgccgcgccgcccgttgcttcccgcgcgcgcgcgcgccgtggtggccgaccgcctggtcgccgccgccgtcagcctctgccgtgcctgtccgcgcctgccgtccgtgtcgccgctccgctccacaccgcccccgccgtcatcgctgtcgtcacaacccggccccgccactccgcgcgctagcttccaagggacgaaggcagagcttcccccctctgccgcgtcgccctctctccctcctccttttccccaaagtggcaagggggcaagccccctttcccctcctccttttccccttttctctcccgccggtgtcattccccccgcccccccgtcgccgctttggccgcgaccgccgagcgctagctccctcccttgaccgccctaggtcggttcccaaatcgacgttgccaccctataaagcccaggcgccctctctcccttctcctcttgttttgtcccatcgcctctactccattatcgccgcctcccgtgctccgttcatcgtcgcgcgtgtcggaggagccggcacgagcgaggacgcggaaggggactccgggcgcgccctcttcttcctcttccctggcccgaggccggagagatcactcccgtgccgtcggcctctcgtctcagcgccccgcctcgtcccggtagtgcctccctccgttctccctcctcgttccatctcctccccttagactcgggtagtagcacgagtagcctccccgtagctagctggcgccgccccgaccgttgccgccgctcgctgtatgctcgccgccgtcgccgcccgtgctccgtagcgcctgctcgtcgccggcctcgcttggcatagctccgcccaatccgacgctagcaatgggttcccgtagccgtgtagatgctctcaccgctgggaatcggcccctcgtgacctcgtcgccgtttcccccttttctctccgccggttgccgccgccgcaatccgccgccgacggactccctccggcgaatccaagccgttggctcgctccctctcgttctccctcatcatcccggtgtacgtcccgtcgcccctcgtcgtcgcacgacgtcccggagaaaccgccgccgcccgccgtccattcgcggccggcgccttcgtcttcctccagccggcccgcgtcgcagccacgtaggcgccacgtcggagccacctcggcacgaccggatcggctgacccggccagccgctccctccgttccccccccccgtgcgcatggtccgcggtgagccatgaggctgcgcgtgggcccgccgcaccgcgtcctccgcgaaccgcgcgcatgcgtcgcggctccctccctaaaccctagcacgccccgcgtgcacctcgctcacggtgagccgagtcgccgacaagcgggtcccacccgagaccacgcgggatggacccggcccaccggctctctctctctcccctccccgcccccgcgcgcgctttgggccgccttcttgggccggccggcccattaagctcggtcgagccgcccctttctctcgggccgcgccctagccgcccgaggaaagtctaatttccctccctccttcctttcctttcttttctttttcaaaaaggatttaaataaatccttttcctttagactaaaaatccaataatcttagaaattcaatatcttcccaaccgtaagtccgtttgactccgttcaacttccaaaatttctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgtattgataggattgcacttaatctgcttgtcccgtctgcaaggcagattggcggacgtacctaacttgttgcatctgatccttccattgttaattgttataccatgtcccccttaaccccttagttgcgcctcggtaatcgtgcactctgtacgagtatcgacggtcgccttcaaacttaaaatctgagaaacatcctgggtaaaacttgggttttacaaaagactcggaaaaacccgacacctgggtcggtgcttgcgaactaaatgaatttccaaaattgcggaccggggaatgtaccgggtgtacagtttcccgctcttgcacttaaggaccgtttccttggaatttcatccgaacataagacaagtacgaccacatgggtggaatgggacacccctggctgagtaactagctaatcgggggagccatgatgccaagagacatgtggattcaacggggtggtgtcggggaggacccccgggtttcctggcacaatatggtatgggacctgatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaactgttcgaacagccgtgcccacggtcatgggcggatgtgaggtgattcctagcgtagttttgttttactactgctttgtgaaatttgctgatgtggtttgggattgatgtttggaaaatctgcggctgatgggatcagccaggcccgggtggccgtttgaaagctgttggccgggtgccaatcttgatcaattcaaaagactgatacattgcacatactccgaccggacgagacgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtactcccatactcacccttgctctacataaataatccccccagttgctgaagaagatgaaacggatcccgctgacgaggagttcttccaggagcaagccggctacgatgagttttagggtttcggcctagttcccaagtcgcgcctgtgatgtttggtcgaagtcttggcttccgcttcccttttgtaatgcagttgtgagctcgggatctgtccgcagcccaacatgactgtactcctactctataataaagagacctctgttgctgtgatattctgccttcctgtgataccagcactgtttcttgggactggtatcgactaacaggttaatttggagcgtcacgggctagttccgctcgggactagttcggggcgtgacacagaacaatagatcaagacaaaagatcaacatacaagccaacatatgccaagacaagctgccggatatcgacatcagagatatgcctggatcaaccctatccggtacctatagagaccggctgtagggatttaacgttgtctctgatctcgccgggcacgaactcgaggaggaaggctaccctgttgtcgactacgagtcagaccttcagaccgccatgtcgataacagttagataggttaccccaaatattgtactggtgcgattatggtgaatatataagagcaataccggcttcggccaacaggatgtagggttattatctgacaattcaggggcccgaacctgtataaaaatccttgtatctatcttttttaccttagtctgagatctatcctagtaccaacgatccccatactatgcaaataccggaatcgcgacatcaaacatcgacaatgtgagttatgtatccacatgtcaataagatcaaacagaggtgcagattgatgtcaaagtgtgaagagcagctagattgtcattaatttattattcccaaatttcatgacagtacaatttattctataatcaagcagtaattaacctcaatgattaactctaaacgggttatgttcaaggcttggaaccagtgtactttaattttaacagtatatggatgtgcatgtttagtgggttgagtaaagattctgccacactccaggagatatttgatgactgaaaaattcctagcatacggtggaagccgcacacacgtgtgtttggtggtttgcgttggtgactgcataggagtctcgttgtaatctcttcaaaaaaaaaatgtgagaaagaagtcgcctcctaatttttcaagtctctgtcccaaatcaaatattttttttcttggaaaaaggtgataacgataccgcccgttattttcattgatatgaaatgttttgtaacctaagcattgtgtgggtcaggttactacctaaatattttgattggctgctttttattgggtcctgcataacagttaacgagtgttattattttttcttagaaaatttaacaaggtagactttggggacttggatacactttgtaggccttttattatttaaacctttgatttgatttcactcctgtgttgctggagctgccaaaaacagacttgccacacaaccacaatatattccttatcagtaaagtgaattggcaattttattgcggtattttttttaaaaaaaagtgaaactttgattaaaaaaaacattctcaagcaaccacaatctattcctgtcatagcaagctaatcccctagtcaatactagttacaccaaaatcaccgaggtaaatgagttactccaaaacaatataacaaacattgattaatatgaaatagtacataaaaaaatcctttgccgtacatcaaatgatggtacaaattattgggatgaacgtggatttatgatccagctccctcatatgttacaaaaggtgacaaataataatgagaagcccaaaattaaaggccttgcgtctgatcaagaaacttgcccatgatcattcgtacatcagctaaccagatgacgacacaacttcggaaaggcacaccactacaagaaaagcattccatagcaccaaccgcgagcaatcaacagaagcaagctagcaaaagcagaggagtatccgagtatcctacagggaagctgatgagcaagacgcaatctctgtctctggtcggccggtgtcgatcggttagcatttggggagatcggacggcggagggaggatcttctggttgggtaggctcccgtcctgcaccacccatgccatcttcaggccccagctgacgtgcacctccaagtggcaatgcatgaaccatacccctgcacacgtccaagcaaaagtagcgaattagttgcaaatttcaactcatgtgtgcgcagccaaatctgttttctcgcttattgatcagaaatgcaatgtaagaataaaaaaaatcaataaaatgttgcaataatgcaatgattctcacctggattgtccacgaggaagcgaatggcaacccagccggccgccggcacgccgacggtgttgcgctcgacggggtcgacgaggttgtacttggccgggtcgttcacggggtcgaagttgccgaacccttggccgacgacgaagaagttgaagccgtgcaggtggaacgggtggctctcggcgccaaggacgctggtgccctgcatcaccagctcgaccgacgcgccgtacgggagcacgaccagcctcgtcccgttggacacgttggtgttgttcggcggcgtcccggtgtagttgaacggcgacagcggcatggccgggaagttggaggcgtacaccccgttggacctgccggtgtagtgcgactgcagcagcgccgtggaggggagcacgaaggagacgttgttcacggccgccgcgaaccggctcccgttgggaccctggcacgtcccgttcacggcgcaggggtgcgtgcccaggccgacggtgaagaagaaccgcgtgtccacctgctgcggcacgttcgccgggtactccgccgtggcgaagctgcggagctttgcggtgtagttggagacgaagctggtgtcgttgatctgcggcagggtgggcctgagcaccgggaggttcttgttgaacgccgcggtggagtgggagctggggtcctcgtactcgaggattcccgcgacggtggtgttgtcgaacgtgccggacatcgccgtggagtatggcgccgccagcatgtagaacgtcgcaccggggtacgacggcttggtggtgaggagcacgttggtggtctggcccggggtgatgaggagggtgtccacggtgaatggcttgacgtagaccgcgtcgacgtcgaccacggtgagcgtgtgcccggcgatggagaagaagagctcgtcattgagcgcagcgttgatgagccgcagcatgtacgtcttcccggcctccaccttcagcttgaacgtatctgcatgccacacaatgcgtatgcgtataatcaaaatgtactagctagctagcttatagctgcaagtgtacagcacagtgcaccacctttggcagagcagttgtagagcggcccagggaggccattgatggtgaacgcgtcggagacgttcgggcctccgccggtctgcgtcgcctggcttatcaccgcctccgtgtccgccttccaccactcgcctaccacccaaacaaaacaaacgcaatttaacccctgatcactgatcagtcgccatgtttgttacgcttacgtacagacccacgccacgcgacagtacgtctgtcgtcgatcattacataccgaagacgacggggacctccttgtccggcgccgggaacgggtaggggacgccggccttggggaggatgatgatggggccgtacacggtggcgcggagccaggagatgtgcgcgtgccaccacagcgtgccgcgctgcccggtgatggtgtacttgtacacgtagctgccgcccggctggatcgggcactgcgtgatgtacgccggcccgtccgcccacccgctccgcagctgccggatgccgtgcctgcatcatcgatcgatcgatcgatcgtcacaatgcgcagtgatgagctcgatcggtaaaattttgcaccggaaaactgatcgatcaaacggtgaagcgtgcgtgcgcgcgggtgtgtgcgtaccagtggatgctcatgttgtagggggagtggttgatgacccggatgacgacgaggtcgccttccctcgcgaacacagtcggccccgggaactgcccgttcaccgtcacgatgctcttgctgctgcacagccgtgtcacgttcgtcgttttcacctgcacacgtacacaccatacgcacaaacacatcgcaattaacgtaccattacactattgccacgcatgcatgcaagttggttctctcgatcatgcatgcatcgaacgtaaagaaaacaaagaagaaacagaggacagcgactcacatcgaattggtattccctaatgtcgcccttggccaggttgacggagaagagcagtagcgcggcgacggcgaggatggaggaacggagaaggtaggagatagccatggatgcctcctcgagctctcgacttacgtacactgagagctctcgtcggctaatgggctatgaatgtgtttgagatcgatgctagatgagtgtctaaggtgtctatatataatagtactagaggacaggaggatgagatcgagaaaatgattaattaatctgtacgcttctggtgattctgaacagaagtttttttttttgagtttttttcaactcggccagcttagtaagctttatttggtgcgttgttggttaatgaactgggcacgaggtcgatcttcccaactcgcaaggcacaaacactgagagcggggcccatgcatgcatatagctgtgtatagcttcggagtgtggctaaagtcaactactcttctgtttgcatgtcaccttgaccaccttttatctttttctcatgtcttaattaacacgcagaatgccgaatatacaatataataattagatcatgctgcaatgcgaatatgcacttgttaatttgtgtgttttggttatctttgtcacgttttcttgttgacttgggtgcacgaatcaatttagctcagctctactttgaaaataggggattttatagccagctgaagtgcgatttactcagaaataaagaacttgtgtggatggtaagaactttcacatttaatttctagtacttgtgtacttatgttgaacttctttccataatctaaagaaccgctgtcaaggttgtcattatttttaaggcgtgaagattggtggttcggctgagattaatttttggcggcacccgaaatgatataatacattagcgcatgtatcaagcgttaactattactccctccgtttctaaacatttcatgtcgtcgacttttttaaatatgtttgactgtttattttattaaaaaaatttaagtaattattaatttttttcctatcatttgattcattgttaaatatacttatatgtatacatatagttttacatatttcacaaaagtttttgaataagacgaacggtcaaatatgtgctaaaaaatcaacggtgtcaaacatttagaaacagagggagtataaatttaaaaatagctttatttgatttcttaaaaaaaacttttacatacaaaatttttacacaaaacacttggagaataaggaagtagccattcggaacagttaattgttacaatacatagtaatagtctgctaatatattgttctatgagtgattttccaggtgttgattaggtaccagaagttaaccatatttcttgtacaatataataatgtcttacttccttaatgaccgtaaaatttcttttgtcatgtactttagccttttttttatgatacataaaagttttgcgcatctttatattgagcattgggagaataccaattcaaaatataagagcaatattgatatggtctccgaattatcctttttaatagagggagtatggtctccctattccgtttgcttgtaatgtaaactcaagaattcctttaaccggtcgatcgggagagatcatcgaggttagttcgagttttctgcacctactattagaaatgtgttaaatcaggggtagttgaattttcgctttaaaactaaaggtcagaggcggcaccaagtggatcagttgcaaatcacatacttttttcgtcaaggcccctaccatattatccttacatgccaagggatgagatcacgagagccagtgaagacaacgaccttggcctggacgagagggttgttccaagcccgttcttcgattggcaacacattcgcgtcggccagaaatggccaggcatggagtacattactaatatatgtcaatttaaaaatgggggattcttgatttgtaagctgtttatctggtaggtcgtcgcccgcggatggtttggtaacggagctgtgcttcgaacagttctcttctttttgcccccccaagtctccaaaggaagagaaggatgcctgacccaaccttacctgttgctatccatggacacagcacacaatgacacaacgcatgctttgcaaggcagacttgatacgtaaggcaagtgggggttgctcaagctcaaaccttctgcaggtatgattcgagtttcggccttgatggcagtttctcattttaagttggggaagtacttcctttgtcttgttctagttttgcagactatttcgttgcagttccccaaagaacgaaaatgcaagataactttctggtacatttcaggaaaaaaaaaaagggacaggagaactagattgcaagatgttatcaaaacgttaacaagtactacaggtaaactctcagggagagggcgagaggctcaggctttccaagctatgagcacgggagactactactcatcatacgctagtgatgggttacaggaacagagaacaaatcgtcaagcagatttcagaaaaaccacgaacacctttatacaacttctcatgccctagtgctaggttacagccttacaggaacagagatcaaatcgtcaagtaaatttctgaaaattcatgaactgaaccactagttatcggcagattcaacagattgaacgcctgcgcgaagtggaaatcgcaatctagcaaaatagccataacttggcatatgaacacctttatacagcttctcatgcctcagaaatattaataatctgttcagcaaacatgcgatatacacctacaattctgtccaagttatgatgccacagcctctccaagggatgatgctccatctgcatttgacaattcagcattcctattgctgtcttcatcttgaaaaccttgtttgaatcgatcataattagttggctcgagtgtcttgaatgggcgttcccctagaacctggacaagatcatcctggtggagaacctctttctcaagcagcagctcggcgatttgtgcaacttgatctttatgttgttttataagctcaacagttttttcataggccttagcgacccattccctcacctcagtgtcaatgatggatgccgtctggctgctatatggtttgctcatctcaaaaccatcctccctttgagggaaagaaagaaggccaaccttttcgctgaagccatatactgcaacctgggcataagtcatcttagtaactttctccagatcattctgtgcaccagtcgagatctttccaatcaagacctgaaaaaaaatcacataattaagtcatttgcttaagaataaactctactgataagttagaaaatgttgtgtacctcctcagcagctcggccacctagtgtcatgcaggtcatgtcaaaaagctgctctttagtcatcaaaagattgtcatttggcacatactgagcaaaacctaaagcagctgttccacgaggaacaattgtgaccttcagtagtggctcggcatgctccaaaaaccatccagcaacagcatgaccagattcatggtaagcaacagttcgccgctccaacttgctaatcacctgtggtggacagattgataagtacataaccgctacacatgaatgtccaattgttcatgccccatataatactttacatccaatgcaacagcacttaattatgcaatgatttctgctgtaacaagtaacaaagagaacactgaaatcacttttaaaattgtacaaaccaacctaggctctcaaagcaaatgtgaaggtttcaaagtgcgcctcagtcacatcaagaataaaatatagcaattatttgcaatttaagaaaaaacagttataagcagttctcatatagaattgacaacattgaccaagccgatattgtttaacatatatataataaaatttgctacctcctgaattgataaaacaaaaagtatggcagcccaacaacaaagtatttgcaacaattttgtttatttatgtactcgtagcctagcagcattgtggatactggatagtttggcagccaggttgcaaaattcttatgtaaaatttgataaatcaactagtagaggcaaatgaaaattggcaccgtaaaaaataccttgtttttcttttccaagcctccgataaccctatcaattgcagattcaaaatgttgcattgtaatgagtgtgccctcacttcttgcagcaattaaagctgcctcattacaaacattggcaatgtcagctccagcaaatccaggtgtcaaagcagctaatctttgtgaataaaatgatggttccttgtccagtttcagctttttaaggtagatgcgaaatatttgatcacgaccctttatgtctggtttatcaatacttatctgacgatcaaatcttcctggtcttagcaaagccttatccaggatgtcaggcctattggtaccagcaagaacaacaacaccagatgtagttccaaacccatccatctctacaagtaactggttcaatgtgctttcacgctcatcatgtccaccagaaaaacctccacggcctctagcacggccgattgcatcaatttcatcaatgaatacaatactaggtgaacactgccgagcttcttgaaataagttccgcaccctggatggtccaacaccaacaaacatttccatgaagtctgaaccagaaatagacaagaagggcacaccagactctcctgcagtagctttagcaaggagagtctttcctgtgcctgggggaccaacaagaagagcaccctttggtatttttgctcccagttcttcatatttcttgggatttttcaggaaatgaacaaattccataatttcttgtttggcttcatcacagccagctacatccttaaagaacacctgtagcacacaagaaacaaggttacttcagtagaattatatgaatatgttattgtatgttctttgtcaatggtgaataaagctacagaacaaacatttacaaaaaaggatatgaatttcatgttttgttcaaaatagcaagagatggaaatagcaaataaaaactaaccttatttttggagtttttatccaattttgtcacttgaacttttccaatactgaaaatgctacggcctcctttcccaggaccacccccaacagtaaatccattttgtatccttttcccaagcaaatatattaatccaataattagaacggttgggacatacttcattacttcctcaaaccattttgcttcagtagtgtaagtgattgggacataatagtgtggatctatctccaatgctttctgggcctcttgtaacttctcttcaaaggagtcaacacttccaatattgaagtaatacttgtagctgctaggagactctatcccaggaagatgacttgtagttatatggatatcactatcctgaattcgatcaattgaaggtgaactcctgacgtaaaccttagcaattgacttgtttgaaacaacaatgtggtcaactaaaccaggttccaacaacttattcttgaattcttggaagcttatctgaaaagaattacaattaagtgggtatcacaagttataatggactaggaaatgaatgtatgtgtcgcacagaaaaagaaactggtagggaactgaagtgtggatatatgatatagttatacaggattagatgattaataggatgtagaataccaaccatattgcatttcataccaacatggcactaacaacatacgaagctcatgctaaaatgccctatatcaaactcttaggataggatatgatatgccatcagtaatgaagtactgtagctagggtcacatgctgcaccaaataatcacattaatgctctcgagcaaaagcataccatctccatcagtacaactatgtgatttaaatcttttcagtcaaccataacttcagtcatactccctctgtttacatttgcttgtcaccattaaccggtgctgttacaactttgaccacaacttttttaaaaatatatatatatatcatgttttgatgaatgaaaacagtatgatcatatttagcatgtaatataatttcataatatagtactccctctgtctctaaatttaaggaattctggctataaatatatggatctggacatgcacgtgtccagattcatagctagaatcccttacatctagggatggagggagtatacttttaaatatttacaagtttcttgataaaatatgagaagtcaaacttaggatatgaatagtatagtgaaaattatttaggaatggaggggggcagctaattaattatcatcaattgtgttatgtacaaataaaacataaactaaggactacatgtgaaagcataatttttttttccttaccactttgctaggccagcgaaaccaccaaatatttttttcaagataaaaaaagtaaccttatatataacctcatatcacctctctaattggactgcagcaaaatgaacactgacaaaatttatataccacacagaattggaatgattcttttctgaaatttataaggctgaccaaaggcgaggaccttcagtaaagtaaatggggattttgataacagctatcttctatccacaagtgtgaacaggtaaaatgacaatgaaacacacaagccactactgttgctcatgtttaacagtcggtttttcagtaggaacagacctcctgctctgatgaagatgctgatgcagataacaataataggccaaaaaggaataaaggagcaatcatgtccttgaattgtttaatgctctcctcgaaattccattgatcacctgaactggattgctctgcacaccagaaatgaccacattaagtatgtggtttgcagtataatgctatatacggatgcatcaaactttacaaattgtacgcaaccaacttgctttgggctaaaggctcatgttgtcgtattccacaatactcatgctagtacctctcccttaaaggtgagcgggcagtttatgaggcactaaaactcaaatattagcattttcagctatacatgatacttacatactgttaggggtatttgtgcaataaaataaaacatcaactagccccactctgtttaacatgtattgccacttacaaaagctctgcatatcatcttcttaacattgttttctattatcagtatactaaaactagaaatcacaagttatgatatagcatgattttagggcagcactcggaaggttaagtcgccactggtatgtaaaagtctactctctttcaaaatattttgcaaagctcaacaccttaataaaccatatccaacacaagagcgaggaatgcaggttaaaataagcacttactctttgagtcggacttgtcactctcatcccctttacctttattctcctcctccgaatgcttcccgtggtctgaataaaaaaggcaacgttaaatattaacagagtcaccagatatccccaaaaaccacctaaccagccagaaagcttacttttcttcgacttgtcggagaatagccgccggaactgccggctagcaagcaggaacctccagtccccacccttccctgccccggaggccaccgctgcccgattcccgataactgacgtcacatagctgcgcagaaaacccaactcgccgcagggcagcggcggcgacgaagcacggagcccgccatgccccccgagcagagaaccctacggcaacgacatccgcacacgccgcccgagccattagggcgaggacgcgcaggaagaagccacaccaatcggagaggggaaggggagggggtgcggctcgggcactcacctggcgctgccgggaggagcgcgcggaccgggcgagggcgcgggagagggaggagaggctcatggcggcggcggcggcgagcgcattggacggagatcgaggcgggggcgggccgtattagggttttgatcccgcccgcgctccgcgtgcgtgatcgatcgaaactagccggtaaagtgtactgtgcccccgttttctcgcggagagagcgacgaaccgacgagacgaggtcacgagggacgcggttgatggtggcggcggagagggctcaagggaaatttgttggtgtcgatgaaagggcaggtggacacgcggcaagggattgccaccaatctggagacagttcggagcttccgctgccagtatgggtccatgggccaccctgttggataggccacgatattggaccgctaccaaactggtccatcacgatatataaatgaggaataggttcattttaggtaccttaacttaacagtgagtttgattttcgtcctttcaaaccacaatatttttctacaaatttcatcgaatttttaaaaaattgactataaaaagaatcaaatgatttataatatgaaacagagggagtagtagctagcaacaaccaaattagtttgattggtaatgaaaaatatcaaaccaaatatgcgtttgataccagcaatgtacacatttagcctccaaattaagtggcaaactagtatatttctaatattcatcaggtattagcaattaagttcgttagttgtgcaacctgtttatagctagctcggtggtctttccagcgtcgggcgaaccccacaagttgtattcttttttcgtagctacgttcagatcctttgacctgtccactacttatacgtatccatcagtaactaattacaccttgcaagtagatatccagtactgtactatcgagtcatcttcccaagtcaactccccactcacttcagctacagaaacagtgtttcctgggaccacggccagtccaggcacgaccatatggtcggcggcgagtcagaggacagcgccgtagcggcgtcagcgcgcgccacggacgacgaggccgaggtcgagccgccgccgccgccatcgtcgcacgagcgatccgtcgcgacacgacgcggcgcggcgtgctccgcgtcgccacgtcgtcgtaactcggcgacgtcacacgacgtcccatcgtcttgtggccactctggccgtagccggccggcgccgtcgccgtcgtcctcggacgtcgtcggcgagaaggccgccctgacatagttcttcctcttccttgccgccgccgcgggcgacgacggcggcgggccagcgccggaggcggcggagaagcccactaccgacgtcggcggcggtggctgggcgatgtgcggcgggaagagcggctgcgggccgtgatggtgcgacccctcgtacgtgacgatgagcatctccgggtcatcggtggacttctcgacgtgcttcttggcgctgcatcgggagctggtgcacttgtagtaactcctgcattttcaccggagatgatgttaccattgccgtgatcctgcaaatttcggcttctctgaaaaagactgctcatctgaaaacatcgctgttgtgttcattagccgccgttttaatgcgatgcagatggatgttaattcttgcagttcggcgttcgtgtaattaattacgttttcggtgatgacgtgcacttggagattattcaacagcacagtgattcagactatatatggcatgtgcatgtatatgaaagcatgcgtgtcttcgcaccatcctgtatttctctgaacatgatctggaattaatgtctccggccgcttgcttccgctggtgtgccactacgccagtgaacaacctacctgcggcgcgcgctttcaaccccgcgtgcacagtgacactgattgactctagaactccacgtggtgctactagttgggccctgtttatttctcacccaaaaattttatatcgtatcgcatcgaacattttaacacctacgtaaaatattaaatatacataaaaaaaataactaattacacatattgcgactaatttacgagacgaatcttttgagactaattgctctatgatttgacaatgtgatgttacaagaaacatttgctaataacagattaattaggcaacaaatttgtctcgcgatttactgacggattctgaaattagttttttattagtgtccaaacaccccatccaacccatatataatacccgatgtaatacgctaaaactttacacccatggatttaaacacccccttactgatataatatatatatagctttaatttctctggaatctgaacacacgatctatcaatctatcatggttgttgtgaattaaaggctcctcacttctcaactgaaatgctagatcattcacatccacagagacagggcaatcaggaccgtgtccccccactcccccttaagacaataaggatatttaactctattttttaatatatgacatagttaacttttaataaatatttaatcaatagttttatttaaaaattttgtacaaatataaaaaaaatcattcttaaaaagtatttaacgataaatcaagtcacaataaaataaataataattgtataaacttttttgaatacgataaatagtcaaacgtatctaaaaagttaacgacatcatatattagaaaacgtagatagtaatttctttcgttagaaaaggtaagaaaattgaatggtcgaagcgaatgaactgctaagaccacaacatgctactcatcacatttgtgttagttacatgcaggatctcgtagtgtgcagtaggtacctaattaaagagtctcctaaacaaactccatcagttttaaaatacagaaactttcaacgtttgaatctggtttcaaaatataagaatatctagcacactattctagggagtacatactacttgtcctataaattattatttcccgttcaaatttcttcacatctctcactcccacctacccatacaccctacctatccatcatttatttattgtgggatttctatcttttcttgtctaccttaatatctgtccaataacctagaaatatttatatttacaaataaaggtagtagtaattattgagtactccctctgttttcgaataacatactgtagaaattttcaccaaaacacgtagatcatggtaacaaaatttataaccaaattgtcattggtagttatttggagatgattttaaagaatggataaagtggaggtggagggcaagaaatggatccaaaatagaagcacctagaagtttgctctatggtgaagattgatttatgttcacaagtatagctacggagagtagggtcaaaattaaaattctgctaataaaagtgtggtggtgataaaaatattttgaaacaaacgaattggaggaaaatgtcgttatttaaaaatggataaagtataaataaaaatagtatatcatccttttgttttgagaatgtttatatgctatttgacggaaaaacaccttacaaatcatgcaaatcctaaaccattggatcatattaagaatcgtgcaccatatttctaaccctaacccctcatttcttctattgtcattcccagcgcaaccgctgccactcgcaagcttgcatgcatgcgatgcctctgcctcagccccatgtgccgcagcccggccttgccggttggccgaatgaagtcaactgtgccggcaactcccccttcatcccgggccttctccccctcccacctctcttcccaagtcggcggcgcaagtgtccctgtctcgttgtcttccccgtcttcggcagctcctcgccgttggatccgtcaccactaatcatcgtctcctaaccataagctctggtttgcccccgtcatcaaggccaacccatcatcctcctccatctccgtggcttcgatgtggccgccgatgcctcacctccaactcgtgtctacctcccactgtcgggccgttgcctccgacatctctttaagcatggcgatgtccctcttctttgccctcccctaccaacctccaaccctaccacaatcaaaaactctaaaccctaacttcactaccttcatagaggttgctagagttggtaaagaaggtatcgtcggagctagaggagaaaaactccggtcttctgagcacgaatcacgaattaaatttcaaaatgggtaatatacgtgattataaaaagaatatcgccagccatttaaccatctttttttaatgtaagagtgttgcacggctaagcgttgacttccccgtctagggaattcgtcaatcccttgttctgcaccgtatgacactaatcgatctgtactgtacgattggcacacgtgtatacgtatacccgcgagtccttccaagtcccactcgcggaaacacgacacgtacacacgcgcgccgccgtgggcgatagcaggcggcggcgagccgcgcagctagccatattgttcatgcacggattgcacgcacaggcttgaccgcgcgcgctcctggcggcgtttttctctcgatttcgccatggtacggtgcagctgcaagcggctgcccccagcgctagcgccgtatccggtgtaaatgaacgacgtcgacacgcgcatattgcgccattcttatcaggactaagaatacatcttcgttgtcgtcgtcaactcgtcacaactgtatgtacggctacagtacatctttaccacgtcgtcccgttccgctcccttaattggttaaattttctttttcacaacctaactaagaacgatttttgaacgcttttgagcatgggcgtaagtttaatcagtgcactatggtcaacttgtcactaaaaccgtgccatccatatcgcaaaatctaaaccgagagcgctctcgatttagtgttaaaagagcgacgcactcattcgtgagagaatgtccagtgctactagtacgtgagagaagatcctgtgctgccagtacagctacgtgagaaaaggtccaggtgttactagtgcacataatgcatgtctattttttttctttttatagaattttctctcaaattacttatccgatctacaatctgattacaccattacgttcgttgcaattaaatctttacaacaagatcttacatgattatattgcgatgaaaaatatttatatttataaattacttttattatatacgtaagttacttttatcacgtatataagttacttttaaatttgactaaattacttctatacattcataatgctctaagttgattatttttattattgtttttagttaattctatattttgtggactttataaatcttctctacactttacttgtgaatttactctacataatttcttatttcagctcactcacaatataataatttctactacagagagttactcctcccgttttataatgtaagtcattttagcattacccacattcatatagatgttaatgaatctagatatagttctaaattaaagttactttaattctttttgttgtaattcaattttcttaaccgaatatagcaagaatccgacaattgacgacttgacaaatctcatcgactaatctcaggacttcgaagccgatgctaactctaagccgatgactactccgggcttaccaaatttcactgttaacagtaagttacttctataatatatgtaaattacttttaagctttactgaatttacttttatatgtctaagaagtaacttagtgaaatctagaagtaatttagacatatcataaaagtaatttgttatttttcatcaaaatataatcatgtgagatcttgttgtaaagcttctctaaatcggattaaatcggattttattgttacgaacacaacggtgtaatcggattataaatcggatgagtaatttaagagaaacttctctaagaataaaaaaaatacatagatattgagtatactagtagctttttttttaaaaaaaaaaggtgtctctctttagcactatccagatatcactctcggtgtaaatgtgtccctatgtcgcaaaatctaatgcaagccagtgaaagaagggtagagctggtggaagaataattcggattgaaggagaatgataaagcgagcagagttagattggatcgatgatactgcgcgtggcgcacctgggatgtgggttgttcttgatcgacttctgcccgtacttcctccacttgtacccgtcggccggcatcttgccgccgcagctcctcaccttgctcgtgtacttgctctccgcttccaccctgcggcttaatttccaagcaaaccaacaacataatatcaatctccggtaagaactggagttagtttagctctatgcatgtgtgcacaattgtgcatgcacctacaaatacagagagctgtagcggcggccggaggggtacggcggccggggcgacgccgacgacgacagcgccttctcgatgtcgcggatcgtcgggcctgagtacaccgagcacagatccctgctcaccgccggtgccggccgcggccgccgctcgtgatcagcgctgccgcccccgttgcacggcgcggcggcggcggctgctgatgaccccgcgccgaacgagtagtagagggtggggtgttcggcggccgggacgaacaggccgtcgtcaccgaggagctcgcctatgaggtggtcgtcgagctcgcagggccagacgccgccggccacctcctccgccgacgcggtggcctgagctcgcagcacatctcccatcagatatggtcctggaaaacgccgtcgttgcttgtgaggggattggccatacataccacgggccggtgcaacgtggttagttagacacggcgacgaagtaatggaacagctcggagagtctgatatatacggatcaatgacatggacacatggagcctaaggtcaatgtcaccctgggactagatcggtgtcatgtttcaacggaaagtcaacctgtcattggctttggtgcacgacagcaagctaggataagagccgtatgataaagttactccctccatctcaatctacagggcgcctacttttaaagaaaaattaaactcgatagcttttaattaataatcatactaactatatttatacttaaataaatattatgtatattatatcactattatattttaaaatactttcatatgatgctaattttatatttgttgggatcatataataaaataaaatattggtcaaaatatgttattcaagaccatattaaaaaatataaggcttacaattagggtagagggagtactaattatataccagagttttaaaaaatctatttaacagatactaccttattacaaacatacatattataaggatatatatcaccgttcgaatgtgaggctgggcttaagcttagcgtgggcacacaaaacatgaataactaattaaggctgtgttcggcagcccctcctaccaacccatctccctcgtttttcgcgtgcacgctttttaaactgctaaacggtgtgttttttgcaaaaagtttctatacgaaagttgcttaaaaaatcaaattaatatatttttgaaaaaaatagcaaatacttaattaatcacctgctaatcgctactctgttttccgtgcgagcacttagtgctgggaaccaggggttccgaacataccctaagtattaactctattagctactactacaaatatcaaaaattgtgtaaactagatttttaagtacttctatatgaaacttattttataaaatacgaaccgtttaatgattcggaaaacgttcacacgaaaatcgatgaagtagctcattctataagccttgccaaaaggtgcataataagtaatataagtaaaagaatgtattttcaagaaaacatattcttataaatatatagagcaaatcatccatgttgataatctctaatgaagtactacctttgtgctaaaatgtaagtatttttttggcacgtatattaaaaaaatatgtgtgaatgtttttgaggaagtgtgtgattggttaagaagaaaaagtatatgaaagagaatggttgtgattggttgagaagatgagataggtggagaaataattttattttggaacaaggtattatgctacaaatagctagtacattttaagatggatgtagcggctgataagacaatccaaatcaatacacgtgatgcacaagttcgtaagtaaagtatttacctgctactgtgtacctcacgaaaaacagcgtacagtttcttttgggaaaaaaatagagcatagttgcctccccccctctctttctctctccttcagagagtacatcctttttcaaacgtcgatgaaaagaaaatttttcggtgtcacatcatatgtttgatcggatgtcggaaaatttttttggacacgaataaaaaaactaatttcataactcgcatggaaaccacgagacgaatcttttgagcctaattaatacgtcattagcacgtctgtgttattgtagcacttatggctaatcatggactaattaggctcaaaagattcgtctcgagattttcgtgccaactgtgcaattagtttttttatctatatttaatgttccatttgagtgtccaaagattcgatatgatgtttttgggaaaaaaattttggaaactaaaccaggctatctctcaccaaacaaccaaccttgcagaaagtgagacgacgatcgagcgaacagaatatgaattccctttccactcatcgctttctcaggggcggatccaatgtgggtgtagagcggactcaaatcccccctacacctatcggacccatggatacccccctgagtccccccttcaattttttcgtcctgattgataagataggaggtgctaaatgtattttaatagtattttagcatagtttaatactgagattatatgtttatattgatgtactcggtatgttgaggggctgtttggtttggtgccacacaatgttcatggatccgcccctgcgctttctccttataatttcttgacgacgcgttgagcttcggttgatcccgacgcctgcaacagtgccacggccgcacggcgtcgtcgtcgtcaagcgcgagtatgatcttgtccggcacagcgctacagccacgatcgaatttactttcgaatttcgaaagatctcgttgtgtatacctatggcaccaatcgatcttgctcgctgccactgccacttgctgcacgcactgaaagggagacgtagagctgttcctctgaaaatgaccgataaatccacgaaacgattcggtttcacccgtaacttgacatgatatttgggcgaagcaactgttaaactgtcatttgctcattttttttcaggcagtttggtcgagcctatactcggggcctatttagttcccaaatttttttttcaaaaacatcacattgaatctttggacacatgcatgaagcattaaatatagataaaaagaaaaactaattgcacagttatgggaaaaatcgcgagacgaatcttttaagcctaattagtccgtgattagccataagtgctacagtaatccacatgtgctaatgacggcttaattagtctcaaaagattcatctcgcggtttccaagcgagttctgaaattagttttttcattcgtgtctgaaaatcccttccgacatccggtcaaacgttcgttgtgacacctaaaaattttcttttccccaactaaacacatcctcatttactctgctacagttgaagttgaaccacattgctcccctcgccacaagggtgtcaatccaaacgtcatctcggtcaattctgggatagcagcatggtcgaggacacgaggtagtataggaaatactactccactatgcactgaaaaagtcgtcctgcaatttctcgtaaaaaaaaaagttgtcatgcaattggggtagacccagccggggcaggacatggtctctttcgctaataaaaactccgccatcggctcatccatcacacagcgatggacacataaatatatactctctcggttcctaattaaatacttcatacaattttgactagttaaaaacatactctctttatattttattgtataacgccattgactttttaaccaacgtttagtcattcgtgttattcaaaatttttgtgcaaatataaaaatatttatgttatacttaaagaacatttgatgataaatcaagtcaaaataaaataaatgataattatataaattttttgaataagataaatggtcaaacgttatttaaaaagtcaacagcgtcatacattaaaataaagagggagtattaagcgagaaactaaaaaactgttatgttcttcattaatgcgaagagaaaaaagagaagagattacaattggtaaaatagtaaaaagaaaacaaaaggaagtattaaagtagtctaggggatcagtaaaactatatttatttggggataaatttttaatctaaaacatatttatttagggctaactagagggagtatatttgaagcggaaggagtgatgttgatcgcatatgcgaatttataccagaggggctgatatctttgtatgtgtttagttccttccaaagttggaaggttaggttgaaattggtacgatgtgactgaaaagttgtgtgtgtatgataggttgatgtgatggaaaaagttggaacacagcctttggaaccatggcgttacggactcttaattcttgaacggctcggaagatccagagttgcagagacaatttgcagtctttcagctgtttatccccttcatggacaggttttaaccctgcaggcagacaacaacctcggagcagtttgtgaatgtcttcagttcttgacagtgctcacagtaatctactcctatttgctactgcccctgttccaaaaatcttgacgctttaaggtttctaagccaatttagcttcatattaaaacgatcaaatttctcttaattatcgattcaattgtcacgctttaaggtttctaagccaatttagcttcatattaaaacgatcaaatttctcttaattatcgattcaattgtcatttcattgagtacctgcactcagtatgttactacggagtagtacaaagaatcccttaatgcaattaaataataaattctcttaaagctcattgttagatgatttgatggaatagacaaatggtcccacttttcaatcaaatttactactccaatgacacttttctgggacattgacagaagcttaaaaacgacaccttttttgacggaggaagtaaacatctactctatttgtttcataaaaaactactatctccgtttcaggttataagactttctaacattgtccacattcatatagatgttaatgaatctagacacacgtatatgtctatattcattagtatatatataaatatgagcagtgctagaaagtcttataatataaaatagaggaagtaatctagtactctgtactagatgcattctagtattagatgtgagcatatatatatatatatatatatatatatagagagagagagagagaatttttatggtactatatattgatagtatatattgccattataaatgatctaatggcgtatattgatttgaccttccacttaactagcttgcagtataaaatctgaaagggtagacttgtctttctgtgtggtggtccggatccgatgccgccaagggctctcaccgcgccattagagcaggtacaatagcaggctattagccagttataaacatattttaatgagataaacgatgagagagaagagcagcaggctacagatttataaccagctagctgcaacacggactccaagacataatatatgtatgacaggtgggatcgtatattaatagtatagtaagcaactattgtatgaattggctattagattagctatagatgaattagagatagcagtgggctatactattgaactttgctcttatagcgctatcgggcgcattgcacgcacacggcgtggatgcgcgacgttccgcggcagcgtcgaagacaacttgaatggcacctgaccggctggtgtgcgggtcagcgggtgaactaaaatgtgcttgcatgcacaacaagccatagcaccaccatatgagaatgattaattttggtattgggttgtgttagtagtccaaactataaggtctatttcttatctgggctgcaaaagtgaaatgaaactggatttgtgtttgctactgtctctcacgagcgtaagttaaggggctgtttggatgcccacctcaatttaccatagttttttattaaaggtgtgtcaagatgcaaattgtgtggctcaaatttaatggccacacttgtgacaaactttggctaagaaaagggtctatgactagtaggaccaaaagaatagaaagtgtggcatgctaaagttatagaaacaaaccaaacattagctacatttggacaaactaacatacctcaagtgtggtaaaatgtggcaccaaccaaacaggcccgcactagagcagccgagcggcgacgagtcacaccgccgttgcgcgccgctgtcggggcttgtctctccaagtcgcacgccgctgtcggggctcgtctctccaagtcgttcgcgaggtagtgactcacgacatgacatcacaaacatctagggattaaacctaaataaccaattacatttttttttggcaaattcctattgtacccttgtaaatactggcagcatatactaccagtacaatgtgcggtaaaagttctcttacctcacatttgtgaggaagagaataaatcacaacacacatatagatgaggggatttgatcctacgacctccactagtcaacttcatgaaaatagtatgttattgtgagactttaaaagttacatttaaattttattatagttatatatacgttataatataacactacgatcatactatatttatatttatatttatatgaaataaatttttagaaccctgtaccaaccggtcagtggcgaaagcccgccgggggggctaacctgcagcttggctcgcgtctcctccgcctcgaagcacgtcttctcccaatcatttcaccagctgccatcaactaattggtactgctacttccatctcaaaatatagtaatttttagctatgaatttaaatatataggtgactatattaataactaaaaataattacattttaggatgaagagagtactatttagtttggtgttttaatctgtattacgggagccgcaacttgacttgcagcttcagaaatagtagatacatgtgttcaaagtgataacagcaagacccgtttcagatcctaacagaaaagtacgtacaatattcctgagaactgtatagtctgtattctagatatgcaattttctccgcacatcgacgacagcttttatgagtcgaggtcgcgctcgagcttcacgacagtcacggtgattcactatttcactacgtacaagccgcccatgctcaagatcactgttgactgttgagtacttgagtgcttaccatacgaacatagcgaattggaaaacccaaatcagtatgaacgggctataaaacgtcgggcgcgctaactggcgctctgatttgcactgattttctactctaggattggctccaaccgttttatagcccgtgcatactggttaagaccacttaagcatataaaccagcagaagaaccagggttagtcagaccggataggatgttttttttcttctgaaaaataggctgagaggacacattacacatctatctatctattctattattaaaacagctttgaaaggaggcaccacgttcgcttttgggggctaataattcccacattaatcagagaaaaaaaaagaaaatgagagtccaagtagaaatacaatctaaaaatagttattaaaacagctttgaaaggaggcaccacgttcgctgtgggggcaaaaaattcccacatcaatcggagaaaaagaaaaaaaaagaaaaggagagtccaagtagaaatacaatctaaaaatagctgaaattcggaattaaaactaagcaatattgaaagaagtttccatataacaacctaatacgagattaatcaaaatttgaaataaaaataaaataaaatccaaaattataaaaggaaaggagagtccaagtaggaatacagtttaaaaatagttgaaattcggaattaaaaataagcaatattgaaataagtttccatataagaacccaatacaagattaatcaaaattcaaaataaaaataaaataaaatccaaaattagaaaaggaaatgagagtacaagtaggaatacaatttaaaaatagctgaaattcggtattaaaaataaggaatattaaaagaagagttcatataagaacccaatacaagattaattaaaatttagaataaaaataaataaatccgaaattagcaaaagaaaataaaataagagttcaagtaggaatacaatttaaaattagttcaaattcggaattaaaaataagcaatattgaacgaagaatccatgtaagaatccaatacgagattaattaaaatttagaaaaggaggcaccacgttcgctgtgggggctagaaattcccacattaatcagagaaaaagaaaaaaaaaagaaaaggagagtccaagtagaaatacaatataaaaatagatgaaattcaaaattaaaaataagcaatattgaaagaagtttccatataagaacccaatacgagattaatcaaaattcgaaataaaaataaaataaaatccaaaattagggaaaaaaaaagagagtccaagtagaaatacaatttaaaaataggtgaaattcagaattaaaaataagtaacgttgaaagaagtttccatgtaacaacccaatacgagattaatcaaaattcgaaataaaaataaaataaaatccgaaattagaaaaggaaaggggagtccaagtaggaatacaatttaaaaatagctgaaattcagaattaaaaataagtaatattgaaagaagtttccatataagaacccaatacgagattaatcaaaattcaaaataaaaataaaataaaatctaaaattagaaaaggaaatgagagtccaagtaggaatacaatttaaaaatagatgaaattaggtattaaaaataaggaatattaaaagaagagttcatataagaacccaatacgagattaattaaaatttggaataaaaataaataaatccaaaattagcaaaagaaaataaaataagagttcaagtaggaatacaatttaaaattagtttaaattcgaaattaaaaataagcaatattgaacgaagaatccacgtaagaacccaatacgagattaattaaaatttagaataaaaataaaaataatatctaaaattggaaaaactaaaagagagttcaattaggaatataattttgaaacaactgaaatttaaaataaaaaataaaaacattaaaagaacatattggtattaactatttttttaaaaaaaatactgaaattagaaaaagaaaaataagatttcaattaggaatacaatttataaataactaaaatttttgataaaaataaatattattgaaagaaaagaccatctaaaacatatgacgagataaattaagtaagaggcctataaaggagtggagtggtggcggttgatacgacatataaaaattgttaataaaacatcaaatagaatcctaatgacgattaaaaaggagagacgtcaggcaggccgtgaagcaaacgagtaaggcggttgccgagacttcttagacagtaaaaaaacaaaccgcattgataattgtattcgatttttaaaatctcaatgacaataaaaaggagaagcagcgggcggggtgtataagagtatagtttcagagccaccgacggttgacgggacttctagaaaataaaaaataaattccaacgatagttatgttcgatttttagaatcacaataacaataaagaagtaggcggcgaacatgctgtagaggggcatagtggcatcgtttgataggacttctaaaaattataaaaaatgaaactataagtccaacttttaaaggttcagaacttttaaaaagtaaaaaaaaaacaatgataatcatgttcgattttaaaatctcaatgacaataaagaaggtaggcagcgggcgagccgtagaggagtacaatggcaaagctactgacggtttggcaggacttctagaaagtaaaaatgaacccaaacgataattatgttcgatttttaaaatctcaataacaataaagagaagagacagtggacggcccgtagaggagtataatggcaacgtttgacgggacatctagaaattataaaaataaaacacaacgtgacaataaactctaaaaactataaaatccaatttttaaaggttccaagaagaatgaataaaaatagtggtagatcgagcaagcaaataaagaagatgacataaggggtagcaactggtgtgaattttaaaaactatataattagaaacatgaggatgataaggtttggtctctcaaagtcttaagacaatgagatagctatttaataaattttaagtaaaatcatacttaaaaaaatatatgattttgtttgggtgctagccgcgcaattgggtgggccacccagctgatgggcatcaatcccagggatttccgtgagttttttatgccaaccaaaaacactaaccattcaaaaatcagagttttttttaccgctttgttagctgatatttgctcggtgctttggaccacaagaaacaacatgatatttagatcgaaattggtttatttcccaccaatattaactttacaaatcatttttaatttggtgcactgaaaagttctttatcgcgctgaggaggtcgagatgatagacctgatgactgataagatgaaaagggtgatctcactgctttgagagatcagagaactgggattggctaaatcttctttttttttctttgtgctggcaagctagctaatattgagatgttctcttgctcaagttccttgttgcaaagtgcaaacaagtttgtatgggccaagagaggttgagagttttcttgtgtgggcaggcttgtgaagctgttgccacttggttgctaagactcctttttttgtaaaatgggtttttagacaaaaggtacatatataggccccgcttacattgaaagccatcacggcagcaaggagtacattcgttaagaactaattcaggaggttagtcatcagcactccttgtctagtcatcagaagtagtggcggcagtcggactctccccagcagcagaactatggccatcctgcagctccagcgcccgcctaaggagtccaataagcatgtcagaaaattctgagagcaacgataaacatggactacaattaaatgttatttggaacctcagaatcagtaatccacagttgtttggaaacacagtaaagtttcaaactatggatctatcaaatacacatgccattttgccaaagcacatgaaatttgttggatgaaataaaaaggataaaagaaactagctggtcagtttgcttcatcaggatactagtttaccatgacaaaaccatccggctagaaaatcagatagcaacattaaacatgaaacaactaaatgttatttgaaacatcggaactagcaatctagctgcaatggtttgaaactggagtggattttgatccctggagtggatatcccctcgttgtttgcatatcactcaaatagttatgaaatttttttaaaaaataaaaaagatgtattaacatgttatatataactctacaaacatgcaagttcaaattcaacttctacatctcgtaacgaagaaaaacaaatttgattgtgaatatacgttaactagctatagtttaatttgtttttttcgttacgagatatagaagttgaatttgaatttgcatgttgttgagtgatatatcacatgttaatacatcttctctaatttttttttaaatttttttcgtaaccatttgagtgacatgcaaataacgaggggacatctcctcgagatatcaaaattgtttcataacaatgtagtaaaactaaacatgcttacatggatattgaatttgaggtatttatctaacaaacaaattaactaatacattctgtaacaacctaaatggcgccaaaagaacttccacccacctacaaatcatgtcatgctacaagcataatgaaaattaggttgcattgctatatggcgtagcttcttgatgaatcatttgtaagatcaatgtgtgttttgattcttattttgtgatgaacaattggcatatgtgattattggttttgatatttggagattatcgtcgaagtggttttggagataatcaattttcagaaaatgaacaggatttactagtttgtcgggaccggtcagaccgggctgggtgtgccggtcagaccggcgtgtattgcgcagtcagaccggcgcagcccgcggtctgaccggtcgacgctgtgtcagtttcggtttcgggttgtttctttggatatccgtgattgtttcatggttatggcttctagatggatattatacgtatgtaatactgttgtttgctactaatgagtcaagttggagatagcttagtctcggaatatggtttctttgtttgtttcatgtgtaggtgactcgatgcctcgggagagtatttgcggtgatggaccgggagtcggcttggtggtaagacgatgtccgtggtggtcaaatatcatgcgggatactaaggctagagttgatgcacgtggttgatggagattccatatggcatatgatggaggtattgtatgcgtatgggatgcggagtcgaatttggaaggagtcaaatttggtacgattggttatgtaaaggttctttcttgtactagagggtttcctaaggtgtttaggactcttagtatgagtttgattcgtggctttaggctgcctacctcatgtataaatagagggggagcgtgagtcttccctgcatcgctttgtatcgcttttgtattgcttttgagagctagtttagttagggttttgagtttagtcgagatttttgtaaggagtgttgttggtgcactttgtaaacacagagagaaacaataaagttgtcatctactttgagagttcttcgatttgtgtttcaccgggtttcggcagtctaaccggcatctcagtggcggtcagaccggcggcatcgcggcggtccgaccggcggcgtaagggcggtcagaccggcggtggcgacagcaagcgacagctgatcaggcggttagaccggagtttcaatctcggtcagaccggtggctttcagacggtcagaccggacgactacctcggtcagaccgcgatccatcgatttcgagggtaacttttatttccgctaaaagtttttggtttttgggtatctcaaccattcaccccccccccctttggttggcttagttcttgtgattcaatcctacaagtggtatcaaagctttgtttgcttctttggattttaaccgatctagagtttttgccatggctgcttctaataagtttttaactaagcctcatgttttcgatggaacggatttttctcattggtgtagtaggatgcaatcttacattatggctgagaattatgatatttggagaaaagtttctcttccttgtgtgattcctgaagctattaatactgctgctgaaaaaactgcttttgaactaaattgcaaagctcgcaatattcttttgagtgggatttctcgttcggattatgatcgtgttgctcatcttcaaactgctcatgagatttgggttgctttgaataatttttatcaaggtacaaataacattaaagaacttcgtcgtgatcttttcaaaaagaagtacattaaatttgagatgaaacctggagaagctttggatgactatctttctaggtttaataaaatttagagtgatcttagatcttttgattcttcttatgatgctaattatccacaatctgagatttctcgtcactttttgattggtcttgacatgtctatttgggagatgaaagttacacctattcaggagtttgtgaacatgtctactttgactttggattcgctttacacaaaactgaaaactcatgagatgaatattcgttctcgtaaaggtgattctaagtctagtgctttggtttcgtcttcaacttctttgaatgttggtacttcttcatcgaagtcttttgttcttgctttatttaatgccatgtccgatgatcaactcgaacagttcgaggaggacgacttggttttgctatctaacaaattttctcgagctatggaaaatgttaggaacaggaaaagaggagaaccgaatcgttgttttgtgtgtggtgcacttgatcatcttcgctcgtattgtcctaagcttgggagaggcaagaaggaagatgatggtagagttaaagaggatgacgtgaacaagaagaagaacatgaaggagaaggagaagaagaagcattgcatgcagtggttaattcaagaactcataaaagttttttatggatctaaagatgaagatgagggcaaatgtaagcaatttgttgatctagcttttattgctcgtaatgaaagttctcatgttgatgaatctgatgatgataatgaagaaaagcatagttatgatcaattagaacttgctgcttacaaatttgctaaaaaaactttaaacatgttctattgtgcttgatgagaaggatcacactattgagattttaaatgctgaaattgatagattaaaatcttcgattcctgatgatgataattgtcagtcttgtgaagttttattttctgaaattaatgctttgcgagatgtcaattctgttaattgcaaaaaattagaatttgagattgaaaaatctaaaaaattggaatcttcttttgctcttgggtttgctttacatgcttgtgttgttgatgagttgattttgacaaagaatgttttgaaaaaatacaaagttgctttttgtgcaagttctttggcgaatgcttcatgtgcaaataaggcaaaacaaaacaatggtgttttgatttctgaagattgttcaaagtgtgttttgaatgagatgaagttgaaagatgctttagggcgtgttaaacacatggaggaaattgttaaacaagatgaggtgttttcttgctcaacttgtagaaaacaaaaaggtcttttggatgcttgcaaaaattgtgctattcttactcaggaggtttcttatttgaaaagttctttgcaaagattttctgatggtaaaaagaacctcaacatgattcttgatcaatctaaggttagcacacacaatcatggtttaggttttgatccttatgctcataattctagacatcctcctactgttttgggtgttgctaggagaggtgaaattttgattgaatcagagcctaagaacactgtgtttaaatctgttggcatcatgtcttctttgaatacatcttcttcgaaatcaaatgttgtgaatgcaaaaccttctgttgttgcaaaaccatctacttcacaaacttgtcgtgagaagtacacttgttctttttgtggaaaagatggacatttggttggtttttgttttagacttgcccataaacagaaaaaggaaagagaaattgcttttgcaaaacgacattggcaaaaatcgggttttaattcgaggaccacggttagaccgacactgaccagtcggtcagaccggccagcggtcagaccgcaggtaaaccggcggtcagaccggttgctaggctcggtcagaccacaggcacagtggcggtcagaccggcctcggggcaattttgtgcgaaattcaactcagacttttgtgaagcaaaaaggtaagttttttggtaagtctgattctgattttgtaagtgtgtatgtacctactggttctagtggtcgtgtgactcagtgttggattccaaaatttcttatttctaaccccaacacggaggtctcgacatcttctcgttcgtaggtattttggcggcatactccccatgtgcatttaactttgagatgacgattgtatagcaaggtaacatcactttacttttggattgacataattttggtctattctcttgtttattagctttttcatgtgctaatgtttgaggtagtagtttttgttaatactattggatgtatgtcaattcttgagaattttggtgatatcgttggcaattggatgtctttttcaaaatctttgattttttcttgatttttgttcgggaagaattggaggttattttgagggggagttagtgctttttatgactttcttttggcatgttttgagggggagtttgtacctcatggttttatcaagcaaaaatatgacaatgaaaaaattgataaaagagagctttgtttatacatatggtattttcttgtgtatgctagtaatattttgaaggtttatttgtctctagcataacttgtatgtattctagtcttttcatgagatttagtttttgcttttaagggagatgatgcatgacacttaaattctatacttgaattaagaaaatatgtaatgttgaagctagcatctggtttgatttataaatgctctatttatatgctttattgaattgttattccttaaatagctttaattgctcattgtgaaaaagagaataaaaaatatgaaaaaaatgaataccgaattcttggaaacagtcttgacgacaaggacgtattcgatgtgagcaaaataatgggtgccgaatccctggaaacagtcttgacgacagggacgtacccggaataaaaaagaaaaatatgagcaaaaaggcttaagaaaagagaaagttcaaaaaaaaattctcttggttgttttgtgctaaaggttatttgagaaagagtgataaatgcaataggtatatgtgtttagtgtttatttttcaacctatgtgcttattaagatgttgcattataaatcgtatgaaatcatgaattttgattgttgattcaagcttaattgtaaaatctttggttcatggttgtactttaatgcatgcttgttctgttatagatgggtttatcttctttttattgcaacacatgacttgatatgctatatgtatgctaagctcttatactttcaaaaacataattcctatgcttgatgaaatcattgtcaaaagggggagaagagataagttttttgggaagaagagatgagtttttatgagaagagaagagtttttgagaagagcatgttttttcaattgggaatttctttcttttaaaaagggggagaagttttcttttggatttttgagcacgatgtgtacgtttgtacaaagtgtgtttttttaccgtttttgtttttaatttttcaaactccaaaacatttttaatgggtttgccaatttgttcattaagggggagattgtaatatcaacgtgtgttttgattcttattctgtgatgaacaattggcatatgtgattatcggttttgatatttggagattatcgtcgaagtggttttggagataatcaattttcaggaaatgaacaggatttactggtttgtcgggaccggtcagaccgggttgggtgtgccagtcagaccggcgtgtattgcgcggtcagaccggcgcagcccgcggtctgaccggccgacgctgtgtcggtttcggtttcgggttgtttctttggatatccgtgattgttttatggttatggcttctagatggatattatacgtatgtaatactgttgtttgctactaatgagtcaagttggagatagcttggtttcgaaatatggtttctttgtttgtttcatgtgtaagtgactcgatgcctcgagagagtatttgcggtgatggactgggagttggcttggtggtaagacgatgtccgtggtggtcaaacatcatgtaggatactaaggctagagttgatgcacgtggttgatggagatttcatatggcatacgatggaggtattgtgtgcgtatgggatgcggagtcgaatttggaaggagtccaaattttgtaaggagtgatgttggtgcactttgtaaacacagagagaagcaataaagttgtcatctactttgagagttcttcgatttgtgtttcaccgggtttcggcagtctaaccggcatctcagcggcggtcagaccggcggcggcgacagcaagcgacagctgatcaggcggtcagaccagagtttcaatctcggtcaaaccggtggctttcagacggtcagaccggcatgactacctcggtcagaccgcgatccatcgatttcgagggtaacttttatttccgctaaaagtttttggtttttgggtatctcaaccattcacccccctttggttggcttagttattatgattcgatcttacatcattttataaacaaaatgtttatgctagaagcaatcgcatatctgttgtttaccttgagagcatcatctgattgcattgggcatgcacagagagctcgtagccaagcaatccagctatggacagcatcatgcaccataaaaacgtagccccaatggtttcgccagcaaagccaacgccagtcagcagcagaagaagaaagaagctaatcaccagatatgggacaatatagcacaacatgatgtggccaatctggtcaacggacaggagggcatcatgaagcacaaacctagcaacgaaagcagcccaggacaagatggcagccccctccacaaccgaaagaaaggccacgaacataggcagcagatcaggatcaggatcagcaaacggcctcaatagcagagctatgggcgtaaccatcagcagagatattataccaaacccggcagctctaacaccacgatctgtcttgaaggacgtctcctcctcctcggtcaagaaggttgggggatccacgcgcatggccgccgtctccgtgccaatgcgctgcaggtgatcggcgtaggcgtacccgagcaggccggccgtccagcctgtggcgaggtgcatgacggcgaacccgacgctggggccagcaaccgttccggctgcgtcggccagaaggacgccataggagatgtggaggaacacggtggagggacggattgtgcgcgagagggtggagatcaagaagaagaggtaggcggagatgaggaaggcgatcgtccacaggagggccagcggctcgcaggagttgcggagcagcagcggcggggagaatacgaggaacatgcatgagatcaagataacgcgaggtataatgtgatctggaccgccttcaccggaggagagaccggtgatggtggtcgacggagccttggcgtcgacaaggtggccggccaccacagcctcggcgccatctgcttcgcaagccgcggcgatggccattccagtcgtagggttgtgggggttgtgaagtcgaagcgagagcagggccggcgaaagaccaccacgacagccgcggcggcgatggaggagaaattgacttgactgctggtgtgtatcgctccagtcaattaggactgatcgatttgttgccaaaattagtgggatctctaattgtaaatagcacatttactattcttaacgttactaaggctgagttctttccaactcaaccacctctttttttttttgtgtgcatgcatttcaaactacttaacgatttgttttgcaaaaaaatgtttatacgaaagttgatttaaaaaattatattaatttatttttatttttaaaaaataattaatacttgattaattatatgttaatgagtctctctgttttacgtgcgttagagatgagttcaaccccaagaaacaaactcagcctaaaacttgtccttgtcgatctttgcctttacaggtttttttttagcaatctaaatgtgcgtctagtctaagcatctccaagagtttcttcaaatctcaaatcttgctctttatttgttcatttggcaatgaagcaaaataatttcttttcaaattttatatacattctaacagcttcttcatatcccacactctctaaattattttggttgtttagattgatgttattttaaaccataccatttttttaaataaaaagttgttaaatatgtctatatatttatatatttagttcttttaccaaaacttaataaatacataaggaatcctaccaaaacttggtaatattgtcaacttactgtaattttatcattgtcaaaatttggtaagatgtattttggctatggtctaaacaacccctttgaggaggtatcagtatttttctctttgagcgagtatgagtatctttctctttgagcgagttgcaacttgcaagcgagagagatgggaggaagagagaataggagactcacgtttggcaagtggtcatcgtttggaaccatgccactccgtcactcttttcgtcctccccgtcaatctttccgtcattcccatcctctctccggcatgttcaccacgttgacccgctcctccatcttgccggcagccatgagctcgaggagggagtcgaggaagtcgctgccgcggccgtccgggtgcacggcgtaggcagtgacgaacatggggtcgcggccggcggcgaacggcggcggcgatggcgaggggatgctctcccatgaccaccgctccacctggtgcccgacagggccgggctggggctgcagggcaagggccagctcgtcgccgtggaggccatgttcctcatgtcgctcgcgctcgccgccgcgcacatcgccatggcttaccgcgccagctgccgcgagcgacgccgcctgctcgtctacagaatcgacatcgaagctgtaagtgattgattcccttctttgctcgtatcgtatcaaaacaaaggattttgcctagtggtagcttgtagtgtggattggaaacatattaaacccaaaatatgcaagctttctagattccaatccgtgttttcgagagattctggagaacaatcgaggcatacgcttgccgaccttttactggacatgacaacggccagaagaacacgacgtcccctcacgcgaggaaagcaatggtggagcggtggccggcggatgagggcgggacaaggcactgccggttcttgccgccgctggctgcggcgcagggcgcgaagaaggcgaccgcggagtctgtgcgctcgatgcggagctcggcgacgaggcgcaggtcacggccgtatccgcggtcggcgaggtgggtgagcacggcgtcggcggcggcgtcatccggggcagtggagaggaggagaacggggagaggatggggaagacgaaaagattgatgggaggatggaaagagtgacggaagtggcatggttctaattttaaaattttacaagtgacatctagcagataacgtgaatagtaatggtatattttttatttaccacatttacagtgatatggatccaattaacccaaggctaaaaggcaaatatagtcacgggccaaaatgcagctaaagcatgaattccatatactttgatcaaggatggctaccacaaacagtactacatagtagctcagatgtctcaattcaaatatgtgccgatcgataagggttaagaattacacattcatagattcgtattatagcataatgcgctcgaggataacccctaatctttacacatgcatgtaggagtattcgttaaggactagtggactactaattcaggggaaaaaaaattctctggggcggagccccaatcctcagcgcgtgaggcaccattctagataggtgccacctgtattctcaccaatattgaagcaccggaaaaaagtaaagcaatttggattttttttttcttagcgtatacgctccgtattccagtggtgccctacgaacttgtatcgtattctctgccctaatcacgtcgttagcgttcctcgttcgtcggagccgtaatccagctattcgcccttccgttccggccatcgccgcgcgtgtagttcgccgcccttccatcgtcaccgtggccgtggccgtggccatggccgtcgtagtcaatgtagatgaatccccgcggcggcgccttcaccggtgccgcatcctgctcatccaccggcgatgacgatcctccgaggcccctgatcaaccatggaccaatcaacaatgcatggcagcccgtttacaagacacgaagctccaaagaaaaatatactagaaagaaataacgtgtttgagtatatcgaatcactgcaaattgcttccaggaagaaataaaggttgcaatagcttacaaattagaaacaatagttaatgttattgttttctacttatatgataagtacaatgtctacttaggaatcacagcttcttcaaaatctaatctccagttcattgagcatcgacgaatgcgccatcgtcgagaatatcgatgccatatggttgtggtcaaggttgtgctggcagttgcattcatcgatatcgtggtgtttgtggtgggcggcctcggaggatcgtcaccaccggcggatgggcaggcaacagcaccgacgaaggcgccgccacggggattcatctacattgacagcaacggtgatgacgacggcgacggccacggcgacggcgacggcggaagggcggcgaactacacgcgcggtgatggccggaacggaagggcgaatagctggattacggctctgaggaacgaggaacactaatgacgtgattagggtagagaatacgatacaagttcgtagggcactactggaatacggagggtatacgctaagaaaaaaaaatccaaattgctttacttttttccggtgctttaaaattggtgagaatacaggtggcatccatctaggatggtgcctcacgcgctgaggattggggctccgcacgagagaatttttttccaattcaggggtagttggatgttgagtgttgagatcaataagctgccgcagtactatttatctagacgctggcagtcagagtcaagaccagacctgttgtaggccatcttcatctctgctctgctccaccggcagcctgaggagagtccaataaacatgtcacaaattcagatagcaacattttaaacatgcacaacaattaaacgttatttggaacctcagaatcagtaatcctgcaatcgtttggaaacgcattaaagtatcaaactaaacagaattggtatgtggcagcactacggatctatcagacaaactacaacctgttagcaacccacaatgtgccaaacaactccccgtcgcatacagatcatgccaatgctcatcaaaagtttaatgaagattaatttgcatagttatgcagcttctcaagtaaccattttacaaacatatcgcttaattatgctagaagcaaagacctgcatttagtttgttgatttaccttggcagcaccatcttgttgtattgaacacgcacagagagcatgtagccaagcaatccagcaatggccatcattacaaaccagaaaaacatagccccgatggcatcgccagccaagacaaggcagctcagcggcacacataggatggagctcagcagcagatacgggccaatatagcacaacatgtagccaagctgatgaaccgagacgaaggcttcaaacagtaagaacttagcagtgaaaatcgcccagcagtagatggcaatcccttccagaatcgagagaatggtgacgagcagggacagtgcaggaggaggcatcttcaccagaagagctccggccgttgccacggctaaagagagcaaggtaaagaaggcagcaacactacggcggtgcaccttgaaggagctctcctcctcctcggtcaagaaggttgggggagccatgttcttggccgtcgtctccttgccaatgtgctgcaggtgctcggcgtaggcgtacccgagcaagccggccgtccagcctgtggcgaggtgcatgacggcgaacccggcgtcggggccagcgaacgtgtcggcggcgacggccacaaggacgccgtaggagacgcggaagaagactgtggagggacgcattgtgcgtgagaggctggagatcaagaagaagaggtgggtgcacatgaggagggcgatcgtccacaggagggccagcgggtcaccggagtggcggcgcagcagcggcggagagcatacgaggaaaaggaacgggactgagatcaagattatgcgagctcgaatacgattggagccttcattgtagacagtggtgactctgcggcctcggcccgatcgactcgccggggagatcgtcgccgagcccgagtggtcgccgtccgagtcgcgcgacggcggccgaatgtcggagggattgtcgtcgggggaggatgagtcactcgccacatgggtggtgtcgtcgatggcgtctccccgcaagaagtcctctgtcttggcgccggtgacgatcgacggggtcttttcaccggtgatggtcgacggggtcttggcgtcgacctcggcgtctgcttcgccatccgcggcgatggccatctcagtggtagggtactagggttgtggacttatggggttgtaaccgcgagcggggtggcgggttttataatggaggaggagctgcccgtagcgggtagcggggcggaaggagaggattcggattacccaaaaaggaaaaaggaaaggcgtgcaaaggaacaggaaagaggaaaaaggaaagtaaaggaaaaaaaatacggtaacgctaattcgctgcgcgttaggattaatcgagtgtggattctaatccctcgaggggatatccccttgtatatctttttcttccaaatttgatgcaaatagttgtgaaaaattctgaaaaaaattgataatgtagagtataatgatacctactagtccaccaaaattcatgttcaaattcgatctacacatcgagaaataaaaaagacaaatttagatataaacagtacgctactattcatacgctgaatttgtattttttatatctcgacgtgtgagttgagtttggacttaagattttgtggagttgtatatatgtgttgtatgaatgttgtcaaatttgttcagaattttttataaccgtttagatggtttttaagcaaacgagggaacatcccctcaaggggtaagaatagtttcccgaattaatccccttttcccttttttccgtttcctcccttgcaggcccgctcctctctccgttccgttttttcccttcttctcagccgttcccagtacttctaaaaaaatactactatcgttcccagcccacctctcgtattgcttctcttgtaacaaaattactagtcgaataattcctattgcaaccagtttctccttcctcgtagagaggcctttcgatcttagtcttacccagcgacgtcttgcgcggccatccgatttattcgagaagcgtccttttataaacagattgtttgcaaacacatgcaattagttttgctgtttaccttgacaggaccatctggttgtactgagcacgcacggagagcatgtagccaatcaatccagccatggccatcatcaggaaccagaaaaacatagccccgacaatggcatcgccagccaaaacaagatagctcatgaggcatacaaggaagctcaccaacagatacgcgccaatgtagaacatcatgtagccaagctgatcgaccgtgacgagggcttcgaacagcgcaaactttgcaacgaaaaccgcccagcagtagatggctgtgccttccagaaccgagagattgatcacgagcagggacagatcacgaggaggcaccttcactagcagagccatggccgtagccacaagcatagagaagacggcgaagaaggtcacaacgccactacgatgtatctcgaaggaactcttctcctcctcggtcgagaaggtggggggagccatgcgcatggccgttttctccttgccaatgtgctgcaggtgctcggcgaaggcgtacccgagcaggccggccgtccagcctgtcgcgaggtgcatgacggcgaatccggcgatggggccggcgaatgtgccagcagagatggccagcaggacgccgtaggagatgtggacgaagacggtggtgggacgcattgtgcgcgagaggatggagatcaagaagaagaggtaggcggacatgaggagggcgatcgtccacaggtgggccagcggctcgccggagtggcggcgccgcagcagcggcggcgagcacgcgaggaacaggatggagataaagcacacgcgagctccaatcagatcactgccttcgtcggagagactggtggctctggggcctccggaccggatcatcgccaagcccgagcggtcgtcgtcgaccgagtcgcgctcgcgcgccggcggcgggcgaacgccggaggggctctcggggaaggatgagtcgctggccacatcggaggtgtcgtagatggcttctccccgaaccaagtcctccgtctccgcgccggtgacggtgatcttgtcgccggcgacggtcgtcgacggggtcttgtcgtcactggtgatggtcggcggggtcttggcgtcggcaaggtggacgtcgacagcctcggcatctgcttcgccatctgcggcgatggccatctcagtcgttgtagtgttgtggggttgtaaggccggagtgagcgcagggccggcgacagacctcggcggcggcggtggaggaggaggaattcgaggttttggctttggggaacaaggcattttgctctgtgtgcaacacatgatgtctgcgagcctgcggctgtgggtcttcccggtcactatgttttgactgtttgatttgttgccaaaactagcgaattttaatatgatgataattaagataggattttatcatcatgcatttataaatatacaataataatttggtagttacatatatgtcaagttatagtagattaaaattttaaataacatacaaaatatgaacaaaatgatttattaagatattaacaacataatcacggatccaaagttagaaaacaaccttgctctgtaaaatcttagatccaagagcaaatctactgtacctaaggaggtaccataaggtactaaaaatttagtgtaaaatttggtacctcataataactagataccaagagataccaaatttataatagaaaaagtggtacctcatggtacctcctcaagaaccgtaaaattgctctagatccaaagttgtgctaaagaggaccataaccttccacttacaaatcgtactataaaatttgctaagaacttaaaccaaacaataccatcgtattagtgactcctttgatatctcgagaatatcccctattttcttgaatgtcattatgaatttttttacatgcttcgtaagtgtcatgtaggatcctaaggcactgtgacgttttagaattgggtgccacattttagcaagttcgggaaattgaaatatatgttaagagttcagggatctagatgatacaaccaaacaagtttagagatgaataatacaattttgttagatatacacccctcacatagagttcactcaaccaacacttgtatttctcgtatatcccaatgagacaggagttagaactttctaacacaacatttgtacaggtacgtacgtttggcgaaggcatgttcccaagttatactcacttgtttttcacacgcgcatattttttaaattgttaaatgatatttttttaaaaaaatagaaaacttgttttaaaaatatattaatttactcttaaattttatgaaatatattaatttattcttaaattttatgaaatgtatttatttaattatttgttaatgagttgtttcattttacatgcgtagggagagtctccaactcttacattctatatttgtatatatatatatatatagctatacgttcaacttcttgtatattattgctttgtgtctaactcttttggaaaaaaaaatattgtatattcttggtttgtgtctataactctctttggaacaaagaacttacgcgcgaaaaaaaaactttttcgtgtatcctaatctatatacagctccactttaaaaatttgcagatatgtaggaatatactctctccatcctaaaatgtttgacgccgttgacttttttaaatatgtttgaccgttcgtcttattcaaaaattttaagtaattattaatttctttcctatcatttgatttattattaaatatacttttatgtatacatatagttttacatatttcacaaaagtttttgaataagacaaatgatcaaacatgtttaaaaaaaatcaacggtgtcaaatatttagggaaggaggtgtcaaatatttagggaaggaggtagtataaatttggagatgatgaagccgtaataaaccgagcgacttactactctttttcttctcctccaagacgaggggagcatctcaatctgcaataagagcgaagccccggtccaaagcagattaagatatcaactcatcgcgcccaaaaacccacacccccgtagccaaaacccgccgaggaagagggagaggagcacacgcatggcgctcgcggcggcgcccgcgaatctggcgggcaagcagagcttgcgagtcgtcgtcatcggcgaccctggcaccggcaagtccagcctcgtcgtgtccgccgccaccgaggcgacgtcccccgcgtactgccccccacccgcctccccgtcgactacttcgccgaccgcatccccatcaccatcgtcgacacctcctccaggtcctccactgcccctcacgctagatttgcgggtgtatttttttttgttgggggatttgtggattttgattcgttgacaattctgaattgctgattcagcccagagcagaggtcgaagctgatcgccgagtgccagtcggcggatgtggtggtgctcacctacgcctgtgaccaacctgcgacgctggagcggctcagctcattctggttccccgaactccggcgcctccaggtgaggctctgcactcactgccggaattgattggtaattttgtggattaattttgtccgctgtggctcatgttttgttctgcttggctcagttggaggcaccggtgattgtcgtgggatgtaagctggacctgaggggtgaggagcagggaactcttgatgccgtgatggcacccatcatggttgcattccgagagatcgagacctgcattgagtgctctgcgcttcgccagatcctggttaatatgtctgcagtcataattttgtgttgataggttgctctgagatagggatgcttggcacattgctgcacataattaagttaatagctacaacactagctagatcataattttattgtattctaggcatgaacttgttgtacttttactgggcaatacttttattatgtactgtgtttattagctaaccagtagcaccaagttggacagactagagtaatattaccaataataattagagcagttttaaaaattatgaaatatacaagaaagtattacacgatattctgaatacacagggacattctctctgaatttgggtttctttctcagaaaaacccaggcaactctattattctttgtttatataaataaaagtcgtattatgttttgggccataatttattttacaatataatattgacatctagggaattaacattcatgtgaaagtactttgcaatagaaatgcaatggtatcatcttgtatggcagtaaacatagtaacatactatatttgttaagtcaatagttataaattttgaattttccaaattcatgtgtgacttgtagttatcaatggagggagtacatgataattctgtctgatgctgttaggcttgagtccatggcctttctcatccatgactggctgttgtagcgagtccagcacgctgcgcgcgctatggcgtgtttccctcacctgcctagtctcccgatacttgtttccacaaatcggttgatgaaatttggcaggtgttggactgtttgtatcagttgtacaatgaattagttaattatcgcatgaattatttgaaccatcagatgcattaaaagtccagacattgtgctagtctctagctaactataattgcgtatgtttgcaggtttatgaggtcttctattatgcacagaaagcagtgctttacccaacagctcctctatttgatcaggaggcacagatgctaaagttacgctgtatgagggctttgaagcgtatatttattctatgtgaccatgacagggatggagcttttagtgatgtggagctcaatgattttcaggtttgtagccactaaagctgccttggtttctttgattagtgtaaggcaaactaatgcttgcactatcattctattaatacttctggtgatgttaagaatctccttttggctgctttacaggtcatatgcttcaatgctcctctccaacctaatgaaatcataggcgtgaagagaaccatccaagagaaattgactgaaggtgtaaatgaaaatggccttaccttgactgggtttcttttccttcatacccttattattgggaacggaaagctggaaactacttggaccgtgttgaggaagtttggctatgataatgaactcaagcttagagatgacctcattccagcaattaaacgagctcctgatcaagtaatgttgcccttttgttgcttccagctatcctgtgtactatctgtataaactagagtaattgtacatgtgcatgatcttaacactgatagttaattgttttagattctataaattgagttgctctgaattcagattttagaggtgaatttatgagaatttagggtaattgatcgtttgttatgctttttatttacagtttatatatacaccctttggtattttcatcactaacattactactgtggtaaaatatccgcactcttaagaactcctaaactgctctagaaaatgtgcttgtaatttgttagtcattcaatttgatgcgaatctatggtgttagcttcactaagcatcttcatgtttgatatttatcatacttctggtttattatatattttgctgataattaatttaaagtcaaatcattttttttgttccaaaccttggaattgaaaagtcaagtcattgatttcttgagagggatcttcaacatgtttgacacagacaatgtaagttctatgcactgatgtgattgttattctcctgaatcgtattcaactctttgttgtactgagcattttttgtaataaaaactgtcattttacattgataatttgaaaatgccttttggtataatatccaggatggagctttgcaacctgctgaaatcaatgatcttttttcaaccgcacctgaaaagtaagaagctgatagaacgccctttcatgtttaataacttgatactttcattgtaacaaaaagttaggttaccaaaattgttaaatatttcttgtattaatttctctattggacttgatgtaatgaagattctttgcattagaagggtgtgaagaattactatttaataatctgtctgttgatatttcctgtatcaatactcttctattggaatttcagtccgtggtcttctcatctgtacgagaactgtgctgaaaataatgtcttgggtggtttgtcgtttgaagggttcatctccaaggtattttctcaaactttgcatgataagagttgacacaacaattgacaaccctgtatttttttgttgatggattgaccttttagcaaattattatttgttgattggtttcaaaacaagaaagagaagccctttctctattcagaactcacacgcattgtatttattggtgtggctgtcctgtagcactgtgcaagattctttcatgactctaggaaaccccatattgttgttcttttaatctctatattcattgatctgtgcattctgagcatcaaaactaggtatggaatagattgcttacagtgcatgtaaagtattaagcaaattaatctgggagcaatcatatcttgtataaggagcacgcagtgtttaatatgaactatataatttgtcttgacaaacctgtgggggtgttgttaggcagaaaattgatctttgatttctagaattttattgttgctttaatcttgcgtttggaaaatactgaatttccttattggtctgttttcttttattgactaattattctgtaattgcagtggactcttatgacacttatacacccgtcaaatagttttgccaaccttatatatgttggctatcccggcgattttgattcggcatttaccaccacgaggaaaaggcgagtagaccgtaaaaagaagcagactcagagaaatgtgttccagtgttatgtttttggtcccagacatgccggaaagactgcattgctacaatcattccttaaaagatatcactccatagtattttatatcatgaactttgtttgccatggttatttcttctgatattctcactttcactcttggtccttgcaataggcaaccttccgatgctcctcctgtcaatggtgaacaatttgcagcaaatactgttgaactgcctgatgtaagtattcgaaattcttgatttattttgctcacaccatatgcaaccattttgatagttttattttgaacagtgcaacatttactcatgtattcgtaagtattctacagtctgagatgacagatactctttaaacaatccatattcttgtttattaaaaaataagtaactagcaacatatttatatgaaaccataattgatctgcatcttaacacttgataatgtgtgtcacaaacaagttagtttctaactgtttggtctgattcaataattttcttccactgaaggggactagaaagacacttgtgatgcgagaaatttctgaaggtgatgttggaccattactatcagataaggaatctttggcaccctgtgatgtagcagtaattgtttatgataggtatgctatccactgaattatccccctctttattcatggccataagttttgtcagttgcatttttctttcatggtcactgaattcttcctttttattcatgacaaaaatcctcaatacacagttttcagtagcagcactcctttcccattagctatagcagtatgatttgtttataaacctggcatactatgagagaactttatttttgctttagatgaaatcaattttgttgttgtgatgcatttgtattaaccccagtgacaaaaacagaaaccaactgccaacaaaaagagaaatttcagtcccccaaaaaataaaaaacagaaatttctcttgttttagagacacgtcaacatcttgtggtagctatcaagggatctaaacaaactagcagtaactggaggtccacagtttggtaggactggcaaataacatatgctgatggtaatctaaatatagacttgaaaccaacagctaactgcctgggtactggtatgggatgttcatctccacaaggaatatgaattagcagtacaccacttaaatagaataaccgactacacgatactgtcaattggctcgttgaagtgactgactttaatcctttatcctgtcaattggtttaaatattcgttgttctatgcgagccctcctgctgacagttcacagattcaggattgaaccaatgtagtaattcagaagttcgacacataaatattgtttattcagatgtacctctctctatattatctattcagttgtacctaattttctgcacacaaaatgtgatgctgttgaaatggcagtggtgatgaagtttcttggcaaagagcaagagaattgcttgtacaagtggccacacggggaaaaaacactggctatgaagttccttgtctgatagttgctgctaaggatgacctcgaccaatctccgttggctctgcaggactcaactagagtaagcttcaatacaatattgattcatttttaaactgttatattttatttacctctgagaatcatttgtcctttttggcacagttggttggttgaactggaattagatatttgaatgaatcagtccccccacccttttttttttcttttgcttttgctaattggagaccaccatgccagtggttgtttctgctgcctcatggaaaaactcttgatcaaactgtgtcgttccaagtcaacattcatacaaatggactgatttgtcaatattgtctactattgccaccagttttctttatgtctgatctctacagctatggattattttcagttgttttaattcaataaaatcatgtacttgtaggtgagccatgacatgggaatcgaaacaccaattcctattagtgtaaggttgagggatttgaacaatattttctgccggatagtccatgcggcgcagcagcctcatttgagcatcccagagactgaagctgggaaaacacacaggcaataccgtcaacttctgaaccgttccctcacggttgtctcaggtaagttagtgtcaagcttctgcctctaaagtgtgtttctgtatttgcctttatgctctggcacaaatcgatcatgccaattactacagaatagtaagagcacaggtttagtaagacaataaaatctaaaagtaatagttatttatgattttgagttgaaactgaatagtggttttatcttaagttggttgagttctaacacaactgatggtgtgccaataatttgcagtaggagcggctgttgcagttgtgggcgtagctgcttaccgggtttacgcagctaggaagaacgcgtcatcttgaagctctcctggacagtgatgaaatgctactctcctggacactgatgaaatgctgctattcccctcactgcccaacaacaggatagattagattatttttattgcttgttgagcttcgtaacatgctgttttctcttgcaacatcgtttatgtaaagatatatactcagttaaaatcacactggctgggaaaagggaatgtatatactcgatatgtccatgttgcgtcgcctattgaatttcagtacgtcccatgagccatttttgaactgactctaaaagatatattatagacagttctataaaagaaaaccctccaaaaagttatttaaaaaatcttccgtattgggatatcattacagaaagttcaactacacaactgtctgtggcagtctaacagatagaggaggagtgcttggtctcttggtaatttcgacgcgaatcgcaagtttgcaaccccaccagttacaaaaaatagggttgtgtttagttattgtgccaattttttttcagtatacggacacatataaagtactccctctatcctttaatataagggattttgatattttgcttacaatatttgaccgctcgtcttattcaaaaaattttggaattattatttattttatttgtgacttactttattatccaaaatactttaagctcaactttttgtttttgatatttgcacatatttttttaataagatgagtgatcaaacagtgcaagtaaaatgtcaaaatccattatattaggggacggagggagtattaaatatagactaataacaaaataaattttagattccgtccgtaaactaggagacgaatttattaagcctaattgatccgtcattagtaaacgtttaatgtagcatcacattgtcatgtcatggtgtaattaggctcaaaagatttatctcgcgatttacatgcaaactgtgcaattgatttttttccgttcacatttaatgctccatgcatatgtctaaacgtttgatgtgacggaaaagttggaagtttgaaaaaaaaatttaaatctaaacacagcctaggtaagatacacgattttgatatcattcatgtcacctcaaagtagaaaaaagaaaaacaagaaggagatatcattaatgtcatctcaaagtcaaaaaaggaaaagaaaaagaagaagaagaagaagaacgaaacaaaggctggtttagttcctaactttttcttcaaactttcaactttttcatcacatcaaaacttttttacacatacaaacttctaacttttccgttacatcattccaatttcaatcaaatttttcaattttagcgtgacctgcacacacccaaagaaggcgctcgaaacggcccgacgaggcgaaggcgccttttattccgtggaaaaagtacaccgaaggtccctcaatttgttatcgagttacaaaatcgtctctcaaccacaaaatcagatacccgatgtccctcaactaacaaaaccattcacttatcctccggtggttttgacgctggttttatctgacgtgacggctgagtcagcgtgggacccacgtgggcctcacatgtcagagtgccaggtcatctctctcctcccctcttctctcccttcctcatctctctctgacttctctccaatttgttgcgacgcgagcgacacggctgcggtgatggtggcgacgagcgacgcggcagcggtggggggaggagctgcgggcgggcagtgggggaggggcggcgggggtaggagcgccgcgcgggctcccccgccggccgccacccacgaccacgaggcggcgtgggcagcgtcaagttcggcggctccaccgcgacggccggctcgttcccggccgacgggctagtcgggctcggcggcggcgcggtctccctcgtgatgcagctcggtggcgcggcgtcgctcggccgaagattctcctactgcctcgtcccgcactccgtcaacacttcatcggcgctcaacttcggcgccctcgccaatgtcaccgagcccggcgcggcgagcacgccgctcgtcgccggggacgtggacacgtactacaccgtggtcctcgactccgtcaaggtcggcaacaagaccgtggcatcggcggcgagtttgcgcatcatcgtggactccggtacgacgctgacattcctcgacacagctctgatgggaccactcgtcgacgagctctcccgccggtgcagtcgccggatgggctgctgcatctgtgctacgaggtggccgggcgggaggtggaagccagagagagaatcacaaatcacatcgataaacatctctagaagtccatcttgttcagataatcacagtacttatgtagaaaggatagtaagatacagaaatgcaaaaataagctgtgttactcctgcaaattgcaagtgaacagaacaatctcaagctaagctgttctttaatcagaagaacaggatatgaacaagcagaatttcaagatattttgtggcgccggtttcgctttcttacctcgctatagattctgtgagagatcaaattacatgacccataaattgtagagcaatgcaggagtaacactcccagctgagaaattgattgatgtataacactccgatcttcgatcttcgttaggcgatgcaatgagagaattcagaattctcaccaacagccagcttgctagaatagagtatgagttactgatcttgaatgacctcgtgtgtacagccaacaggaagcaaaccgaacaggcgagtccggacttgacgctggagttcggcggtggcgctgaagcaggagaacgcgttcgtgacggtgcagcagcggacgctgtgcctggcgatcgtggcgacaacggagcagcagccggtgtccatcctcgggaacctttgtcgccgccgactgcgcggggagcggccggccggcggaggagacgagcggcgggcaggcgcgctgcgggagcgggacggggagagcgaggacgccgccgccgtcgtcgtccatggccgcagatctcgcgcccgcgctgtcagcggcgtcgccggcgggagtatgtgattgcggggcagcggcgggcggagcaggcgatggcgggcggagcgggcacgacgacgaagacagcttcttcccgcgtcggcgccgccggccgcctctcccttctcaagcgtcgcagccgccgccgcctcccttatcccgtatcgtcgtcgccgccgcctcccgggcttctccgatggtccgacctccgaggtcgcacgcgccgccgctggacctcctccccaacgccagccgccctgcagagaggagagaaatgagagagatcaggaagggagagaagaggggaggagagagaagacctggcactctgacatgtggggctcacgtagatcccaagctgactcgccatcacgtcagacaaaaccaacgttaaaaccaacgttaaaactaccagaggatctaaagttcgagggacgcccggtatctggttttcgcttgagggacgattttgtaactcgataacgaattgagggaccttcagtgtactttttccttattccgttgtcatgggctcattgtaactggttggcccacttgagaactggagaggcctatgttatgggccttggcttacgatagggcccacccgacggcgagccgtccgcgtacggggtcaacgcaccgagcaacggattcacaccggaccacgcgagctccttccgatgcggggcccacgtgcccaggaatccgaggcggaagggatcattccaacagctgggagatctccggcgccccgcacccggttcaggtggacccacgactccgcaactctagctcggccccgcgtcccgcggggcgcaccaacacccggaccacgcgacgaagcggagtcgtggatatgggtggcgcccgggcccaccgtattcgctgaacccatcacttcccgtacacctggcacccctacactcccgcacaccgcaaacgtaaacgcagtggaatccaaggcgacattgtcctcctttatccaaaaacaaccctgtataagacccttaacttacaaatagccccttacatcgttgtcagggaggacttatatctaaatatggataatgtttgtccttagttgaaagagtttcaaacccaaacagtggccggtggcttcccgcctctccccgcgcgttttcccgcttgaattcgttccgcaatccgagggcgggtagggctccacgtcaccgatccagctcctccttgcggtgtaaggagccgtccaattccgtcctttgcaagccaaattcctcccgccgccgccgccgccgtcttcgcctcctttataatctcccttctccgccgtctcctcccaagttccctcccaaatcccccatttcaaaaaagggaaaccaaatttctcggcgaggaggaaaagaatcctgcaatggagagcaaagcagaggcgttggctgcggcggctgcggcggcggccgcggcagcatcggcggcttctaccggaggaggacacgcgtgcggcggatgggagacgccgaagcgggaggagtgccgcatcccggcgacgctgccctgccccgcggcgccgaggaaggccgtgccggacttcgggaagaggcgcggcccgcccaagaacggctacttccagccccccgacctcgaggccctcttcgcgctcgcgccgcgccgccaggcctcctcgtgcgcttgattttgaagcttcggctgcggcggcggcggcggggagctctggtctagattaattttgggatctgtagatacttcgctatgtttctcttctgttgtactctaggtattagtagtggattagggatgggcaagaggagggtttagggagtaggaggtaggtatgtaggtgatggcggggcttgagatgaaatgagattatcagagctcataatcatactgtttttgtattccttcagatgataaaatcttttcctggcacctgcttagttgggcatttttgcactctctctctctctgctgatgttattggttcttgaggtgattgatatgaaatcatgtactcatgcagcagtagactttgattaagacctttaatggcgtcgacatcggcggcggcagcagattgttgcttgaagattgtggcctccgggacgtcgtgtggtttgctcttttctgaatatctgttacagcccacaggggaatagctgtataccggcagttcttttttttttgcttcactttcatccgcggcatctgactaggtaggaataggatagtgatcaccgatcatgttgtagtagcttgaaggtttgaaaaggtccctggttgattcattgattcataagcagtagtactgcagttcagtcttgtcttgtgtttactgcttgtaccagcaatggactcgcaaaaaccgtagttttactgctgagatagtccaggtttcgttttgccaaggaattaatacgggcgggaggaaagcagagcagtgtgtgcgttcgttcttgaatctggatgcagttaatgcggctgtgggagagagccctgcctctgcagcatggtgtgtctttgcctcctccctagctggagctaggtacggtgtaccactagtaggagaaattgcaaatgcatgtggccaatgcgtgtgactagtgtcagggcttcatgagaacaatccgtggtcctgaatcaagcaaagctatagacagaaaggagagaagggaagatcctggtgacacggacagcttcgagattctgtgaccgacgagtcgacaaggacacaacgtatgctcgccatctcgccgcggtgccgcctgttgggcgaacggcgggggcgcatgtgtggtgttgggtggacgaggacgacacgccccgtgaggccgtgacttcgtgagggcagcgagaggaggccggggagcgtacgccatacgtgcagcgtgcggggacaccgggcagaatgagccgggtgtgcaattgcaagcagcacggacatggccatgtgatgcccccacgacaagtgttgcaagtgagatcgatcgatgccagcaatttttgtttcttctctagaaaaagttttttttttgcccgtgcttgcagaatgatatccatacacctatgctcgcgataggtcgagagtagttttctcaacgactaacacttgcgacttgcgaaacgtcgatcagtcggggccttggctacaacaaggacagcaactcggcaccggccagcctcgattagtgcaggtaatttcgcccgcaatctatggctcttgacagaggcagagagttcgttgcagcaaccagtagtattatatagttaatttatacagaaagattgcacattagcacgaggaaagtgcagcaaaggaggccccctcaacaactccatgacggctgtggaaactttcgtcaggaactgttactttaccttgaagccaggcacaaattctgtcgtagaaccacatctaactggtgacacaaaagtattttgtcccatcgcaactaacacgatgagttgtgctaatctagtactcacaggaccataacgcacagtagctcgaaaaaactctttttgtcagccataaagaacacctggttcatattaaaaactagcaatgtgcagagttccatatcagggaatgcaaaggtttaggcgttgtggctaataatggcggttgcttgtgttctaatcaaacaccaacagatctccatgcaaaatgtcccctcttacctccagcctccaattacaggatgattcttctcctcgtgccctgaactcctcttgcttatgccaaacgtacttataccaaagctgacaacattcccaatatgagacaaaaataagcaattttttttcgcactgcctcatctaggtttccatattattgtccagataacccagctgaatgtttgtcacctggaagaagatgaagaaggtgccaaatttatttaatcctagttcattgagaaagcaggcctatataagcctacaccagcaaaaattaagtactgtaatacctggatagctgcttatggttggtttggtttgttaccatgccaaaatattgacactatcaaaacctgtcaagttttggctttgtcaagattttggcaacacatgtgtaattggcatatttgttgccatgacaaacaattcgtttatgctaattatatttgactgggccccaatttaacaaggcgacacaagcatgtcaagttaaatccatatcggaaaagccgcttggccaacagccttctgttcacttgatttggatgactggatgaaatgaatcatatatagaaaaaaacataaaaaaagaatgttctggctccacttcaacaacttgcacacaagctccaagcaacgtaacggcactatttagttcctttctttttccttttttctttttgttccgacaacaatctcccaaaaaacaaattcttgagaaacaaagaactagaggaaaaggttgatgaagttttatagaattgacctggagggccatgcatggttagcttcaaaggctcacaaataaaaaggcgcatgcaaggtaatgcagcggaagttgatctaagataagaaaggtgacaaataatgttgttttttacaagcaggaagcatgacctcctaaagcaagcctttcatgatccaattaggaattgatatttcaccttctatgccttctgtgaaaattaactggctctcaaagtcatatattattatgcttttttcatcaaaaagttatataggtatgcttcatagggaggacaacacactatactactagataacagcaccaatcttaacattgcagcttattacacacgcctcttggtttctttttccaaaaaaaaaacaccagaatatgttttagttaattaatatagtagtccattgtaaatcactaaattagtgtggtcatcgcatactcgcatggatgtagcaatacatctgaaaattagctgccttgccgaaaactgcaattcgatatactcaatagacagcaagcaggccctctgcactccctagccaggtgcacaaagcaggagcaaagagtggcccaatagcagtttttttctatggactcctaccaactcggccaaccactaccacgctgtgacctcccaccatgcagggcacgaacccatgatgatcccctatatagagagcccgtactcatttctcgccaagtgcaccacttcactcttgcttccaagtgcaaccacaaaaccagttcaaaagctgcgccccggcagccgcacggcttgggctgggcatccgaaatgggcactccccgtggcctacgaaatgccggctcctcctcctccgcatgccgcttcctcgccgcctttgccgtcctcctcgccttgccgacgctcaccgccggccttacccgtcactacacgttcaatgtacatctctaacgagcatgatcgatatacgtacatggccggccgtgtcgatccattcttgatgtgtggctgcattgatgtttctggccgtgttctgcaggtgcaaatgacgaacgtgacgcggctgtgcgtgaccaagagcatcccgacggtgaacgggcagttcccggggccgaagctggtggtcagggaaggcgatcgcctcgtggtcaaggtgcacaaccacatgaactacaacgtctcgttccactggtaatgccaaacaccatcgcacacattcttgcgcaatcccgcaacgtattcatgcaattcgatcgtgtgtgatcgatctcatgacgatggcaatgatatgtgcgtgcaggcacgggatcctgcagctgcggaacgggtgggcggacgggccgtcgtacatcacgcagtgcccgatccagggcgggggcagctacgtgtacgacttcaccgtcaccgggcagcgcggcacgctgtggtggcacgcccacttctcctggcttcgcgtgcacctctacggccctctcgtcatcctccccaagcgcggcgagggcttcccgttccctcgcccctacaaggagctgcctcccatcatgttcggtacgtgacgcctctcccctgtgtgatggcacttgaacttgaaattgtgacggtgtttcgtaatgcgtacacttgtgtaggtgagtggttcaatgcggatacggaggctgtcatcaaccaggccctgcagacgggagcaggccctaatatctccgacgcctacactttcaatgggcttcctggcccgacttataactgctcgtccaaaggtgagatgctctgtcctctcctgattggcccatgaattaatcacggatttgtctgtttatgtctctatgatgctcgtggcagacacgtacaaggtgaaggtgcagccagggaggacgtacctgctccggctgatcaactcggcgctcaacgacgagctcttcttcggcatcgccaaccacacgctcaccgtcgtcgaggcggacgccaactacgtcaagccgttcaccgccaagacgctcgtcatctcgccggggcagaccatgaacttgctcctcaccacggcgcccaacccgggttccccggtctacgccatggccatcgcgccatacaccaacacgcagggcacgttcgacaacaccaccgccgtggccgtcctcgagtacgccccgactcgagcgagcgccaccggaaacaacaacctccccttgccgcccctgccgcggtacaacgacaccaacgcggtggccaacttctcgagcaagttccgcagcctcgcgaccgcgcggtacccggcgcgcgtgccgcgggccgtcgaccgccacgtgctcttcaccgtcggcctcggcacggacccgtgcccgtccaaccagacgtgccagggcccgaacggcaccaagttcgccgcgtccatcaacaacaactccttcgtccgccccagggtggcgctcctggaggcgcactgccagcgccggtacgccggcgtgctgatggccaacttccccaccgcgccgccgcacccgttcaactaaaccggcacgccgcccaacaacacgttcgtgacgcacggcacgagggtggtgccgctcgcgttcaacacgtcggtggagctggtgctgcagggcacgagcatccagggcgccgagagccaccccttgcacatgcacggcttcaacttcttcgtcgtcggccaagggttcggcaactacgaccccgtgaacgacccggccaactacaacctcgtcgaccccgtcgagcgcaacaccgtcagcgtgcccaccggcggatgggtcgccgttcggttcctcgccgacaatcccggtaagaatctcggcatcacatttggcaaaatcttggtttgcatcgacttccgttgactccgaatgcagtgacgacagctagctgacatgtggtgcatgtgtgtggcaggggtgtggctcatgcactgtcacttcgacgtgcacttgagctggggcctgtccatggcgtggctggtcaacgacggccctctgccgagtcagaagatgttgccgccgccgtcggatcttcccaagtgctgatggctgatccaatggccgggccgggacagattgtttgcgaacgttttgctgtgtgcgccttcgcgttccgttgtgtttgacgtacaaaactctttgatttggaccgacttaattttaactggtgtgtgccgattttgtggcaagtgtttgggggttttgcccccgtgcttaattcctctttcaaaacagaataagatgtaagcaactcggttctgttggtattttttttcgtgggcatttgttattggtgtgtacacagtcgaatccataatgtaccagataacttctatatttaattgttttggtttttgatcatttcaatataaaaaatggcttaagctcgagagtaagaaaagcgatcacattatcttactatctgttataaaaccagccccgaaatcgacgtcggtagctaaacgcggaagaaaacgccataggagatccaaaacgacaacgtcaccgagatacgatatttggtaacggagttcagccgtagcctacatctccagggcactgattacgggcgctcctctccgatctagcatattacagcgtatcagagttacaacgactcacggtcggttgacgcaggcaaccgctccctctcgctatgctaagtcaccatgcggttacaacaagcacgcccctctatttatgagagatcttaggatagagtccgactcatactctagtcctaatacctattacaactccaagtcctaaattgtaaccaactacgtacacatattcgacacaaactctaacactatctacaattggaggaaaaaaaacgttgctatctactatacacgtaatcggagatgctataaacattactcaacatgctttttgggacaaaatcacaattatttctagcattgtgatctgttacgtgattcatgcttcagacgagctattaggtggttaggtttcaaggtaaggagggtgagggatgaggaagttcagaaatgctaccccccctctcccccttcctccacctggtttccttttttgacaccgcattactttcctattttagtaaatttatacacctaaagtttatacacctcaagtttatacatctaaagtttagataccaaaagtttatatatccgattcaaatttgaatttgaattcaaatattttttttatatatagtatttctatacatctaaagtttatagacctaaagtttatatatccgattcaaatttgaatttgaattatatccgattcaaatttgaatttgaattcaaatatttttcatatatagtatttcgatacatctaaaatttatagacccgattcaaatttgaatttgaattatatccaatttaaatttgaatttgaattcaaatattttctatatatagtatttctatacatataaagtttatagacccaaagtttataattcaaaagtttacatatccaattcaattttgaatttgaattcaaattttttatacataaatttttctaactttttattttttttaaatttttttgtggtgtactgtaataagaaaagaaggggagaagggagccgcggccgcgcgatgaagttggaaagtgtccccgacttagtgcaatggacggagcgatagtggaatcatctcagccacgagagaaggggcatgagtggtgggccaatgttggtactggggaaaactcattgttggagtcattacgaggtggtgagaggtgatatacggtgtatctaatggatggtggcgtgagggcattgagttgaagaagaaagagaagtgatgaaattgagttgtgagtagcaaatgctaaaggcaatactggcaaggcagagggcggcaaaagaattgtgacatgcggtaacggctaggagtgtaagtgggtcagccacgaacccacttatagatcaaaataagtgggtgtggtttattagactataagtggatttcgtgggttagctacttacatccctagtcacgacatatatgtcaaatgatacataaggatctattgtttcgcctattcgtagaataagccaaacgatatatttgtaaacgaaaagtaatttgtgaagaaaaaattatatgtgtgttcttagcgatctaaaagcaaagactgaaaaataaacttcaataaaatacctcaaaatcaacaccaaatttaaggtttaaaatttaaagtttagctgataagtataagcataagcgaaaagatgaggctctacgattttatttgtgatagaccataatgtaataatcttctttgattgcctaaatgaatatttaaaagcttgtagcatctagaaattatgtcccagttatgttagacatggaaattccaaattgtacttcatcagctacttccttcgtccatgaaagattgtacggacggaggaaatatgcatttactttggggcttaaacgatttgtttaacaactctaaccataggacgacaagctgttgttgggaccataaactaacaatttgtcttgttttggagctagtggctattaaaggtgatatgtgtaggctttaaacttgtactgatctatctgacaaaactgattaataactgaggcgttcagcaaatatataaagcatgcgttggcataggctaaatctttatatttcgaaaagaaaggatgtagcccaaatctaaggttacttaattaggtggacaaaagctagttaattactatgctaaaaatttgaagtcgtgcgcatacgtgcttataaattagaggactcaaatgtggagatgaacttggcattgtgagacgagtaaatcttctgatgaatttgatggcaaaagagtttcttggagatggcgcatcagtattttttttggtgttatctttttcttttgtgtttttgtgtgtgttttgtgtgggtggggcgctttgccacggccaacttcatggtatagagaatttcttggagatgcatactgactatgatgttatgccaaggcacatatacttaaaaactagctgggtggcccgcgcaattgcgcggctagcacctaaacaaaatcatatattttttaagaatgattttacttaaaatttattaaatagctatctcattgtcttaataagactttaaaagaccaaaccttatcatcctcgtgtttctaattatatagtttttaaaagtcacaccagttgctaccccttatgtcatctccttctttatttgcttgctcgatctaccactatttctattcattcttcttgtaatctttaaaaattggattttatagtttttagtgtttattgtcacattgggtttcatttttataatttctagatgtcctatcaaacgttgccattatacttctctacggcctatccactgtttcttctctttattgtcattgagattttaaaaattaaacatatttatcgtttgggttcatttttactttctagaagtcccgccaaaccgtcagcggctttgccattgtactcctctacggctcacccactgcctcccttctttattgtcattgagattttaaaatcgaacatgattatcattgctttttttttactttttggaagttccgaacctttaaaacttgaacttgtagtttcattttttataatttttagaagtcccatcaaacgatgccactatgcccctctatagcccgtccgccgccaactatttatcgtcattgtgattctaaaaatcgaacataactatcgttggaattcattttctattttctagaagtcccgtcaaccgttggcggctctgcaactatactcttaacaccgcgcccgctgcttctcctttttattgtcattgagattttaaaaatcgaataaaattatcaatggggattattttttttactttctagaagtcctggcaaccgccttacttatttgtttgcttcttggcctgcctgacgtccctccttttaatcgtcattaggattccatttggtgttttattaataattttatatgtcgtatcaaccgccaccactctactcctttataggcttgttacttaatttatctcgtcatgtgttttagatggtcttttctttcaatagtcttcatttttctcacaaattttagttatttataaattgtattcctaattgaaatcttatttttctttttctaatttcagaatttatttttaaaaaaaatttagttaataccttattgtgttcatttaatgattttattttttattttcaatttcagttgtttcaaaattgtattcctacttgaactctcttttaatttttctaattttggatattattttattttttattcgaaattttaattaatctcgtattgggttcttatatagattcttctttcaatattgcttattttaattccgaatttcagctaattttaaattgtattcctacttgaactcttattttattttcttttgctaatttcggatttatttatatttttattccgtattttaattaatctcgtattgggttcatatatggaaacttctttcaatattgcttatttttaattccgaatttcagctatttttaaattgtattcctacttggactttcctttccttttctatttttggattttattttttttatttcgaattttgattaatctcatattgggttcttatatggaaacttctttcaatattcattatttttaattccgaattccagctatttttaaattgtattcctacttggattctcctttccttttctatttttggatttaattttatttttatttcgaattttgattaatctcgtattggattcttatttggaaacttctttctatattgcttatttttaattccgaatttcagctatttttaaatattatttctacttggactattcttttcttctttttcttcgattaatgtgggaatttctagcctccacagcgaacgtggtgcctcctttcaaggctgttttaataatataatagatagattattgacgatatgttatagtgggttttgttcagacttaaaaaaaatgttagaccaactataccggttatctaatccatatacagtttctcctaattcgattcatatacagtttagagctgaggggttgtttaaattgtagccaaaataaatcttgttactaaaactttaaagaaaatgatgtggtttgaaatgccatcaatatgaacaacacataagagtctaaggtaagaagagtctacaaaagttgttttagtaacaactaaaaagaaagatcaatcgaataaagctacgctcagattgaatggttttacctacgaggaagcactttcgatcaagacctaaaagcacacacccactactgtttcccgacgcctactattttttctactccctccatttcaggttataatacgttttgactttaatcaaagtcaaactgttttaagtttggctaattttacagataaatatagtaatatttataatactaaattgatttcatcaaataaataattaaatatatattttcataataaatttgtctttggttgaaaatgttctttttcctacaaacttggtcaaatttaaaatagtttgactttgaccaaagtcaaaacatcttatatcctgaaacagagggagtagacaacataataaaatttcatctttacttaatgagttacaaccaattattacacaaattcacacaataacgagcacacaccaacaaatctaaaaaagctcgcccaaataacatgaagcaagcataaactaatatgcaccaatacaaggtaaagaccccacaagatggtgaaaagttgcataccatttgactcgagtttacgacatgcagtatttattagcttaatgtcatcatcacacctttatagttgagcctaaaaccggatccagcacgttgcccaaaaaaaacctacatataatatttgagcggtgatttgtcaaaaaaaaaacaaatcatttctcctaaaccatagaatccaacatatagcatatgctcctaaaataataagtttcatgttttctttatcaatacccacaagccaatccccaaagatatgagatgaactatgtggaggatataaaccataagaaacctgtaatgctctccagagcaaaatggcactccatgaataaatgatggatcccctcatttttattgaaaaaacaacatctcacactaatatttcaatttctcctaaccaaattgtcctttgttaacactatccctttaagcaaataccacataaaaatcttaatcttaagaggcatcttaagtatccagttaattttgttcctcccaatataagtattattaattaaagctaagtatatagaacgaaccgagtaactattttgatgaaaatttcatttaaatatttcactttcttctgtcaaatggatatgcacaattgaagccattgttatcaagtcgcccgactagtcgtgattagtcgtaaagtcggtcaagctagtcgactaaagagccatgacttgaccaaatagcaagtcgtgcgattagtcgtggttactcgtggttagtcgtagattagtcgtaaattcagccgtaaattagttgtgattagtcatagcaaatcaccaattcaccatgctaattggcttattgtgtttagtactttagttttatttcttgtcgacttattgttttgctttgcaactctatagtccatagtttatattatatacattccttagcacagtataatactagtaaagattatatattgcatccactgtttttgcatgaccaagtcgtgggctagtcgtggactagtcgaccaagtcgacaagttggttcaggggtacctcgactcgactttacgacttgacaaccatgatcgaagcacacaagttatgccaattgaccaggttatagcctactaaagctctttaaaaaacattcagcggaacagaactcataacatttgcaatcgaagagtatctccttcaaactatagaatacaaaggcaggtacctatctttaaaggaggtatttcctatccacttattcttgcagaatctgacttgttcactattattaattatctaggaacccatatttaagaatgtactcttaactttcataagtcccgacaaaaaataggaaaccccttctttcctctcaacttgatttgttgatagattatcgaagtatatttttttcaataaatcttgccaaacacattgctaatttattagcttaaacaaccatttgttcaataaacattggttttgaattttcaattataaactccaagtccaccctgattttttgtcagacatataatatcccatcatgcaagactatatttctttttatgttcatctccttgccaaaagaaacgtgatatgatatgtaataatcatttaactactaagtttttctcaattattttccagcctttgttgctaagatttccatgatatttttctcaggtatgaaagtttgagttgggctaattactttttgaacaacctcagtaattctatttgtagcaatttcgataaaaaaattaaaactaatattaagtaagcaaatagatttatattgttgaatctttgtaatctttttacacttagatagtaatataatattatcaaaataaacaactctatcaactgctgattcttgaactgcgtcgtacgcgatcgtatgtgcatatgcgtacgtgtcatcgggctgacctgacacatcgaaggcaatatggcagacagatatttgctgccccttgcccgtcacctactttcctttccctgtattctacgttaccgtggcttgatcacatacacgcaattattttgttcagaatttacggaagcaaattgctccacatgcatcattgcatcacccatttaagagtgtgtttagttcacgttaaaattaaaaatttggttaaaattgaaacgatgtggcgaaaaaattagaagtttacgtgtgtagaaaagttttgatgtgatgaaaaagttaaaagtttaaagaaatatttcggaactaaacacggtgtaatagtggggagagtacataatgctactataaacgagctgtagactatctactcgtattgttatactgtggactgcttcaacagtatcatatctgactcaagccacctgtatggctgtatagactatctgtccatgctgaacattttgcccgaagctctgtcgcacgtacgtacggcgtgcgtccgaactttcagcgaacgtgtacgtacgtaggcgaacgttgtgtttttgccacatcggagatctatctgatcgactcgtcgacgtgaggaagaaaaataaaaattaccgtaagagatctgggcgaagcaaagaagcggatcacgcatcctaggcactgtgcgttcatagtgcgtccgtacaccagcagttgatcagactccacagaggttcagagccagcacgacgagtgccgctacgccttggtcggagacaagcgccacagatgcaccaacgcaatgccaacatggctgtaatcagttccgctcttcccttcccttccctcggttcctcgcagtgagaattgtttgcagtactgttaatatagtagtagacattgacgtgtgagtctagacccatatgtcagccacgacaactgtatcagcgctactggatttgcatccggctcctcggcgaacaaaaaaaatctcgaggagaggaggcctgttccatctttgaccggccgggctccacggtcgccgaatcggatagccatgagcccgtttgatttggcccaacctggttttaatcattggccatggcgacgcagcccggcggcgagcgagctagcagtagctgatactgacatgtcagaaagcggactgtgacacacacaggagcgcccagcgagctctctcgttgttcggtcgctggagtacttggacagttggaccaaaagttgatgagcacgcatcgtggaactgcagttggggaagccgggacaaacacaaaaggcgagcgggcagcggagacaggaggccgatcgatcggcctatggacacgggactcgtcacgggtcacaccgggaagagattcgccgagatttcttttttgagcgcgagcgaatgaatgatcgatcgatccggagaagcagagcaggcagtacgctgttctttttttttttttttttttgaccgtcactacaccagatcctcacatctctgatgggatacctgtgacgggcaatcgaaatggtcactaatgaccgtcacctctgacgggttatacgggatgccgtcatcggtgaggcatccggctgcgacccgtgacaggtaactagttacctgtgacgggttaaaaatagaacccgtgtgaggttacctcacctcaaacgggtttaagtcctaacccgtcataggtgactagttacctatgacgggtcacagccggacagcccgtcagaggtgaggtttactcacctcaaacggcttttaagtcccagcccgtttgagatgacttctgccactgtatatatatgtctcctctcccagcgggacccacatgaggagataaggccggccggctccctcttctccacttctctatctcttccacttcttctctctatctctcctctctttctctgtgccgggcgaggggaggcgcggcggcgccgagccagcggggacggcggcggcggcccggccgccagattcggcaggggcgggaggggaggcgcggcggcgccgagccggcgagggcgg

SEQ ID NO: 82292 - DNA, 711 bp, Oryza sativa
taatattgatacgtctcgtgtcggtaatgatatttatgaaccactggaattaatgtggttggtttgtgtaacatttgtttttattctctctctccaaacattgatatatatccattttcgtcaattcagtttaaatagaagatctagttacttgtgttccaaggttgtgtaccatatttccctgtctgaattttgatgcatacgcgtcgggtgactagaactttcgtactactaattaattatcgatcaactagtaacatttttcaaaacatcatttgattgatcctggatttttggatgactcagtccgatggccagacacctttcttcaacctctcttttttctccatttgctctatcttcttatctaccatcaattgagctttatactaaccctgtacgtttcacttacctattgtctcctcaaccactactgattctttcctcgatgatggcaagcaccaaagaagttagggcattggggtgttgcagctaaagtacatatacatggaggccttgagcagtcggtaaactagtggcggtcagcgatgaagacgatacaatgtggagaggtgaggtggtgccaccggagctatgagtaaagaggaccggatgtaggcggtgttggcggcatatgaaattcaaagcaacttaaggagtatatattaggccatgttcttttctccaacaaaaactggatacaattttggg

SEQ ID NO: 82293 - DNA, 15625 bp, Oryza sativa
gtagttttctatgtaactacacatccacacgcacaagcacctggttggttggtctttggtcatttgatttttttttcttctaggcttgagtcctttgtaatcttatttaccagctattccatttggtagataccgcttgccaaaaaaaaaaagaaataaagaaaagtcagaaggtgcaaaaaaaagaaataaagaaaagtcagaaggtgcaaaaaaaaaagaaaaaaaaagagccgcaccaaaaaaaaaagaaaaaaaagaaaaaaatcagaaaaagaaagtgtggaatttttttttgttggaatcttagagagagttgcttactatagcgagttgtggattgtccgagtgtgatcatttgcttgcttaagctaggattgagtctaggctacgccagcaattttgactagtactttggactattattcaatttcgcaaatctgtttgatttttgctattccttgtgatatagttaagcctaccaagatccacatactactaatctttacatgtacgaccttgcaatcgctccactcatcaagcgtgtcattgtgccacgaaccagccacggtgattgacctgttttgcattctttgagaatattataagaatttggtatatgcttgagtgttgagtgccttcaaaagctccacatatatatagattgttaggaactgacactttcttgtgagtttcttttgcttgctaacgatgtcaggtacaagttccgatgaaccaacactgaagaatctagcgcataaactgaagggcatggaaaattggtatgaagagttgatgcgtaatagtaaatcatacaaggaaagcacagataaacatttaaaaaccttaagtgaaagcctggtgaaagtagtagatcaaattgagcaaatgaatcgatcacataaacaattaactgaaaacattcagaatataaatattggacatgaaaatattgtgcgacgcattggtttacttgaggctgcaggtgaagaaggtgtaggtgccactgctcatcgacaccaaagatatgacgatgaagacgaagagcaatctgttgctgatgatgaggaggaagacgagagtgttggaaatagaagacgacgtcgaattagggacaaagatgatcctttatctaaggtaaaatttactatgccttcttttgatggtaagtttgaaccttctgtttatctagactgggagctagctgttgagcaaaaattctcttgctatgattttcctgataataagaaagttaaagctgccagtagtgaatttacctcctttgcatctctatggtggaatgatatatgtggtagaggacttagacctagaacctgggatgatatgaaacgtacaatgaggtctagatttgttccttcttactatgctcgtgacatgttaaataaactgcaacttttaagacaaggttccaactctgtagaaacatactatcaagagatgatgattgctttgtcacgatgtaatttgcaagaaactgaggatgctagaatttctaggttctatggaggtcttaatagagagattcgggatattcttgaatataaagaatacaataccatgaatagattattccattttgcctgcaaagctgaaagagaagtgcagggacgcaacaagcataggagttctcttgcaggtgctacttccacacgacagtcaacaccacgtcaatctactactgttgttcgtccacctacctccatgccatcccatgctcaagaaacaagcaaaaacgcttcagttcagactccagccaagagtgcaacttcagtagattccactggacgtacacgtgatattacatgtcataggtgccatggcattggacacattgcccgcgactgtccaaatcggcgagctctatttgtgaatgctgatggtgagtatacttctgctagtgattgtgatgatgaatatgctttagctgccactgaccacgcaggaggacaagatgatgaggacatcgaggaagtccatttgcatccagagtcgctagatcagtatcctagcctaattgtcaagctagcacttagtgctaaagagaagtgtgaagagcaaaaccaacgtcacaatttgttccaaagcaaagttcttgtgaaaggccataccgtcaaaatgattattgatagtggaagttgcaacaatttagcaagtgaagagatggtcaagaagcttggcttgactacccatccacatccacatccgtatcatattcagtggtttaatacatgtggtaagatgaaggtaacccgcttggttaaaatacctttttctataggctcctaccatgatcaaattgaatgtgatgttgtacatatgcaagcttgttctgttattttggggcgaccatggcaatatgatagagaagttgtttttgatggtaggactaatacatataaatttatgttcgatggtaaaagagttgttttgcattctatgactccagccgctgctttgaaagatgatcttgcaagacttgaatgtgaaaagaaagcgaaaagtgaaaatcagattattgctaaacatcctgcttcaaatagtaaaatagaaccaagtaccacaaagaatgaaattaagttgaagggtgctttgttggcttctaaatataatatttgtgcactagatgagccagattcttgttgctatgctctattttgcaaagatcctatactcacattggctactgctcctagtactttatattctttgccacccgctattactaaccttttgcaggaatatgaggatgtttttcacgatgagatacctccaaggatggccaatggacgagagagtgcacacaatcaagaagatgggattgagtcgaggacgactccaattcaagaaggggaggatgatgaggacatcacttcgtcggatacgctcataacttcacacgctccaatgataattccaagtccaagtccaattcggcctccggagacagcactgacttcaaacggacctagcgccttcatgccaactccgatttgagtgatcttggacttcgtggaaagcttatatcgctacctttcaaacgcatctggtctcatgtccaaattcatctcgagtcaacgggaatcgccaaaacaagacagtgctgttgctgaaaccgaacttaggccttgggccttgtaatagactaggcccatctcgaaagtgtcaccctccacctccacgaattagcactgaaccctagctttattttcctctataaatagctttgttcatcctcaaaaacatttgggttttgtttagttgaattttgccaagtgccattcaccttgtctctagtcctcgctcgattagtcggcgactatagattcagagcccccaatagttggtgtgttgatttgccgggtcgattagatctaccacttcaatcgcaactattcctttgtgcttaattccctattcgcagtatttagattgcatcttatcttgttcttgcagtgttctctcgtttgcattgcagggatcatcaaccgcgcgtcacggttggtacgacatcgtttgtggtgtagcgattgcacggcgtcttggacttgttctggttggtagccacgtcgcaaacgtcgcactcgatcaaagcgagagttatccccctcaccagaagatcgggccacgagagagagtgtcatcacgctggagggcagaggcagtccattgtggtggggatctcgtccgccgtgggggctcgtaggggcattcgctgctgcctccgccacggggacctgtggaggcgttcgccacctcctccgcgacgctgcgacgcccaccgcagcagtagctgacccagaggacgctgacatgtggggcccaccatatgccacatcggcgaaagcggagaaaaattgggtcaatactgctttaggatcttttttgcatggtttgtgatagttgaggggtagagatttttggtattgcggactggggatctcaaacaaactcaatgtaaagttcaggaacatcaagtaaacttattcctctatctatctaaagaccgaaggtccgctccaaacataagagattgggcctaacttgtttgtttcacgaaggaagagtgggccaacttgttactcggttggcaaaaggcttggccttccctatctcctccttccaatcttctactgtacttattattcgttgtaatcgtgttggttttagctgtagttgctgtagctgtaactagttttccccctgcgttttgcttggtgtgcgatccgagcgcgcgcgttcgtggagtggagtcgtgtgccagcgatacgatcaggacgtgttaatcagataaccagcactaacaatgccatcttttgtggtctcctccctaaccctgctggctggctgtttccttcaagttggaagttagtcgtcatggtcacgtaccacttgtaatcttagagtggtcagacgtctgtaaactctatccggctgcaggtacatctcaaggaagaagatcgaaacaactcgagcccatgctgctcaactaggagtaattattaaggatcaggctgtgccattgccaattatattgacatgcatgttctgatgcgtgcttgcagggagatcgatctccacatccatcaatattgattaacacatctaatacaacaaggaatctttcgtcccatctggggtttgattcttcacagcaaatcccaccaagagaattttaatttcttgtgctcgatcgcttgctacggctcttgttaatttgtttactgtcgcactgcactatatgcacgagcgccatggatcgatgatgacaaaatgttatattctgtcgtctcaagcccaagatgtacaccaaacttagcgttaaataaaacagcagtcgacacacaggatgaattcagagcagttccagagaggaaaaaaaaagggcttcaaagaaaaaaaaaacgattaaggggtgttgcgagaatcgaactcgcgacctctcgcacccgaagcgagaatcataccactacaccaaacaccctttctgaagactatggtatgtaaattttaattgtattttacattttcagtctattattctaccataattcaaaatgtgaatatcatgtggctgctttacacagtttcaacatgtacatgtgattatttgtgcttactattagattcacacatgtcgatttcgactttcaagcgtccgatatgatgaacatatgccatgtcggatatataacgaaaaataaaattgagagtggttcatagcacagacaccagaaacttaaaattaagaggccgaggttctcaatactagttgtgttgtattaatttatgagtgaatctgaagtatgtgctagatatatctatgctattataaaaactgaagatatttatatcaaaattttggtacgtcatccgtatttcatttagtttttaagttagttataggtcgtcctcatctaattcgatgtgagtctagaataactatttttttttctttttctccttttctttttccctgatcctcttccaatctcttatattttctctattttcctctttttcttttctcttccaaacttctctcctcataaatatttttcttttaaaattataattgtttaagatgtgtatgctgcaaatttgttactttgcgaatgctttccaccaacaatattttttcgtaaattgaataattaaaattttaatctttggtcaataaggtatagcaaaatacgcatgcgtcaacttatggaatagccacccaatcgatatgtaaggctatagaacagtatacatgaaggattcttcatatgatgatgtatgaagcgagcttactcaatgctataaaagatttctgactttgttttgtcattgttttgtttgttttgtttcggtttgtcatttaaattgataaagtttttatcaatcgtgaaaattgttttcaactgcgcacaaatatttttgctagtatatttttaaaaaaaacaatctgcaatatgtatgcatgtcgatatacagaagttagaaacatgtcgctagctagctgtggggagagagaattgaattgaagactgcaggagatcgatattggaagggatgattggttgatgagaacccgtgatgagagaaggtaagagtatttggagggacgcacagctcagagctcacgagaccaaaaaagctgatcagaccaattacaactaaacacaccatatgcacggatggatggattttaatttttttttcatgtcatgtagattgatcatgctgcagagaccaattacaatgaaacacaccatctgcacggatggattgattttaaatttctttcatgtcatgtagattaattgatcacgctgcagatcaaattacaactaaacacatcatatcatatgcatggatgtatggattttaattttctttcatgtcatgtatattgatcatgctgcaaagcatatactatatgcatctatatatgggaatggtatggcaggatcgatgcgtacatacgatcgacgactgcagacgcgtttgcgtcgcacacaagcatcccaaatgcacccagagaccttatcatttcgatcgcttttgacgcctccttctgaaacttaattaattttcattagccaggatagtatatttaatttaatgcatgcaaggcaggcaagagatgaaataatccaagctttagtgctctctccgtccctaaatatttgacgccgttgattttttaaaatatgtttgaccgttcatcttattcaaaaatttttgtgaaatatgtaaaaatacatgtatacataaaagtatatttaacaatgaatcaaatgatagataaaaattaataatatgacaaatgatcaaacatatttagaaaaatcaacggtgtcctaaataaaaatacttagggtactgactagtgatgacaattttggcctgggtgccaagcgataagcaagcacgcgtgcaagcagtcactatatgtttgaccaacccatccttctcatcagttacgttaatcatttgctgtgactctctgcactagctacttgactgaacaaaactacacatatcgattgaaacatcgatcgatcagagacagtatatactccatccgtctcaaaatataaatatttttagactatgacatggtctccgagatactactttgaccaacaatatctataaaaataagatgttttaaataaaaagagttgtatatttgatagtttgtttaatgataaatctagtaacatcaattttacatgattgatcttttttattttttttttgctattaatggtcaaagtttaaaatgtttgacttatcattatgctaaaaaatacttatattttagaacggagagagtatatatttctgagctaggcaggagaacacgttaggttaggccgggtgacatgttctccccggcatagatagcactagaaaacaaattgatctgtttgcattttgtatacatgttgtgtaacaagacgtgttcgatgtgtatatattgattaattatcagtttattgtattggctaatgtatattgttgggtgaaagctacttgacgcggttggaccgaaagctctagctagctaatcactacgtgcctgataaaaggcgtacatttacgtgatccgggataaagaaaatgacaggagctcgatcaggagaatttaaagcagagtgatttgcaacacgtacgatattcgatatcaagctaattaattataagtaggagtatgtaattaaggctactgtagtcggtagttttccgtgtgtcgtctcgacatataatgttatcaattagaaggaaaataaatgagctaattaagcatatatatatatatatatatatatatatatatatatatatatatatatatatatatagctgagacgacgacgattctcgcttcgcttgtactactcaaactccattgctcagagtggatgatcctcttgcaataatcaaaataaaatagtaaggaacgtgtgcatgcagaacaaaacgaagaaggcaaagagacaaggaaaaacaagatagagtattagttttgtcttaggatccatcctcaggctgtcaggcaacacaccagtactgcagatcgatcatgtgcacaccccaacaattgcaattatcaataccatacgtacgacacagcaaagtactgtactgcccactgatcatcatgcatatcatcgatatcactcgttatatatatatatatatatatttcagtcccccctcgtatatatataatgaccatgcgagcttctgattgatcgatctatatatatgatcgagatgcccattacaaactagctaagctagcagctggtctctctcttgatttgtgtttccccagagagagagatctagggagagatgtcagggaaagatcaaaagaaagcagcagctttagaagagaagctcgagctctacgttctgttacaaagtcaagtgcggtacgtaatttaattaacttaattagtatccatgttataattactacatatgcatggttcggtatctctcgatcaatttgagaatatataaaatgagctatattgacttctatctacattggttacttctaatttttcctattgcaataatcgatatgttttcaccctcacctatcttttctcctaaactggaattttaaaaagaccgggcttaaaacccaaatctaccggcagcgatactgtgccaaacacactattggttcaaaaacttgtgcgcttccagttatgaatcgatagtaatagaattttctgcagcagtgagagtttaattatattaatctaaacatagcatgcatgaatgtatgattatatgcaggcaaacgagacatcaatcctcgtagatgcgtccaagtacatcaaagagctcaaggacaaggtatctcaggagcctgaacagctgggcagcactagcagttccatgccaatgccaagagtatgtgcatcgcattgttacttacttgtccatctctctgtttattttctaagctaggacaacgcatgcatacaatgatacaaagtgtatatgggtaaacaagtacaatgtgtgctaatacatctattataaactagatgaaaccccacgcgttgctgcgggagtttggtataataataagaaataaaaataatatgtaagatagttagacgatagaaacttgcataagttattgtggtttatcataatttaaatagtatatagaatgatggtccaaatttaaaagtaatttgatgtggctttatgagaggagaaaatgagggaggtaattccaaccatagattaatcatttgagggctagaaacaattgaggagatatggcttaatgagagaagagagaaatagcattaactaagtgaaaatgaattgtataggtatatagatattatacaaaatgatggagagatatattgaaatattttgagaattatgtggaatgatgatttaacatgcttggattttttaaagctctaaaatttaaaatttaagtgaggatatactatataggcatataggatattataaaaagtgatagagagatatattgaaatattatgtgaattatgtgggatgatatttaattaacatgcttgtattttaaagctctaaaacttaataaattaacatgctcgtatgagatttgagatgtattaaatgttagtggatgatgtggcatatttgtatgttgagctttaggatatagtgggccttaactttatagaaagataggatattcaaacttttaaatttcaccatcaatatatttacatcaaaagaaatttatggaatctaataattaagtttatgatattatgatagtatttttttaaaaaagcaaatatatacatacctttaaaaaaaccttcgagaattattgatgtggttatgatttatccaaattatattttaaacgtgaaatatttaagattggactgagtacaacaataatgcaaatctatttagttttccttaaaaaagataaatatatatagtctaattaacacaagccttcaccgatggagcgaactaagttatgaagaatatagctttggatcactcctcttcagcaacggagatagctcgcgggcaagtcttgtacggtgtccacgcttgggctacgttgctaccgtctccactgtagatagccgctaatacctataaaaatcagtcgatcactgaaaaacactattagttgtctgggttcgacggtggtgatagctccacaactgctcctcatgatactttaagtttatagctcatcatagcataaaatgtgactcttccttcaagttgggaaaaaaaaagaacttaatgcagcattgaagacgtatggatgcatgcaggtgagtgtttcatcggtagagctagagaagaagagaggttttcgaatcaatgtgtcgatggagaagagtcagcctgagttgctgacgtcggtgctagaagcattcgaggagcttggcctcgacgtccttgatgctgacgtgtcgtgcgcagatgacaccgcatttcgttttgaagcgtttggatccagccaagtacgtaccacactaattatctatcgatagattaagtaatttcgttgattaatttggctaattaagccggcccctttcttgtgacaacggaagaattgtactcgttgataatacttttgacttttttttagtcaaagttcttttgatttaaccaaatttatagaaaagattagcaatattttcaaattagtttcattaaatttagcattatatttatttcgatacaatgtttgctacaccgctttgcattaaaaatattattatattttgctataaactttaccaaacttaaaagtttttgactataaaaatcaaacaacttataatatggaatgtagggagtacttacataataaatcttgatgaatactacaggacggtatcccgttcgaacggggtgacaccacctgagatattatcccgtccaaataggatatcgtcttgtagcatttccctaactctttagtgaattatttattagtacttagttgttgtatttgcagagtgaagctgcagagagaagcgtggatgagcaaatggttcggcatgcagtgctgcaagccatcaagaaatgcatggacggatcatcaatttgatccagaatgaactactttatgtttagttctaaaaaaagtactttatgtttcgacttaatactcatctgccgtagcgcaagcttattgtgaggatactaaatagtatactatctatattttcagttaattttgttgtaaaaatttgctcatctcttggtgctgaatgaacaagaacggcgttttgtcgtttaaatattcgtgcaaagaatctaaattgtatatattgatcacattaattccagagatatgcatgtactatcatttaattacacttatacatcgtacgtcgtctaactaaattctaaacgaagaaaaataaaagggatattaaggcgtcttggcgggaaatgctttattggcaagcagagcgcgggtgatctggacgcaaagggcggcgttcctgacggcgaactcctcgtactccggcgagaacaccacctcctccgcgtgctccaccaccgcccccatggcgcgctccttgagcgccgcgctcgagctcagctccgccacctccagcgtccgcagcacgttgcccgcctccacccccgccgccagccgcgcctcgcacgctcgccggaggaacggcacgtcgtacttgtcgccggcgaccagcagcgcgtgcaggtgccgctcctccgtgcacgtcgccagggagcccgtgtagaggaaggcgaggaggtgggagagctcgtcgtgggtcagctccggtagcgacagagagtcgccggcgggggccttgcagtcgtcgtcgccggcgaggatgtggcggaacacctccgacctggtcgcctgtatatagctgggcctaattagtttcattgggcccaatcaaactaaaagaaggccggcctattgggctgaaactgagagagagagagactgacaaggatggccttatgggcttggattgggggcccagttccaggcctgacggcgatgtcggtgtggatgccgtctttccacgccgccgcgaagccttgctggagaaacgatgccctctgcttggtctcctcctctctgcatcgcatctgcttcacctcctcccacgcatctctcaatccctacattgagtaacacgcacaaatgttagcagttagcactatgatgctgataagtgtagtatgtatgtcccatgcacccccaccaattagcattaatctgtgactgttcagaattaattctttctgaagattagcataacaacttgtccaaggcatgcacctttatttcctcattccagctattgcaatcaaggagaatcttgtgtatgtcatgccggtttggttttttaataaaaagataacatcagctgttgaagcacactagtatataaaatacagcttctgaaaacggtctttaagcatcgatcaatcatgaaccttttgacaatgagatttccaccaaacctatcattctcatgcaactctcgattgagacttgctcctcaccattaaccaacacaacgttgacagcaaacctgacgcatgcgtcaatgaaactgaatgatgtaaccaatgcaacaagagtttatattgcattacatgtgagatggaattcctttttatcaattcattctctaccgaaatttctctgcttctagaatctagaaacacgcaaggctagatttttcatggaagtagagcacacggcacaatcgagatggttgtaaaccgaacatagtcataccaatcctaaaggactaattaataaaggagcaaaatgagatatgggaaggtcttaccttggttgtgctattgagctttgtcaatctgctgggcttcaccgagccttgatcagcatcggcgtgctcgtcgtcgtcgtcgttgaagaaggcgatgatggccttggcaccttcatagcacgcagcgcagatggcgttccttggaagcctgtacatggacgccatgggactgcacacgcagcaatccattgtttcttctggccttctccttctcctgctgcttccttctgccttctcttccttcttccttctccttgtggcttggcaacgacgtgaacagcaacgctagcattgtgtttttgagctgtggtgaggctataaaaacgaatgcttgggacgacagggggatagagaggaggatggtgtgttggctatttcgttttcagggactaatgtattgtaatgagtggtggttgctaactaagacagccaggggaattaaaattctcctgctctctctctttcttcagtacacgtttgttctccacagagagaaaaaaaaaagataatgcaaaatatgcaactcatgaatgtagtaggtgcatttagcacttttttgtttcagtacattgactaaaatggccttacgtccttgttacaaaatgaagtgcatattaatgtacagtgaacagtcggtcattcagaacattcaagttgagtcctaatcctacgggactaagagaatgccttgtcaattaagttagagaaagcatgggatttccttttaatggaacgcaacgtacaattgtctatttagcccaaggccaactaccgtttaccaaaaacagtctgttcatagaatgtagatattaaattttacttaagaattactagcgatgcaaataaatatgggagcagtagtagcagagttattgatcaatgtcgaagactcaaagtgctctctctttatacttagtggtttcttttcggttcatgaatcttcatcttgcaacttctttgaaaatgaaaagaacaaaacaatgtgatatgttttgaattttttttaagataatagaagctttattatgacttagtcaaataacaccaagatgatacattccaactgagcccatcccgacctctgcataaaatgcacacagccaataaaaggacaaaactaaatccccatcacgaaacataggtactagtgactatcaatccgtagactagatcgtcacccttgggtaaaagcatcccgtgccacctagtccaaacgtcgagataccactgcaatagtatcccataatcccgacttgtggatgatagcccagatacatagccacagagtaactagagtaataacctatgttttgaaaatttttggcatgatattttgttgtgcatttccttgcgagaaaaaaaactgtgatatgttttgaaaaaaagatggcatgaaaatttgctccgcaatagtatcccacaatcccagcttgtggatgatagcccagatacatagccacatagtaactagagtaataacctatgttttgaaaatttttggcatgatattttgttatgcatttcctaaaaaaaactgtgatatgttttgaaaaaaaaaatggcatgaaaatttgctgtcctatgcgttttctcgcaagaaaactctgttttaatatgaatactatgcatattaccaaggaaaggaacacctgaccaatatagttgaggggacaatactgtcttttcctctcaagatataagtagacctcagaagaacataatctgaaattaactcagacaaaatgatgaattcatgattatataatgcgtgaaggaatcatagggagaaggttgataaggactttccaaccttataagagactttaggtatgaagtaggagttggccggaggcatggagggtggcacggccttggctaatgtgttaacaagctaaccacttccctcccactcctcacccaacggcctgtgttcgatactataacaaagcagaaaagtatgatatgatataccagagaactagatatgatgatttaaacaatccattttgctgctaagagcaggtacaataacaagctataaaccggctgcaaacatattttaatgagataaaagataagagagaagagcagcggactacaaatctgtagccagctgcagcacggactctaagacataatgtgtgtatgacagtgggaccatatgctaatagtatagtaagcaattattgtataaattgactattagattagctatagatgaattggagctagtagttggctgtactattaaccttgctcaccagaagctggaaggatgttcctggcttcctgcaattactgtctcaggatgagctagcaagctataacagtacaagtagtaacatagtagattaagctacttttcaaaatggttttactgtaggacttcttaataatttgattgtagcaggaacaaacatatgcatgaggaatagacagccctgggcttacagaaggtctacactagtggggaattaaggcagtcctgcgcgctcctgcaatttgtgttgataaaaaatggaaagggtgaggacaaatttggcgggagaaacgtcggggaatggatatatatgttggttggcacataataatccatcatatatatcctctccatgattggcctagtgtagttgtagagtcaatcaatgaaatggatggatgtaagcatctcattctcattagcaagcttattaaggatgcctccatttatcctctcttcaagagaattcttaaaatacggagagcacatt

SEQ ID NO: 82294 - DNA, 694 bp, Oryza sativa
actttctctgctaatactttgtttcttggtaggattcaaagcctcatctcattgttgccccaaatgctggtatagctgcatatcctagttggattccaactattgtaagtataaatgttcttgattagcaacctcctcccattttggatatgagcatgattggctatgaatttccttgtgatactaccactcttaacttcacaaagttgacattgttccagctagtttcatgctaaagcatacatctggaacttaaagtgtattcttcacaaatcgcaaatcatccctttatctcagttgatgatattcaagtaaaaatcgatgcgtttaattggtcatcttttcttctctaacccagacaattttcaacagacatgttatctatggaagaaagtgttagcattatattgtcctcatgtgaacttaaattaaaaatacaccacactatgacagctttaactgatgattgccagtataacacagtatactctatgtcttagcttgtaacagacttccattttttgtgctcattctattcaattttcattgaaggaaataattaggaaagttgggattcctgcaattttcacggacttctgtgaagaagctgcacatctagcttcgtcctgcattacctccataactggtcaacccctcagagtcccagtatgtgttctgttcttggctgcaggaa

SEQ ID NO: 82295 - DNA, 21139 bp, Oryza sativa
  unsure (1)..(21139): unsure at all n locations
accagcctctgttatttatacaagaagaagtgccctgtctgagtctgaatctcaaatagatataatagcaaatgctcgtgctcccaaagcggcttctgcgtcaagccattctatccctattaagactagaatagtagtcagcatcagcataaatgttgaggtgcatctcgctcacccattgtaaggcattggctcgcctgccattttgctgatagaaccaaccgtgtcttattgtgtgagaatgcaagggcaagggatatatatatatatatatatatatatatatatatatatatatatatatatatatgaaccaaggttcatatgcacccacctcgtatggctgacacatatgcacattgcactatggatgagtctagttcattgtgtactaatgcagctataatatatacctactccactctgttcctatacaaggctgcgtatgcatgcttgtttgcttggtacaagttgacttgcttctatgcttcccaaagccccccgcacctgcatgccacacctatattctgacaccaatgtcatgtcatcatcactacaagctaaaaatctcattcataaaatactttcggctctttttgttagttgtcatgtctactgggtatatgatttgggggtatatcgcttattcgcttgccacggattgaaaataaaaaaacatgtggttaatattttacagatatatgttacattctaaaatatgatttagttacaatctacataaaaaaatcaaaataaacgtccactcaccaccaaaatatgatatttgcatagaaatgttattttgcaacgtgatgtataaatgatattgcaaaatgatatatcacttggcatttattataaacttaaaaaagtaaatgactggtgttcctacgaatatatgccattgcatcataaaatctattttttttccaattgtaattaacatagtaatgtaatataagccaatacatcataatatctaagtttatgagaatatatataacttttccaattgtcattaacatggtaatgtaatctgaccaagttgaccacggtaaagagctaattttgagatttgataatagcacttgacatgtgaaatcgaatagatctattgcaaatttgataatagctctagagcaactaactagcaacaattgctcacttaaatatacaaataaatgtaaaattaattttccagagtgaatgtcagatcctttgtccgagctatctttcgaaaggctttcaaaattatctccacagttttgtgcgccgaggtgagttggagtattgatatacaatcaagtaaataaaaaacaaattaaactagcacacagactaaaccctgatcacatccactgagcatgccatgtccttatttatggaggaatcagtgcaatgtcctgttggtcaaagatatcagtgacaagacaaaacacggcatgcatgcccagtccaggcttttagtagggtgaaaagaaatgtgagaaaaaaatatgtttggttttattggaacataatatcaaagttgaatgtccactcaccatgaaaatacaatatatttgcaaaaaaaataacatttcaaaaatgtcattatgcaaaactgatttccaaaaatgacaccgtaaaaagcataaatcacttggcatacagtgaaataaaaaacatgtgattgttatttttacatatatatgctacacccagacataattttttctataatttatggcctatatagttaatttttttataatttatggcctatataatttgttgctggaaacacaacataatgaaaatatcatttgcaaagtgatgtcaagaataaaatgatgttgcaaaatgatagtatataacttgacatgtattgtgaattaaaatatcgcatgagtgaagtttctaaaatggaaattatgctacattctgtgaatatcaagagaaaagaaagagaaagaaagaatattcaaatggaggaataaatgctacgattagcttcctttgacttgctcttactcagggagtacatggcctacgtcagacctacactagcattgactgtgcgccgtgccggtgtactactgtgaaacaacgtgtttaacccccacagtgagcttcatgagggcaagtacaacgggtcggcgatacccgtcgacatgcacttttttttttgcgaaacccccctccccacggtgctcgcttcggcccatctgtcgtctcgttcgtcgacgaggccagcgcgtgctcccaggcaacgcgacggcgatgaagcccgttgtacgacgcgatgcggggaggcgacggaagcgcgggatcagctctctcgcgcgcggaacaggttcgcgccttcctcgcccgccaaaatctctctcgcgcgcgttgaaatagcccccccccccctgcggccccatccaaccatatttcgatctggccaccatgtcgcggcaggcacggaaggaggcggcggcggcggcgcaagatatgctgaagttggatgcggcttggatgcgcaagccagctgcatcgcaatcttgaaagggtgcgatggcactgatgcggaaggcccagggaggagctcgggcggtgtcgatggtgccggagcagagcagttcagggttggcggcgcatgtgccagagcaccggagttcgggatatggcgcggctagtccaccaccaagctccttcaccgactgcagctacttcttctaagatcatttcatatataaatatatataattattatatacatgtttattttacaagtcatgcggaatatttaaatgtactgtgcattgtcttatgtatgcaacaaaatgactacaaagatcaattatacactagatcatcatgatttgtgtgtcaaaggatgaattaaacactctacagacagccaaaccaacaacccattgtataagctgtctgtttaagctgtctatttgtgtaaaaagacagcaagctgtctacacggttgtacttgccctgaatatttagtgcatactaacccatgtactagccgcacgcatcatgagaacgatggatggctaggattcatggagcatatggaccaaggttcacatctgagttgcataatatgaaccaaggtgcatatgcacctatatgcatagtttgacagatgtacctacctgattggttcccttcatagtggcggtaaggaatggtacatgttatgatttttatggtccaaaatggccctcaagtagtactacagtagttcgaatgaattttttttgtggttttcctttttttttcaaagtaatgtcctaagtttatttaatatgttgataaaaacatgacattatatttctaaaaaatatataatgtagattcattacaacatattgtgagataattttgttatttttttacaactttagatatgtaattgatattttattcaagaataatgtatttccattttccccctcaacggtggtattatctttctatgggcggactttgtgttctctttggtttgcacttgcaagaatttttttctcacagttttctagtcaatgcaagttttgggtttagatataaattatttttaaaatgctatttagagatgtgtcatttgcaggttttattttcagagaaatatcattagtatgaacattaggagaccatttgcacattttatttagagatataaaatcattttctaaatgctatttagagaaatgtcattaacaaatcatttgcaaattttatatttcatacaaaagaagatatatgatatatcagtatgaacatattcaataaatcttaatatatattactcagctacaaagtcaagagagataaaaataataatagttttttatatgtacgagtacaaaataaaaatttgctttgaatcaatgaacgtctcgtgtagtgacatactagtgcaaaaggacaatttgggacaaactcaaaatgtgacagtggcattgtgtaccttccccgggtgtacatacacctcctctcatccaccgtccatcccaaccagcagcgatcggatattccatctgcgaataacgggtatggccgtataggatccgctaaatattctaaaattattgttgaattagcgatggataattaactaactattaccgcttatatatatagttgatgtaattcagcatgcgtgcagtgatgaatcgtcagtgtgcttagtttgatcatggctagctagcttattagaaagagatcaaaccactgatgaatcggtcaatctgtttgggtcggccgagattgactagggtgttaacaacatgttaaggtgttcgatctctctctctctgcgttctgaacctacgtacggtcgtacatactttggaactacgttctgaatatgtatatttcacccgagttgaagttatagtggtcgtttaattgagagcagaagttgaacggagcaatgctgaccaagccattgtggccactactgccgtcctgtgcgggttgatcgatcgagcacgttgagtaaatcataggtatgatgccatttgacacgactcaaatgcgttatcactttatcaggatgagcatattgcagccgccaccgtagactcatcaagcacaactatatagaaacgattttttttacgagaaccctataggttggttatagttaaacttctcgcccttgcaaaaatcgttttccaagaaaaggttcacgggccttttcgcatacggccccataagagatccgtctctgaaaatagacttatttttttagacgagccttttaagagaccacatgtaaaaatttattttttttaggagggggctcttaagagactgcatgcgaaaatagattttcatgttttctcctgttctctccactgcatctttcctctcccactgttcttatccactcatcctactcctcttatcttcctctcctactccctctcctcccttcctctccccttcccactccagcggctgaggcggggacggcgggaaagagcgagcggcgtcagcggcgacgactactgcgacgaccgagccgaatccaccgccgccaagcctcaggcgtgtggatccgtcaccgccaggccttgggtaagcgggatctgccatagccgggcctcgggggactttgaccacgatggcagcggccttaagcgacaactacgacgatggatcccggcacgacggcagcagcgaatttgacacggtggcggcggattagggtttatgtattgtggatctagggttttttgttttgatttttctttttgccaaattatttttgcgtgcggacggctcaagtgtccacctgtgaaaattggattttcgcatgcggctgcgttgacggcatgcaaaattccgattttcttcgcagacctttaggcacaggcgggtcgcccgtccatatgcaaaaaaataacttttggccgcatggagaaaatatttggtagtagtgaacattgtgaatcatttgagaaagtttacggcatttgaggacgtaacatattttctaatgtgcagtttagtttcataatacttttttattctagcatttattttatttagaatacttgtcattctcacatttcaaagaacttctctccctgccctccttcatcaatgcagccatatatcaatgaagtcatagctctcattattagctcatctcaatcaacttattagatcgactggtttggaaaaatagttataatgtacttaatgaggatataaatataattttctatatctcttaattagttagagagtacctcatgaggatatcatttttttcctgaaaaacaaaattaatggattggagattttcctttctatattacgacctaatcacttttcctttttgtctgtttcttttcaccgattgtgttttttttcaggcgcgcagcaaccctttttttttttacttctgttttgtttttctctagccatttttttttggaacatgcacgtgaggggaaggaggatgactccgctttttgagtagtagagatgtactccctccgtattatgacgctgttgatttttttataaacatttgacctttcgtcttattaaaaaatttatgtaattatcatttattttatattgacttgatttatcatcaaatgttctttaagtatgacataagtatttttatatttgcataaaaaatttgaataagacgaatggtcaaacgttggttaaaaagtcaatggcgtcatatattaaaatatggagggagtaaaaaaattagtacaacgtaagaacactgctagcatagatcatttttcagtattccggattgcagctcttgcttcctaaaaaattttcagtacccaaccataggttataagagcatcaccaacagattatctataattttctcctaaaaatttgttttttggtttcctaaaccgaaaataggaagtgaaaaaactcctccatccaacagatagcctaaattcaatccccaaaacttaaaagtaggcccttctgttaaactaccaacagaaaattccgtttttttttctttcacgcgcagaaagatcgctatctcccacacgcgggaacgaaggagagaggcgggattgcgtgattgggagcgccttccgcgcccacatataaacggagcgaggaaccaggagaagggaacttcaaaactcgggtaggagagtaggggatctgttggagctgatttttggactaaaatccctcaaaatcagttttgggaatcatatagggagactgttggtgatgctctaagagatttttgagtttccacccatattatgaaatatactcaagagagttttacttatgaaaagaaagaaagaaaatgttacagacttactagcttaaagtaaatacacacatatataatagtattcattattcaaacaaatttacaaagaaacttaattataagaattatctgctactgctacatgaacagatacagaacaccatgaccctcttctactcacttgagagttagaggcatatgcttctaaagaaaagataaaaagactttttttctagacttgaccttatgcaattatgcattcttacaacacccaaacaaatcgataacaaaattacaaaacgctataaaaacaataaccatacttgaaggaacagagaccagaaccagaaccatggcactctcgttctcttagcgatcgacattctcgtttttttttttcagaccgtccacagtagtgctaccgtagaaaagaacttcagtgagaaaagtaggtgacgaacagcgccgcgaacatgagcaggtaggcgatcgcctgatcgatggccttggcgtcgatcaccctcgtcgccggcgccgccgccgcgccttgcgccatggacagctgcatgaggccggagaggaagaaggcggtgaacagcagcaggtacaccttcagggtggccatcttgatgtgtgttactgcaaagctacctgaaagcctgaaactgtcttgagtttttaagatcttggaagcagctagagatgatcaggctggattgccaacacttttcttctgatgtgtttgtttgtggcaaatgcagacgggttggtaggtatatatatatatagatgcagacatttaaatatatttgtaaatctccattcaaagttgatcaggaccttgagattcaggaattatgcagagatgcatggtgaatcggtcaatctgtttttctgtctgtttgggtcggccgagattgacctgagagtgttgttgaggaggtgttctctctctatgttctgaactttggagctatgtacatgcttgccggctggtgtacatttttttaaggtaatgtttctttctaaaagataactagccaaatacccatacattgtaatggattattgaaaatagctaaaattaagttctcgttgaaaaaactgtcttttacttggttgaaacgagatctttcatcttgaaaacgaaataaaaaaaataccatgcttaggattgcatttctaatgtgagaaatagacgtttggttttcgatcagcacttaaatatagatcgatcacatgctaataagtttgtgagattttttcttaatcgagataaagcgacagaaatatgcagtatatatacaaacaagcatcatggccacttgtcaatattggtggtggtggcaaactcactaccaccaccaagaattacaatctttttaaacctatggctcatttagtataatttacataattatgcttttatcttataatttttaatcttcatagttcaatttcaatagatatttagggttaacataaacttacggtgcaaacactaatattttgacactaaaggagacaatgcatttatttaagtatatttctaaatattcattcgaagttgataaaaatctacatgtccgttaagtctgagtttccggcacgtggtatatattagttggcaaaaatctatatatatatgctcagtttacttacaggcaaagatcgatcgatccgtccgaacatgtgcagttcacacgagatggggtgtgtttagttcacgctaaaattggaacgatgggacggaaaagttggaagtttgtgtgggtaggaaagttttgatgtgatggaaaagttggaagtttgaagaaaaagtttggaactaaactcggccatgaagttagagcatctccaacagcctccttatccccctctctaagttaaattttagcaattttggctcaatttcacactccaacagactggctatcgagctggccaagccatccggctggccaaagtcctccttccactagccaaatttgaccaaccaaaatagcctagccaatcgtgggccccacgccgacagcatccctctcccctttctctctccgccaaccgtcgtcgtcgagatgccatcgctggtgctgtcgaggtcgtcgttgccagacgccgccgtcaccagccgtcgtcggcgctgtcgccgtcgccagccgtcgtcgtgccgttgccagatccgcgaggtcgtcattgagccgtcgccagccgtcatcggcgccgtcgtcaaccgtcgtctccgaggtcgtcgttgacggacgccgtgccgtcgctagctgtcatcgacgtcgtcgccaaccgaggtcgtcgtcccgtcgtctccgaggtcgtcgtcgcctgccatcgtcatcgccatgccccggcggattcggccggtgcggcatgtagtagaggacgccgccatctcgctcctgccgtcgtgttcaccgcccacgccgattggccgccccgcgtccacgcgagctcggcccgagcggcggcggcggcacctactgcaagctgagcagagtgggtttggggaaaagggggagagatgaggaagaagaaagggttgtagagaccaacacgtgcgtcccactgtcataggctcataatagagagtatgaatggagaggctgttggagtaaataagagtttgactgactaaataagatggagagttgaccaaatagacatttggagagttagggggtgtttgggaaagaggggctaaacacccccttagatttagagagacggttggagatgctcttagttgtttgagagtagaagttgagcagagcaatgctgaccaagccgttgtatgtgtgtggccatttgtcgtcctgaacgggttgagcacgttgagtaagcattggttacagtgtcatttggcagttgacacgacttaaatgcgttatcgcgcgctttgttggatgagcattgcaagccaccatcgtagactcatcaacattgtaaaccctttaagaaattttacgaggtagcacatatatattttttatataaaatttagttcctcaaatactaggatacgagaaggatgtcattgtttttttaaaaaaaaatgttacctcctaaaatatttcttcaagagaaaatcactcaaatccttttaacattttacacagcgggatcaggtgggtagattccaccgtgaggacacgagccaattaacataaatttggttttgctagtgattttttgacgatgtttcggaatagacgatgtacagctcatgccgtcgacgtcatgcgtaccatgaacatatatgcggccttagttaaaatgacgaaggagtcttccccgcaaaaaaaaatgatgaaggagtcgaagaatcaatgaatcatgaaaagctgaaaatatgctcggtcgattaattacattttttgcactaatattttgttgactcttgtgattcccccttttcaacttaattatactctttcgtatcctacgtgcagtttcccgagctactaaacagtactcgctccattccaaattgatctatatatttcatgggtacaccaagaccaaaaaaagttaataactctctcatactatatttactctatcaacaaactcaatgcatgcactatccccactatttcctagccaatagcaaatcaagatattgtatgtgggttataaatgcttgtgtgcatggatgcatgcatcaatatccatttactccaatgcacaaataacgaatagacctaatgaatgaacacaaatatgtagatcatttagaaataaactaaaaaaactatatgtagatcaatttggaatggagggaatatgttttttattaaaaaaatttctatggaaaagttgtttgaaaaatcatattaatttatttttaatttttttagctaatatttaatcaatcatgatataacgagtcattctgtttttcgtgtggaaagtataagttcccaacacatgtacaatagaacacagccctaagcctaaccctgaaggtactgtcctccttaagcgtatatgacttaagagcaagtttaatagtggagtagctaattattggctattagcacatattaaagctaacatgtataatatgttaacacatattaaagataggatttattttttttctatcttatctatttctcttactatgaatttaatgtaaatatctaggagcatgtgtatagctagctcttgcataaaagccaacactcctcacttttatttatctctcttttccatataagcttatagttagcttataactcagtattatccttactctaagttttactatagaaaatgactacatgaaatttaaccaaaaaaaacaattacttgcatgaggagtatggagagttaccacgttttatagtgttaatccataggagtagtacatttttggttatatatagtacattttgtatctcgttgaggaccataaaaacactcttaataatttaaacatatgtaacaacattttagtatgtacaaacactgcttgcatagatcgttttcgatcagtattttggattgtagttcttgctttgtacaacatgttcagcatccaaccctagaccataagcagatttttgagtttccacccatagtacgaaatgtactcaagagatgtttttctatgcaaagaaaagatgcttcaggctttccaggaaacagtatatgcacatacattattcaaacaggtttacaaataaactcaaactatatgagatatctgcttaattacattaagatatatcatatatctgttcctgttttgaaagaaaatgtttcagacttaccatcttagagtaagtggactgtctaaaaatcattcgacacattttgcttagaaaatctgtcagattttcaagtcacccaaatagctacgtacggctgagatgagaacgggcgttaatcacgtgaagccataagttgatggaacaaatatagtagtattcaaacaaatttacaaagaaacttaaattataagtatctgctattgttacatcaacagatacagaaccatgaccttctttaactcacttcagagctagaggcatgcatgcttctaaagaaatgatagacttttatctagacttgaccatgcaattatgcattcttacaacacccaatcaaatcacaacaaaattacaaaacgctaaaaaaaaaagtaagaaccatacttgaacagagaccagaaccatggcgctctcgttctcttagcgacaatctcatctttttttttccagaccgtccacagtaatgcttcagtgcgaaaagtaggtgacgaacagcgccgcgaacatgagcaggtaggcgatcgcctgatcaatggccttggcgtcgatcaccctcgccggagccgccgccggcgccggcgccgtctgcgtcgccgtggacagctgcatgaggccggagaggaagaaggcggtgaacagcagcaggtacaccttcagggtggccatcttataacctgtaattactgcaaaatcgatctaactgaaagcctgatgaaactgtcttaattcagttcttgagatcttggaagtagagatgagtctggactctggatgatgagtttgctaacactttgtgaattgtgaatgtgtgttggttgtggcaatgcagacggattggtatgtgtatatatagctgcagaagaagcagctagagtcagctaccactctgatcaacctgccagtgtgctttgtttgatcatgacttgagagattcaggaattctggtgaatcggtcaatctgcttgtctgcctgtctggatcgtcaggattgacttggagtttgagacctctctgtcacacgagatacgttacatgtgtgtgacatttaattttcagttcttgacgtgtcattgctgcgttagctgggccggctacgatcttagcaggacgagtgagtactgagtggatgattaatttttggggattcagtttcaacttcgatgggctggaaaaaacggaaacaccacttttgccgtttctgtcaccactaacgactaatctgcatggttttctctgtctctgcggctcagaattagagttggtgtcgtgtgatttcaagtgaaatgagaagtcaaaaaatattctgggttggacgatgtgcatgggaagtcgtgattggtgaccggcaattgcacggttttggaggaataacgcatgaaaggacggcgttagaaaacggcacaacaacgttgaccttgggcctaaacagtagtagtgcggttgatttgggaaaacgaatcggtttggccggctgcatggcaaagtgcatgtgagtgtggatgaaaaaaattcactgcaaagtgcaaaagccttgagaagtaggtatatatcgttaaaaaaaaagcatctctgatttaacccatttttgtggggttgcacattgcactgtgttattcatttcagattgaataaataagaaaaaaagggcttaagtgaatttctttggtggtggacaacatgcacaattgaattactgcacgtgaagctcgataagaaatatttaaagtttaccacaaaatttaattaaaattttgaaactttgaccgtcaataacttcttaattgtgtatttaaaaatatataaattgtgttgatggtatacaaacttgttaggtggtgtaatttactacataaatttatgaaataatcattatggtgcacggacttatctagtgcttctgaactaaatctaaaacgatttattgtgactaattatgtttcttcacctgagagggataaggatgtagtgagagattggattttgttgctgtaattgtgcttgtaacttatttatttttaataaaatctatttaacagtaggggcctcccctgctatgttcttgtttaaaaaaagttcgagtttgattaggatgtcacacgcataattgaggacatgagacatatcttaagtgtaaataacctttatatatatactttatatttattttgtttttattcattatttgtatccattgcattttccttttatatgtttttttctctgtttatatacctttttctctgtacactcaacacaacttattcaatgcttgatttggtatatgtttctttaaaacaagtaggagctctgctattttaattgatagaagggaaaaaagcacatagcattactaatctcataagaaaaatggaaggcaacaaccaaaaacacgaacctgcgtttattttactgaactacgtacaaagccagagccattttactaactgatcatatacataatatcctactcagcgtgcaatttagtgaaattagttataacatatttttttctttctttagtttgcatacactacacaagtttttcaccgaaacgagcaatttacaagttcacgtattaccttcgatttatattataagtcgctttgaattttttttatagttaaattttgttaggtttgactgaagttatagaaaaatatagtgacattttcaactaaaacaaacatactagaaaagtatatccaatgttacatttaatgaaacttattggtgtcatagatgttactaattttgtataaacttagtcaaacataacaaaatttgattagaaaaaagttaaaagggcttataatataaaacggagaaattactaaattgcacactagtctaataaagtttgtgtaccgacagtacaatttattcttaaaggattcttatgcgttgatttaccttgaaaagcttatttgaaaattgatttacttattttaatataaaattgattatgataagcttattaaggtttattaaggctctgtttgctggccatggttgggaaccttaccctcccgcacggaaaacgaagcagtccattagcatatgattaattaagtattagctaaatttttttttcaaaaatggatcaatatatttttttaaacaactttcgtataaaaactttttacaaaaattgcaccgtttaaccgtttgaatagcgtgcgcacggaaaacgaggtaaagtggttgggaaccctcatgaaagaactcagccttaactttatcatcgtactgttttatgactcgaagcccaagggagtatttgtgaagtcatctgctatgatgggctttctggccatgtgaaaataaaggaataagttcactttgtgaccctcaaaagtgattaaaatctaatccgtgaccctaaaccacaaaaccggatatcttgacccccaaacttctaaaaccggtgcaatttgactccctcggtggttttggagggcggtttcactgacgtggcgccacgtggcgcctacgtggtgatattgaccgagtcttcattccacgtggcgttgacgtggcagcgaaattaaaaaatatgcgtgggacccattagtcattcaaaaaaagaaatgtgggcccactgacatgtggccttccttcttcctcccccctctctcccttctctctctttctctccccttcttccccttctgtcgacacgcgggatggcaacaagagcgagcagcggcgggcggcgaggccggagctgcggcggtgggcgggagggcggcgagatcgagcggcggcgcgctgcgacggcgagggagctgcgctcggcgggagagcaagcggcgaaggaaaaggacccccaccctagacaccgcccagcctggagctgcgctcggcggcgagagcgagcggcggcgacaagtgtaagcacacgttcggtttgttttttttcttgtttctttgattcgtagccgaagttcataactgaattttccttgtttcaggacgacgtttaagaggatcctgaaggccaaatcgaccgagcgattcgatgggctcccttacctgttctcgctgctgaactgcctcatctgcctgtggtatggacttccctgggtcgccaatggcaggctgctcgtcaccaccgtcaacggcaccggagcggtgttccagctcgcctacatttgtctcttcatcttctacgcggacagcaagaagacgagcgtaattcttcccatcctgcacctaattttgtcttagaaaaatgtacttgtagactgcagtactagattgctactgtagtagcctagtgctgtacattttcagttttgtctgatggcaatatgccatcaagaaaggaaaaggatggtggagctctgcgcgctgccgccgccgctctcaccgccgagcgcagctccaggctgggcggtgtctagggtgggggtccttttccttcgccgctcgctctcgccaccgagcgcagctccctcgccgtcgccgcgcgccgccgctcgatctcgccgccctcccgccgcagctccggcctcgctgcccgtcgctgctcgctcttgccgccatcccgcgcgtcgggcgaaggggaagaaggggggaggaagaaggaaggactgacatgtgggccccacatgtcggtgggcccacatttctttttgtgtgaatgactaatgggtcccacgcatatttattaattccgctgccacatcaatgccacgtggaatgaagactcggtcaatatcaccacgtaggcgccacgtggcgccacgtcagcgaaaccgccctccaaaaccgccgagggagtcaaattgcaccggttttagaagtttgagggtcgagatatccggttttgtggtttagggtcacgtattagattttgatcacttttgagggttatcaagtgaacttattccgaaaataaatggaataagttcgctttttgtcccttatcctgatatcgagtttaaatctagtctctgaatattatcggatataacacatccctcatctttcaaaacagatacaaatatagtcctatgataatattgaatgtggttttaggtgatgtggcactgacgtgacacaagaaacaaaattaaaaaataaaaaaccatgcaggatccacatgtaagtaaaacaacaatcttctttcctatcaccctctcattcaatcaggtgaaggtggtagagcaaggagcaaccttggccccgacaatggctgcgacctcaatgtcatcggcgactcattccggcggtacggttcgcggagggcaatgttcgctagctacgaggcgaaggggaacgtggtcaccgactcactgtcaacctcacctcctaccaaagtttaacgatgtaggacgaaaccacctccaaaaccatctgagaagtcgatttgcaatggttctagaagttagggaacgggttatacccggttttgcacttgagggatgcaatccaacagggacatgacttgtggaggcaaaatagacttattcctaaaatattctcactggcttagtttggagtgttaaacttttctcgcaggccaaattattaaacattttacgtggccaagttttcacgggccacacatggcctattaatgtatactggcagtctaaacttcagcctttaaaattttcgcatggcctatttacgataagaattttcacacctccatcctcatattccaaacctctcttgcaggaaaatttttccaaagacaggaatcctcaaatattcccaatgaggccttgattgcagttgcatatatcatgccttaatttgcaaaccatggtttttagctttttggtctcaacttcataaaaagcagcccttaatgctcccagatcaactccttttccatttaaacccaccataaatcccctgccggtaactcccattaccgcaatataataaataaaacaagaacaccaccattcactcatctccttcagtttccacattcttgacaccctctggctcacaatcccattcagccatgcaagaagataacatcagtaagaaagccaagctgcgaaaatccatacagctcttcctctcaagaaacctcaagaagatcccaccgattcacatccccagctcagccatccctgcgaagatcaccagcaaccgcctcctctccacctgcaggttccccagaaccccatcgctgcacggcggcggcggtggcggcggcgaccaccgcaccaccgacgacgacgacggcagcaacggcagagaccaggcggcgacgctctccgacgtcgaccgcttcctcttcgacaacttccggtccctctacatccacgacggcgacaaccatcagcagcggcgacaaccaccaccatctccggggaaattcacacagccagcagcggcagagacatcatcatcaaggtcagagtcggttgcagaagacgcaagaggaacaagctcgggtgatgaagacgacaacaacagtagtacggccataatgctgttctccgtggatccttacacggacttccggagatccatgcagaacataatagagatgcaccatggtgaggaacctcagccgttggactgggacttcttggaggagctgctcttttattacctgcagctcaatgaacaaagtgtgcacaagtacattctgaaggcgttcgccgaccttactgctggagcccatgtcagctgcccagcccgtgggaaaccgcaatgggctgataagagtgtccggagtaggaaacactattagggcacaagattgtaatgtatttgcttaaattttttcactcgaaagtactgagaataataatgcacaaaatacaaatccatatcgtgcgaagccatgtaaactcatgatgtaaggtacactgcacataaaattagttttacaactcccaacatttttaaatatgtgatgtcataactttttaacatccgtatgaaacaaaaatataaaaaatataagtcatgttcaaagtacctttaatgataaataaatcacaacaaaatattgataattatttttttaataaaatgaatggttaataatatgtgtagaagccaatagcgtcagattttttaaaaagagggtgcggaatgctggttaaacagtcagaaactcagaataacctgaaacacatcatctcaacagaaaccataaggtaggttgggaatgattattgaatcaatttctgccataacgaagtattccaaatgtgtattaagctcaggtttcccataaaaaatatcaaaagataattacattcaagttattgatttagtaatttacacggacctatatatagagacgcgtgggcaattcccgtcaatccactctagtttagctaataatgcagtttcactcgcgatgaagaaaatacatgttttagttaacctagtagggtacacatactccactatctgcaacgcactggctggcatgatacctagtggaatcggataatgtatattagttaacaaaactgccagggcattagtcacttagaaaactatgacatcagttaactctaaaggctttacatttcttcttcaatgccccccctgtcccagatgatgggaacaaattcaacagaactatttgaattgaccattaaagcctcgagggcacaattatgatatgagaagcacgggttgcattttaccacagaagtttccagaaattgatctgcaaatgcaaacggtggtcagaaactcaaataatcctaccatcctaatgaagctgatcaataatgaaaggggccattcagtacatatgggagataaaaggaaatctagtcaatttatcttacaaacatttgtagggcatcaatgcaacggaagctcatcctattccaggcttaataagtgtgtaaagatattctatcctactctttcttgctccacatgttaaaagaaaagatatagtttgcatggcccagataaggaacatatgaaccaaataaatacaaattcttgatatctgctgtattacagagtcaacaaaataccactggataagtagccgatattaaacagtcaataaataataccattgaataaatagtacaaagcttgaaaatcagcccaaataaaacctgaaatttattcaggttggccctgaaccatgaatcaagggtgcagaatcattctgaatgttggcctaatgacatctaagcatacacagtgtaacaaaatactgcctccggttcatattataactcgttttgactttttttttctagtcaaacttctttaagtttaccaagtttatagaaaaatatagtagtattttcaacataaaacaaacatactatcagaatatattaaatattagttttaatgaaacaaatttggtattgtagatgttgctaaatttttctataaacatggtcaagcttaaaaattttttactagtaaaaaagttaaagcgacttataatatgaaacggagggagtatgtataaaagaccagtaattatggacaaccccaaaaacattcgaggtgtttttgcatttggaaggtcaaagaatcttttgctgaagcttaatgttctcacaatatccacttctccttggaagtcaaaaacaatatcacattcaaaaacacaatgatgtgcacatcacagtgttttcaagtcatccgattagtcgcgactaatcacgattagccgtccttatctctaccctgacctcaatcaggaacttcaaagcaattagttcaaccagaaaacttatcgtccgactaatcacgactagtcacgattagtcgatcaaattagtcgtggacgactagtctgttagtgctaaaaatgtgttggactttacacttcagtggcaggccttttgcccagcccaagaaggcatgtacccctcatctaaccctaaccagccatctagatctagtcacgagagacgggagaaaagatgaaggacttattgcaactaggataggtaaatgatttaactttaagaccttaagtcaagtgtgaactgtaaactctgaaaatctgattatccttaatatttataagcatctatacattatcctgggtacccctagcctatagtcaccgactaatctacgactagtcacgactaattgcgattagtcgactagtcggagcccttacgactagtcccgactagacaacttggaatcactggcacctcaataatgatataagaacattccgttgacaaattatgaaataattccatatagatgataattagtagtgacatcatcatgtaataaaaatatactccatgtatagaaactttaaacagtgaggaattattaggcatagtatagcttaatgttcatgtaattagaatgagagtgttacctttaaatagtgcagcaaatcatgtatttggcacagtatagctttgaacaagctgctcatataatgaaagatgattcttaggaacaaaaaccctaaacctgtacgcacaaaaccataaatcaggcatagtaaaggtgtgagtttactttcagctagtagagaaacagatgtaggtttacccttcaagaagtgggagtcgctctggagacgaaaacagttttgcacaagattngtnggtccaccattgtcataccg

SEQ ID NO: 82296 - DNA, 20140 bp, Oryza sativa
cgcccggccagagggcggcaaggggccgcctgcaaaatggccggccccgattggcttttttgcattcgggccccttgctgccccaccagaggacggcaagggttttcctgcaaaaaaaaccctccctccgtcatcgcccgttcctcccccgtttgccacgtcagcttgccgccccagaggtgggcgacagggtctatttttgtaatttttttggccgatagattatttctgtaaatattttaaaaaaaaatctaaaaccgaaaaaaattcgtgccatgtctgggccaccattttgggccgtgcaaggagcaccagaggctggctggattgggggcaacgctacgaccgtcaggcaagggctatattatcttcgttgccttgcacaggctcttggtagtaacctacacccagaggcttattttagacatgactgtcacgtcgattggcgtataggttcccaaatgtgctagggtttagcgcattctcttggtagtttcagccttttttaaccagaatacctgacaaaaatatcaacaagcaattttgcaagcattaggtggtttcttccataatctcagggaactttccatcccagggaactggggaggctcagagaaggcccccatcggttggctttttttctaataagccaaaacggcttattaagaaataaaaataaatttataggtaaaatttatatatatatatatatatatatatatatatatatatatatatgttctttgtaatttaaaagccaatgctgaaaaagaaactacgttgaaaatatctcaaaatcaatctcaaaattaagtttaaaaatttaaaatttagcttattctttggtttattggaccatccgatgggagcctagctgtgctcagctctatggtatgcttcgtccgcaattctcaagttcagtttctcagcattctgtgcaaagttcattttcagtgggtgcaatggaagacccattctctaaaagagctgcactgaagtacactgaagaaattaaagactaggtaagctacctagcttgtgatcatccgttgatcacttgctgaaattaagctgctactctttgatcatcatcagacatcagctgtgggtagcttaattaagatcgacgataatggcgagcttgaagcttagggcgtgcgtgcttctgtccaccgtgttcttcttctccgggctcatgcagctgtccatggcgcaagctggctcgccggcggcggcgacggcgacggcgacgacggcgcgggtgatcgacgtgaaggcggtggatcaggcggtcgcctacctgctcatgctcgcggcgctgttcgtcacctacctagcgcactaactaactaattactccgtattatttattttaagttcgctagaaaggggcatgccaaatcgtgtccttgttgatttgagcactgtaaacatgctgtataattgcataattatttcactgtaagcatgcataattgcacatggcttatataattatatggagataagttttcaagttgttcctatttgaattagaaaaatgtttcatgtatgtttgacagttcgagttgtcaaaacttgtaaagagagagatacgattctatgcacggagacagctcccgggtaggtatgttggacagtcatctaggatccatcgctgctgtctcgtactacggacagccttcgacatgctatagtcatccgggcttgatggtggttggctccgctatattgtgttcctgttattttctaagaaattgttcttctatttgaatttgaatgtttgtacgctcacaagatgtttgaagtgccttttcccttggagaaaatttttttatgtttaaaaatacaagtatatataacttgccaggcatattaaatcttcgtttggaagtgcattcccttaacttttctacggcatgtaaaaagagacaaacgattaacgcatgattaatcgaatatttattattataaacataaaaaatgagtctatttgacttttaaagaaacttctatataaaacgtttttttaaaaaaatgccatttagccgtttgggagatatgctaatggaaaaggaagttgcatgtcggaaacgatgaaatgaatggggcctaaaccatatatatactccctccatttgtttttgtttgataggatggggtagtattatattaatgatcttagggttgaatgttgcaacatgcatatatatagtgtatatgtcttttgggttgcaattcatcacttgcatcaattgcaattcttctcgttcaaattaagatgcctgtggttttgtcggaaacttggaagaattgattctggggtcaaggattgcatgaagaccatacattccgatttccgagtcagccgtcaaggtactaaaaattgacgttaatttaacggaccaactattctgacctcacctggtttatcagctctaataaaaaagaggacagaaatgcaacccaacttacctaaccgtcaaggtacctttcttgcttgtatatcatatatatcagagaaaaatctaccccaccatctgtcttaaacactagcctaaagcccgtgcgtcgcaacagaaaacaaattaaggtttttgcttattaaattaattaataatcacttatttagtctaagtaatattatgatttttcttattgaacaagtgattttgaaatttaggaatctaatggtgaaataggggaggacttgttgaaaggtggtgtaataatatagattatagggcccagttttaatattgtggaaataaacaccatcgctagtcgcaatagtataaatatgaatcttagagggcatatagttaaacctcaaggtgcaaaggccgaaaaatattccatcatcttaaaaataaaaggttaaacctcaaaatctaaaaccactaatacagtttaaccttaaaaacggattcagaatgcagagccaaaatacagagattcacgtatcccttaattaagaaatggttgcttttttggacttataatcatacatgtgacctaatcaaagaattaatcttatggtaagactattgtacctacttctaattttagcgacccaaaagtcaaaacttgaaatattaggaaaaaaaatcccttaaataaatctaaaattaaatactaaaactcaagtttgctatggcatataagcagcaaaatccttaacgccaatgcaaatgctgtcgaatattaccaggcatactcaaattaattcgatgacttttttttactttacttaactaggtaataaaataaatactgttggtcaaatttttaagaaaatgttaactactactccacccgtcccataatataagaaattttaggtttttgcttgtactgtttgatcactcgtcttattcaaaaaaatttggaattatttttttttttgacttactttattatccaaagtattttaagcacaacttttcgttttttatatttgcacaaattttttgaataagatgagtggtcaaacaatgtaaacaaaaactcaaaattctttatattatgggatagagggagtacaacgtatacttacaaacggaggtaatattttacaatgtcggtaatcacattattgggcgtgcctgccctgcgttgcagtacggaaatataggacagaacagcacgacaatggcccggtcagaattgttctgctgctctcttattaacgctgttccttctgaaaattctgcaataaatttctgtctcattgtatgatagagtctgtatccaactatcaaatacaaaaacaaaaaaacatccgagtatctgcctcgtgcgagaattaattaaaccagacgtggctatcattaattaattgtagtcattagagcacagttagtggccggcttgcaagtagtacgtacgtagtggagtagctccaaattagttgatgaaataccttctagctagtcaatctcgccgagccagactctcacagactgaccggttcaatatatcatctcctcattcagtttctctcctcgagtcctgatcaaaccaagcacactactgacaattcatcgatcgatcactgcgtgctactccgaaagtccgaattgcatgtagaaatatatatatatatatatatccatattccttcccctcgcactgtgggagatcgagtcagacacgtactactgcactagagcaaaatccattcgtcttgaaactattattattattattattattattattcacttaatcagaagatggcatgctgttcttcttcggtccaggctcgtcgatggctatgggccaaataggagatcgcatagggcctcctttatgtggcccatataaacatgaaggcccacttccaattgctcaaccatagcatgcaacaaccaatagctcaataggcagatcgattaacaaggccaagccagggggtggggcactactaggctgtgcgatcgtctaattttttttggccctagtgctggctgctgtgcaatcctaattccacgccacactaactgccgagatgtcgatcccaattccacgtgtggcgaccggcgacacagcttgttgcttgcgactctgaggctgcagctacctcgcctcggttagctcttggctcctgctttccccctcctcgtccgctcgtcatcctcgacttgaccctcgacagttcatcctcagactggtaagattagacttcataatatgcatcaaattaccactagtttatgatagattaaatcaaattatcatgttatgggtatagcccatcaacatcgtgtccaaccctaaaactgtttatattttgaggcaatattattttctcttgctaatcgagtgtgtgcataacttagaaatgaatatggtatgttttgatttacagaaatgaatgccaaaccaataagatgatttctgtgcaacaaaagttattgtacaaaattcctactttggtttttcttcttcttctttcggaaaaaaaaaacatggctcggcaaaacaggacatggaattttcatctgactaatggaaaccaaaagttcggtagcatatcacgatgccctgaaatgcgtggcaaatattttaagaagtttcctgttgtttctatgagtgcttatatatctgcctatatcatccgttttcaacttgagaccgtcatgcattcgtcctaatggtattgctcagtattcattcttgcatctggctctggccatttatcagagaacacaattaaaacaactccagtcatactgttaatgctatgttcggttaatccccaagagagagggattggaggggatttattccacacctattgtggtgtggaattattccccctcaaatccctccaaaccccttcaaccccttccataccgaacaaggcggtcaggggctcagggcacagtaccccgttcgaataatccaacctgctttgaactttgaggcacattttgtacgatttcaaacgatggcacatgagttctatacatccatttctcaacaagttcaaccaaacaaggatcagatcatgatcatcagaaccccttttaatctgcaccatatctcaccccacaaccaaactacatacaaccacaccaagcagcagcagaattaaggagaaaaacatccgaaaacactacacaggctgcagcattcatggtacatggtacactctagctatagctgctgcttgatttgatttatcagtaccagggcgagtccgggacggcggtgatgacggtcttgacctgcaggtacttgtccatggcgaccatcccttggtcccggccgaacccgctcatcttgtacccgccgaacggcgcgtcggggtcgaaggcgaagtagcagttcacccacaccgtgccggcccgcactgacctcgacaccatgttggcaatgttgaggttcttggtcacaatgccggcagccagcccgtacttggtgcagttggccttctctatcgcctcctccaccgtcctgaagaaaaaaaaaagttcagatcataagtcaagttttcagaatgtttttttttgtttgttttggagatgagatcagatcatcgaaacttgtgaggtttttgagtactgacttgaacttcatgagggacatcaccgggccgaagatctcctcttgcgcaatcgtcatttcctcctgcatggaggatcaacccagatgagcattgttgatttgatttgattgtgcttctaaatgtaagctggttaccttgacatccacaaatatggtaggctcaatgtagtatcctttgtcaccagtgggtttgccacctgtgagtagggttgctccctcgttcttgccgatctcaatgtacttgagaaccctctcaaattggaccttgtcaacctagcaaatgaaaacataatgttcataagttctgatacaattgtccattttgtcatctcaatgttttttcttccattgctcgcatttcgacagaaaatgtttcagaacaaaaatatgaaaatagtaggataatattacctgaggacccatattggtggcagcatcaaaagggtctccaactttccagttcttggcagcctccacggccttcttcacaaactcatcgtagatcccttcttggacatagacgcgtgacccggccacgcaaatctctccctgaaaatttcagacgccagtagcacggtcagtttttttttgctctgaagttcagagtctgaactgaacactcctaacctgaacatttctgaaccttggtccggtgcatagtgcatttagttaccttgttgaagaaaactgcaagggatgacagactgacagccatgtcgacatcggcgtcgtcgaagactatcatcggagacttgccgccgagctcaagagacacattcttcaggttgctccgcgccgccgactccatgatggcacggccgatttcagcagagccagtgaaagcaacctgacatatgcacaacaacatttcggtcagaaactcattcagacaaaaacctgaaacgctacagtaccagatggtgatcggagtgctcacactgtcgacgtccatgtgggaggagagtgccgcaccggctgtcggcccgaatcccgggacgacgttgatcactccatccggaactccagcctgaatgatgatatcaaaggtacactgaattatcatccaaattctagaaaatcaactcaagaacaagaagaaaagcaggcatgaaaacaaaagggtggatttggtttgaacattggttaccagcttggcgaggtgagcgtagtacagagcggagaggggcgtctgctcggcgggcttgacgacgatggtgcagccggcggcgagggcggggctgaccttgaggaagaacatcatggtggggaagttccaggggatgatgacgccgacgacgccgatgggctccctgagggtgtacccctggtacttgccggccacccgaagggactcgccgtggatcttgtcggccgcgccggcgtagtaccgcatcatctgcgccgcggcgggcatgtcgatgatcttgcccagcgtcagcagcttcccggcgtcggcgccgtccagcgccgccagctcgtcggcgtgctgctccaccaggtcggccagcttgttcatcaccctgctcctctcctgcgtgacggcaacattgtttgtggattttgtcggacaagctacagtaccatacagtaaattggacgaacttgtaaaatttggctctgaagaagatcatatgggagtggaaacacgtacatagcctgacatgcggggccacttgccgtgctcgaaggcctctctcgcggccttgacggcgaggtccacatcagccttgtctgcctctgcgatgtgggccaggacatcgcctgttcgtgggtcccttgtcttgaatgtcttgcctgtaaaaatcaaatccacatagaaacaattacatttgtccgttttcgttcttgaaacaagatttaaggagatagagattaacattttgagtttttccatggtcctttgggtgatgtcttttagtttatctctttgcaccatcatttttttccttagtagtaatatagggccagacctttgagattagctgagtgggtggattaagaataaagcacaggctaggcccatataattaggggttggctcgataggtggatcgagaataaaatgctggaccctaggtggaatgatggacagagaacagaaggaggacgactgcacttttaaagtggtagagataactattttcagttgaaaaagtatgacttgatttatcacgagagtgaagtatccacttcacacaaacataagaggaaaagaaaagaccgtggcaaatatttttagaaaagttgaaaaagtcaaacactttaatagagtgaacattatttccattcttgtaaaccctaattttgatattaccttcgtcccgaagtaattgtaattctaaattatcttatcatatactctctctgcttcatattataaatcgtttgacacttttcttagtcaaagttgtttaggtttgaccaagtttatagaaaatattagcaacatctacaatgccaaattagtttcattaaatctaacattgaatatattttgataatatgtttgttttgcattgaaaatgttactatatttttatataaactcggtcaaactcaaagaaatttaactaaaaaagtgaaatgacttatatatgatacagagaagaaaaactatgatgtctctcattcaatggtgcatatgtaaaagtgggagggtgcttgagagtaaaatatggaggaatttgaatgggaagtgattgatgagataatttgtactttattacgaaaaccatttgagataatttgaattctagaaatataattattatgggacagaagtggtacaagagtacaagacactgatcaaaattttcaactttgatcggttgcaatggccaatccaaatagaggaagaacaatttgagatttttcaaagttttgtaccgacaggaccttcttggtccatcttttttttttttttgaaagcaaggtccattttgttagtggcacaatgagggaatgccgaggattatgaacagaatcccacgagaatggaagatatttatgactagtcaaagctgttccctctcaccatgacgtcatgtctacgtggagccacactcacattgattccctttttccatttttagggtggatatttttctgagggcataataaatgctggataatttgttttctcttgtaaataaataaagctattccccctacaaagaaaccaaaatttttttaactgccttaatttgcaatcgcagtgcacgccacgtttggccacttgacgtacgattcatggtgcttcatgtagtagctagctaataccctctccgatttggcacaattgacatttaaacataaccattcatcttattttaaaaaatcataaggttattatttattttatcattatatatatactttaagaataacttgtattttttttatgtttacacacaattttaaatctgacaaatagtcaaacaaatgtgtgtcctaaaaagttgttatatattaaaatcggagggaatagctagcttgtcatgtgtgctgtgctggccggctgctaatgctagcttagctaaggagataaacaaaaatatattctttattatttgtagatatctgtatagctgggagcgagacatatagaacgtacacaaccgttttgacttggcttcgatctggcctcctgtttctacggatgcaaccacgtctaagagtcaatatcatgtgctcatttcataatgccaaagtacatgactcatgcatgacgcaaaactttgtttcattcatgctttatatacttgtgatgaatgatgtaaaagaaaatatataataattaagagaaaataaataacaccgaattaaaaaaactataggaattacgctttaatttagttaattaactacttctgatgaatgatatatatgatgcaaaaagaataaagagagaaagaaataacatataaaacactataggttatattattgcaataaattaaccaccagcagacatggctacttacgtatatggtaactgatataaatgatataaatgtgtggtgtaccgttagtacaagggttcatggacatggatggtcgtttaatgttttgatggaggcagcaagaattccttttttttgtttaacgaatcatgagccaccaattttattaaatagaacaggagaaatttgtgaaaatatagtacagctagctagatccagagcagttagattctttgcccccgtaaggtttaagttttaacctcctctttaattttcagtattagatcggtcgtcgagagttttccatgttggaacatactctttctttcattttcaggagaccgcgagaattgaagagaaagctagctagctagcggctattttcaaaacaaaaaaaacaaaacaaaaaccgcctcagctctatagcaacacgcagtacatcatattcatacgtacctacatatttgtacattatattcatacacgtacgtacctacatatttctctaatttttatgcaagaaatcgagcatgagttaactccaataaattagttcgtcaacagagtaccatcatatcgtttgcattccatgctcgatgttaagccgttagttttccttgggagagattttgatcagttggctgacgacgacaacgacagtgcgtatacggtaaaatactaatatacgtgacaaaattgttcataactatatatatatatatatatatatatatatatatatatatatatatatattgcaggattgttcataactattaatttgtagaggccggttaaatttatcatattttccaaagaaaatgtaaaaaaaaaatggtacggaattgtcgagagcttaaatagtttcctataaatattagagacagttctgaattaagttgtattggtatcatattttttatataaactttggtacttcctaaatatcctaagtactggtacctcgggtatggtaaattaaatttctcgtatcagatagctggaaagagaatgggtagaaacacacataaggatgaaaaattataatcaaagacgatgaaacgtgtagcagtacgcctatcttgtaaagaaaccatgggaattaattaattaattaattaattaagttaatcaatgacgatgaggcatatatctatgtattacccgaggcggcgtcgacgaactcgccgttgatgaagagcttggtgaacttgatctccggcaccaccaacccgccgccgccggcggccgcctttccattgccgcagtcgccggtgctccccatggacgacgaataggctcttgatctctagttaattatttgtctctaagcttcgagagatgcctatcctctacttggtcgtcgtcttgatcttcttctatctatcttatagctagctggctggatggcttcctctcaacaaggagaacagtagatctcttggacacagcagggacgactggcttgatctttatatagacgatgacgacccatcgtcccaatgcatccatcgatcgtgccaggctatattggctgtacctaggaaaagcacctcattggttggacttggcccaattcttctgttcaatttttttctccatccattatatttttatatatgtgtgtgtgttttttttactttaacaagatctttgagatgctatcaataatatttataaaaataagttgtttaaatgaaaagagttgcatagtatgttaatttgtttaatgctaagtcgagtaatattatccatatacatggttgttttttttttgctattgatagcaaaagttaaaaatatttgatttagctttatttttaaaaatgcttatattttaagatagagtgagcatttgatgtctctcatggctgttactatcaaacattaatcaatcattgtacttaacatctatcagtttcagttttgtgttataagtaaaatttttgtaacttaaatcaaatttacataaaatatgcaaacgtttacaatatcaagtttaactgaaatctactgtgaaacatgtcttgcatagtgtattcatttgggaatgtagatgttacttacttttttttccctatattttgattgaagttaaagaacttttaattcagaaaaaaactaaataaatgttacaatatggggaactttttttagaacttacaatatgtaactgaggggggtattttctaacactagcttccatgtgcagattagttaactatatggtcaacagcttcaccttaattcctgtgccaccggctgctgctattatgtagtagtagtatgtgatggttttcgttcgcacgtccagttgcatgtactttacaagataggcgtaccgcaacatgtacactatagactacttatcctcggtcgacgtgtcttctcctgcttcatatgtttccgccggttgatgcttttatatggactttcttctagagacaccatatttctgttatatcatgcatgagtgttgtctaagtttctatatttaattagtaaactaactggattttgctaagaaaattgcatggaccaaggtctaaatttagttggaagtaatactgtattaatttgatatatacctttgtttctatttctgtaaatatatacagctgtattttgcgagtaattttatcacctttgaaaagataggggatatcatattttttttatataaaacatgatattcctaggtacttaatatctataggtaccaaaatttttaattttagtgtaaaatttgttacctacatgtactttctataggtactttcttaagtaccttaaaatttattttgtttatatgtagagtggtcaacctaaaatgaacggtattaaatttttgtcctttaatttgttcttgttaacgtattaatttggtggattttaggagtagtgtacttttggtcttttttttaacaaatactataaacttacaaatggttagaatatgtcgaatatactagtcctactagaagttggatttgaagttagaataggtgtaggatacagagttagaatcggattcctgtcatatgttttctttaaatagaggggagcaccacaatgtaaccatgtcgactacaatgtgcgtagacacgtcatggactcataatggcttagttgccatgttgattggggagaagcatccataatcagagctctggagatatgggcttcggttgaacctcgttgacaaatatcgtgagttcttgtgtcttcatgtaatgtgtcttgggtgatcaatgactgaagtgattgagaatgttagtcgttgttccgctatatcaactaacttttataacaagtggtatcaaagccaaaggttttagcattttgatcaagaagacatgtgaaggaggaaacacgaggtgggatcatgcatcggaaggagatcatcaatcatggcaacgagatagatggtgacaacgaggatgttgtggaggcgaagcttgtgatcaaaccagggatggcagaacgtgattggaagatgaggctggacatggccgtaggtgttctgagatatcggaggggtagtgctacgaacgacatgcctgacgcacgcggcgatcgcagatccgcgacggcgaggaggctatagaagaagggcgaagctgacgaacgtgatgcggtgcggtggatgtgcagggcagaggacgatgaggtcgtggatggtggacacgagggctgcgactgcggtacgtgcagaggcacagactaatggcatagggtgttgtcctatgcatattgcttgcacaaagtgatcacccagcaagatgtgtggtagaggtgtgtcatgtgtgcagaccagaccgagctaggtcagagctagaaggttagattgcaagcaagcaatcataccgtgggtaataggacgttcggatcaggttgaaaaaaatacccgggcaacagtgggttgaattcgttgattcgtttggcagtacaagatatatctaagatatacgggtcggcatgataggatatatgaaaatatgtgtcattaaagaggaagagcaaaggttatcgtgataacttgttcaagtgattcaaggcaatattgaattttctcaaattatcatggatttggtctacggatgcagaaaacatagatgttggattttttagctcggttcataagataataagaaagaaatggtcatgacatcaattttatgcatatacaggcgcctgggtatttgatttggatttggaaaagcaagtgttctataaaatttatggtttttggttggcttctcttaatcaatcgtttaaattaatacctatgacatgcttgatagaagacattgtccttctgacaattctgatttagcatgtgtgctctgttcaacccatgcaagagaaaccactttacatattttctttcagcgtccttttagtgctgattgctgggctcggtttggtattgtctgggacatccctctcacctttgaagatatgctagctagctacatcaagcaaagacttcctataggtcttcacattttgttgagaaagttctttatgcagcgtggaacatttggaagcaaagaaactcactaatctttaagaatatacctccattagtttcttatgggaaagctttctttaagattgatctttcgcttttagtttttatattaaatgtttctgagagacaaactctttcacaatggataaacctcttgtaaatatttttttaatttttattaataatttttttactgtgggggtttcccctacagtatttctcctcaaaaaaacaaggaagaaatggttctcttcaatagtccaatgagtttgatttgtttatttagtgatgacaagagctatctagtcatggattagataaaatcaaatttaagacagaagataaaggtgaacatggcctttgaggagtctagtatgagccggttaaggaggagttcaatttgagttggcaagatgactaagatgataggtgggaaaatggaggactactgcaggcagagtccatatgaagaaattacagggataacaaaagtctcctaattgttatattgattggggcctactacaagctatggactcgtagcggcttagttgctatattgatttgggaggagcgcgagccccggagatgtacgctttggctgaatctcgttaacaaatatcgtgtgtttctgtgtctttatctggtatgtcttggatgatcaatgactgaagcgatcgagaaggttagtcgttgttttgctatatcgactattttttacataatagggttaatacaatgaattaataagttcattttacgatcttcaactggtgaagcgtggaaattaaatttggactttaacctcgcatgattcaatcctcggaaatttcaatccagataaaacaataaaaattgactgagatctcaaaattctgaaatgagtttcttgtaataactggtaaagtaaacttccagatgggaaattccatataattgacccacaaaacttaaaaatctttcactgacgtacacaacctttttccaactttgggaactttcacggaacacacacaaacttttcggttggccttatgagacctttttagttcttaagccatgaatgtcaagagattcaccttccagaaagcgcttataaagaagaaatgggaggggcattacaatttgagcccttggatcaaagttcatcagagcaaggtgttcttttcttctgaagatgaaaattaagttttttatgcaaaacgaggtggtattaacgtatggttggttaagttttaattattgcaaacttgaaaaatagattaatatgatattttagagcaacttttatataaaaagttttcgcacgaaacgcaccgtttagcagtttgaaaagcgtaccatgaaaatcttaatattaatctaactcttgttggagaaaagaatgggacaagcagtagacaagtttaatttgatacaagatgcaacctgttgaatgcaccatatatgcacagcaaggttcaagcatgcatgcgttgatctgttctgagaaacctcctcttgttttaattaattacgtggacaataccaactggaccactggtaataccactggtaatatgaactcaacacattcacaaacatattttaaagattatattagggaatttcacattttcaccttctaaatatcaattaaagaaatgataaatcatggccactaaatttttcttggtaagtacgtacacggaaatgctggttagagttctataaaaaaattgttacttaaggtaatactcttttcatttttataatatctgacgctgctaacctttttacatatgtttgatcaataaattttacacaaacacagcaagatataagtcatgcatgattaaaaaacctttaatgataagtcaagtcataataaaatataatataattatgttaattttttaaataagatgaataattaaacgtattttatcagtggtgttgtgtattaaaaaacgtagggattacatcatataataagttcaagttaatcaagggcatcatctggcattttcgcttatatatatatcttgtcacagagtaacatcccaagacaatgatcgactcaacaataagacggtcttcaattctttaattatattatctccatttgatcgtttgttgatcgaattatatcgcatgccctcctgctttggaatacaaatactctacacaattcgactaacgtgactgccaaaaccgtcaaatttaatttaaattagcgatccataatcgatccagacaacacttgcttgatggacaaccctacaattaactaatacattggacgagccgggacccaatcaattaataacttttgtctaactgagagctggttgcctttaagcaacgcgatttgtacatgtcacgctatatttgttatgaaatcatcatgagagctacgctctaggcctctagcttaagtttcgtctaaattatcgcgtaatcagaggttgacttggggcataattatagcccaaaggatgaaattagcttaccttggcacgtcattatctcagcatttgatagtactaatcattttagagttagaagcacttttctcctattacaaatagtacttcccctaattgttttggacaagcatctaatcaaaccttttaaagttagagtatcaatttattttaataaatatgtagattgagtatatgaaaatcatacaagatgcatgctctttgcctcaaaaaagtactttcattaaaattataatttaaatggattttataaacactttacaacaagaatcagtagttcagtagtcccagagtcatagaaatatattgttttgaatgtcttaaatcaattttttaaaaactttaaacatcaatgctttctaaatattgacaccatatgcatgaaaatcatatacgtagatttgtcttgaaaattattttcatagtattatgtgtttgtcatgttttgtaaataaacaaatttcactataggacatccaaagattatggtttttgctattggacactagtaaaacatgaatttggctgtacacaacataaaaatatggtaatttaattgctagaggacatcatgcacaaccattaaactgtaatatccactcaatatgtatgttgcccctttcgttcttcctcaccaccttgccacctgctaggtttttgagagtgagagagcatagagggggtagggatacagtctggttaaaaccaaacgtacttgcctcgttcacacggatgggagtggcattatagtcatcttaaaatatctctctgctcaaacatgttagaaatggtaaattaactgacacggtgttctccagcaagttatcatgtttttaaggtgtcctcaagccgaggctgtttggttgataggcataagttgccacactttaccatacttgaggttaggcaagtttgaccatgttaaatgagtgtttggttggctcccacaaatgtgacaagattcatcttttgtaatctaggtcccacatgtaagtgactctaaaagtgtggcatggtttcattttgttggttagagtgtggcttggattttgatggcatcacctttgacaagtttagctaagaaagtatggtaaatctaggcaatgttagtatatgaaccaaacagcccctacgttttgatagtaaagccataatctttgaatttcttctagaaaattttgccttataaatatttgcaatagaaattagtagtaatcttgttttacaagggtaagctagtagttaaagttgtgttttaaagatattgtcaaggtaacgaaatgtttccttgaccggagtaaatagttaaagttgccatgttatattatgtattgtcgaaataacatctagttgtgactgaagggactatattgatctgcactttcaatttgttagtccaacttccagcagacttttaattggaaaacaacagatctctggaccactgtatcgttgacaatcgatccaagggtggtcttctgttaatcagtcacgatcagaaaagtagccttttgggatgctatacatattccaagttttaaaggaaatttgtaatatcttactccaatttgcaagtgtcctcttgagtatcataatcctaggtcctagctagcttgtttctagcaaattgcatatgaccaatcaatttcttatttgtcaacgaggccgatgcacctttatcacctcaaaaaacagatttgtcaagatttcatattactgccgagtaatagaaaaagtcaacgcaaaaaaaagtcaatgtgtcggtgtcggttagcgtttgatagtatactgtcattaacctttttcttatgggtttacgtcagatcatcagacaaagaaaaacacaccgagaaactgaaatatactgtctttattccgacaaattgatatttgatacaagcaatcaactaaccacaaatataacccaacctttcagctgtatatatagaaatgttatttttttccactgtaattaatctttctgtgctgttcatcatcagatcatagccaaggggtgttgtagagaggggtgaccaccgccttggtgtggaggtacttctcaagggcgtccatgcccatgtccttgccgaagccgctcatcttgtaccccccgaacggcacgtcggggtcgaagccgaggtagcaattgatccagattgcccctgcccggatcgaccgcgaaaccgtgttcgcgacgtcgatgttcttggtgactatgccggcagccaggccgtaccgggtgctgttcgccttctggatcgcctcctcaaccgtcctgtgcaaaaatgttcaggatccagtggtttcaggctttcagttagatgttcatgtgatgttagtcaggctggaaatgttcagaaaaagatgcctacttgaatttcatgagggccatcaccggcccgaagatttcctcttgcgcgatcgacatttcttcctgcgcaaaaggggtctattagtttttcgcacgatttggaaatgtgcatttttgttctctttgaaaatgctgctggtcatattttagcactgaggagtgaagagcacactggtcatgttcatgccttgacgtccgtgaagatggtgggctcgatgtagtacccgttttcgccgcagggcttccctccggtgaccaacgtcgcgccttcgcgcttaccgatgtcgatgtacttgaggatcttctcgtattgctccttgtcaatcttcgttgtaattgcacacaagtggttattacagcttgctgaacatctttggttctctgaatctgaagtttgtatagttgaaaaatcagagcatggttactgatctagcatatatatatacctgagggccttgatgaactcgcgggttgaacggatctccgaccaccgatttcttggccatctcggtcgccttcttcacgaacgcatcgtagatcccctcctggacatagattcgcgagccggcgacgcagatctcaccctgcaacagaacaggattgttgtggaaagctgatgagattttcacaatatgttgtgcttatgccagctagatggttttctgacgacatggccggtgagaggccgaccttgttggtgtaggaggccatgtgg

SEQ ID NO: 82297 - DNA, 719 bp, Oryza sativa
tattgtattttttatttgcagaattgctcgaccctaatccaccggctcctccgctactcgcgcgttgcggccgaccacccgcttcatgttctccctcaacggcgttgggctcgtcttcttcacattcgcccggccacctcgccctcccctgtgcctcccgccgccatgctgctgcccttcctaaacgcttctatctcaccgacaggagtcaccctcgagaacgcccgtcccaatacagacttgccaaatccattgaacccggggagaaagaagagggacggcactggccatcggcccggatcaggagaagggaggggcgctagctagcggaggaggagaggaggcggcgtgtgcgagtgagcggtggcgccgtgccggatcctccgccacctgcgcatcacggccgatgacgccacggcgaaccacccgctcgtgtcctttatttatactccttccatttagaacaccaaagaactggttaaaattacctgcaattggtgctaaattaaggcacgtgttgagatgttttcagcaaagaaaatcaagcagtgtcttccctaggatcactggttctctttagatctttcgttgaacttgtagagaggaaaatacccaagtaggatgcatgcatgcctgcctgcaggcgagtaccaaaatcaccgagcctatactaagggatactggatggtgatgcaaatgagcaaagggctgcaggaatt

SEQ ID NO: 82298 - DNA, 698 bp, Oryza sativa
ttccagtatttccataaaattgagatctatttaatggcactactaattagtctaaataggatctttcttttggtcttttgtttaggttttcgattgtttgcgtatagttgcggttaccggattttcgtcgatcgcgggttttctcgaagattcgtgaagcttcgtgcagaccttgagcaaggcaagtcaccctctgaccaattgctcctataattggaaaatcattattattttgtttgcaacttgcattattagaatcacacactcaacttgcttggcctcggtatgcgtgccaaaccgacggacctacccagtagtcgcactaattcatgtaggttgtgctaccctgatttccttgtcgctccacctttgtggtacctcagtatccgtgctatctgagcgcgtataccaaatatcccacatacaccgttgtttgtcgaaaacttgggaaatgggttcgagaagccttgaaaacccgacatgtggtgtcggcgtgtttgaaaataaaatggattgtgaaaactcgcgatgcgggggttgtgcctgtgtggcactgtcccgtattcgcatataaggaccgattcctgtggaaaattcatccgagcatataacaagtgcgaccacacgcgtgcaatgggacgcccctggctgagtaattagctaatcgggggagccatgatgccaagagacatgtgggc

SEQ ID NO: 82299 - DNA, 4459 bp, Oryza sativa
gattccctagtttgccctgtggttgaactggttagttccagtgtgacctttgctttcagtctgctgagaggtgtggagagaagataatgaaggaatggtcgtggagcaagtgctgttcccattaattgactgcattttttgtgcttgttatctatccagcgcgccgatccttgatttccataataaaagtttagtattgggtttgttaatctgcatggttaccttttgcatcagtcggtccacaaaagtcaaacaaagctgtgtgggcaagtgggtcactagctagctgcctgcctaactattttgttgtgctcatggacatgattgcgccatgatgaaagctcactagctcactcactgcctctgcctgtgcagaaaaggccgcattcgatttaaaggatttttgtatgaactgaaaccttaggaattttttttaccatcattcatttcataggaataaaacctatccaattcctaaggattctattcttacagcctaattctataagattttttttatattatgagagacctcttggaaaaatttctatgaattggagtgcatgagtcattctaatccttaatttttttttctacctatgatttggaaactctatgaaccgaataagtgctcagagttgttggatgtatcccagtcaaaagaaaaggaattgcagatgtgagattagactatcattatccccttgtgaaaaatgagcagatgatatatccgggtagccggcggatttgcctggagtgatgcatgtgtatcttatctatctggttgggcggcccttgtctgaatctcttgcaactgtgcaagtgggctggtgtgtgtactgtaaaacccacacaagcttgagagcgatggaccgactgctcgtggaaatacatagaaactgagaattgagagatggagcaacaagaaaagtcattacgaattctcgaaaaagaaaaagaaaagtcaatacgaacgaggagtacaaacaaattaatgcttagaagaaacgaagcaagcttacaattaacttgatgctacgatcgatacagcatgcttacaaaagacaagcattatggctgtgttcttctcccattttcccaacctatctatctctcgttatccgcgcgcacgcttttcaaactgttaaacggtgtgatttataaaaaaagaactttttatataaaagttgtttaaaaaaatcatattaatcctttttttaaaaaaataggtaatacttaattaatcatgcaataaaacaaacttcattttacgtgcggggaggggttcccaaccccctcctccgaacacagcctatatatccttgatgctgatcgctagagtatgtttcactttctttcctccaaaaaaacgacacatgctcgatagtaagtacagttggatcgatgcttgtctcccgtattttctcaactgcagggaaaaaaaaatgccatcggtctgtccaaagcaggtcacgtactcttctgtccaggttactctagtttggtagttagcacatggcttacactcaatcttgcattgcaaccgatcgagtaccgattcaatattgcatcatgcggctggctctttctttcttgaacaattcagctacacaaccaacatcaatatacgtactcctagtagtatataaacaaggagtacctcattacaacaaatctacttgcctgtatccctgtgtgccttcaagaattaacagcagctatatctagctggctaatggtgagctccccattatgatgaaaaaaaaaggtaaaatttgctacagaacacttaaagattgtggtctttgctgtgagacatccgaagatcgtgtatttgctcttggacaccgaaaaattatggaatttggttggcggcacctcttcccgtattttattatttccagctgaaaccgtgagacaaactttcataaaagacaattttacccatgggccatttgtataagccgaccaggtccggctgcaaccatatgtgagagaagtagtagtagtcagagcagccatggccccctgcccgtgctctgccatggcggcagtgcggtggtgtttgtcagtgacagcgcatggctgccaccacgagcgtcggcgtcaggcaagaggagatggaggcgaacccggtggcgcggcacggggctctgggatggtgtgcaggtggtgctgcggcaacggacggtgttggccggaattgtggaaaagacagagagaggcagtggcgcgaggggaagaaggcttcggccttggagctcaccggcgacggcggcgcaggaaggagacggcgatgtccacggcgcagcacccggccgtgatggcctccacgacgcggcggctcgccacggccgcgccctcatcgtcgccggtcggccacaggcagaaccgcgctctgcccatgagctcgccgtggtccacccctgccgggaggagaccgtacaccagcaactggtcgtcccgcccctcccactgcgtgagcagcacctcccgcacggcgccgccacgcgcgacgcctcctgcagcgaaggacgcgacccgtgtcaggggcaggaaagagagaagaaaagagagaagaaagaaaatagaaagaagaacagtgtcaagggaattttggtactttcaacactctttctctctctgttttcaccgaaaataataaaataatgcctcgagtgtccacagggccggccctagggagggtcaggccgtgcggccgcctgaggcccccaaaatctaggggccccctattgcacatataagtatatatactacgtacttaataattttagtcaatgggctataggcctatattaagttagacagctaaatagctcaatacagaaaatgaattttagtccatcgccagacctgtttcagtgaagccgaagcgattttcatcttactcccgtcgcttcgcctcgatcacatcacgccactcacgtcgcgccacctcgatcacatcacgccactcgctgctcctgcgctcttggtgactcgcaaacggaaacggcaaatcggggctcgctagtagtcagccacgctcgtgtcgatcgtccgccggttgccttctctgctcgctaccactcgctgcccctgctgcctgctgcttgcactgctctcctccaattcatttattcatttgatttcaaggtcctacactcctccaattcatctcatctggtaaatttctctatcacatcgaatattaaatgttgtgtatttataagactatataaatatatatatattagtttatgtataggggcctccatataagtttttgtcctggggccccaaaaccacaggaccggccctgagtgtccagcagctaattaccatatttttacagtgtccataagcaaatacacgatttttaggtatctcacagcaaatgccacaatatttgagtatcatgtagcaaattttgccaaaaaaaacagacatatagtagtagttatttttaagatggaatttaagaattaatactccgtagttggtaaccactaatccagtgcacatgttgactttccaaaccaacaataggataatatatgcacggatagactaatgaatgaatactaatttcattttttgcggtatcttccagaagaaaatcttgcttgtaaaaggctcattaaattacttgcttgctacccgtcatggaagaaaacgtggagaccactgtgacatatatagtgataaaaaaacaaggacaattaattgcatttgtaaattcgccatcgatttttttaatattgcaaggatgccactcgaatgatagttccagtggtatttttataattttctagtgtcagttttgcaataataatttaaagtagtggtaaatttgtaattgcccctaattaaaatgactaaagggatgacaatcatatactccctccgtcccataatataagggattttgagttttttcttgcaatgtttgatcactcgtcttattcaatttttttttgcaaatataaaaaacgaaagattgtgcttaaagtaatgtagataataaagtaagtcacaaataaaataaataataatttcaaaaatttttgaataaaacgagtggtcaaacgttataagcaaaaacataaaattccttatattatgggacagagggagtactaggaaagataagctaaggttcccctaactatgaatgacacatggtcacatgtttactttagcccaggcacttgagatatattaattattaaattgttttcaccatctactactttctccctcctaaaatgttgtatctagattcattgtcataagatgtgtcaaattccatcctactccctctgtttcaccatgtaagactcatatatatgtagatgttaatgaatctaaacacatatatatgtctagattccttcacatccaaataaatatgggcaatactagaaagtcctatatggtaaaacaaaggaaaacatgg

SEQ ID NO: 82300 - DNA, 695 bp, Oryza sativa
ccgcggtggcggccgctctagaactagtggatcccccattcgggattagtccctaagcctcacaagcaccgtctattataagaaaagaattaagaggagcagtaggacaactatttcttctatcaccaattttaaacctaagagagggctccatcgatctctaaaaccggtgatctcgaagccaaacataagtgcataaacactagtccataaagaaagaaaccgggagaagattgaagtggcttcagtggcatctcaaaacggttatagatcaaatttcacataagcaagaagtgatcatgttaggctaagattcaatttatataattagagacaacattgtggtatcagagcagaaacttagccattatgttcccatcattccgtttagatgccatatatgcctatgtcttgatgtaaattatcagtaaatgaagcaattagcttcggattaactcaggaaaaggagtttcgggataaagcaaaattttccagcaattcaattcagcaagtttgggaagattgggataaactagaatgaaattcccaagttttcccaaactcgtgaacctacgaccgaaaatccccaagttttcaaatggaacttgaaagaatactatatgcgtctattgaagaataaaactatataccaatatacgtctcatggaaaataatggactagctatacaactcta

SEQ ID NO: 82301 - DNA, 36261 bp, Oryza sativa
ttcctgccggaacagcaagctgccctcctcctgcaactctcgcaagtaaaaacaggttgctcccccttttctttctttatctgcatgcacctactacagatttcattcacttgcatttcgtaataattttgcttcatcccaaacggcactactaccttgttgtgcaaattgacttatgggacaaagacactgcaatcttctagtggtggggtctggggtggttcgtgccttggatcactctcttgttttagcctgaaaatcagctacattaaactgaatgtggaagtaatccagacttttgttctttctcaatgcattgcagttggaaatggtacaataagagtaaaaggtccatgacaatcactgtcaccactttagcatgatgctgtatggctgtactttgactcaagtagaaggataactgttatgttcctacccagataattgcaaatcttgtcaaggaaattgtgggcatcctatctgcattactgtgaagaatctgtatatttcccgtaaaaaaaaatctgtatgttgagattgtaaggctcattatagtccctgagaaagggttgtgctgttagttcattcacagccaacaaatagttacagtgggtgcactttaatatctgaaatactaaattgcacttttctttgttgtttttctgaattctgactagcaaaacctctgaggctcagggtactcggcctatttcatcctcggctccttgtcatcgatctaaaaaggtcagttgcatttcctagaaccataatacatgttttgttattaggtattgaatcattgtgctattgcctcttggagtgatctacatgatgcactgtccattacatttttgcccacctttgccatgtaataattactaaaagctaaatgtgctatgtatttgatttctcttgcacttccctgaccatatttatatatattctgcaattcaactgtgatactgcatatccagatgttatcctatgaatattttgacacacactgcattggtgtgctttatggatatatgctatgatgctaagtataatatgctcttgcccggcaaagtataatatgctcttggccattttaggaatcacctagcttaggtacacaagtagagtgcactgttcttgttttgtttttgagtttcggtcctagacatttcatcgggtgagccggtgaaggtaatgaaaccagctgcaccagtgtcttcataaacagcttttgcagaaacgcctctcaaagaaaaataaacagttgtcatgatgtttcaccttttttattgcttgaaactttgaacagacgaagagcacgaggatggagaatacatcttcaggtaaacatatgctaccagaagattttgtcaagaagcagagagcctactttgaggaggttgatgcctttgagctgccagaggaggaggcctcagagacggacctggagtgaagactcagttaaatcagtgtatcggtgcagctagcttgtaagaaattactagaatatgtgactaccctacctgtacagaagcacgctcgcatagttttacgacaatgtaactgcgagttagtataacccgtgtaccgtaatcatcaccagtcaaagccctactgacgttggctttgtcttctgcttgtagttgtacaatatcaagtacttagatattaagatgagaccggtgctttcccccgtttgacctaaacaatggctatgatctttgttttttctggaagtaactgctggcttggagtactaatttttcttcaaagttacgtctgatgaattttcttcagtttttttctaagttacctgtgttatactcctacataaatttccttcaatctatgactggcattttactcgacaccctcagcctaattatgctagaagctatagatggagcttcatgtgcctagcaccaacacagaagtcatataacatgtcgccgttcaacatgtgcttttgcagcatgcagtataaggtgtggactgatgacttatcaaatcaaccaaaaccaaacatttgtttctttgtaataatcaattaaacagtgatactgattgcgatactgccattattagaccacgcagatcgaacccccccaagtcatgaagaagattattcttcatacaaggtaccgttttatccacaaacaggccgtctggcacaatcagcttcgtcaaaatcttgtttctttgcagaatccaagataattaaaataagtagtgagtggctttgatgctgcaaatacaatacaaggcaaggcactgaatattctttgaaagagatggctgccatttcctttgctttgctttcgtttctgcttgtgctcaccactcaccaccagcccaactgctcccactctgcatcttacttctgtgtatgcatgcagtcgagtcaacatacatcaattggctggcaagcaccatccatgcaaggattgagcacaattttctgagtcactagtctttggatgcggcttgtgaaagataccaccatattctgcagttgtatgcaaatgcaaatatcaattcgaatgaacggataggtaacagaagcagttgaaaacaccattgacatccggaggaaaagctcctccaaattgaacaacgaaaatattcgacaatcaagagaaacttccaaagtttggggggtttgcatacatggaatgtaggattggttaatgatactcctctatcttcctaatagttaattattttcatgttttaaaataaaagaaaggagatcacactgctaaaagtgacttaaggtgcacaatttgttgacaaagtatctccggctaatgaattagttcacacctaaagttatgacccaactgatcatgcctaaagtacatatattatctcaatgcagccactctaatttgtggactactacagctatttgttgatatcatagttcgagttttcaataaccattagcaaacattttacccaatagtttaaaccacaacagttttggctaggttgtactacaaactacaacaacgatattgtagaagaacaagtcaacctgaacaataagaaataacaagttcagtgataactgataagatcattcacctaccatccagcagaaattcattttttttgtcactcgagtcagaacaccacaaattcaattttctccactacaaaacacctccattatacgattacactattaattttgtcaccataaaataggttaacattcttttgtacagaaagaggtacaaaaccacacaatcttgtttatactaaaagggagcaaacatatgtgcattcatggataatatttacctcgagtctccagagctatccatttggtttttcagtaattcttctagatggttacatcttagtggagggatcaaaagaccaaaccacaaagggtatcttgtcatgttggcatgcccccatctgatcctctccacttgcatgcactttctgactgtagagttttccattaattagcctgatacaaaaaaaaggaagatcaactaacaaaatgcaaagaattacaaagccacaataatatacatatgacaaattgagcacgtgcacagaattctgcctataaatattcgtgtacatttgactggcaaccagcaacagcactcaagcctccaaaccaaatggcttcccctaaaccctttgcttgcagtgccattgccttgttatttgctgcaaacttggtgtcagctcagcttagcgcaaatttctatgacaaatcatgccctaatgcactgcccaccatccgaatagccgtgagatctgccatcgcaagggagaaccgcatgggtgcatcattgctccgcctccacttccacgactgctttgtcaatgaaagtgtcctgaacctgcagagatattcaaaattttctcacttctaagtattacgtaataaccttcagtattctgacaatgcagggttgtgatggctcggtgctgctagatgacactccaacattcactggagagaagaccgctgctccaaacaacaactctctgcgtggatttgatgttatagacaacatcaaggcacatattgaggggatctgtccgcaggtggtctcatgtgctgacatccttgctgtggcggcacgcgaatctgttgttgcggtaaggggagaaaatacaaaggatatcaaactaaaagttagttatttgtctgtcttaaaaagttaacaggaactcctgacgtcagaagatgagcaactgaaatgaacaaaacataactctttatgtatagctatgaaattctataccaaaacaagccttacaaagtattaaaagtcaagttgccaaagatagtaaaataaattaattgatatttataaaatacaatcagtagtgacatatgaaaaccgacaatttatttttcagctaggaggtcctacttgggttgtccagctgggacggcgcgactcaacaacagcaagcctggatactgcaaacaatgacattccagctccaacctttgaccttggtgatctcacgaagtctttttcaaacaaaggactaagcgcaactgacatgattgcactctcaggtactgtgtatgtaaatggaactttttggtatataataccatctataataaaaccataaaataaaacagctatccttgctgaagcttgattgtcaaaacaaactgtacaagtggtgttacatttatgtaggagtatcaatatatcatggtgcaaccccaacaggttgtttagtatcaagatgctactgatcaattgatcactaacatcaaataaaaatatatgccaggggctcacaccataggccaggcaaggtgcgtcaattttcgcaaccgcatctacagtgagaccaacatcgacacttccctggcaacatctctgaaatcaaattgtccaaacacgactggcgacaacaacatatccccccttgatgcatcgacgccctacgcctttgacaatttttactacaagaacctgctgaacaagaagggtgtcctgcattctgaccagcaactattcaatggtggttcagcagattcccagacgaccacctactcatcaaacatggcaacattcttcactgatttcagcgcagcaatggtgaagatgggcaacatcaaccccattactggatctagtggacagatcaggaagaactgcaggaaggtaaactaggtcataaatttttacagtctaagcctgtgtgtgcctgtgcggaagagtgtaatgttcagagaagggagaagtgtccctttcctgatgctgtagtcgttttgaaaggtgtctgtattgctattaaagaacacatatgtgaaagaataaaatggcataaaaaggcaactggtgtaacagttgatatggcctttcatcttttcatccacaattcttgcacttgaaagatcattgataacaaaactcggctccaagcctcttactatggttgatgaatttcatgactaaaacaaacttgtaataataatggttaagaacaactgttcagaatgacttgtcatgctggcagtgatcattacttggcttaattccaatattcagttcattgactatagtttcttaactagtacaactcataaccgtagtatatcaaagttgacaaattacatatcaattgtgtagggttcaggtatatgatcacaggatgattaaaatcaccattaagaaatgtggcaatcatgcttatttgaaaaggaaaatttgaacattagatattttcctaccgtctgcacttgatatgcagatatgcaagtgcctatatcagcaacaaggaaaagctaataatatatcatatcatgattttgttttagataatatcatatagtcatattcaataacaaagtgaaaacattgacaatttgtcatatagtagatggagatttctccttagaaccaatatttattttctgaggtagacaaatatttgcaacaaaatatattgtttcccacggaaggtttcccagtaaaatgattgggaaggttttgtttttcaattgtgtagagcaagccagtcctatacaacagagttgacaactcaaaggggaaaagaaaaagaacaacagtgccaactgagtagataaaatcttcctaacaccatagtcgaaagcaaagtcaggagtggtgaatgttacggatagctgcatttatacttttacagtcgaaatccatgatcttcatccagttctcataatctccaatttcctgtaacaaaataaaacaacagatgtttcagcaacaagaaatggaatatgatcgactaaggaaactacgcaaattgcccagcattgtactatagaatttatcatgttattccaaacgcagtgctgcacatggatacttttggggaaaatgaactgcaccaaaagaaagcaatccaagcaatgtcatctcattttttattatttgacgataaaagagcatgcgattggtgctctagtaagagtagtatccatgaaccggagaaaagcatctaaaaaaaggagatgaaaggaagatgagtagaccttcaagacagagttgattgcgttggtggcggcaagccactggtcagtctgcttcttgtaccgtgcgattgtagcaagcagcgcgcgggcttcaatctctatgcgcctctcgttgatgtagagctcctgcgctccgccatcaaccgtggccacgagaagatctgcaacccgcgccgcgctcctcactgcatcgatcttttctctgtctgtatgtattgacggggaacaaaaaaggtcacttggcacttgaaaaatcaaaggtggaaaggaaatttcatcaaaattttggtattttggcgaaatcaataggggatcggatcgaagggggttagggttaccggttatcttgcgctgatgaagggaatggtggtggtggcgttgcataatgaggagcagcgccgcttccagctgcccgcccgccgcctccatctcctcttcaatccgtggatggaatggaagcgaaggggatttgcaattatgacactgcaagcattaatattttctataataacactgaacccacatttcatagacacaaataggtccatttgtcatccacacggagtgtcaaaacagcgaagccaccatatttgcagttctaatattgcaattttcttcgcgaggggaaggaagggaacacgagaggcgatctccagtgagggccggcgcggcgacgacagattggcggtgcttttaactatttgccacttttagatttggcaaataactatttgccacccctatctcaatgacatgtgggtccacatgtgtctatgacatgtgggtccagtggcaaaaagttaattgccacatctaaatgtggcaaatggttaaatatctccagattggcgggtgttttcaacggacaacctcgggttaagatgtatttttcttcatacccctcgcacttcacaaattttatgatgagttttttgtaaggggaaaaacaatcattgtgaagcgtttgatcgaatatgcatcagatatgtgctacaagggagttcaacataaatttgaggataaaattttgtaaatttgtgaccttccaatttactcctcgattttatgtgcctatgatggttaagtttcgcaattggacatgtgagtgggatggagactttgcgagggtttcctcatttagagggacatcaaggtggtggtacaaaatactactattgtgtgacgagatggtgaggcagcggcttcagcgttgagttggcgttgagaagtaagaaaagtagtggatgctctaaaaagacagtgagagaaaacaatcatgttatgatagtggatccaatataatagcaaaatatgttgaaggcggaggaggccaataacacgagagaaatgaagtagagatgaaaatagagatgcaattacgaggggataggttatgggtaggtagcaccaacgaggtgtgctaacgagtgatggagcacgtggtagatggcatgatatcgttgcatacattggttaagcttctcgagttgatctaccaacttaccaagaaacaatgaaagagcgtgagaagaagaatgcagacatatctagaggttagtagaccaagatttataatctttgtacttcaattctcacaaatcaaggtccatatgtgacttataacaaggtaggtaaattatactccctccgtctcataatataagggattttaaaaaaaaattatgacacatcctagtactactagttagacatagatagcctatctagatttatagtactagaatgtgtcacgtccttttaaaatctcttacattttttttatctcatctaagcaatagccggttttagttgtctttaaaaccagcttagaaactgaatttattgcttgattgcatttgcatagtgtataattaacctccatatgtataagaacatctgaaacttcagtatattaaaatccgttttcacgattttgatgaacgcctagtctgtaaggatataaatgttcctgatcgtgtatgatgaaatttataacaaatatggttgtgggttaccggaccaaagtttataatctttgcgcttaaaaaaccgataggtttgcatgtagtgggatgtgcatctgtacgccttacctctagtagccaaatcttttcagatgcaactccttatcatgtgtcttttatcttgacaagaatgcatgatggaacttagtattagccttgttgcccaatctccatcttttgattgttgaccagtctctttacatcttaacagctctttaacttttgttaatgatgtcttgtcaagctaagtagcttaactagctagcacactgtaggccattgacttgttaatatactgtagatgcatggtctctgttttccttctgcagtatactagagtactagacatgcatgcagatttggtcttgtttgatcagccaaaacctccattgattgcggtccaaaagcagataaacccactacctgcatgatcgaatgcattcggcagccatgtagcactgaattcggttgactaagattgtgtttagttcacgagaagaaaattttttgaatgtcacatcggatgtttaatcggatatcggaaaagatttttggacacgaatgaaaaaattaatttcataactcgtctgaaaaccgcgagacgaatttttgagcctaattaagccgtcattagcatatatgggttactatagcacttataactaatcatgaactaattagactcaaaaattcgtctcgtgatttccatgtaaactgtgcaattagttttaatttttatctataatatattatatactacaagaaacaagctagacgtcttgtcatggttaattagctaggtaggtagttccagaaaaggtttcttgccaaagtgcagccttctcataaaaacatctccccagaaaacaaaatgagacatttgagctaccggaaggacattttgacttatctacattttgtattggttaaatcaagacctgaaatgccattgtccatgtcactacttcaattgataacatgcacgtatggcaatatgatgtttttcatgctcaatgcatgattgatcatcctaaaggtcctaaaggtaaataggtgattaaggatggattatttgcagtttaatctgcgatgacggagtacacgtacgacgttgagttttaggtttgctgagtacgatccaaatcgaatctttgtactgcatcagctgcttgctttgcctaattgattcttaattccgacactccatctaacaatcctgtactgctagttaatttcataatgtacttcctatatcgaccggccttatatatcttgctcgtcctttccgtagtaaggatatttactactagtcacttataagcaagcgattatagtcgatgccattaaggcgttaactgctaccacgataacagataggttcgatgatgcgtccatcttaaggttggagctgctgtgtcaattagacggcaagttcaacaatgatgacacgtatatatcctctgggaagtctgttttttaagtacgccacacccctacatatcctcgccagttaaaaaaaagagcaaaataacattaattatatcctttagtaaaaaaatagaaaaaatagcgtaaataatactttatatttaagtttaggtttccgttgttacgcacgagcatccaactagctagtatactaagcaactgagtatcatcatgagtaatattctaatcttcttcatgtgtgttgggcctggtctctctacggctacgtatacggcatgcagaattgttggggttaattagcgcgctcctacatgtacgtgttattctagctgatagcagagctactagtaactaggaagaaataaagcagacgaaagataggtgaactcaccgtgctagcttttctaatgtttcccccctgtcattcgtttagcttaaatcaagttgctcttacactagctagctgatcgagccgtgtaaactatatatttatcttggattttggttggtgatatgctatagctcctgcctcgttctccataaaagaattaaactggccaatgatcaaatatggtgtgtgcacttgtgcgtgatggttattgatcaactatataggccatccagacagaatctcagcaaatcagtgactgacatttcatctgcatatgcttctattgcagttgctagttaattagctactagacttttcgtaagatcagaggaacatgcatgtacgtagtgcaatatactaagctgatctttttctcatgcatgtttgcgtgtgtcaagtttaatttatagtatgtatatatatatatatatatatatgaaaaacaacaacattagctttaggaaacttctccatcctctgctcatcaggtcccttggactaaaagcaagatcatggagatcgatcagtacgcatgcacttgtcaaaggcctcaaattaaccaataaaaaataacctctctaaagtgggaggttaattagggttgtgtgaactgcactaaaactaagtaccacagtagtactatactttgacccaaaacaacacctacaaaatcttacaacagcattacataacaaacaaaaataatgatatatgagcagatacatctggtacatggatgttattataacaaaatggagaagcgacatctggtacatggatgttgttataacaaaatggagaagcaaacctaaccggaatggacgtatgcaggtcaaattcgtcagctaaacggcttggactcctgcctaagctagcacccatgctccggcaggtagaaatgcatcatgtcggaagtaaaactaattgcattatattgcaatatactgtactattttaagttatctgagttgttagtaaaagctaaagaatttttgctgactgcatatgatagtagtaacttggaaggtgagtaatctatagtgtattaaccaacgaccagcatgatcttctttgactagtatatactaaacgactgaattgtcgatcctcgtagacatattttgcccatgaacgtccatgtagctactttcgagtttcaatggcgctttccaaggccatgtactttgattaccatgatcgatcatttgataatgagcagcttgctaactgcatgtgttagcctagctcccttaggaaaaaggggaaaaaaaaagaaaggaacaactacaaaagacacacatatatacatagtacaaaaaaccagaccggaccgacggttgaaccggaaccagaggtctggatggctcggtttgctgtaaagaccgcccctgcatttgaaccggaataaaccgcttgaaccggatggttttcatgtgaaccggtgaaccagagagaaccgagccggccggtttgtcatgccaagagaggatgggccagtcaatgccttgtgcgcgcaaagatctcaaggcccacggtgaatgtgtactattgaaaatagcaagaaaaatgtggggaatggggttcgaaccctggttggctggctgttttcaacggaggatatgcaacaatataacacttccggttcaacattcgaaccgtgtgaaccggcggttgaaccgctggaccggtgacccagggacttgagcggttcgatcaccgattcggttttttcaactatgcatatatactccctctatcctaaaatgtttgacgccgttgacttttttaaacatgtttaaccgttcgtcttattaaaaaacttttgtgaaatgtgtaaaactatatgtatacataaaagtatatttaacaataaattaaatgataaaaaaagaattaataattacttaaattttttgaataagacgaacggtcaaacatttttaaaaaagtcaacggtcaaatatttagagaacgagggagtactatgcattatgcatatatatgtaggcatgcatgatgatgctttagctttacttaagcgtgtataactgttggacgcggtccaagtgttctcacgtaccaaatcctagctaaaagtacgtgtacattcttttctcttttttttctgaaactgcaaaaaagaaaagagaagaagaaaagaaaagaatggtgcactagtatacgtggctactccacaatgcctaacaatataaggaaaaggcacagcaaaaggaccgacacggcaagaaagatggtatagacagtgcagctagctgaaggtgcaggctttgcatagtgtgaagcgtctgattctctgacggccagcagcatattcagcatggacggtttgattgatgatcaactcaaagtccaacagagtaggtgaacattaagacacagagatgaccatgacgcaatctaatcatgaagacaccatgtattttaattcatactctaattagctacatactcttgtgcctctgtgaagctctaactcagctataaatacatgcaccaccacagctctgctatctccaggcactggtgcactcaccaaatcaacaagctagctaactaagcttaccacactcacatactcctatatattttggcacgcattgattacctgctagctccttgagcaatatcaatatggctcagccgacttggtcagcaaggcgcgtcactgccgccctggtcgtgatggtggtggtggtgctcgcggtcgccggcgggtcgtgggcgcagctgtcgccgagcttctactcgtactcgtgcccgggagtgttcaacgcggtgaagcgggggatgcagtcggccatcgccagggagaagcgcatcggcgcctccatcgtccgcctcttcttccacgactgcttcgtccaagtaaccatcctctacctagtacaagtatacgcacgcacacattgatcatgctatataattaatctgtgcatgtatgaatgccagggttgcgacgcatcgctgctgctggacgacacggcgagcttcaccggcgagaagacggcgaaccccaacaacggctccgtcagagggtttgaggtgatcgacgccatcaagtcggcggtggagaccatctgccccggcgtcgtctcctgcgccgacatcctcgccatcgctgccagggacagcgtcgccatcgtacgtactccacttcgatcgatcgatctctatatactgaaactgaaactgaaaatggtacatatatgcagctgggtgggccgagctgggacgtgaaggttggtcggagagactcgcgcacggcgagcctcagcggcgcaaacaacaacatcccgccgccgacgtcgggactcgccaacctcacctccctcttcgccgcgcaggccctctcccagaaggacatggtcgccctctccggtaaccactgctagctgttactagtatttttgtttccactgagcattcaattaagtctagcttgttaactaacaaaaataaaaatttataaatgcaagcatcaattcattcacataactaaacgaacaagcatcgtcaactgttccatttttcaatcccttctagaagggaaaaggaaaaagggttcggaacaacttcatttcacactctgtttctgaatagtatcagtagcttttgtgtcgatctgcacacagctgggtaccacgcaaacggaacagatagctacgttttcaatttgcagcatacttggcattctccaagcctatactactttgacaagatgattaatttacgaaagtctgcataaacatctcagattcaactagcagtataacctctgactctgagtccccacttgtctcccctgtttattttttttaagaaaaagaaagattcagtgtcatctgtttaacatgcaatttgttaacttacttgttaaccaaacaaaacgtagtagcaaagtcggtaagcatggttgtcgatgggatggcataaagttactttgaggtaatgacgtactcctaaccgtgtctgcgttgtcggtatgggttaatttgcttctgaagaaatagtacaggcttttctttttaaggttcagtaatcagtacagactgctgccgatcgaaaagatcagtctgccatcacatgccgtgaattggctaaatcacaaaagcaaaaattaatttgtttcctaaaaaaccaaaagcaagaataaagttgataaaccctggctacccatcaagttattaattacaaccacagataatgttccttttgttctgtttgttaataaatgtgatcgaataatgttgattttttttctgtattccaattaatattagggaatgatgaagaacctatactttctttctaaaataaaaatattcacaatactatacaaaagcaaagacctaaaagctcagctcttaaatattctaaattattcttacacatatgctcagctcttaagtatagcatgatttcatattgtacctgcaggatctcacaccattgggcaagcacgatgcacaaacttcagagctcatatatacaacgaaaccaacatcgacagtggctttgcgatgaggaggcaatcaggttgccctcgtaactcaggatcaggtgacaataacctggcacctctggatcttcagacgccaaccgtgttcgagaacaactactacaagaacctcgtcgtcaagaaggggctcctgcattctgatcaggagctcttcaatggcggagccactgatgctcttgttcagtcttacataagtagccagagcacattctttgcggattttgtgacgggcatgatcaagatgggggacatcacaccgttgacgggatcaaacggggagatcaggaagaactgcagaaggattaattaagaaatgattaagaggcaagctgtgttcatgtccagtagtgcaaacgcacattgtgtcgtgtttcttgcggatatgtttgcaacatctcccttaatttctttcatgtgtttatgtatcattatgttcgtttgaaataatgaaagtactatgtgatttgttttaatgtaacatatgcttagtttatgtggtggtaaatgatcggttaggtttggactatagcacgatggaacttgactgaaagactgaaaaggagtttataactaaaaaatgaattggatgagtaaaacgaaaggcaaaatacattcaaaagaaaaaaaaagaaaagaaaggcaaagtcaatatcgactcttgtacgtggaagtatagtgtgtgtttaacttgagtaggaattgatgtgacaagctaacaaaatttatggacctttctatcatcatcatatacgcggttgatctttttgttgatggtgtagttggttcagctagttaaatagtaatcacaaaactcgaaacaagagcgtcgatatgtccgagtggttaaggagacagacttgaaatctgttgggcttcgcccgcgcaggttcgaaccctgctgtcgacgaccatttttttttaggctttttaatctttggaaaaggtacaccgaaggtcccccaacagcccaacttatcatcgaattaaaaaatagtccccctaccgcaaaatcggatacaacgccaacaacccaacttatcatcgaataaaaaaaatagtcccccaaccgtaaaaccggatacaaagcatcccttaatttacaaaacaactgcaaactaggtctctcgacggcctagaccgacgtggcagctgacttagcgtgtgacccgcgtgggccccacatgtcagcctctacttcccctcctcccctttcaacgggcgataaggctgggtacggtgggcgcggcggacggccaacgcggaggagctgggcggcaccgacggcgggggaggaactggacggcgtcggcgatgggggaggagctgggtggcggcggcgcggaagaactgagcggcgggggaggagctgtgagccggcgggcgtgtgggggaggagctgcgcgcgtgggccgccatcgtcgtcgtcgtcgtcgtccgccaccgccaccgcctcgccggccttctccgcccgccgcaacttcgccggcttcacgcgccgtcaccccactccgctcgccgtcgtgcttgagctcgtcttcttctatctcccccgtgctcccgccgcccgacgccgccgaggtgctcgcctcgcgcctcggcatccacccctccctccgcaccctcaacttcgcgatgcgctccgcgccgcgcaccccgacctcgtcttccgcctcttcttccccgacttcctaggcgacgccgccaccgtagccttcctcgtgcgtgcttgctcctccgaaggctgcccgctcgacggcctccgcctccagcgggtgaggagctgggcggcgttggggaggacgagagagcagtcgagcgacaggaacgcgtcgatggcggcggcggcggcgcggatgtgccactcgatggccttgcttggttggtcgacgccgaggcggtcctggatgtcgtagaacgcgatggccatcggcaccgatagcctgacgcagcggtcgcggagcccccgcgacgtcaccaccttgctgtgcttgtccttctcgcccgccaccacgcacgccacccggctcgtccgccatgctgctgccatggccgccgacgccgacgagcgtgcagcacgggcgctagcgctccttgccgacgacgacctcctccatggccgacgcttgcgctagctcatgcgaaatccgcctcggcttcgtctgctcgattttaatggaggctgctttagcacctcgtgcttctgccgtcgcctccctccccttctcccgtgtcgccgccgccgagttgctgtcgccgcatcgctggccggctgtccgacctccttgtcccggtgacctcctccccaccgccggccggcttgcccagaggagatgagtgagagagagagaggaggaggaagggagaggaggggaaagaaagagatgatgacgtggcgtcctgacatatggggccaatgtgggtctcacgctgactcacccgccggttttgtaagttaagggacgttatatatctagttttgtggttgtgggacgattttgtaattcgatgacaagttgagggaccttcggtgtactttttccttaatctttttattccttcagtatcaatgggcctttgttttttactcactccttgagtgggccggccttaatttctattgggccgcatctcatttcatacagctgaagcccacagttgtgtcgaaatccaacttccaaccgcatgagctaatccaatcactgttcggcgttctaatctgttttttttctccttttcctccacgaattcataccctccacgcaacggaaaccacaccacaccccgatacgactaggatttcctctctgcttcttcgatccccttgttattacaatcgatcctgcaagagaagcactctataattgcagcggcaagatcgattttttacaaaccaacaaagcagaaaggattcacgcgccgccgcttgcgatttgtgagttgtctttcccctttcgattccccctcctctcttccttcccctatcgtcaactagctcgagttgcttgcttgttccctctgctgcttcctctcttgtgtggattggattcccggcctggccctttctttttcctcttctctcctagattagaatcgtcgcgatttgattcctcaatctctcgatttggccgccctatctgttattaatccccaattgttcttcacacacatactcaattgcaggtcaattgcagccagaaagaggcgatggatttcaaagtcgcttcctttctcctactcctgttaatcgtcacctgcggagctgctcaaggtcaaggcaatgattttggtacgccctaatccaacaccttcccttcctcccttacctatgctcctcctggctcctgcatgcagtttggaaccaacatgtcaaacattctcaagggaaaattggacaagttttttattgtgcgtagtaaagtatcattctaaaatttatatatatgggcagctgctgtgggtattttatttggttgaaattcaacttgaggataacctgctactgatcctcttagcttggttattcattgcctgcaaaatgcatccattatttttgttcaagctttgccatgcactcgttacaaagtcccatgttcatctcacaatggtacacaatgataaacattgtggtcacaataaattattgatagagaaaaaggaaaaagaggatagcctaatctaattgttggcatctctgatttctctcgtatgttaaacctaggctagttattatttatttatgctagttatggtatgttttaacagtgttacttttttaaaaatttctgcaacaccaattattggttatgggtacatacttctcataaaaaggattatggatacatacaacaaggctagagatgcaatatcacataatgtgacaggaattaactggttccagcttcacagaaatgagaatgtgcttcccaattattggcaatggtttacttttacttcttaatatgtaatagaaattattattttttgctgacgaccttcatgatattttattcaggcaaaattagttatgtagcaccgaaatttcacgatcttattttcattctatttatttgtttgcaccgaaattaccttttgtttattattcattccttctcagttgtccttgatctaaaaacaactgaggtcggggaagatgctagcccaatgtacaaggagcaaattgcgttgaccaagatacctgtaactcttctgaggagcaagcacagctcactgtgctcggcttgtgaaaacatcacaagcgaagcagtcaactttcttagtgagaaacaaatacaagataagataatgactatccttcatgacacttgttctcagacattctcctttgagcaaaaggtaattgttcccttttgatttggtttgttagatcttatatattgtgtctgtatattagaaatacaaccaatttgatcaaaagatatgacacatgtaggaatttgattcccttactaaagtaccaagaaggaaagatattccatgaacaatagtagtttaacatgatcactttgtatgtctgcagtgtcttgagactatggactcctatgcaactctcgtctttgcaaaaattgctgagattaagccagatgagttctgcaaacagtatggcctctgcagggacatggctcttttatcagctatgaaaagtgaaagcacatgcgtattctgccaccacatcatcgatgaaattatgtccaaactgaaagatcctgatgcagaggtgattgattttccctcgattacacaattacatcgataaataatgagcatacatttggaccctaacatcttgtgtgtgatgtttgcagtttgagatcattcaattactactcaaggaatgcaacaagattgaaggtcatcagcagcaggtaaaacatttgaagtagtttgtaaaaattctctctctgacccaataatgcttgtttggttaatgtacatgtctacatgagtgatatgggttgatgaaatcgtacgttttcttgttgacagtgcaagaggatggttctgcagtacgtccctctggttctagtgaacggtgagaagttcctggagaagaacgatgtgtgcgcaatgatccaagcctgtgatgcaggcaagaggaaggcattcaacttgttctctgcacggaaattggtgcgtgacgcatgaagtagtaggaagcgtgcatacacgaatcaagttgtggtaggcatggagaagacgaagaagtgatggcagcttgtacatatggttgttattaatgatataggcaatactactctgtgaaggggataatccgataattgtatgcacacatttgaactgtttgtctgatagtaatggctatacttacttttgtgtgcttgcttctggggagtatggagcagtatactccactatttaagtagtactacctcagtttcatattataaaactttctagcattacacacattcatatatatgttaatgaatctaaacacatatatacctagattcattaacatatatatgcatatgggcaatgctagaaagtcttataatatgaaactatatatgtctagattcattaacatatatatgaatgtgtgtaatgctagaaagttttataatatgaaacggagggagtactgaattgagcgagaatttgtacacgaccagaagaaactaaatttacatagcacatacccagagatgttgatctgcactggctaggagcaaattaactaaactgtgcaaagcttggatccggccacgaacataacagactattgatctctctttacgagaaaatctatcgtgtaccactgactttgctctagatccacaatctgccactgactttgttcagttctatagtacgccatcgccttttgtttaacttctacaatttaccatcgccgtctagttagtctccgttagtaccatacaattgtgttctaatgacgaaaatacccctaagatgaaaactttcagaatttggccgaaaattcacaaataccatactgtaacatgtcacagaggttgcccggctcatattcttctatgataatacatgattatctaagcatacatatgattgttttagcaacttgtttgacggcatgttgcacttacaaaaataaatctaatcacacgcttattttatattatgtattgactaatatattacttcctccgtttcacaatgtaagtcattctagcatttcctatatttatatagttgttaattaacaactatataaatatgagaaatgctagaatgacttacatttgaaacggagggagtagaattctagcaatacatacgtatgtatgcggccgccacgggcttgtggaccacggacacagcctgcaatattgcacgtgtacttgtggccgtaacagaggcggacatgaaaatatattgggttaatttttttattctagaggtattttggtcattagtacgaaattgtaccgtgctaacggagacttaactgacggcgatggtaaattatataagttaaacaaaagacgctggtatattataaaattaaactaagtcagtggcagattattgaactagactaaagtcaatggtatataagtagattctctcatttatttatacatttacactgttcaaaatcatcgtcattgtcgttgttttgttgttgccagtttagtcaattacactctactgatactgataccagaatgctttttttttttttttgatttgacaatacgaacgaacagctcctctctcgtcaaaatgaaaagaaagaaagaaaaaaacatatatataagacgtcaaacctcggaatcgggggattgtgtttgtgagtgacttgtttgattagatttgccgggacgggaggacaagcagagtagacgacggagtttggattggaaatttggaatgacgacgacgacgacgactcggcaccgcctccgggatgcggcggtggcgtcagtggtggccgtcctcccccacgagatctccccgctcatcagcgccgcctccaccttcttcttcgtacgtatcgtatcgtatgcttccctctctctcttgcttcttgcttcttctcatttcatttccttgattcatctatggctttatggctgtgcagatcctcagcgcctactttgccgtgctgccgctgcgggacgagggggccatctccctgggcctctcctccctcccgggtctcttcgccggctccctcctcctcacccttgtcgccgcccccgtcgcctccctcgccttctccctcccatccatccccaaacccagggtccgtattcttcctcacttacattatctatttttattagcttgctttttatgccacaagccaaccggttagatttcttagatgcaaacttcggtaatgctttgtacctttacggacgcaatttttacacacttattgtagtcaatcacgcaaaaacaactgcattacattctcacaatcatgaaaactctttttaacgaatatgaaaacttgaattggttcagatgaaaacttgctatttgctctaagttcagatgtaggcacacttcttaaacctgaaggaatgcaattcttaactcaactcaattatttcaatgattgtattgttcttgctttagtgtttcactagttaaaagtagtatacctttattttgtttcatttgatcaagatgctagctttgccttctgtatgactggaacagttgatgaattactttagagtaccatgttaatcattgaatttgtgttcttttgtctgttgagaagaaaaaaataattctggtctgtgttgtgcgagcttctgtatatttaccacaggaatgcaataatttgggtatttcttcagtaaacccctttaatttaagatggttcagctagcttttccttgactaaataccagattcttgtcctcagctttcttccgtttgtttatcgatgatgaggtctacattttaagaatttgaaatattctgaagaacaatacaggctacaaatatccttgcagttatttcttattcactgacatcagctaattttatcatctatattcaggctttggttttcatacacagattcttcagtttatcccttcttgtcttttttgttctttggtttgcctctacccctgggcattccccttctatctcccaggtaatatacattgctattaatcttggtttttgcaattatgtacaatatagttattaaatttcaatgaaattgtgaagggaaaaaattaccgtaccatgaattttcactcagctgcttcgtctgtccccctgaatttcctaatctaagaatcattcctcacacaaaaaaaaacttatttttctctgtttcttggtgtacaaatcaagtcaagcgaagatgcttcaaataaacctcctggatggggaaaccacagttggttctacatattagtgagaataagcttgtttctttgggtacgacttttcatgctacatgggcatgttcatttattctaattctcaaactgattattgatttgagtaattatgtctatttgaaggtttccttgcttaatctcattgcaatatcatcaacatgggcaagagtaattgatatcatggatagtgaggtatcatttacagctgctctaaaacttattggcaaattacctacaactgattacttttgcttctgatattcttattactcttttaattcagtcaggttcaagattgtttggttttattggggccggtgctacgctcgggcaactttttggttcattatttgctgcaactatggcattgctagggccctgtacgtatgattttctgaacaagaaaacaaattcctgatttaaaatttctagaatgcattttcacatctccgaaatgtgcctcagttctgctcctgttttcatccctattgatggaacttgctgcattgtcatcgaaaggaatctgcactgatgatctacacggctcaacggaattgtcttcaacaatgtatgtatccttctgacaatggtttgcaatatcctgacttatctatgactgttacgttgaccggggcaaaacatatcattgatacggactaatgtccagttttactttcatttttaattcttaaacttaagtcacattatagtttgtaaattctttcttttataatcaacctcaaaacccttgaatggattttgttagtttgaacgtctcatagcaaaacagatagattgcctgctgattatttgatttgatattttggtgattccttgttttgcttatgattgcatcccaatctattaccaactgcagagccgaacaaagccaaaatacagaggctgatgatgaaatgtcttcactggtcacttcacaaggattaccgtcccaagtctccgaatctcagaaaaccaaacctgagatttttgtgatgtttgaaggtttctggctgattgcacgctctccctatctgatgtatatatctctatttttgtggctgagcgctgttgtgtcgtccttcttttacttccaggtatggttcttctatatatgtctattgacatgaataagttccacatcactgtgaccatgttgtttccttagttacatcgttggaaggatccaccatttaccatccatttgaattctacctgatttccagaaagtgacgatagttgctacaacaatatcaagcccaactgccagaagaagaacctttgcactcataaacagctttattgccgtctttattcttgcagggcaactcactttgacggtatttatccatctccagattgtccttggttttattattaatagtacccctttttgcagtatgaataaatcttaacctgacaaattgtcctgcacaggaccactatgacatgcgtcatggtgaagtagctttatatgttgcaaactgaacattttgactcattaggctctccctcctttttgttttggtggggaaggctcaattagaaagctcagcttcatttctaacatctatttgatcatgcatgcgtatccccaaagtgcttatttttctcatacaacattgaacttattatttagtgatatcttcctttgttcttttgaagacaagaatgtgtcaaaatttcaatagattttccttctgaattctgatgtaattctgatacacgcatatgttcctcagtttgacaattaagagataattcgcatctcatatcgtcaaaagaagggaagagttcattacgatgtagtcaaaatgatgtattgcatgtctacatcactacattccaagtactgagcaacttattagcattggcaaaaacaatataatttaaaaatgtcctaaccaacaagttgttagaaaactgcaatgactgaggaagttttgctaattttgtttcttctttcatttcgaaaaaaaaaatctcgaaatttcgttactgattcctgttatgaattaaacaactatttcagggtcgtatccttaccatagctggtgtaacagttgctatctgtgcatccccattcattgccacattgaatatggttgcccttgctctatggccaacttgggttgctgttgctgtcactgaaacaattcgaaaggtacatatagaacagggagctatgattgaacttttggtgtaataaccgttttttaccattaaatgatactttccaaaagtcacatacaaataaatatgcatatctagatgtgagcattcattaccacctggatattcatatttgagagctgagacacattaatttgaatttaatctggaattttcgcatgtcaaggatatctaatcactcataatccatttttgtgcaatttagggttttcgatgttagctctaaattgctgctttcccaatctcatcttttattctctgtaggtaactacttatgttttgacaagacctggaagggaattgctattcacagttgtctcacaggatgagaagtacaaagccaaggtaaaagatatgtcattacctgtttgagtttagtgaccaataagaaacgaaataatacatttgcttgaatgcaatagatgagttgtgtcagtagtacacattatcatgcaccacagagaactaacaaaatttctaatccctggattgctcatcaattttcatcaatttgcattgtgttatagatgtctccggtagatatcaagcatatacacatcaacatatgtgatgtgtttttgttctcaaccctggttcaaggtggtcgtaggcatggcgcaagaggccgccctttggcatcttgcccatcctctgtcgccaacgcttccttcttagcgtgctaggtcatttggtcgtcccattgtaatcgcgagaataggattaagtccttgttttcctctccccccccccccttttcttcccaaaccccccttcttttctttgttttgccttttgtgtaaattttattcctcttaatacagaagtccgcaatccttttgcgtattccccaaaaaataaaatggctctgttttgaattcacctaggcacatcagagttagccttgtctcttaaaatggagagtgggtgattagcagcgaaatttgaagttgaatttccagattaagtaggctattgtagaaaaatagtcagtttttcagttgccttcttagtcttatatttaaaatcatcttaaatacgtgttcacaaatgtatgacccatttcagttttgactatttaactaatgaatatgattctaataggtttgatagatgttgttgttcaaaggcttggtgatgcaacagctgccggaatatacagtttgttgttcagcagccttgagaagaaggcatccatggtcaccctctacgcgttgccggtatgtgtcatggtttcagtcattgtatttgtaccccatcaccacataagattgcatatatcactgaaaaactaattttctcccttctgataacagctctgcttcgtgtggcttctaacggcatttcatttgggccggctccagacaaaccttgtcaaggttcaggttgcttcttttgcatcttcgattcctagataggtacttggttacctatagtaaggtgattgtagcttacttaattcacttgtagtgttcttaacacaaatgcttgatacggggaactgctgcacgtacccacagaaatgcatactgtaagtaaccagagtgcagaaagaaatatggcacaacgacaagtcaggttgccagtggcgttgatactccttttgccttgtaagactaatagaagatttatcgagaaacatttttgttttcaatatagcattaggattactacaggaaggatacaacatgcatagaggaagaaggaatactgtatgactagatgaataacagatgagtatgtgatctctgcgtctattgttagaaacaatactgtcttgcagacggcagtgtatgtgacttgttacattgctatttgctaatgagaaaacaaggctgaatttgttgggcatttttgcttcttttgggaactcaatatgatcttcaggcatgtacaatttactgttaaattgatactatagaagtgctctcatggcaccttctgataacttattgatcatgttcttcgattttcatactgcctgattaatttctggaacacacacacagatacacgcatgtaaagacaagctgcatttcttattactgtattttctttgcaaagcgagagcccaagattgaatggtggagagtagaatgaatattgccttgcgtgatctttgtgctaatcctttttaaaattgcgcgggaagaatccccgcgtgagttataaaacgatacgcgcgccacgccggatcatcaagctgcgagcctctcgtgcttaatactagtcactaattaagtgcttaagctagtgcttaacactagctagctaattgctcatcattgatcaagcgaagaagaagatgatggcgtcaccggcatccaagcgcgccgccgtcgtcttgctcgtcgtggttgcttctgtgatgatggcgacgccgtcggaagcgatgagaccgaggaggaaggcagccgccgccttggtctcgtcggaggcccgcgtcctccgcttccccggcttcccgggaagccgccagcgcttcccggggttccccggagccaggccgtcgccgcgcgcggcgccgccgaagccatcaccgccgccgtcgtcgtcgtcagtccccgccctgccactgtctccacccgccggcggctcgctgccgccgccgtgcgggaggtcgtcgcagacgacgccgccgggcaccttgatcccgggcatgccgggcagcggcggcggcggttcgtcgccgacggactgcgtgacgtcgctggcggggctgacgacgtgcgcgtcgttcctgacgggggcggaggcggagaccccgacgccggcgagcgagtgctgcggcgggctggggatgttcctgaacagcacggcggcggcggcggagggtgaccggacgttgaggtgcctgtgcccggtgatcctcggcgacgtcaaccggatgctgcccaagccggtggatcccgtgcggatgatgtacctccccatcgcctgcggcctcgtcctcccgcctcaagtcctcttcatctgcttcagtcagttcttaccttcacttgcactcattgattcatcattctcaaattctatcagattaattcctttctgacgaaaaactgatatattattgattctttgattgattatggcagccgggcagcctaacccaccggtgctctcgcgtgttcctgtctcctggtcgacgctctcttcaggttcttgctgaatttgctctcttggtttcctgttaattcacacattgttcaatctggatttttttgcattctaatgtttttgttgttgttgttttcttaatatgcagcaatgtcgccttgatggttcacgataagatcgattcaaaggttactgatgattcagtgtctcactttaagcttacaaagctgttgttggtcttgagtgttgtgttttcagaaacagctgagcctgtacttcagtaaaccacagagttagctaccatactgctatataaccacataagattggttggtacatcatgcgtggtgtaagagcttatttcttatttatagggaaaaaatatgtaagtcatttcatcaaatattctttctccacaactaaagagtgtgaaatttgggacaataaggaaactgaaaatacaggtcaactgcacagcaaaattccagtaggaatggaatgctttgtctacaacattacttgttataataatcaaattgacaggaaaacataaatatcagtaaacttaaacatccgcagtcaacctctgaacatgcatacatcacatttggcgatgatatgatgaattttcactttcagcaatagtatgtgtttcactttcaacagcaatagccgtacacatgagcaaagtgacagtctcaagacggccttattcgatactctgaatttacaaggcactatgtgcgtgtgggtttcccaattacacaactggtcgccattaagactacgcaattgcaaccaagaaccaagatcatccagaccagcaatgccatcttctggcacctccttattttgtcattcttattattatcagatacctactaaattagatcttgtctgagctttattctgaggataggtgaatcaaaaccttttcatctgcaccagctagcaatctggcagcaaagaagaatactactagaggagctaaggttctgctgttgtctgttccataatgaattcaatttgcgcagatttgtttatttagttctatcatatgtttactgcatttcctgacctgtaggcttgaatagaaggatatggagaagttttcatttacttctcaagcctcccgaagagcacggacccgttcttgaattaacctcctctcgagtcagcaatgccctcaaaagcatgctctggcagactgtcaaaagactctttatgtggatcattcttagcaagatcataagttgcagcacggatcgctctcttattgggtccacagggccttttagaagttagtttctcataagctgtcttaagctgcaagcaaaagataaatgctaagaatgtggcctggcttataaccctgacaagttaagaattcaagaagatgaaacctacattcatattctcgaaccaaaacatgtaagcaattgcaactgcaggtgctctcccaagtccagcagtgcaatggacatagacacgccctttgccttccgatatagcccattctagtgatgcgactgctttgggcaattgagtcctcaacgaatctggatcgaagtccactggctgaaaccaaataaatgcaagcttttaactcactttcataatcaaacttgcactaacttcattggaattaattatttcctagacttttatagtttacttttggcactcaaagatagcagcttactgttacttttacgctcttctgatgtacagtgttggaggtcaatattttatacttttcacctatcttgtcatatagtggaaatatgaaagcttgctaggtggatatgaattgtgattatctcaaatgaattataaagtccaatgcaaaggacaaggccagctgtgctcattgcagtaaaagaacaattaccatattttctcattaaacaacttcttagttcatctgtcatgtttatatgaataaaaaaaatgcaccggtgcaaaagaccagacactataaaagttaatcaagcttgaaagtaggaatgtaaagtgctcattttttgtttgaagcagaatttcataagcaaattaagcatgatactagctcagtacataaataagcgtctcaccggtcttctgatgtgttttatgccaagttctttgcacctattgacaacagtttggaaatcaatgccccaatattcaatgtccttgtcctgctgtaagcaaagaataaaggctactttctcctcatcttttaagtgatcaatatcttctggtttttgaggttgcgagccaacaatcaagctatcactaatgatagcataattcatacctacattccaggagtaacagagtgagaattgcataaacacaaagtagggattttgttttgctcctgttaattgctgtatctatttcagtgacttataaaaataattaaagcaagctgtgcaattcaattaagtcatgacaaagtatgacaccaatgtttatctccacatcaaattgctatatcttcagcaagaactttcacagaacttatcaaagaatggatatttcacaaacatttaatgtacaaaagataagggcctctaccatcttaaaaagatacatttttcacatcatggtgtaactttcattataatgtaagtgattctcaaatagttatgtttagggtaacacagtgaaactgccatatgaagataataaaatactaaaccaccaaagccctcaagcccaccaaaaatgcagaagtaatttccatgcagatcaacaatgcagatttgatcactatttgaggggtggtagatataagaatgcaagccctgtggagccctgttcccccaaaacaaaaacacttcatgtggcaggctattagagataggattcaatcagctgcaaaactgaagaacataagttgggtaggatcagagttttgtcaactgtgtggtgaaattgagacctctgtgcacatttgctttagatgcccaaagaatacctcgagatttttaggatttctttaccatggtcattgtgaatgatagctccaaagaaaaactagagttgaatacatgttactggcggctgagagtttgttgctgtggtctgtcagaattgatatgatttttagaagcaaactcatcttgacagcactaacaattcctgttcgcattatttgtatgttgttacagtggaagccacttctgaaacctgaagaacttccaaccttggagacattggtgggtgctcggtaacaggatgtttagcttctttttacataccatggtttttgacaatcatcacaaaccattaccgactactaacatttgtagcaaacttagtactgaacatgaaccatgatgcatcataagcaacagaacaccaaatctagacttgacctacctcccacaatcttctttttcttttctttttctaatagaaatagaaaacctcccacagtgttctcactgatttgacatttccccaggcctgactcaggaaagaacccaaatctcctcggacaaggttgaatctttaccaaaatgttgattgagtccagtgtagggctcaacatccacacaagaaaaccttcatgagtcatgacacagatacgcattgatccagcagttatagtatctcaggctcatggatgggacaatcgaacatcaactgatataaacgcactaatgtagtaatgctataacaagacaacgcgtgcacggaccaaatcaatcatttcggcgggacgaaattaacaatccccatcccaaaaatagaatcattatctaggtaggatcaaaagcgcgtagacgaggaaaaaaatgattggtacggacctaaatcatggtggtattcgtagggattgcgcatcattctcttcatggcggtgttgtagtcctccatcctagtgctccccgtcgtggaggagcggcacaggaaaaccccagaggaactccgccgccgttggctcctgcttcctccggcggccatcctgctcctagcagcgacggcgccgcgcgctgggagtcccggggtggccggaaaacacggggcggtggccatggcggccatgtttgcaggatgtggatgtggcaatgcgacgatgcgagcgaggcaagcagaaaggagaccggccggtggtggtggtggtggtggtgggattcccggcggatttggcgcggcttctggatcccggcgacttgggacgatgcacactcgtcttattaatcacgtaggtatctgaaaagcaagaaatcaaagagcgtttgagcaccaggagaagagaaccttgttgtctagcctttttgcaaaaatcaaagagaatgtgacaatgttgatgtttgccaaagagaagcacttgctatagtttaaccttatgtagtcactcttttttttctcttttttttattccaggatgtaatccttttttagatatattcgatgagatgagcattgtctcatacggttcattggaaaaacgtttaatcttaaccatccatttattttaccttattttatcttaaccctccattcgttttcatgtcaagaccataaatgggaagaggtaagatggagttgcgtctagatgctctatcccatgctttgcaagaagagaagacaaaaaatagaaaggcaaataagacaagaaaaacaaaaagagggggcaaggcaacccgaaggctaagctagggtttttgccatggctacatccggactcctgagctcccccttctccattccgatctttactaatcctgcctgaaggataatatctctgatacgcaccaaaaagttgtctttaaataggttccctctcataactagtttaggtttgattatatcgttagtgcatactatgtgtatctaagtaatcaaaagagtataatcttcttatgtatacatttataatcgattatatcgttgatatatgtttttagtgtgcagccacacgatttcacaacatcactacctaaattttatttcattttggtttgcttttgcttattgatagtgctaattgtaagcataagctttctctatagaaaacacataccacaataaaaaaagagacactttcatgagcatgagaaaacttcatgttgaagaaactatgagtgtgtgataggcaaggtggcaattctaatataacaaatggttccatttcaaaacctaggacaatatactggacaataaaactaaatactagactctctttcttgaaagcaacccatagtatttgacaaacactttgatttaacaatggaaagtgaacattttgtgtacacttttagaaagcatgtgcttaattactcaataggtgttataatacattaatactatggatgttaatataattaaaataatatttaggaccatggtagtatgatacacttaaaaatatgatgatatccaaatattgcatttataaacaagatcttaactggcagccttatttctttcttggtgtaggagatgaatcctatttttatatattcttttcaccgacttgtaatacactactatgtaaatactatactcttaaattaagagaagaacaaacatgtactcacttttagttatacacatagggagaactacaatacttcaccattcttttcttgatctcttaaaaaaggaagctctataaagaaagtaaagctaaggataagggtaaaaagaaagtactatgatgaatagcttggaataacctagtatatgctaatattagttgaattgaaaacaactactaaaacaagaataaaatgttgcattaatagtcaaaggctgagacaaagcacataagcatactctagaatatacaaaacttttaggaaatctgaaaaattttcaatacaatttctatgttaaaaaaattatatattgtgttttctttaattgtgtagtactagtagtcggagtaaggagaagcaaaacatgaggagggagcgacacaaaattaactagaggaaagaaagcaaaaatggcaaagaaggaagaaaaaagaaaagggaagaagaagaagagacgctggcagcagctgcgtcgagacgctttatcccttgcctcgcgagaacagaaaaaagaaaaaaaaagaagaggaagaggggaaggcaatccgaaaggaaattaggctagggttttcgccatggctaccacccaccacctcgagctccccctctccattcccaatctctccgactcctcctaattaatcccgtattcccaccccccaagccaaggacagcatctcgcatccgcgtccttcaattgatttgattgggttccccccctccatttcagggtttcgtttcgcatcgcagcaatcttcccgacccagcaagcttcttcttcccttgggtccgttagggtttgagattgagaggggcggcgctggcgatcgagattggtacggcggcggaggcggaggtgggcggataatgtgtatactgtgcgccgtgcaacggtggtcgcggcgcgtcgcaccatgctgccatggctggtgctcccgctcatcctcctctgggcgctctcccagctcctccccgccgcctaccgcttcgaggtcacctcccctcgcctcgcctgcgtctccgtcctcctcctcaccctcttctggtacgagatcctcctcccccgcctctccctctggcgcgcccgccgctccgcccgcctccgcgaggagcgccgcgcccacgccctccagctccacaagctccgcaagaccgccacccgccgctgccgcaactgcaacaacccctaccgcgaccagaaccccggcggcggcaagttcatgtgctcctactgcggccatgtctccaagcgccccgtcctcgacctcggccctgccgggaccctccccaccggctggccctgcacccaggattggccaaatgctgccggtgaccctgcctactggctcgacctccgctgctcctccgataacctgtactcggggttctcgtggcgcttgttctcttccttctgcgtcagcatgaggtggttctggagggaagtgctcagatttggctcctcgggggacggcgatggcttgggccgagatggtaaaagattagcaaaagaaggggagaacggagcaaaggctgaggagagcagagtcgagaaggcgaaaaggaaggcggaggagaagaggttggcgaggctggagaaggaaatgctagaggaggaggaacgcaagcaacgggaggagatggcaaagctcgtggaggagcggaggaggctaagggatgagaaagcagaggctgaagagagatccaaaggcgccacacctgttggggagaaggatcctcggaaggaagtggaacgtagacggcaggagaggaggaggaaggacgagaaggataagggatcaagcaagagcaattcagattgcgaggatatcgagagaagagtaaccagggaaggggagagaaagcgggattctgatagaagaaatgagccagagaagcgggatgcaacaagagttggcgctgagggtcataagccctataattttgatgctaacaaccagggtagtaagacagtacagagcaaggcaaagtactttggccgtatgacaggcggtctgttatcttcttcaagaggttttggtggcggttccttttttggtagaagtgctcagacctctgctcctcaagttaacaaggtgactaaaccgcttg

SEQ ID NO: 82302 - DNA, 618 bp, Oryza sativa
atggtaattgcagaagaaaatgctaagggaacaaaattgtaccttcagtttagaaagtgtttcttgtgcagcaaactttctagcggcttttgaattccgatttgctgcagtacaaatgataattttgctctttatgttaacttctactttgacatggtactctccatcagctttcataggtttcggaaggcctaactcaaatccatgacactgacaaagctctcgaagttctctcatcggattagtgtgcatgttggcgaaggtcaatactggctttagaagcataagcattaccttccaaacatagttcaggttgaagcctgaatctaaaagcactgcgccaatacaagattcaacaatatcaccaagagcctgtattgttgtagataaaacttataagcttttgccataaaaaaaatcaatcaatcaattacatataactaattgcttacagaaaagatcacaatcatggtaatgagctatgattaataattctctaatacacttgcaattattgataacacttttgctcattttgtagaacttataaatctcccctatcatattgaatattaaacagtatcctcgaggagtactccttccgtcccataaaaagcc

SEQ ID NO: 82303 - DNA, 671 bp, Oryza sativa
tgctccaatctctttctctctcctcctcctccacctggatctccctctctctcctccaagaacaggggcggcgaagcagctaagccggatttcgtggttggtggcctctccccttccaccaccaggctcgccccgccgctgccgcgaggtgcccggccgcctgtttcttctctccggtgcatttcgatctgattcccccgtccgatttcgtgtccgtcctgcttcacacccggatggttcgaatcgattcttaaggaggtgaggcgtttaatttgttgttgagctacgtgtaaatccccccctttacatatgcgtggagagattggagcgggcgtatggagcttcgctgagctcacggcttcttcgggataggcgggggaggagggggtgatggtgccatggttggcatgaagcttcgtttctcattttccatggtgttggaatgcagcttctcagcttgagcaatttgagggaaatattgtcaaacccagggagcgttttctcagagcagtgattataatttttcggtttattagcattctttttttaagtatacaacttcctattttcatgtaactatatattttcaaggattgttactgtttaatttgacatcacggctgcatggatccatttcctcctagatagttgcagcttcaactcaatctgct

SEQ ID NO: 82304 - DNA, 5493 bp, Oryza sativa
ggagcttgaccggagttcttgtcttcggcgacattacctgagacgccgagagctcgtcgggcccgagtatcctccaaggccaccatgacccgttccgtcgccggggatcatcgtgtgggtgcggtgacggaacggtgacgtaaatcctggacgacgacggatgcgacgacggtgatggggattggttgagggcgagccggcggcggggatcggtggcggcgagacgacggatgcgacgaaggcggagcggcggcagtcgagggtggcggcgacgacggatgcgacgacggcggagcggcggcagtcgagggcggcggcgacgacggatgcgacgatgggtgacggcggagtggcggcagtcgagggcggcggcgacggtggtggcgcggggatcggtggcggcgagacgacggatgcgacgacggcggagctgcggcagtcgagggcggcaacgacggcggtggtgccgcgtgagagggagagattagggttggggagcggcgcgcggttggggaggggcggggacgcgtgagagcgagagaaagggggcggagaggatggcgcggtggagaggtggagacgatcctgagcgttggattttacacagagatgatctggaccgttccatgagtaatgaaagaatgagtgatgagtgaaacaccttgttgaactatagagtaagatatatgagtgcaagttagatatttattatctcaatttatgtgattaatgaacctgataattacataatggaaataaatggaatgataataattttcacatctgatctgaataataaaatctcatccactcgaattcatgtttgaacggtctaaataaatgggagcgataatggttttgattttgacatccaaataacatttttgtccgtctaagtctacatccggttgaatttgagaatataattagttacctttttttgtcgcaataccattaatagttagcaaaatatatcaatttagtatcaaatattctaaattatctcatgtaagtgcttacattgttattattgtatagttgaaaacttgaaatgaaactacttaggtattcgattcggaccaaaatagattactaactgattctagttcacatattctccacacatcatatttgtattctcacttgacacacattcgattcattttccaatccgtctcaacttatatcgtgtatgatatagtttagccattatccaatttgaaattgaccgatcacacccctatctagacctagtcgactaactcgacgaggtaagcagtggcaagatgtggtcaatgatatggtcttcggcttgaggttgttgatggcttcttatgcatgatagttcggtacttcggtgatttcttgagttgtgtttagttcctgaaatttgggagaagtttggggaaagttggtagtttggaaaaaagttaggagtttatgtgagtaggaaagttttggatgtgatgtgaggtgatgaaaagttgggagtttggagaaagtttgatgtgaactaaacagggccttggtgtcttgaccttacagggtattcgtatctctaagttcctgtactcttgaggtactcgtagagagaattttgatcagctcatgacaagtcatggtcatatctaacttggtcttgtaaaatcataccctatttggtggccaatatatataacatatttgaggagctttaaaattctaaaaagcagtcgattggcaatcagcttcgatatgagaatataacaaagctaaatttctcagcttttggcttctaatttattttctaaattttacaacaaaaacctcgtgagcaagtcatcagcactccatcggtataggccgttttcgtgagcattgggtacgaagttgaccctctaacctccttgaccaagcgttgcacgaccaaggctgatgtagggaggtggagcacccttggggcccataatgggatcttttttttttgcggggtccataatagggtctttgatctacacacgagacaattcgtggtaggagccgatatggctctgatatgatttgttggctctcgatacaaataacacacacgaaccttgggacaaacacctgatgtttcaaccacacgttcgcgtgtgtgattcatagacaagagccaacaagtagtattagagccaagtcagctcctaccgtcgaccgccaatccgctatgagagtgtgtgggactttccccaacccaccttcccctctatgccggcctcgtcactgcgatggcggtggccgtgagatggtcatgcagcgttccacgacactccgcggttgacgacacgcgccatcccacgcatcccgctcagagtgcacacgacccggattccatatgcgcgccatgagcgctccgcgacccgcgtgtgccgtcgtagcgcgcgactcggactcggactcggacgcgctaccgctgccaccacgcagggtgctcggctgcccaacgagaacagaaaagagctaactaatcatgccaatattaatttgtagatcaacgttggtcacggagcaggtgggcagaacaagaagcggagcctgtcgaggcgtcggtacttgatgccgacggcgagcacggccatgacggcggcccagatcagcacgtccatggcgagcgacgtccccgactgcgacgtgacgaacgtgagcacgaggctggagtaggacaccaggaacggccactgcacggcgcgcgaccgcggcggcacgccggtgagcagcgccagcgtgagcagcatcgagctcccgaacccggcccagctcgccgccatgaacagccagtaccgccgccggtgcttgtcccgcatgatcgggtcgccggcgccgtcgtcctgccagtaccctcccgggatgttcgtccccagctggtacgtcagcgccgtgatcagcgtcgccaccaccagcagcgtgtcgttcttgttcgccccgaaccccggcgcgtgactgcggccgccgcccgccgccgccggcggcgacactgccgttctcccgccggtggttgtcgcccagctccccgccgacctccgccaggtggccggcgcggccgtcctcaactgctccggcgtccatcttacctcaccacgccggcccctaactcaatgtccagctgcaaagcttaattagatcggagaaagaacagtaaaatttttgcagcaatttagacgaagccaatacttcttgtctactaagatcttcttttctactcctatcttgtgttcttgttttcaaacatgctgagtgcatatgcacacaaacacacgcaccgccatatatagaggagaaatttcatagttaaatcacgtactttcttgatcgctgccaatcggtttgggaggtaatttctctgaaggagatgggaagcacagcacggagttgctagtccactcaagtcttctgtccgacgaccttgagctccgtggatatcgcgcgttcaggtaaaaaggacctggagctctggtccgatcgggcgaagactgaactattcagtctctcctcgtcaacgccaagtccacgtggagtctactacatgctgggttctgcttatcatattaatccatttttaaagtattttaaatcataccgaatgcaagttccgttttccactctacctcctcccgaacacactcgtacggctgcgtttgttgcaccagactgagagaggaaaaaatatatctgttttctgttttcccgcactgacgcttatgctaaacgatgtgtttttttataaaattcttttaagagaattagtttaaaaaaggagaacagctactttagtccctaaaatttctttatagaatcagtttagtcctaaccttttaaatagtctaaagaaatccttaaactttgtcataaggcctagaatactccttaggtccaccaaaatcatcatatggatatgccatgtcatcattcatgcaaaatctatgatgaattgtctaatttaaccttatgtatatcatagaaaaataaatataaaagtgaattagacatagccataggaaaaaaatactctttttttcaccctttagaggtatatttttgctcttacatataccatgtattttttttaactttttccttttgttttttattttcctgtgcgtaagggtaaattggacaaatcatatagattttgcataggaatgtgacatggcatgtctgacggagctcgtggctcctcaccgggagaccgcgcaggcccccctttgccagttcggccgggggcttagggtgagatctcaagctctctctgtatgtgggaagatcgcgtgcccggaagaaacgcgagacacggacgatgtatacaggttcgggccgctgggaagcgtaataccctactcctgtgtttttagtggatctgtgtatgagggagctacaaagtattcacttcctttcccctctgccttccaaaagggaaaaagtccccccactaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggtgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgccaggccatgtgggcgattgcgtctgcctcaagcctctggtcatgatactcccggtcccatatcaccgacaatgtccatgtggtgattttggtgggaccaaggactatatcagtccacatgataaatttaaaggacttgtttggacaatatgaaatattaaggactaaaatgacccaggagcgaaactttaaggaccatattagctattctccctttaaaaaatcataatatttatttttttaaaaaatataaaataattaatacttaattaattatacgctaatggtttaaatcgttttacatatttctcaaatttctttt

SEQ ID NO: 82305 - DNA, 17075 bp, Oryza sativa
tctgaaagtcactctttccttttcttggtccctagtgtacttctgacctgaagagttaattaagttaaaaaaggtatcaaccgtatgtatttgcatgtatgaatttgtagctcctgtttggattaacataactgtaatgggagatggtttttttctcttaagttcaaccccccctcccctttttctaatataccatctaaatagttataaaaatatataaaaaaatagaacatagattaatgtgtgacatatcgcttaacaaacatacaagtttcagtttgacctatacaaattgtaaaaaagaataaacatgattgtaaatagtaacgtactatctagagtttactttgttcttttacttgtgttgattaaatttaaacatgcaagcttatgtagcaatatatcacatattgatcgatattgttaattttgttaagaaaaaactttttggttgacattcaaaaattaaaacaataagacatcttagacaaaagagatatttaactatttgccactcttctaaaccaccactctctgtttgccactttttcccaattttggttacttcgctgctttttttttttttgttatttaggttagattcgggaaagtttaagaaggagagaaaattcatggttattctgttatgtttcttgataaatgtttgttgtaatcgacatgaaacatcttcgctttgacactcttcatctccctgttttaactcccttttccttgatttcataaacctgtatctatttcatggcccaaattagtaccgaggaggatggattcacctcaactcgttgcatgcaatgcaagaaatgaatatggttgttgatctttttaattgattccaggccaacattaaataggaaagtctgaaatggatcaacggggaacacaaagaggacggctaagtgtagaatggacatttcacgtcacttgtccatgctgatatgcctatgtgtcatgccatgtaagtaagtgttatctgatcatacgattaatcatcctgatcagtcccctgactccgattagggacattcattcgatcagcttgatcagaaatctgatcatttgattaatcgtcagtcaggtgcgatcagatcgagcacctatcgatcactttcagaacaagtcttagggttgagcacatctgaatgtgtgctacaactgttggttgctttatacgtactagggcaagtaagtgatcattctgccatcaattataagcactgattgctttataccatccattatactatttaggttctggtatacatagtaccgatcaggtcaattaatcgaggctgatcgacgattactcatcctggtcgatcccttggcgatcaggatcgattagcgatcagataacattgtacgtaggcaaaaaaaaaaggcaaaatattaacgatatttctctcacgattgatcgagtgggaaaatttttaggacaatcttgaaagtcgcatttgaatagtggctgtttcttatagtggcaaaattaatagttaaaatttccgagacaaaaagactttcccatagtaaatgttgtatttttacctgggcaaaccgtctccttgtctaccacatcatccagttccacgcagctatacatgtcatcgacaaacctggttaaaccggcgtcgtcgtctgaacctgcatatgcatacatgcacaagttgtggtgcaaaagaattcagagaaagaaacatatacttcatccgtcctaaaaatataagaacctaaaattgaataagtgtccagataaatcgcactaggaaatatttcattcaatcctaagtttttatattttagaatggaaagagtatactagtacgtatatggagatgccaaagtgtacgtacgtacgtaccatattctatgggcgctgggtgagcggaggcaacatagcttgtcgtctcctcctcctcctcgtcgtggagaagcagccggtctagtaattccggcggggatttaggccgcaacggcggcatgatcagatccgtgcagccgctgggctcggagggttcccgagatccaccgctaggttcatcctcccaagatgccatcagccacgcccccacgcgacgccgccactgcttccctcgatcgaccggcgcgccgccgccgccgcaatcgccagcgagggcagccgtcgaaagacggcgcggcggcgccggcggcgggtgaccaaaatataggggacaaaaaagacaaaattagttctagagcatcggaagttgtcgattttggttttatagcatcaaaagttcaaggctcattttgatagcacctgaagttacctccgttacttctgtttagcattccatccaaactccagttagttttcttttcttattattatttttcaacaaaaaattagatcaaacaccaatggtggccctcttccacttccttctcatctcgaaacagcagtcatacaggagctcaggccggtcagccatggtgcgaacgcagtatgctggctccacgagctcgtcatgtaatacttgagccctcacgagctcatccgcaagccgctgtgttcatccgcgcttgctaggtgtgatctatccacattctagctttgcccggacagcgccatcgtcgatcgatctcgtctgccgcgccgccatggccatgctagagcttgttcaaatcttgcgtgctcaaccaggtccatttcctccgcggccgtgccgcttccgagttcgtccgtgtgcactgccctcggtctcccctagatgcgtcatcctcaagctcatccaatccatgaacgcccgaagtgtcattgtccagctcgtcgccggcattgtcgggaccgcacggaagcaaagccctccagattattgtcggcgcccttgagctctctccgacatgctgccctcgatcgagctcatccatcggccctcaaattcgccccgaagcaccaccctcgcgctcgttgcgggctctcctgagtgccgacccactcctccttgccctggatccgttgtctaccgacccaagagccgccgcctctagcatgccagaaccagctgccaccatccaaggctccaactcgctcagcgctatactgtcatggtcgagctcgcctgatgccttgaagagtggtcaaccataggagggagagcgcaggaggaagaagatagaggtaggatggggtgagccgacggaactgctgacggaatgctaaaaatagtaatggatgtagttttcagtgctattaaagtgaatcataaacttttaatgctatagaatcaaaatcgagaactttcgatgccatagaaccaattttgccatctccggtcgatgcgagaaatggcgcggagttgaaagcccactaaagcccaaggcccacttagctgctgacacatgggccccggcccgcttggcccgcggggaccccatcgtctcactcacctcccccccgcttcctttctgcctagggtttctctctctctctctctctcctctctctctctctcctctctctccaatcgaatcggaatccatggagtcgtcgcggtcgcggaagcgggcccgccaggactgggacggcgccggcgcgccgccgccgccggcggagcgggcggtggtacgtccgtccgttcatccctctgtctgctttgctcgatgggggtggtcgggttcctagggttcatgggggctcctgtgctgacgttgtggtgcttgcaggtggcgaggggcggcgcgtcgccgccgtggagggacgacgaccgcgacgggcactacgtgttcgacctcggcgagaacttgaaccgacgatgtgagcgccaccccgttcctgtctcttggttggctgaaaggagatttgtgtgttcttagatcctgcctgcttggaaactgcagtagttttgttcagttttatgtggtgctgtagaattctactgcgaaagttcattgcaataatcgcatgagtgatttggacattgattacctagtgtaatacagtataatattgtatctgtgttctaaaaccaagggaggtgaatgaaacaaggttcccgtttggattagcaactttctgttatgttaataaactatatatgcccttgttccttgcttttgttcccagcatttattgatgctaattttagttgaaattgcaataaccgtagggctttatagctatttaggttctgtgagattgttcgttgatattcttctcttcttggctatgcagacaaaatcttgagcaaaatgggagaaggttggattttctgcaatctgttccctagtacctggtgtctttgctattattgtaatgtaaagcaacaggaatcattttaaatttttaataggtacttttgggcgtgttttggaatgctgggaccgtgaaacacatgaatatgtcgcaataaaagttgttcgtagcatccgcaagtacagggatgctgcaatgattgagatcgatgtgctcaaccgccttgcagaaaatgagagatacagatcactgtgagtacctcaaaatatttgatcccaaaaatcttagtcttttctgtttctctcctgatcagtcttccttactggccagctgtgtccagattcaaggatggtttgactatcgcaatcatatatgcattgtaagtctcaatttcattcatttatgctagttctaaaaatctataccaaatgtcagttgttgatatgcgcatttacagttccaatattccatattccacttttccctgttagttcaaagttttgtttgttggcaatttactttgctggccctccgaatattcacctttttgctcgtaggcagtgaaacatgctgctatgtacgatatggtaatgtgcttgaataggatttccatgcttataaaacagttgtcgttctttgctcataaaggtttgccgatatggaaacaaatcaaagataatttttcttcaatggatatcgatggttttgtcaggtttttgagaagcttgggccaagcttgtatgattttctaaagagaaatagataccaacctttccctgtggaacttgtgcgggagtttggacggcaactgttggaatctgtagcatgtgtgtgattgtttgattctgcatatcaattcttaacaaattcggtagctgctgattcattcttctgttgctgaaaaggagcatgcttgaccatcttttcctttctttcttctaaaatagatatgcatgaattacgccttattcacactgatctgaagccagaaaacatactccttgtgtcttcggagtatataagggttccaggttccaaggtaatgtcaatcagttttgtagtgatcatctgctattctgaaactaggcatgcggtattagcagttatgttgaatgatcccttggggttgtacagaagaattcacaagatgagatgcatttcaagtgcttaccaaagtccagtgccataaagctgatagattttggtagtaccgcctttgataatcaggaacatagctcgattgtttctacaaggcattacagagcacctgaaataatcttaggtaaattggttatcttttaaggtttgcttttattttatcttgcttgagtttggaatatccttgtgatgaaggttaatgtggcctcgagtatgctccaatggagcacaacaaaggtgcaattcaaaatccttggatgcaataattgataatgctgttagaactcttatttttagtgattcgaaatgacagaactcattaaaacaatgaaaacttcttgccatcactataatcatgttagtattggcagaagaaatagcacttggtctacttattcgtcatttttttcagtgtactatctgattatgctttatagtaaagtggtaggcatttgactgagaagaatgtttttattaacttggtatttttagagatggagcatatattcctccctagataattctgatattcttgaatatgttcctatgacaggcttagggtggagtttcccttgtgacctttggagtgtcggatgcatcattgttgagctatgctcggtttgatatcttgtcatgcatatttttcctttcttttaccttagcctatgttcctaaccataaaaaacctttagggggaagcattgtttcaaacacatgagaaccttgagcacttagcaatgatggagagggttttgggtccactcccagaacacatgataaggaaagccaggtacattgtggcagtgtgcacactactttgatgatcattttcttttacctttttctgtgttgtcctcaatatagcaagtagtaaacgaatctatgttttactgtttaatttggcatttgacaaggaaaattttaattgtatcactttttaaaaatattttttgggttttcctttctatagaacttgacttgttagtggtatgctattctgccaagttgaacccctcaatatgtccgttttcttatactagcttgtaatttaacaacagtttgttcatgtgtagacccaaccttaaatccagggttttttttaacagtttatagttactccaactcactaatactcgagtcttatatttcttttgattgatttatccatagttctcatataaagtaataataatagatgcaactcatgcgaatgctgtttctgagtacgtcatgtggctgtcatgttaactttggctatggtatgctaccatttactgtcttgcaatgatcaatcttcttcattttatactgattttccatatttgcatcgtgtatgtcaactggaatatgcagttcatcagctcagaaatattttagacgaggagcgcgtctaaattggcctgaaggtgctgtttcaagagagagtatcagagcagtcaaaaaactagatcggctaaaggttttggttccctcaattatgtctctttttttttgctacgtttatccccaatctaaattatatctctaaaattcaaaacaatattatgcatattcctgttcttcagtctatctcctgtctgctacaagtaaaagaaataccatgcatagaaacatacaaatcaagagtagaagcagaagctgtttttttttaatgtaactatgcatctatagttaatgatttgtctgaatgaaggcatattatgtttgtaaatgtttgatataaagcttatttcagttttgtcagggtgcagatagaaaaaataaagttccattttctttggtgaactggtcctcttgtagtgtagtatctgtttcatttagtgatttactatgctgtttgtgtggtaaattcagagtattattctgctggttagtaaaattattccttcaaatttccactaagaggaaatgagaaagtattagaaacatattctgaaatatctgttctgaagaagattcaacttacacacctcaaacattatggactgaaacttcaggacttagtggcgaggaaggctgatcattcaagggcggtgctggcagacttgttatatgggcttttaaaatttgagccatcagagcgtcttactgcccaagaagctctagaccatccatttttcagaaatacaacatgagtacatgatcatgctgactctacccctcccaatatgtacgtgaagaacccaagcctggagaaagcaggcgcaaggacattcccatataaagcagaatgccttcagctcatctgtaccataaatcttctgtaagctgagctataatgcttgtggtggtgacacggcataactgttacgttcacccgatgtaatgtacaatagcattgaatctagggaaggttgatgtagcagatggaacttgtgcattgtgagttgtgtgatacatgaggaattgcattgcgactcatgtcgcagtgacacaacaatgaccaaagcaggccatatatgccccttccaaatgcttgtatgatgtatccttgctggggtgttcatgttacttaaacatctctgtatcctgaagttccgttgaaagcctgacaaagtacatagtagggttggcacttggcgcctgtttgtcctgtttgcaacttgccatgacttcctgaaaaatgttgtgcatacactgttacagatttgaatcttcaaaatgcagagagcgagaggaattttgattcgacaaagaaactgcataccgtgagaatatttgttgcaatggtcgataactcttttttctttttccatcttttggctttggaagccaaatccaaatccaaagcgaaagccgatctggtggcgatttggaaatctgtcctctcgagtctcgactgctgctggtgtctggtgacacatgtgttgctgggccagtgccctttttgtcacatgtggaacaacccctacccccttttttccttcacggtgtcacgtcgcactcctttggcccggtgttcggtcggtgttcccacctcggcccgctgctgcaactgcagcgtctgcagcgacttgtgatggtctggtcagggcacgcacacgacgccgcgccgtgccatgccagcttgcctgcactgcaacgtgggacacggacacggacgccgccgccggcgagccgtggcatcgcccggcgctgctgggggcaagcacctggatgctgggtagcgaaagcgaacaaggacttcgtgccaagtcgatgagaaacacaagtcgatgagaggacacctccacgccatgccatgccatatcgagagtccaggctttgtgggtggctgcgtcgtgtccgtcgccctcaacgtggcccgtcagtgtccgcggcaggactcgtcctttctcctgacgtggccgcccggtacatcagaaaccgacgaggcgcaacactgcccagcttggcaggccactctctgtttacgatcaccttatgattcgtttgccaaaatttaaattttaagacttaggcctggtttagtttccaatattttctttaaatttttaactttttcatcacattaaaacttacttatacacataaacttttaacttttccgtcacatcgttccaatttcaattaaacttctaatttttaagtttttttcatcgcagtttgcttttaaatcgccagtaacttttattcgcaaactatgttttggactgataaaacagtacggcttataatcagcgtaagcgaaataataacctacaagagtcggttctgtctttcgtcttgctttattatcagccgtagctttataagttttttagttggcttaggatgattacccgcacaaacgcaatttacatatgattaattaaatattaattattaaaaaaaatattaaaaatagatttatctgatttttaaaatcaacatctacacgaaatgtatcatttaacgtttaaaaaatgtgctaatgaaaatcaaggaatcaaccaattcaaattgtagtttagaacgggcactaaatgttgagatttaatcttattactgctaattttacccaattaaactacggattataattgcagctcaaccaatccccttctttgaggaattagccaccaccacaaccgatatagattgtctacggtactgcagcctgcagtagatcagccactgccaccactcaccactacagagtacagaggatcggcgcccaccacatcacccatgtcccaggatccaggccatacagagatcacccgagtcccagggacccaggccatacagtgataagagggaaacaataaatgtttattactatgccaattaaaataaatcaatacaataggtatgattaaagcttaactggctaggtttcttacagtgaaactaatcaatccaatatttaaaatgctaaatttaacacgacgataaaatattcttttagtgatagataatatactcgtcgataaggagatactcgtggtggcttcatcaatcaaaaatacgccggtctaatcttttataggtgtttatagtgatagccggataagatgtgtgtatgtttataaggacgagcgtgcgaggagaagccgctatcctcgcgacgtgcgacaaggattaaatcaaatcaagccgtctcgccttggggtttcccatccctccctttaaaaaagggcgcatcatctctaaactcccctccacatctccaaacttccaatttctctctccacatctctctgtgtttcttttatttctcctctgctcgcggcgatggcggcggcgaacggcggcgacagcaaggggttcgaggtgccgaagctggagatcaagttcaccaagctcttcatcaatggccgcttcgtcgacgccgtctccggtacgtcgctgcgtgcttcctaattaatcctccctcttgcatctttcaccttttttttaattattattcttctcctgatgctttttttgactcacgaaagttagcaacaagaagcatctgttagtacttctgtttctttattgtttgcaactttctttttttactatctccgtttcgtattagaaattaacataaacttctttaagtttaacaatttttttaaagaaatagcaacatttagaacacaaaacaaacgcaatattaaaatatattaaatattggtttagatgaaactaatttagcgttgtaaacgttgctaatatttttaataaacctgaacaaactcaaaagtttgattagaaaaaaaatcaaaacgaaaacagagacggatatagagtattgattagtcacaatacgtgcgacaccctgcgcttttaacaccaagttagataaatgtgatagccgagtagtatctatagcgtgttaagaagtgcgggacgtcatagtacgcaagtgagggtgatttatcgtgtaaaaaagatagaagaaaccgaatgtgaggatgagacaatggtagtatggtatctagatttaagcattgcttcggagaatttgtttactgaatgaatgcatgagtttcaccgaattttcgaataaataggtataattcctgtaaagttcattaaaaaaaaacctctattccaaaagaggcttaaaatattactaccaaatatgcatatttaaatgcatgttgcatggtccaccctgttccatgtggaggtaaatcaaatgaggcctaatatattaattactactactggacaacttgctagttatggggcttagctagggatcaagtcaaatattccaggattgtgccaatgctgaagacaactttggacacgggcatctttgggatatatcaaaaaaattaactgatattggttgtttgattgtgtggttgtgagaaacaagagctaaacctgcttacatgttaggtacttccaaacagaagttgtgccatgccatcactctatatttttttcgttttgaaagatccatcactgatcaaaacagcagaaattatggaagcctctttttgaccaagatctagcttttttaaacaaacgcaagaagatgatcaaacacaccacacacatttctacatacatctcatcaccaaagatcttgagcggatgggtacgtatagaacacgtcatcaaccccccccccccccccccaaacatctcactttcaagaagatattgctcgagagaaacacacgtcatggagagctgaaagtggatgtacttccaagagagcgagaacactacagctgcatattgcgtgtgaaagactgaaaatctgaaactgtagagcctgaagaaggggggaaaagaaaaacagagtgtcgactccgtgtgaaactctgaactgaagttattttttttttcgccgggaaggccgaaggaggccaaccgagtatattaagaaggaataaaagttacaagagaaaaaacatcaaaatacaccaaggtgcattgccacacaccacacgctaccacccaagcacaaaccgctgagggtgaaacctagcaccaaacgacccccgctaggcctacggcaacaccacagagacgaggctccgaaaacgatgccaccatggtggtcacgacatctaggatgccgccatcgcccatctaaaaagatctggttttcacccagagaagctcgccaagaaagggggagggtaaccctcgacaacgctccaaggagattacgacgtccgaagacgtagccgctgccggtccggtgaaccaccggactaggctttcgcctgggaccctacaaccttgactgcagatcgccatccaccaactcagaaccaccacacagacaaatggcagcacgtggcatccaccataccgcaccgatgcccctccgtcggtcgacttcaacgaaccaccacccctgaaagctggcccaggactcctccgttccaccacccgccggccgcctcgccagatttggccgaaggagaacccgggactaggtggcattgcttcggcagcctgagcttcccccactgacgagctgccgcctcaatccaacctagaaactccccgcaaagaaggggaggagctccatgaaggctgagggtgccgaccggcaacgaggaagacgacccaccaccgccaactccctttgctctgccatctggccgccggtggtgctgctgctccagaccggcaccacccgccggcgcccccgaagtccagccgtcgctcctcccctagccaccgcgacggcatcccggctgcctggcccccacgccgagccgccaccgaggcctggacgacccaccgcgccatgggctggcgccgggcgaccaggccgagcgagtgagcgggggtgcccctgccgctccgggcaggctgcgctgcccgccgcctccgcgacccggccggccacgacgagccgcggccatccgccgcccgcgcctgccgctgacgagccgcctccacgtcgagccgcagtcgtccgccgcctccgcgcccgtgccgggccggcctagccgcagccggccgccgcctcgccgccttgccgccggccgccaccacgaccgcatgtcgtcgcgccgccccaggcctcctcgcgccgccgccgcgcagatccaggcgagggagggccggatccggccatgggggctccggatccgccgcctcctcccctcctcgccgccgtagctgccatggaccacgccggcggggagcttcgtcgtcttcgactcttcgtccttcgcgcagagaagggagacgctacgaagagaagaaggcctcgccgccgccttccctgcctgctaccggcttcgccgccggcgggctccagcggcggcgaggtagggggagggagggagagaaggcgcgggtggctagggtttttgcgcccccgagccgcccgacacgaaagctatgcgcgggggagggggggctgaactgaagttaggaaattaacaacagagggtgtgtttagttcacgctaaaattagaagttttgtttaaattgaaacgatgtgacgaaaaatttgaaagtttgtgtatgtaggaaagttttgatgtgatgaaaaagttaaaagtttgaagaaaaagtttggaactaaactcggccagaatttccaggcgtcactgcctgtagctttgtattaaattttagatgaaatcaattctttttttttcctgggaatgatgcgtgtgtccaagctatagcttaattagctagtggcggtgagcctatggagcgttgcgagacaggcattggcactgtgggaagaaaacgaagggtgggagagagcttgagaaggacaggcagatccacacagatggcgagatgtatccatatgaatatgatagtaatatgatgaactgtgtggcagcattgcaaaatgccacatggtaccatggagtaatatgcatcactagagctatatcatgtggcgcatcagtgtccgggagaaaaggcagggtagtgggacacatggaaaacgcggtaattttgacagtaacatactacggttttagtcaggtcaagagttgacagcacgcagctttagttagaactaagtactctccctccgttctcgaataactgacacggttaactatagaggtctcactttgattacaaattacttttaaataattatattatgaatttatgaagtatattttcaagtgtttattaaatttctgtaaaaggacgagcggtcaaaagtttaaaattatatagtggcagcgtaaattatttgagaatgggtggattattttctggtctctattggtcgtagtagaagcaatatgagccgttgatttacaagggtcttatcctattttacgggacagttataccaggcaatgtctaagttcaatgtatgtgcaacgatcagtgcacatatatatacacacacacgagtgatgaatcctgttgactgttgagactgagctgttcggtatctagcgttttcaggggcttaattaggtttatttttcataaagcatccgtacattttctttcttttcttttcttttcaataaattagacacggccgggccgtccgacccaataagtccaagcatgccactatcactatggcagataacactagcttgcaacgtcgcttatgcagacgccaataaaactggcattgttgtgctagcttttttcttaaaaaaaggaaaattgcattgttgtgctaagctaggggacgacgcctgcaaatatttcaatgcattattgtgctctgattgggctcaacactcaattacgtgttgcttttttctgaatataaattataggagtacaaattaagtacatatatatctgatcacatatttctcatatttgggtacttcgacattgaccatccatcctccataataatattatttttcgtgctagccaagtactgatttggatatataaatgatgaataggatgtttttgagcagaattcattgcctggtaatattttgcaaggaatttaaaacataggcctactttgaaatggagaaattttaaagaaatgttgcgtaaattaaattaacttctacgaaaagcgtacaaaattctttcgttcgaaaagagctgttcatcccagcgcgattagactagttcgtactactaaaggatgaagtactagtatgtagtaggttgaaagtgctttgaaattcaatgtctttattagtatttatttttatctcgcaagacatacgtgtacacaatattatgatatctctagagtaataggctcaaatgtaaaaaagttcacgtgttaattaattagcaataagaaaaatgtatgacatgtcgcccttccactttgacatcttgtcactaagtaagcatcaattatacaccccattaaattgataatgacattcaaaaagtgggattagactatattcatcaccatcataatgagcaaaccagacaagtggatggtgaaaaaaacaatgcaaatttgtcatgctgtggaaaatctacttggacctaacataaaaaagctagaggctaactgatccatccattaacattaagaaaaagacatacatatgtaaaagataaatagataattttatctgatcttccgagaaagctctagttagcctggatggttctgtatatgagagattatatatgtaatcttgagatggtgacaacctaattaattaattaattaacaagcaagcatccaggctaataaaccagtgactgctaataaaccagaagtactgtagacaatgcccattgaggtgtccctgaacaattttcaggtctgggtctgctggctctcaaacactaattaagtcagtaaaaaacaccttgtatgtcatcggagatcagataattaatctgattatggtagccgaatattatatggctctggttcgtctgcaacaataataatttggctcctaattaactctcaagtttcatgatcaaatcctggaattcatactggggatcgtccaaaatatttccttcagagtgtctgtcatgccggtgtcttcttccataattttttttagttacaagtgtttgtgtcgtggaagcaattgaaagttgttgatcagagattcagagacctgatgggtaatttatcttaagaaacatgcaaatatcagtctagctagttgattcagaatcgccatgtgtggtagctatcgtgcaagcgtgcaaatagtttagttttttaagctacgatatgttattgtcatgtgacatttggtaatcttttttttttcaatgattttcttcgaaactagacaaccagtagttagacgtcaacgctttggtttttaattgcaactagaatataaataaattaatttactaataatgagggtcctgtatatagtataaattatttcccttgcttgttacgtgtgcaattaagtataaataaagtagctagatgcattattatcgatccacattatccacttgggtagtaaggctacttctcagttctcacaagtgtactacatgcgactatgtgagaatctctgaatattattgtccctttccctctagtcaaacccttgttttacaatttattcttacaatttgtgttcagaatactaatttaatagggctaccataatatgtacttttagcacttttttcctttaaaagtacaatagtatatatcgatatatacgaccatatcagttgacaagttatttttgctcttttaaaatacaataagatgttctattatacaatcatacgggttaacggatcttttccctttatttgcaggcaagacattcgaaacccgtgacccgcgcaccggcgaggtcatcgccaagatcgccgaaggagacaaggccgacatcgacctcgccgtgaaggccgccagggaggccttcgaccatggcccctggccaagaatgtccggctttgtaagcgcgcctctctccaccatcgcccgaaacccgtaaacgggttggatccaaacccgttagttaataataccaggcggcccatctagttataccgcactaattgggcctaattaagcccagcttaactttgaatttttggcgccaattaatggctgcaggcgaggggaaggatcctgcacaagttcgcggacctggtggagcagcacgtggaggagctggcggcgctggacacggtggacgccggcaagctgttcgcgatggggaagctcgtcgacatccccggcggcgcgaacctgctccggtactacgccggcgcggcggacaaggtgcacggcgagacgctcaagatggcgcggccatgccacgggtacacgctcaaggagcccgtcggcgtcgtcgg

SEQ ID NO: 82306 - DNA, 12851 bp, Oryza sativa
atcagtattattacatgattaattaagtattaacttttttaaaaaatggattattatgattttttttaaaacaactttcgtatagaacttttttgcaaaatacatactgtttagcaatttgaaaagcgtgcgtgtggaaaacgggagagttgggttaggaaaattggggaaagaacccagtcttatggacacacctaactctacttctgtcctatttaattgtgcctgacgtttatctcgactccacgcgatcacctcatcgttatcgaagtcactcctcttcaccaactccgacgagattcctatgcccaactctcctcccctaactttggcaacttgctttgctggatatctgttgtcgtccctgatcaaccgcttgtttcttgtttttccccaccacatccgccatccatcacccctccttcgtccctacgggtttgatgatgacatcatggttttctcctacttcaatcatccctctaaagctactctcaccgtaaatctactccatctcaccgcctctaaccctaactatctaatcgagtgagatctcaccatctctatccctctagagttcaggtgtcatcctcatcgtcaatgagacctcaccatctccatccctcttctttttttttcctacgcccccgctctagaggtcaaagacaatgctcggggcactgaagatgtacaaaaaagcatgtgagtcttttttatattaccacttatcgatgttgagtatatcagcttaaaagctacatccttctcctattgagttggagtagccttttattgttttcattctagcttatcactcatagccaaaattttaaattttaaaaattaaatttagacagttaatttcgagttattttatcgaagtttttagcatctacttttaaaatcgctagaaatcttaactaattaaaatattcgtaattttccgttcgccacaagacggatgaaggcgccttcgtccgtcggcggtgcgccttcgcagcccccaaatcccaatcgctcttagaattggatacagggaaatactttctaaaatcggcgcaaccaaaactcaaccactctgtcacaaaaaatcaaccacaatcatcataaaatcacaaaatacatcacaaaacttcacaaaaatatacataaaaaaagaagaacaacaacatacatcacaaaacatcacttgcctgctgccggatccaccctcggccatcgccaccgcggccctcggccgttgccaccgccgcactcggccgtcgccatcgccacccgatccatccgcggtagccgccgacgccaccaccgctgccggagggagaagagaggcggcggagggagccgccgctccttatccggccacggacgccgccaccgtcactggatctgctgcgggaggaagacgagaggggacggagggagccgccgcagctagatctgcctgtggccaccgccggcggatctgccacgggaggaaggctagagggagtggagggagcccaccgccacaaccctcggatccgcctgcggccgccgccaactctccgccatcgccgctgtatccaccgcggaagggaggcgagacagggcggagggagcggccgccggctagggaggtgagatggggcggagagagctgctgtcgccgtccccgccgctcgcgggaaggggggaagggcacactacaaccactcggggggagggggtggagggcgctaccaccgctgctcggtgggggaggtcgccaccgccgtcgtcggttttcgattgatcgagagagagagaggatcgggggcgggaagggtggaaaagaattttaggattagggtttttgctgcagacatttatattggttgtgatcaatctagaccgtccattcgatcgaacggctccagcttctcgcgcatcgggccaccggactattgggcctccgcattattgggcctacaaatgggccgcaattaaaataaatgttttctctctcagtaattttaagcaactttctattttcaaaaatagcaccattttaattatttatgactgcttattaatttaattccaactaaattgaataaactagaacattggctagatttttctcatgatatggatttatttttcgactaaaaatgtaattatttatttgtcatgatatagaatttaaatttagactaaaattaaataattttaatttttaattctatatggactctattcttcttccaatattcctatttttttattgttctaattagtttctatatgaactctaaactcttctttcaatatttttattttaaattttaattatttttctaaattgtattcctatatgcactctaggctcttttggagaatattctagactcctcatccaatattatttattttataatttatactttatattaagtcgtattatttatatagacagattaatctatccagtgtagggtttttttttgcaaaaagatttgttttatgtagatatccgattggacaacgtgattttttttaaaaaaaacaaaatgaaagagtcctggtctacaatgagttctccttatttttttatattttactccaattaatatgagaatttctatttgagacttttctagcaagcaaaaataccaaagcagtgtgaaaataacttcggttaaaaacaaatatttttagtgttattacaccgtagcgaagcacatgcattttgctagtacaaatataaactttttacccatagttatttggttccttttttttgcctcatcgcagggagagaacgacgaggccgttagttttgtgatctaacggcgacgatgcaattatgataactagtatggtggcccgcgcagattgcgcggctagcatcattatattttctctcatataatagcatatatgttttctcattatattattaaaatatattacaatgacaacataattttaaattttgcaataactttacgaaactactaatgtgtaatattcatattgtattttatatacatgttagttattaattatttttaatatcaaattttagttatttgtgaattatatatattcctatatggactttagaatcgtattttaatatttctttttttaattctaaatgtttattatttctaattgtatttctatgtggactctaaacttatctttaaatattctttaatttttaatttcaaatttcacttacttctaaactgtattcctatattggctttaaactcttcttcccatgtttttcttaatttcaaattttagttatttgtaaaatatatttttatatggactctaaacactacttttcattttattatgtttattccgaattttagttagttttaaattcttatatggactctatactctacttctaatattccttatttttaattctgaatttctatttttttcttaattgtatttctataaggactctaaacactacttttcattttattatgtttaatccgaattttagttagttttaaattcatatatggactctatactctacttctaatattccttatttttaattccgaatttctttttttttcgtaattgtatttctacatggactctatactctacttctaatatttcttatttttaattccgaatttcagttatttcctaattgtatttctatatggactctagtctcctcttctaatatttcttatttttttaattccgaattttaactatttctaaattgtatttctatatgaactctagtctcatcttctaatattccttattttttaattctgaattccaactatttctaaattatatttctatataaattcatctttcaatattctttaatttttaatttcaaatttctgttaattttaaattgtatttctatattgactttaaactcttcttcccatgtttttcttaatttggaattttagttatttgtaaattgtatttttatacggactctaaactctacttttatttttattatgtttattctgaattttagttagttttaaattcctatatggactctatactctacttctaatattccttattttttaattccgaatttttattttttttcttaattgtatttttatatggactctatactctacttctaatattccttatttttaattccgaatttctattatttcctaattgtatttctatatgaactctatactctacttctaatatcccttattttttaattccgaatttcaattctttttgactgaaattgcgaatttcagttatttcctaattgtatttctatatggactctagtctcctcttctaatattccttatttttttattccgaatttcagctatttctaaattgtatttctatatggactctgctttttttctttttctccgattaatgcgagaatttctaggtcatgagagcgaacatggaggctcctttttattccgaattttagttagttttaaattcctatatggactctatactctacttctaatattccttattttttaattccgaatttctattttttcttaattgtatttctatatgatctctatactctacttctaatattccttatttttaattctgaatttctattatttcctaattgtatttctatatggactctatactctacttctaatattccttatttttaattccgaatttcagttattttctaattgtatttctatatggactctagtctcctcttctaatattccttattttttaattccgaatttcaattatttctaaattgtatttctatatggactctagtctcctcttctaatattccttatttttttaattccgaatttcagctatttctaaattgtatttctatatgaactctgttttttttctttttctccgattaatatgagaatttctaggccatgagaacgaacgtggaggctcctttttctattcctttaataatataatagatttttttaagaaaaatgctcgtgttatacgtgatctgagatacacttgatacgtaagtggtgtgtggtttaaattctgagatcccgtgttgaattttcaacacgctcgtaagttcttctaaaaaaatatttgaagtgacgtctctctccaaacctttttttttttggtggggtttagacaggatctgaaccggacctgtacaagttgaacctgatgagacgagatactatgcatgcatataaacattacacgatcctaatcccaccaaggagaaaaaaccgatccttggcgaggcagatcctgacatatccttgtcctcccgaccaccacagttgatcgtagccaccctggcgtgcgtgcatagccagtttagccacacgaaactgtagctctctcgacccaaattccccgaacccacctactagctactcctgcactgcaacagcaaatgcaaggagaaaagcaccgagccagccgatgagactcggtgaccgtgccccggcgccgaccgccgcgtgtgcgtgttcgcccaggcaaaagacacagcgcaattgcgcgcactctctttcgcaggccgcgccgccgccgccgcttcgctttgcaattgcatgcgcccttttgccgacgccgcctagcttatcattatccttcctcgtcggccgcggttttcaccgtcctctctcagctcccctcgtgttttcaccgagcgacgcactcgtaaaaatacatcaaagaacgccgcggtaaaagctacgcaccccgtacgtacgtaaaaaagtgggtggtaaaaaaaaaggatgggttggtgtactggtctctgcgtacgtgaaaagactagctatcgatgcgtgtatctctgtgcgtgcgcgaacggaagaggggagcagcagcgagaggctttagctagtctcgcctttttctttttcccggctttatataaggctcactcgctcacactcactcacttgtgtctagtttacaccgatcagtagtagtgctactaccactttgggtcggatcgagcttgttgttgcctgcaaatctgcaaataatcttagctccttcagctaaagagcaagcaacggctactagcttccctcaacgccctcgtcgcttgcctcaccgtcaccgtcgtcactcgtcattcaccaacactcgtcaggtacgcttctcgcagcttgtagtatggatatgtgctgcagtgtttagcttctactggtgtgatgattaatttcttgggcttcttccgatcctgtgacgaagtcgcttgtgataatttggggcttattcagctcagacgaccagatgcaaagcctgaaagtctgtcgtctgctaagcctgtagccgtagcacgtcgtcttctcgtgagcctctggttggatggaaccttggagaggagatggaagtatggtagtagtgtcgtaccagtacttgtgcctgctgctgctcgctgcacattgagctgcgtggcgtatgcgccgcgcattttgctgcctttgcaaaatgctcgccgatgcatatgcatatggtctcgttctcctcttctttcgctcgctgctcttttgaggagagagacacaagcgaggccggctttcttttgcccccaaagctgcgtggccatggcgtgcagccaaacgcttcacatctctcttttctctctctttggcactgtcgagataccagtcacgcatcacggccatgtacgaacacgtctcctcctctgcagcaaacctgctcttctttctctctctatctatccaacgctatcaaactgtagccgtaggcctctggcgaggcattaaatgcaagcgaggcattaaaacgcaggcacagctcatgattgcgtcgcttgttggtttcctcctcgtcgtgttccaagcttcgacctgcaagctcggacggacgacttgccttcttgccgtcgcaaaagggtgccctaaaaactgatcctcggtcctttccatgtcacccacgacgaagaacaacattgctcgcacagcgtaggagtagctaccattccttgtcctgtcatggaacatcaccgaggaaaaaacgagtaatttatgtctactacagaatcttggctggctgatttctatagctacctggacagcgcattttcgagtactagtataggagtatagtactctatgattttgtggatagtagctttttgcatgtttgggtgtgtttagttcacgttaaaattgaaaatttggttgaaattaaaatgatgtgatggaaaatttaaaagtttatgtatgtacgaaagttttgatgtggttaaaaaattgaaagtttgaaaaaaaattttggactaaacaaggcctttgtatctttattttacaaactttgtgctgttggagtagtactagactactagtaggagtaactttgtattgataatactaggagatgaacgtacttgtaggtaatggtactaacagactacgaaagattccaacagcatctatatatgaaaaaggggaacaaaggagaattctgaaaaaagaaaagcacgcaactcctctctttgatttttttgcttttgtccatccatgcatcagccaacggttaaaaaaccccgtcgttgcatcatgggtccgcagcaccaaaagcccctcatcctcctcccccttttgcagagcatttcttcccttttcccccagcaacgagggtaaaagcaagctagtatcctactatggtctactccagccaggctaccactgccatcctgcatgtctcccgtccgtcgatcgtgccatcatccgcctgcagcgtcacgcgagtcgggttcgccgtgacgacgacgacgacgagagatcataatagtagatggaagactaccaccagcggtagcatagctataatagtaacttcttcatcatttacagttaatttaatagtcaatagtcaattcatataatagttatctataaatatatactatttctacctgttatacacatattgtgtcttgtaatccgtactatagcctattgcttatctctctttcttcactgtgtttatagctggcttatagtttaagaacggtggtgaaatgctagaaaagttactataggactaatctcgcctttgctccaaaaaagaggggcagaaagaccggggcgtgctcgtgctggaccatccgccgctctcgcgcgggaccaaaccaaccaaccagccgcgcgcgcgcgcgcgagcccggcagccgagctagctagccacgcccaccaattccaccgtgcacgcgcgcgcatgcgtgcatgctcgcgagaacggtcgggtcgggccctcggcgtgggatcgagttgtttggttgcctttcccgtgctcgatagatagcgccggacgacgacgacgacgtctttctggtctttttgggtgcacacacgcacccgtttgcacgtcgcgtcgctgtccctcgctgccacttcggctaaaagtcgtgcgacgacggggatcatatccgtgtgtgtttgcgttcggttcgacacgtgacacggctgttgtgtttgattgtctcgtatgtactatatttttcacctccctgaagaaaaaaaatgggaaaactgagattagtaggggaaggagttttttttttaatcttgtgggtggcctttgtgcatgcgatgcgattcgcaccgaatcttgtctggtcaggtagcggcgtcacgtacccatgttacgtcctttccagcttcaacgccgccatgattgcactcagtcgcagcagccgcgcgtgctcggctgcgccgtcaataatggcctcgtatctcctccacccacaaggccacacacagcccagtagtaggccagtagtccaccggggtcaactcctccttcgagtgcaacctctgccagtgccagccatcaaaccaagacccccccgaattagccccaaatgatctctttttcgtgtcaccttttccctttttttttcgtcctgcgatcaggctagagtacgtacgagtactagtactagtgtaccaggcaacgagagccatcgatggcacgcagcgctagtccactcgattacggttgctcgccgtacgtctcggcgcgacgcggccgtggtccctgcgtcgcgcgcgcgtcgcgtcgcgcacgccacgccggcgctcgcatgcgatcatgcgcgagctcgtcgcaccggcttggccttttgccgcgcgccacggcttttctgacccccaaaataaaagaaaaaacggctgcagccagcggcggccggtcagccagccggccagctacacggtgcgcgtacgtacggggggaaacacgcactgtgtggggggaaggaaaaaaactcgttgagcagactgggtggctctcggttcaaaattgtctccattgatctaatttttaaaaacttttaaagtaaaaatatttatttttaactaaagttgcttacacgctactctcttcggtctaataatacttgcccttttatataagggtaaagtcaaactttagaatctttgattatgaatctttttaaaatatttgtccttcaaatatgatgattacatgtatagattagtcttaaaaaataatttaataagatcatatatttgttaatacttttatacatgttataatgaaaaataatggtcaaaattattttttggagatcgtatccttgtccaaaacgacaagtattatcaatccggagggaatactaacttagctcattaaacaaagaaaaatataccccctacatccataaaagttacacatattatttatattatttttgtcaccaagaccaaggaaaatttaaatcatcttggatgttacaaaatcatagagtgaatgcaagcatgtaaccaatgagtgtttagatgcctccttgggttctaatcaaatatttaatttgtctccttatttaagtcttgaatgcataaagactgcagatagaaataacttatttgggaaaaactcaaatgtgaaatatatttaacttttgtggttgaagggagtaataaactataaaaacagtactactagctagcgtgtgatgatatctagatttccgtttacaattataaacgattctaaaatacttttataatattaaggaagtagcaaaacgataaatcatagtgagtattatttaatatatttgacaataaactagaagtagtaggggagaaataaacaatacaaaagtcgataagtgtaaaataaactaatagaatactatgccttgggattacagatatcttatgtttataataaattaaaataatataatctcttatatttatatatcgagggagtacgatcatttagcgtattgtgctgtacgctagaaatttcttacgtctggttcgtagaaccatttgtgggtgtgatcttaagcgagggtacctgcgtacgtaggtagaagatggggacggggatatggttgagagaacgggagtggtgaatgccgtcctgaatccacggagcagcgtatggagtcacgatttgttacggtgagctctcgctctcgtcatggcggaggtggatcgatccatccattttcacgccggtcgtggtcatccatcaatgctcatgtatcgtgccagcgagattgcaggtgatgtcttcatcatctaatcggaaattcagcaacctggggagaaaaaaaaatcaacaaatcgctgagcactgtacctaatttccgggacgattccgtacgagccccctaacagtagtgtacttactggagtactaagtgcaatgagctaatgccatgtttgccattactacttgcaagcagtcaatctttagggcagatgagacgatctgatccgtccgaagaaaagagagggggagagggacccagccgtgttgtggtgtgatgatggcgccttttgagcacgcaaaagaggagtcctagaccgacctgccaatgccgtgcccgtggcagccggcaggtagtgggttggcactgcctgaccccccgacccgactcccctgcctcctgctgccgctagctgcgacctgcaccggcgcatgccgcagcacaacagcagcagcggctcacagtcacagcttgtgtgtgcgtacgtacaacccgagcacgcgcacagtgccgcaccgcagcacgcggcacagcagcggcattaacgccacatgctctcataaacgtatgagtatttcttcgcactttttgcaggcttgcgatgcagcgacgacggagaacgcggcgccgcgcggcgaagggcgagacgaggcccggggttgggtgcgcgtggtggtggtgccatgcacgggctgatcgggttggatggatggtcccccgtccgtagccgtaagggtggcccgcgtgtggcaggtggcgcatgcagcagcgggcgcagcggctgctgcttgctctgcttgttcccctccccaagcgccgtgttgcctctgaccgcgccacgcgaatgctccgctttgtccctcgacgccacgccacgcgagtagcgccacgcaccgcccaccaccccatccatccatccatcgggccgtgcgccgtggttggcggcgttttttcttggtaggttttgtattgtacgcacgcactggtagtggacggctagtagcctagaactggtgtaagtcgttaacccgtaaaacctacttaacctgtttggattcgtggccgaccaattacacccctacctaaaactaagatcggtgctgctgctgcttttgcccgtgcgcgcacgagtaaaaaatgggtttgggccatgagggaacgagggggtgtgtgtgttgtgttcttctattctgcaatggtggagcgccttcttgtcgggggcacgcacgcttccaaagttgtaccgcacgggcaccgaggggcagggcagggcaggttctctcggctttgggacatttcttgctgcgtcgctggtggtgtagcagtggtggtagtgggagtagtggcgttcaaggccaaaggatgttgcgtttcgatttctctagtgcttgggccatgctgcatgaggcttaaactaaactttgatcacactttggatgcatgttcctgcacaacaccaaaaataaaaaaaaaataaaaatcctccaaaaatagcgcttggtaggatgtccgtcatgccagcaatacgcagttgaatcagacttaagtgcctgtcagcattgaacaaagttttgtaatgtcaaaagttccattattatacacacaatctgcctctcaatgatatttacaagtactactagtactagtactcccatggtaacataacaccacgcgctagcggccagccacacgaacatgtgatacacttctcaataaaaatccccatccattctcccttccttccatccccttcgataatccacccccatccgttggaaacctcagctgcactaccctctcgtgtttctcgcgccccaattaatccacgggccacaacgttttacctaccgtctccccccacctacaagaaatcatttctacgacgcctgctacctttggtaaaaaaaacggagcatattttgcttcttccctgttcaatcttaccaccggcaggcaaggcgaggtctatttatttatttaccgcgcgaggcggccactactactactaggaccaaacagggtcaaagcagctgcagtagttgcatcagtgacgaagggttctaatgcctttctgtcccgcctcgcattaattctttggcttggttggatgcgagagaaaaaagaggagagattttggtagaattgtaagatttttgttactactaccactcgttttcttggcttggtttggtttggtgtttgatcacgcggtggtgacattataagggcgcggttgcgcaggtgttcgaccagcgggtggcgaggtcggcggcaaggtggtggtggtgcgcacatgctcgaggtgctggac

SEQ ID NO: 82307 - DNA, 22298 bp, Oryza sativa
tttgagcatggaagaaaggtgagagcggttttcttggtttccgtggcgcggcggcggcggactttgcaggtgaagatcacgccggaggtgagctcccggagcgtgaaccgggcaatcatgtcggagctggtccgcctctaccacgactccgatctcggaggtcgcctcccggcctacgacggccgcaagaacctctataccgccgggacgctcccgttcgacgcgcgcgagttcgtcgtccgcctcaccgacgacgacgacggcaccggcgtcccgccacggtgcgcgcattatttgcccacagcccggcgctccattcttctccggccatgtcttaaccgtcatcgcgtctctggctccgcagggagagggagtacagggtcgccatcaagttcgccgcgcgcgccgacctccaccaccttcggcagttcatcgccgggcgccaggccgacgcgccgcaggaggctctccaggtgctcgacatcgtgctccgtgagcttgccaaccgcaggtacgcacacgcattgctcgtcgtcttgtgttcttgcaagggaaaagaaaggaaaaaaactaatactgattggccccaatggtaggtatgtctcgatagggcggtcgttctactcgccggacataaggaagccgcagcggctcggcgatggcctacagtcatggtgtgggttctaccagagcatccggccgactcagatggggttgtcgcttaacattggtgagatgctcgcgaatatttggtgccctcatgcatgtatctttcctggttgtcatgtgcttgctgcttacatggtggatgatgttgatgccagatatgtcatctaccgcgttcatcgagccgctaccagtgatcgaattcgtggcccaaatactagggaaggatgtcatatcgaggccattgtcggatgcaaacagaatcaaggtaaatttatgcttgcggggaaggaatagtctagccttgttactgtagtgggatgtaagatgtgttgtttggatgcttttggttaactgatagatggcttaattgtgatgctttgcatgattatctgatttacctgtggaattcgccaattccatgcagatcaagaaagccttgcggggcgtgaaagttgaagtcactcaccggggaaatgtgaggcggaagtatcgcatttcagggctgacaacacaaccaactcatgaactgatgtatgttatagtgtaattcatttctcgtcatgtactttcaattgtcaaatgtcttgtaccgaactttcacgaaagtagaagcatgcatgttaagcactccctcttgcttctaaatctgagtatggcagaccaaatagaccaaattaactatcaatatccatatttcatatacgttagctactaggcattgtgttaagctatggaactgattttgtttgttttaacagtttcccaatcgatgaccaaatgaacatgaaatctgtcgtagagtatttcaaggaaatgtatggcttcaccattcagcatccccatcttccctgccttcaggtgggaaaccaaaagaaggcaaactatctaccaatggaggttggtattaatctcatcaagtcacaaatttcattagctggtcaattatgtaacattcaaccttggtaaaagacatcatcattttgagatatttcttaccaggcctgtaagattgttgagggtcagagatatacaaagaggttgaatgaaaagcagatcacatcattactcaaggttacttgccgtaggcctagagaacaggagatggatattctacaggtctagttttttctcctaatcggattataacattttgaaatatatggattacatgtttgtcaggagtaaatgtttcaagtattttgtcttactaaattggatgataaatccaaacaccaaatcagtgcattagaatttagaagatacgcatgctaatgtacgttaattgttctatgctgaagtctttgttttcattacccacttccaagtggtccaagcattccatgcaattgatgttcaatagctacccacccaataagtgctactagggtttctcttcacttgatcagcactcttgttataatggttcaagactaaaaaaatttctttccagacagttcaacaaaatggatatgagcaagacccttatgcaaaagaatttggaatcaacattagtgagaagctaacctcagttgaagctcgggtccttcctgcaccttgggtatgatttgcctttgttaatctcagtagttggctaactgctctcagctaataatttgggtatgaaattttgtggctttcagctgaaatatcatgatactgggaaggaaaaggagtgcttgccacaagttggtcagtggaacatggtgaacaaggttagattccccgttttccgcagctgtatacaacagacgtccttttatatatcatgatgatggcctgatcctgctagttttccactaattaagcattttttttttgcagaaagtgataaatgggtgcaaggtgaatcattgggcttgtataaatttctcaaggagtgtgcaagaaactactgctcggggattctgccaggagttggcacaaatgtgtcagatatccggcatggtatataactcttaacttcatctaatggttttgcataatattggtgcttttataatgttatttgttggctgcatcttttcagttttatctctgctcttcttgcaggaattcaacagtgagcctgtgataccaatatactcagctagaccagatcaagtagagaaggcgcttaagcatgtgtataatatgtcattaaacaagctcaagggaaaagagcttgagcttcttttggccatcctccctgacaacaatggttctttatatggtgagtgtcggtttggtaattgcatcgcaatttttccttggaatcctcatattgtgtgaaatgcttaagatgtaacttaatatttgcaggtgatataaaacgtatatgtgaaactgacttggggttgatatcacaatgttgcttaaccaaacatgttttcaagatcagcaagcagtacctggcaaatgtctcacttaaaatcaatgttaaggtaccaaatacttataaaccaagcagttaatacttagcttgtctacacaaatgtagtgtaatgcagtaagcagacttgcagcattgctaatgccttgcatttcggagttgtgatacagatgggaggaagaaacaccgtgctgctggatgcaataagttggaggattcctttggtcagtgacataccaactattatatttggtgcagatgtcacgcatcctgaaaccggggaggactctagcccatccattgctgctgtaaggctgagcatttctatggttacatggccatcattttttttttaacctcttaccctctctaataagctgcatgcaggttgttgcatctcaagactggccagaagttacaaagtatgctggattggtgtgtgctcaggctcatcggcaagagctcattcaagatctttacaagacatggcatgatcctcaaagaggcaccgtaacaggaggcatgatcaggtcttttttgaggaacaatttgttcttccaaccaaaattaattgatgaagcctcctattaaatagtttagggttacctcctaccgattaacttatttttggttctggtcttgttgtgtagggagctcttaatatccttcaggaaggccactgggcaaaagccattgagaataattttctacaggtatgctactgcaaatactgtttataaactaacgtttgtagagtacagtagttagatatttgtggaatcaatttaatcctatgtatcttcaacaagtactgaacctagtgtttttgttcgctatttgaagtatgaaagttgctgttataggcttctatttgtatatctgctaatagtatcggtactgcttctcttctagggatggtgtcagtgaaggccaattctaccaagttctcctctatgagttggatgctatccgcaaggttagatgcatttgtattttctttactcagatattttgtccactttattaggttgcctgacgaaatgttttcttttaggcatgtgcatctctagaaccaaattatcagcctcctgtaacattcgtggttgtccaaaagcgtcaccatacaagactcttcgcaaacaatcacaaagacagaagtagcacggacaaaagtggaaacattttgcctggtaattactattcatcacctcttaaggcatttcattggatctactgcagatgataatgcaaccaacatattgcaaaaatattttttttattttaactaaaaccctcagtttgttggtagaactgtttcagtgatttgatacttgttttcctattcatgatatcacattcacaactgtttttcttggattattaaggtatcactttgggtgaactaacttttatatttactgttattcacttgatttctgtaattgctcatgtgtttgctaaaaaacaggaactgttgttgattcaaagatctgccacccatcagagtttgatttctacctctgtagccatgctggaattcaggtaagaatattgtagtggtccttttgtaaggctgacatatactgaacttgtcgttactctggtccccatgtcttctgtgattaagtatttgaggagacttcatattgtcttttcaaccacaagcagtgtagtacttcctccgtcccaaaatgtaagcatttttgaggttggtacgggtattaagaaagtaggtgagaatgattgaagaaggtgtgtgattgattgaaaagagaaagtaggtgaaaaagaatgattgtgattggttgagaggagaaggtaggtagaaaaatagcttcattttgagacaaattactgtgctagaaatagctacattttgagacagaggtagtagtatcacagtagctagttactgtagtacctagcaaagggcacatctgcacatgctagaacaaacaaacttactataccatggtcaaatttttaatcatgtgattgtacattatagtacttggatcagcaaatattctgtctgtagtagcgctggaatataattccccaagtttgtcctccatgtactgaaatgactgatgtgtgtgagttttccagggaacaagtaggccagctcactaccacgtcctttgggatgagaacaatttcactgcagacgaaatgcagacattgacaaacaacctttgctacacgtacggcattactgaatcttgttaagtttatcctttgcactctgagcttctctctatagaaattgtctgacttggtacatttgctgatgcagttatgcacggtgcacacgctctgtttctgttggtacgttcttctgaaatgatctgaacatttttccatcattttctttgtattcatgtgttattattagttggacacgaattctgaaggtgaatcttgcatttcttttttcctggtccaacagttccacctgcatactatgcgcatctggctgcgtttcgagcgcggttctacatggagccagagatgtcggagaaccagacgacgtcgaagagctccactgggacgaacggaacctcggtgaagccattgcctgcggtgaaggagaaggtgaagagggtgatgttctactgttgatgactgggagactacctttaactactcacatatgatgtacctaacattgtagaattttagtggtagggatttagaattagcttccttcaggaaagggagcagagcaagcatttggatcctgagcgacctcttttgaccactctgtaaagtactaagtaacgcatgtataatagttgttgtatcagtctgaaaaaaaggaagtgcactcagtgcttgtttttccagttctaggatgattttctcttcatggttaagatctggtaagagactcaatacacgaatccattatcaggataacaccaacaattttcacttatagaacatattcgaaaatttctgagaataggctaataattctcaaaataaaaataaaaataacctgcaggatgagcatcattcgttgctgccattaaggacagtaactaaggatataatgctgaatatacgaatctagttaagacggcctgaagcaggtccacagaacccgacttaaaatcattgttagttcagattccgggccacattgtatttttactgtgacttgcagatgaaccttcttccataaataaatattgcattcacttcaaagtgatgttttatgtgttagtgagttttgagtggatatgctgaatacatcaacaagagcaaactgaaaatccaagtatagcatttttaacaagctgacaaatgacagaatcatgctgcgatgataatgttcgtccatccattgttaagaagttatggttgcacattagatataatcatctgcactgataggcataggcaacaacagaaaaaaaaatactactggcattggtgtctaaccttgttttttcatctgcagaaccgtgttccatttcctggcaagagtaaaaaaaatccagctctgctacaagcctgaaacaagctagctgaagttcagtagtcctcaaattaactaactgtacaagcctgatcactcgaatgtctgttcagacaaggttcttcaaaattgctaatgaaacggcttccagtgattgatcatgcttctgttggtccagtcaaactaatggatgcttcaacaattcctttgtccaagcattatatgcttcaacaactcctcagtaccccttcacctcaatcaagctacaccctgcattcttcttgacagtagggtgtgccatcttgccccgtacccttatcacatcctcccatctacttgctgttgcatatacattagacatgagcaaattcacatcagtaatttgggaatcttgctcacagattcgtttggttaaccgttcactcatctcaacattcccatgagccttgcaagcagtgaggagtgcaccaaacagtggcatagcatccttgttaattggaacgtcaccgatcaacctctcagcttcatctagtagaccagcacgacctaggaggttcacaaggcagctatagtgttcaactcttggttctatctgataaacctccctcattgcatggaactgcttccggccttcatcaaccaagccaccatggcagcatgcacttagcaccccaataaacgtaacaccgtcgggcttaactttacttctctgcatatcttgaaacagttcaagagctctaccagcctgaccatttgtggccagcccacagatgatggcagtccaagctgtggcatctctgccttgcattcgccagaagacctctagagacttctcaatgtgcccacatttagaatacatgtcaatcaatgcggtgcctaggactgcatcgatcttcattttcctttgttcagcatactggtgaatccattcaccttgatcaagagcgccaagattggcacagcatgtcaggagagtgacaacagtgaacctgtctggctcaacccgttgcatctgcatatctcggaacaatgtcagcgcctcctcgaagcatccgtgttgcacacacgcattgatcattgcagtccacagaattagatccttctctttgcactggttgaagagcactctggccttgtccagctgcccagcaaggccatatcccgacacaagtatggtccaagaaattatgttcctcgcaggcatttgctcgaacaatttcaccgcctcttccaagcaatcattcttcgtgtacatgtccagcagagcatttgcaactggcagattgaaaccgaagacgttatccatgtacacatgaatcctccttcccaagctcaggtcccttgctctagagcacgccgtcaccgccgtcaccaacgtcaccctgtcaggtgtgacaccgcttctctccatctgttcagacaaagcaactgccgccgagtaccacccgcacctgatgtagcacctgaccatcatgttccacagcaccagcgccctactcggcatttcgtcgaacaccttccgcgcgatgtccacgcgccccagcatcgtgtacatctccatcagcgagctcccggtgtaggcgtcccaccggaacccggtcttgacagcggccgcgtgcgccttgcgcccctcgaccgacagcttgaggaccccgacggccctgagcacgaacgggtaggtgaagctgtccgccacgagtccccgcgcgcggaggtcgtagtacaccgccatgacgcgcgcgaagctcccccgcctcgccagcgtcctgatcagcacgttgcactcccagagcggcatcccgtggcccctcctcgccgccgccattgccatcgcgcggggtgggtggcggcgacgcgacgcggccaagacgtggggggggaatcttttcctatatagagagcggaaagtcacagcctcacgggagagaagggtaggtgtttgtgtgtgtgcctctctctcgagtctcgagatggtggggaagcgagtggcggtggtggtgggagggagcgtggcggggctggcatgcgcgcacgcggtggcggaggcggggtgggaggcggtggtggtggagaaggcggcggcgccgggggccgggaacggcacgggcgccgggctggggctcgacgcgcagtccatggagacgctcgcccgctggatccccgggcgcctcgacgccgccacgctgccgctcgccgtcgacctggtaagctaagctcccccctgtaaatccgccggcctcctcctcctcccttccccttgccttgacccacccgtgagcgcggcgcgcgcgcagaacagggcgacggacggcgagacgaaggcggggaggacgctgacgagggacgaggggttcggcttcagggcggcgcactggggcgacctgcaccggcggctgcacgaggcgctgccggccggcgtgaccgtgctctggggccaccagttcgtgtcgttcgagatggcgccggaaggggacggagatggcggggtcgtggtgacggcccgcgtgctgcgcaccggggagacggtggaggtcgccggggatttgctcgtcgcggcggatggctgcacgtcggcgatccgccggcgattcctccccgaactcaagctgaggtcagccagaggttctagactactgaattgtttactggtagtagtattattgtttagtcgcatgattttttttttcaatttagctgctccctccgattttgaataacactcgcaccttctccacctcctcgagttgggtactactactaattatcgtgccatataattttcttacaactctaattgggaatataaaaatatgaaacatacttagcagagtgaatccaagcccggcctgagacccacgtgcccacgctcgactcacgccgcaaagtctattggacaaaaccccatgtcggcatgcccgatgggttcgcgttgccagccacctcctagtcccgtgtgctgccacgtcgctagccatcaccgcaccgccagccgtcgcttgcgcccttgcacctccacgtcatgtggccaagctcccttcccgtgcaccaccgccgccgcctagtgtagacactggagaagagtagaagactgagggagtgagagatagcagtgaggagtataaggtttgtgatttggggatttctatgctagggtttcatttagtgaatatatatattgcatacaaaggggtcaaatggactattaggccatgtgaggagataaaactatttaaggcctgaaaaatatatatgggctaaaaaattttcaggtcgggcatggtttacccacaggaaaaacccgcgcgcgcctactaagttcgcgggtatcggatcgggcgtgcccacaggcaaaaaaaaaaaaagttatccgcggatacccaaacctatgagcaatactgccattcctaagattttgggtgtgtttgagagaagagatttttttaaaaaagtatataaaatgggatgagccattatcatatgattaattaagtattaattttttaaaacttaaaaaataggttaatatatttttttttaaaaaataactttttaaaattatcttttttaaaaaaacgtatgatttagtggttcggaaaacgtaacgagggatttcttctctctttcatcctaaggaacagccttagtgatattaaggatttacgattgcctttcatctctttcaacgtgtgttttcgggcgcattcgtggacgatagtgtggtgcatgagtcgtgatggtgtgtgcgtgtgtttttcttccattaatgaaaggaaaatattagctgagtttttcagtatttcaatataatatcatgtcaaaatgggcaaacttagctaagattgttttcgattttctgattatttttcaataatgtaggtactctggatactgtgcatggcgtggcgtcttcgatttctccgggaaggaggggtgcaccaccatggtcgacatccggagggcctacccagagctcggcaactgcctctacttcgacctggcatacaagacgcacgctgtgctctacgagctgcccaagaaccggctcaactggctctggtacatcaatggcgatgaaccagagctcatggtaattgtcaatcgatgagaaataaatcagtgtgtttatccctccttttccgatgtgatttggttccgtttggtgttgcaggggagctcggtgacgatgaaggtgaacgaggccacggtgagcgagatgaaggaggaagccgagcgcgtgtggtgccccgagctggcgcggctgatcggcgagacggcggagccgttcgtgaacgtgatctacgacgccgagccgctgcccgggctgtcgtgggcgggagggcgggtggcgctggtcggcgacgcggcgcacccgaccaccccgcacgggctgaggagcaccaacatgtccatcctcgacgcccgcgtgctcggctgctgcctcgcgaggtggggcggcgatggcaacgccgagccgacgtcgacgccgcggcgggcgctggccgagtacgaggcagcgcggcggccggtcgtggcggcgcaggtgctgcacgcgcgcaggctcggacggctcaagcagggcctgggcatgggcagcgccggggacggggaggggttcgacgcgaggacggcgacggaggaggagatttcgcagctgcggcagagcagcatgccgtatttcagtggcgcgccaaccattgagtgatctaataaatgtatttttgtgaatttttatataaagaaagaaatggctatctctatcataggttttctttaccgaaatttcaaatttttagctcctgccctgtttggaataaatgaaatctgtactattttcaataagaagtttgttgtaaatttcaccaaaaaccgttaatttaattttatttttcttctcataggaaccgttcatttccgaaaatgctcaggcccgggcaaccggcgggaggtggagcaggatcatgcgcacgttcccctggccccaccacatgtctcaagaaaatgtttcacccagtgtactcacaatgttttactatatatagatctgatattaaaatattcttttacaacaaattacccacatattttggaaaccctttattaagggaattcgtttcattttttatttgcagtggcatatgtatagatctaatgttatagtgaactgaaacattctttcgctatttgctgaaacattgtttttatataaggtgaaacaacgcccgatttaaacgaatgaaatattttcgatctacttagtgaaacaattccgatatacttggtagagcatcgtgcaactgtcaacgtttgatgtctcgactacggtatttggacagtatggggatcgtcggtgctagggtatacgcgagactgaggtaaaagagatggagacgatgatttttatacaggttcgggcccctgagctatcaggtaatagccctacatcctgttggccggagccaatgttgctttttattcaccataatcacaccagtacaatatgtggggtggcctatctaactgttgtcgacatggcggtctgaaggtctgactcgtagtcgacaacagggtagccttcctcctcgagctcgcgcccgacggaatcagagacagtgctagatccctacggccggcctctgaaggtaccggatagggtcgatccaggcgtatctctgatgtcgatatccggcggcttgtcttggcgtatgtaggcttctatgttgattgtgttgggagttgattgtctcgtggtgggtgttgatcgtctcatggtgggggtcgatcgtgttgatcgtgttgatcctccatggtgggtgtgtgtccccctgtcctcctagggggcttatatttatatccataggtgtccccttgtccaagtagaactagggaaaccaatatgaatacaatccgagtagtccttgtcgtttccatatagaactctggttgtctttccttatccggaactccctcctatatccgtaggctgtttccgtataggacatggtatgtggtgggtcctgccgagatttagtcaactactattaggtatgtggtatccataaccctgacagtagcccccgacttcaatgcaaatgaacgaattcatattctcaattgcgcgcagactttggagtaactattatcgagctcatgtgaacgttttcggtgagttcagatataacgttagacttcctttgtcagcttcgtgcgggcaccgaaagggtttgtctaagtcaatctttgatgttgaccgagaaagtacagagcgtacgactaagtttcccgtcttgctgtaatcgagaatttggattaaagtcaagaaattttatctcggcgggtacatcatttcttcattccgcattccttgtcgagatccagcaatcgttctcgagcgatcgagaaggcgtagagtctgcgacagagccttgtcaacattggtcgtactcgccttagtcgatcttggtgtagaaccatagagacatggagccttcgtcaatgtcgaatataattttcctgaaatcaatactcagaaaagaatattagatagaaatagcccccaagcgaatgctcaaagggtgacatattataatatgacagactaatgaattgaatgtacagaccagtgttttgtatatgagtgtcttctctcttaccgactccgatcagtcagtttgtagagtcatacactctccctagcccccagccttgtcatcggagaatcattctcggaggataaggctcttggacccttgacctgccttggttgaataagcactgatcctagcccccagccgtaaagttggaaaagtcaatttccgattacacggcttagttaatacgcacggcgagaactcttacacgaccagatcttacatggtcttttgtcattacagatcttacatgggcctccacttacatggcactccagcaaccgttggatctctcctccctttcccttccttatctggctacattcccaaattcttgtcccatcgacctagccgaaacctcccctctccccctccacagcttcctctgcctccttgccctcgtcggcgccgcctgcggtgaggctccacgcctccatctcggccgtgtccgttagttctctttttccctacctccgcgagttcagctgttcgccgtagctccccctgctacgtcccgagctccgccgcctccgattaaactgtttgcgccatctggcggcggccagcagagtcctccctcagctccgcgggtttagattactgcgcattgatatgtggacttctctgcttgcttcctgaggttagttatgtataatttttccctaatgattgaaaaatctttgggacgaaaatttccaaaatttggccgaaaattccaatatgatatttggaagttttgaccaaaattttggaagttttcgttcaggggtatttctgtcattatgataaaaatctaacggaggctaactagacaatgatggtatattatagaagttaagaaaattgtgatgacatatgagaatttgacaaacccagtgacatattgtagaacatggataaaatcagtgacacataatggattctttctatttgttcccttaactacctatctactatggtgcgacatgtttagaaaaagttaaatcttatactataattccatttcttacacattaaattatatatacttataatataattttcaaattatatagtgcactattcacattttatatgagaaatatggaaaagtgatttattatctatttaattatgagagaaaaatattagtccaaattaacataaacatatagaaaataaaaaaacaacaaaagaattacggaattactccgcacactaactctctctccctccattttctttttccctctaacagttagtgatcgctagatccagcaataaacaacccagatctagcatctccgttttttgtaaggttggttcatgcctccctaagtctttgcaagcccaacaatcccaacctcaacgacgacgatgacaatagtgtgcatggcgataggggaggagaaaagacatggctataactatagggtgcagctacgcatgcaaaggcggagaggagaaacggtggtggctcatagagaaagagcgctggtggtggtgcgtggagctgtagttagtggtcgcgggtggtctgagaagtttgttgtcgacacaatctctaactgagtttgttaatgtttttctgatatatgggccaccagtcatcataaaaaatagcatagtaaggccctgtttagatacctggcaaaattttacgccctatcatatcgaatgtttggacatatgtatggagcattaaatatagaaaaaactaattatacagattacatgtaaattgcgagacgaatcttctaagcctaattgtgtcatgatttgacaatatggtgctacagtaaacatttgctaatgacagattaattaggcttaataaattcgtctcgcggtttacaggtggattctataatttgttttattattagactgtgtttaatactttaaatgtgtgtccgtatatccgatgtaatacgccaaaactttacatctggatctaaacacagcctaaaaatattgagatatacgtggaatatcagtatatgccactcaattcgcggccctatgatccaattcgtgtgtaactttggaacctgccacgggagagcgaattccttcgtttcactccatccatccgtctgcccatccgttttacgctcgtccgcgaccgccgccgccgccgccacctctaccaccgtacccgagctcgtccgccgccgtctccattagcgtcgtccaccagctcggccgccgtccccgagctcgcgtcgtcctggtgagcctctttctgattcatctctctctctcccaccccaccgggacaatttctgtctgcaatttgctcacgttcgttcgttaaccctagcttctcttctagatctggaagaagctatttcagagccttaaccttaatacaagtaacagtttattgtttgtttcccccaaaatttgggggttcccaagttggatccgccccctgcttcgtcgcaagagaaattctccttttcatttgagtttgtagagcttttcaatggagtatacatcaagtgaggatgatgagctggttgaaggttacatggatgttgaggatgatacaggcaccagcaatactgatcaaggaacaggtctgatgccttctgagatgcgtagcatccttccccgtccgtcgtctgttggcaacggtcggctgatggctgctgatgggttgggcacaaacgatgacccatgcctaggcatggagtttgagtccgatggagctgcacgggcattctacaatgcgtatgcgctgcgccttgggttcggcatccgcgtcgcccggtcgcgcagcgagcggaggaagggtgttgagctacttatcatgaagcgttttgtgtgcctgaaagagggacatcacaagaagaaggatgccgagcctagcgacaagaaaaagaggaagcggctctcgataagggatggctgtccagcgatgatggaagtggtgaggaggggtccggaaaaatgggtcatcacaaagttggtcctggagcatactcatgtgattcttagcccagacagggtgcgggaggtccagctccgtcgcctctctggaaagtgcgcagagcatgataatcaattgcaggagctgcgccggaatgtgtttggagatacagatgcgcaaggccttttcaactacttgaagagaatgcagtcggagaactctggttttttctactccatacaagttgacagtaagaactgtgttagcaatgcagtttgggctgatgctagagccagaatgtcatacacatactttggggatgctgtttattttgacactacttatagtaaaaatgagaatatgttaccctttgcagctttcacgggtgtgaatcaccatggtgatactgttccttttggttgtgcacttgttttggataggacagaatcttcatatacctggctatttgagacatggctgacagcagtgggtagacggttgccgttttcctttacaactgatgaaggcaaagcaattgcatcagcagttgcaaaagtatttcctcagtgtttccatcgtctttgtagatggcgaattttgtctagatgcaagaagaagttgtctgacgactacgtgagatttcccaatctccatgatgagctcagaagatgcatcaacgagtgttatactgaggttgcttttgatatgttctggggtactattcttgacaaatatggcctgagggagaacagttggttgcgatcaatatttgaagcaagacacagatgggttcctgcatacctgacaacaagctccttctttgcagaattgacattgacccagagaggagaaacaatcggtaggttttttaggaataacttcagcacaagagttcctctcgatgaatttaccactaaatttgaccaacacatagacaatttgtatgtacatgaaactcagaaagatcttggttcatctcatccggaacagatcctgaaaaccaatatagccttggaaaaacaagcaaggagcatctacaccaatgccgtgtttgaaatattccaaacggagttgtttgaagcattgcagcattatgctgttaaggttcatcaggatggaccttactccaagtactatgttgacagagatgatcctccaacaaggcacactgttttctacaatgttgccgagaagaaggcttggtgcgattgctgcaggtacgctttctcagcaatattgtgcaggcatgtgcttggagttttcatcttagctggaatcatggtgcttccggagacatgcatcgcgaagcgatggacaaagagggcaaagactgggccagaattaattgggcataatcttgagaatggaaattgctacatggattcttcaacttcaaggtataatgatctcattcatgatgctatcaaatgtgcagagaagggagctgtatcagcagataacttcagagttgcaaaggaaatactccgcaaagccttcatggaaatcaagtgtcttggagaaaaactgactgacgatgacctgcagcaggttgacagtagatagcagtggttatcttgtgaagcatttgagagattgttccagatatcttttactaaaggatggaaatgaggcgtaattttgctgtgccaccatgagtaaaagcatttgagagattgttccaggtatcttttattaaaggatggaaatgagatgtaattttgctgtgccaccatgggcaagcctaccctgtactgacaatgaccaattaacatatttaaccactgtaaatctaatcctgatgtatgctgttagcctgtctgtagaatgctaatctgacttgtgggagtcaggactgtaaatgttgactcgtttgcctgtgttcctcttgctgctattcatgtcatgatatcacaactcacaaaaagttatgttggactcgccatgcttgtagggttttttcttcataaaaagagttacagacatcgtttcttgtttattttgaaaattgatccatttggagtaagcctttgttgttaaatatacaaagtttattgcgttctttaatgagaattcgaaattcggatgaattccttcatgcaaaatcttgacataaaccaacacattagacctttcgtcttgtttgttcgtaataagctttctggtagtatctgctaccttccgattctatggctacaaaacaaaatttacaaagcccctatcatgtttaaacacgacaaaaagaaaatctcctggctcaaattttaacacgccgcagaattcacgaaaattcaaaaaccaataaaaaatcgcaaaaatccaacgggaaaaaggagacgcaggaggaaagggagagagagagagaacaaacggcatcaatggcggccacatccctcctctcccgcctcctcatcctcccaccaccggcgccggccgccgccgcctctctccggcagcggaaacccgccgcagcgcactccctatcctccagggggcggaggccccgcctcgcggtacaggcggtagcccccgcggcggcggaggaggagaagggcgggctgccggcggcggaggcggagaggctggcggagttcctgcgggaggacctcccccacctgttcgacgacgtcggcgtcgaccgctcggcgtacgacgaccgcgtccgcttccgcgaccccatcacccgccacgacaccatcgacggctacctcctcaacatccgctcctcaagctcctcttccgtcccgacttctacctccaccacgtcgagcaggttgagctgctaccccgcactgcatttcccaatttcaatcgtaacagatttgcagcgcattttgcgaagaactcgtgactggatgggtggtggggtttttagacagggccgtacgagatcaccacgaggtggaccatggtgatgaagttcgttctactgccgtggaagccggagctggtcttcactggcctctcgatcatgggcgtcaaccctcagaatctcaagttctgtagccacgtggttagcattcttgcttgacactgcagcttttggaacatttgtttcttcgaattaatgtacgttaagattttcttttattgttcatgaaatgaattagtggtattttaatcccctgaatcatatgtatggatcacgtcttacagagtctactatatgttagaaccataggtctcctgcttgcgacattcgagacctctgagatgaagcatatatattaagcatatgcagcttagaagttaaagtcttaaaagagtacggtttcttttatcaagagcattagtaagcagtcagtctggagtaagatttcgagagatgagatcagggagttcctgacaaagctttcagacaagctttagttgcatacttatgtttagctatgtcaaataactttttattgttgcaattctccaccggatacagttcctcctataatgcaatgcttcatagtcctaattcaatttgatactaaattttagcttttcaggaagcttgtgggactatttattgatgggccggcaaaacaatacttagcttccatagtccacacttgataaagtttacaatactcttaataattgcacttgctgtgatgtgccgtagagttcctggttcttacttatttgtttttttccccccgtttagtgtgcatttttgtaaatagaagattaaggatactatgcttcccagcagagtgttggagagattttgtacatacagagaactccaacacactaaataagtttacccaagtaatcattaaatattattataacttcccaatatgctgaagtgcaggatatttgggactcaatacagaataatgaatatttttcttttgaaggactgggggatgtcttcaagcaggtcatttgtcatgactctacatttttcttataatttgtcaaacaaatgtttgagctagatcttttgattctgcacagctacggatttacaagacccctgatatagaaacaccaaagtaccttatcctgaaaaggacggcaaactatgaggtattaactttaggaattcattttatatctgttctgaagtaacagcactgccatattctcatgatccatgcttcatatgaattaaccatactgataagtatccgaattattttacttgatttttgccagtgtataatctttgctaatgtgatctctatagtagtcagaactcagaacatctaatttatagctgttacttctctgcagaatgtttaagatgaaatcatgaacataaattcttttttgcagattaggagttatccaccattcttaatagttgaagcaaaaggagataaactaaccggatcatcaggttttaataatgtaactgggtgagttatttttctgttacagtagatatttaaccctgtaatcctagtactgattacttataagcgcttgtaaatgtaggtatatttttggcaagaatgcttcttcagaaacgattgcaatgactacacctgtcttcactcaggcttctgatgacaaactctcagatgtatccatccagatagttttgccgatgaacaaagacttggacaggtctatcttgtgcaatgcaggatttcagttactgacagtgcggtttaaagcattgattttggacagctgtgcaaaattaaactaaaagtagtcttatggatttatttctattactaatagtagtaatcttgttcaatcagcttaccagctccaaacacggaagctgtcaacttgcgaaaggtagaaggtggcattgctgcagtgaaaaaattcagtgggagaccaaaagaggaaattgtgatccagaaagaaaaggagctgcgctcccaattactcaaagatgtgttgaagcctcaacatggttgtttgcttgcacgctacaatgatcctagaacacagagctttataatggtatgtttccttttgggctgtcccttattgtttaagctgacatgtgatttttttgatgtacttcactataatgatcctaagactaactaatgaggtttattttatgattaagtgttggaaagttgatattttatcatcatgcttcctttcccaaaattccagttcattcttttttcagttttacatttccagttcctttttttcagttttacattcattgttatcttttttaattcggaaactctcttatgttcttccttatcaaaagaggaatgaggtgctgatatggttaaacgacttcacgctggagtagtagtcttcactgtctacaacacatttctgcaacatatagacacttagcattggagctttcggagcatcatagcaaggtaaagtaattgttcataaagcattttgcgtggtttggtagtattttaaagctgcatgttatttcctctaaaaaagctttgtattctacatgtaaaaaaaatgtagaaacaatttatgtatctaaatgtatcgtgcaacttagttattcccatagatccgtcatgccttttgtcatccatgttttaattttttgcattatgctcatttagcttttgcattatgcaggtgaaaaaaattaggaagatgcatggatgaaatgataggagaatgtaaataccgaaaaggtcactatattacatggtaattctagtccatatgaaaaatgtttgtgtataacaaaagtgaaatgaacaaaatgaaactgtttagaacaaaaggaataacccccacctagccaccctcattcccagtgacatgcctggctgtaacacgtctcttctgtctttcttcctcttccccacatctccaagtaacataagatgataagaacatacagaataggccagggtttgaagatccgtcagttaagatccttactaggattctttcatgtcacaccaagtgaccaaacaacacatcttaaagcattgcctccaactttgacccccccccctttttttttgcggggacaactttgacaccctttgttggaacaaccggttacttcagaccacttgggttagtgttgagttggagtacttcgaactatctatggagtattaggagttaaaatttggatattcgtagacgaagaataaccaaccctgtcttcccattctgttcagtaatagaataaaaaatgacaagagccttattttccctaaaatccctgaaaaaaagaagaaattctacctctttctataagatttaatgaaaattgagaaatcttttaataaaattgctattgat

SEQ ID NO: 82308 - DNA, 636 bp, Oryza sativa
aaggaggacgagaaggaagaggaagagaaggatggagctgctgccccacgccggaggtcccgaagggagacatgagacacaacataagcctttgattttgacgtcttatcgcggccattttggcggctgcttttttcctttttcgagaacttgggcttttatgttttttgagtgtataataggagattcatgtcgcctatgctccctgcagatgatgatttggtacccctgcttaaatggttagaacttcacggacagtagaagttagtcatgttgggtttatttgtgtgctgtgcctgacatataatcactttcttgatcacctagtgattattttctcgtagatagttgaaacatcaagagtctctttcagaagtgtgaggttcagtgcaagctagttattatctttgctgcatttcctattcttttgctgtgtaagttactaccacttgcaatttccaatcatcattgcagcaatagaagttgcgggcatattagcatcgcagcaatagaaatcgctagtctccgatagcgtcttaaagcgttggttttcgactagcgtcagaatagagagaaaagcgggcaactagaaagcggaagcgggctaagaacagacttcaatatcatgaaagcggc

SEQ ID NO: 82309 - DNA, 683 bp, Oryza sativa
caactaatttgagattatctccacgagtttggttgaattggacgcgggatcggggtggcgtcacgtgttggctggctctggctcgactggagcttgaagaagctactgtagtgatagggacataatcagacttctgctgggacttcttttcgtaggcccgattgaaggaggacgcaaactaatagaaatgaaacaacagagaaacatagaagagatataagggaggaaatctgcacttttccatattcagccaaacctaaaagagaggattttgattcctttttccaattaaataattgctgaagtgatctttcattttcatgtttctaaaacccagttgtatcccatgtgtgttggcaggaagaaaacagttcggtttgctggttgatatgggattatgatttggattaaatctaattctaattacaaagatagagcttatatttgataaatctacatcattatatttaaacatggaccaaaacttattctagatccactatgatcaacggtgtatatttttctttcaattaatctgttgatttctaagccacaaatgtgaataaatttttctttattactgtaataaaataatttataaatgtatgggaaaaaacacacatatatatagtgcttctacatggaaagaaaacatatgttacactaagtatgaaaaaaaatgt

SEQ ID NO: 82310 - DNA, 5336 bp, Oryza sativa
ttcctgcacccctccaaaacacaactttaacttcttgtttctacaaaaatatttattaaaaagtgatatatgtatacttttatgaaagtatttttcaagacaaatctatacatatattttttacattttcaaactcaagagagttattcatgatttatattcctaaggtttgactaaacgacttcctttatgagtatggagggagtagtttttaacaaatttgtagacatttcattttatcataatgtatttcattaattttgttttgtattatatatagtcttagatcattaattacaaactagatgacatttccgatttagtgttggattccaatgtagcgatatgacatttttcaccaaattttaataagttttgatatagttttgtcgtgaattctcaaaaaacattcaaaactccgctcagaatatacttttcgtcccacgtcgaaacatcaaaattacatgatttttggtgggttttggtcgaaaacataaaccctggttaatactgaccccggtgaccatttatcctggcttcgcccctccgtatacgtatattggactgttggactggaggggcgcgcatcagccacccccgacggtgaagcggcgtcctgactcctgacactcatttggcagctacaacctgctggcggccattcatgtcatggtcatgggaactgggagcaggtgggcagaaccagaagcggagcctgtcgaggcggcggtacttgatgccgacggtgagcacggccatgacggcgccccagatcaccacgtccatggcgagcggcgtccgcgactgcgacgtgatgaacgtgagcacgaggctggagtaggacaccaggaacggccactgcacggcgcgcgacctcgacggcacgccggtgagcagccccagcgtgagcagcatcgagctcccgaacccggcccagctcgctgccatgaacagccagtaccgccgccggttcttgtcccgcatgatcgggtcgccggcggcgtggctcccgtcggcggcgtcgtcctgccagtacccgcccgggacgttcgtccccagctggtacgtcagcgccgtgatcagcgtcgccaccaccagcagcgtgtcgttcttgttcgcctcgaaccccggcgcgtgactgcggcgcccgccgccgttctcccgccgccggttgtcacccagctcagcgtcgtcgacaccgttcttctgccggctggtctcacccagctcagcgtcgtcgacaccgttttgccggctgttgtcacacagctcgccgccggcgcggccgtcctcaactgcgccggtgtccatcttacctaaccactcttaagcctatgtcaaagtgcaaaacttagatcagagaaagaacagtaaaattctagcaggaatttgatgacgccaatgcttcgcaagaatcacaaagcctgtgttcttgttgtgtcaaacatgctatgcatacgcacacaaaaacacacatttatactggaaattttcttagttaggctatgtttagttcccacacaaaaatttataccctatcacattaaacgtttgaacacatatatgaaatattaaatataagctaaaaaaataacaaattgcacagattgcgactaatatgcgagatgaatcttttaagcctaattgctccatgatttgacaatgttgtgctacagtaaatatttactaatgacggagtaattaggcttaataaattcgtctcgctgtttgctgacggattctataattagtttttctattagtgcctgaacaccccatacgacaccatatataatacctgatgtgacacgccaaaactttacacccctgattaaaacacccccttaattactttgcttatctctaacaatcattgagaggtaatttctcagaagcagatgggaagcacaaggagtggctcgtttagggcctgtttagttcactaaaagaaaatttctgggtgtcacatcggatgtttgtccagatatcggaaggagttttcagacataaatgaaaaaactaatttcagaactcccctgtaaaccgcgagacaaatcttttgagcctaattaatccggcattagtacatgtgggttattattgtactagcacttatagctaatcatggattaattaggctcaaaagattcgtctcgtgatttcccccctaactgtgtaattagtttttttaatctatatttaatgctccatacatgtgtctacatattgatgtgatatttttggaaaaaaaatttggaactggccttacttgtccgagagctgcaactctagtcgagcgaggacttctatgctctaactagtcagtcgtcatcaagttgccgtggaatttatgcagttagaagttagaacaaacagaagctgatgtagtggatatcttattcaaaacctaaatcaacgcatcccctctcccccatttcacacctcggaatccctctgattatcttagtcaattcaaaataatctgaacttggatttccttatctgacagagaattcaggaatatccaacttgtcatcacagcttatctcatcttatgtacaactgtaacctccgttgtataatatatgacgaagttgaattttctcttaaaccattgctgaagcatatctcatttcatcacgattaatggctaagattgcatcgataatgccatgggatcctggtggctgctgcttcctcaagttattagctatatcagctttgtgggcaagctacattttccaggccatcggattgttgttggacagttgagtgatagttctatccttcacaagccaaacatttcgatttgcttgagctgtcttttgggatgctcgctctgttggcaagctgagaaatgaagtccacatttctaaagctttatgacagatagagggtttgtaatgtcaaaagttcacttgccgtaaacttgtagacaagtcgaatttgaaggagagatttgaacgagaggagattgaatttgtaggagagggggattctcaggagttattgggtttagggatggcaataggttaggtcaggcacgagcatagcaaatccatacttggcttgagactcacgtgcccgtgtccgacccacgcctgcgaagtctcttgggcaaaaccccatgcccgttgggcacgggcatgcccaacggatacccattgggtatcacagtaaatatcttaaccccatgcccgtgcattgccgtgtcgccagccgccgcctgctcccatgcgccgccacctgtgccctggcgccgccgcgtcgccatccacagcagtgccgccagccatcgccttcgcccgtgcgccaccacatcgacgcctgcgcttgtgcgccgctgcgtcacgctgccaatagcctcccgcttccttcccgtgctccaccgtcgccgtgtgaagacactggagaagagtagaagactgagagagtgagaggtggcagtggggaggaggataaggttaggggcttggggattttcaggctagggttttattgagtgaatatatattgatgctgtatacaaataggtcaaatgagctattgggtcataagagaaaggttaaactattgaaggtctcaaggatatacatggactaaaaaaaattaatttttggctcaagctgtcaagcatgggttacccgcgagtgaagtataaaacccgtatgcttctaataaattcgcaggtatcgggtgggatatgcccaatgataaaaataggtacccactcccatatccattggttcgagtatcatgaatacgcgaacctacattggattgcactttgcacccttggctgttcggaactgcgaaggtcacattggtgtgtttcaaacggagtctcttttcgaattaattttgcccgtccgtgcttgggctcgtgacctgagaaattgtgtccaatgggctgtcgcccacgctcttcgccagcttggtccatgggctctctctctctctctctctctctctctctctctctctctctctctctctcattcatcctggaggaatggcactaattcgatcaagccaatctatgtaaccgcataaacccatttgcataaccactcggaatcgatggactcactgggggggcaggcagtgtgtgtgatgatgcgaatccaggaggagcctgcagcggcaagcaatgcaaaaacgaagcgaataaccaaccttgagtgtccgtgctgctgccaccgcccactgaagtggctgctcgtctctacggagtaggagtatgtgggatgtggcctacgcctatggtttttttggtcggtccagctagcctagctcatatgccctcgtccacccatgtaaaccgcgacggaagcatggcacaatccggcacaccaactcgtcgattcttccggcaaattcttgcttgcgtgaggcccgatcgagcatcgaccgacactagctaccaacatgtcctaacaacaaactgtcagtacacaacagcaatagttagtgatcgatactggtcgcattgttatcttgtactctagaatgtcatggtcaaatatcaaatatttgtccaaaatcgttcgtttcgtttgacctctgacgacctcagccgagttttgtgctatccatatttagttttcttcttcttcttcttcttcttcttcagcagcgaagccggtgacagtcacgcttttatttacaggagtattttttacccgtcctctacatctaattagatatgtacagtattttaaaattgaaaacttagctcctaaaacaacacaatccaaaattcgctctttttaaattagaaccatagccacttaaataacacaatctaaaattcgcttatatagagatttgaattcaatatcttaggatgctacttaggttaccgcaatcactagactttgcctttgacaataacgctagccgtgctgcacaatcacacgaagttagttaaattaagccaatcattgggctcaaatccgtgtccctttcctcgaaggcgaaaaggagttgttgataaaggcttcgatgctgcacacgacctttcttctgcagcaaactataccttgcctccatttgcaccaagaccagagcacgcacgcttgccactctatatactggcacacctcgcggccatggcgagacacactcctcgctcgccagcaaactgctgcttgcgaccgcgacaatggcgtccaccggcgcgctgcttctgttgctcttgtttgtgcttgcgtgcggcggcaatggcggcgcggccgccgcggtgttctccgggtgttcgttcgagagccaggaggaggccgaggcgttcgaggccgcgctgctgcagcaggcgtgcttcaacgtgacggcgttcg

SEQ ID NO: 82311 - DNA, 713 bp, Oryza sativa
attcctgcagccctgccgactcaaatcaccacgaatcgatcaatccatcgatgggatctaattagggtgttctagcggggtagggaggggaagcgcgcgggtggcgcttacgctgcagaggaaaccagcgggtagcaacgctgcctgacgaggagacaacgatatcgtcgtgggctggaatttctatggacgaagacgaaagtacccctcactaatgaggattagactgttaacccacttttaatctcagccacttatgtgctttgattttcgtgcaatttttttttaagaagtatagaagcacatctcttataaaaattgaagatatttttattaatactttggtacatcattcgtgtatgaatcggtttttaagttcgtttgatttaaaaatacatatttgtatttaagtcgggttttaaattcgtttgcttttggaaatacggaaagagttgtataagatactagtatctctttaaaaatatcgcatgctaacttgattgagatgatcggactcctaattgcagctcatgattttttagaaaaaatatatatccaagcgaatttctacagtgaatatcatcttaactcaacctaccatataacaataataacattaaaataacattcacccgttgtaacgcacgggcatttttttcctagtcaatacaaagctaaaagactaaaacaatcgtactttatcaaatcgcaca

SEQ ID NO: 82312 - DNA, 40847 bp, Oryza sativa
atttgaaactaaaatataaaattacagtcctatataactaaaattacatatgtaaatttagttgacatgacatgtaagtgcactgtaattttgataaaaatgttatgtaagtaaatttgtattagttattttatttaaaatataaaattacagtcctatataactaaaattacatatgtaaatttagttgatgacatgtaagtgtactgtaattttgataaaaatattgtgtaagtaaatttgtattagttattttatttcaaatataaaattacaatcctatataactaaaattacacatgtaaatttagttaatatgatatgtaagtgcactgtaattttaataaaaatattgtgtaagtaaatttgtattagttattttatttcaaatataaaattacagtcctatataactaaaattacatatgtaaatttagttgatatgatatgtaagtgcattgtaattttgataaaaatattgtgtaagtaaatttatattagtcattttattttatagtccgttggatgcaaatccaaagaaagaaaaaatctaggtgattttttatcatccgagtgatgcataggcggttccgtagcaaaatcgtgttgctacacttgctaaaatttattcgttgacttccacacgagacataaaatgaacatatttttcagctcattgtgatttttgcagctcaggttctaattaattacctcgtaagattacttcctccgtttcatacatacatacatacatacatatataaatatatatatatatatatatatatatatatatatatatatatatatatatatatatatatatatatatatgggcaatgctagaaagtcttataacctgaaactaaactagtaattaatttgtacattatttcttcactttatccagggttcaatctattgaaaaagaggaaaatgtttgagggccagcaaaattacgaaatttccgaaatatttcaaaatcgaccaaaagcagagtttgaattcaaacaacaaaaatgagaaaatttgccctagagacatgccatttctgggtgtgttcggatctcccagctcccaactccttcttttgttttctacgcgcacacagttaaacgttgtgtttttttaaaaaagtcgaaagttgcttaaaaaatcatattaatctatttttttaaaaaaatagttaatactacctccgttccaaaataagtgcagccgtggatattcgtgcccaacgtttgaccgtccgtcttatttgaaaaatttataaaaaatttaaaaatatttagtcacacataaagtactattcatgttttatcatctaatagcaataaaaatacaaatcataaaaaatttacaaataagacgaacggtcaaacattgaacataaatagtgtaaaactgtacttattttgggacggaaggagtacttaataatcacacgataataaaccgctccgttttccgtgtggagggattgaggtcccaaccgcctcttacgaacgcacgtcactacgacgaggacaaccgaggacgtgagacctcattgcccctgacgtccagatatcgaaagggccactgccgtcgacattacctgagatttgccatcgtcgacatcgccagagaggctgctccgccattgcgcaccaccgacaagtcgttgcgcctgcgttggagagtccgctccgccgctgtttgtagccaccgccgagaattgtggcgagccacctttggtgccgggaagctgtcgcgtcgctaggatcgaggcatacggactgttttgatcttagaactagggcctaaacgcgtggttacatgggatatacggacacatatttaaagtattaaacgtagactagctaataacaaaacaaattacagattctacctggaaactgcgagacgattttattaagcctaattaatacatcgttagcaaatatttactgtagcaccatattgtcaaatcatagagcaattaggcttaaaagattcatctcgcaatttacacgcaatccgtgtaattagtttttttctatatttaatactctatgcctgtgtcaaatattcgatgtgacaggatgaaaaatttttatttgaaaactaaacaagcccttatacggaccgaccaagttgttataacgaagtgcaaaatttgcaaattggtgtaccaatttacacccgccatacaagtttgtatagcgtgaaagcaaattacttttatctctgttagggataaaaacggagtggatatggacggataatgctcatataatattcgtttttatatttaccgtatacggaaacaaatacagatagcttgaatacggaataagaatcaaatatgaccagacatgaatacgaaaacaattttttctcagaacacgaaaaccaacttaacttctaataaaaataaatatcaacgtacaacctccaaatttaaatatatgacgccgttgactttttgttcaacgtttgaccattcgtcttattcaaaaaatttatgtaattatcatttattttattgtggattgattcgtcatcaaatattctttaagcatgacataaatattttgatatttgcacaaaaatttgaataaaacgaatggtcaaacgttggtcgaaaagtcaacggcgtcatacattaaaatacggatggagtatataattagctcactttatattaaatgtagtataatttataaatatttttaaaaatttaaataatattaatagtgtggactagtgttaagagataaaccactattaaaatctaaaaatgtattttaaaggtcatagagttataaagaaacggggtatgtctcatggcttctgcggatatccgaatagtaatgttcaccgaattattatccgtatccgatggaaactccgatgccatattcgtatctgtatccgaattatccgatccgaaaggtatccgtattcgtttttccccggagcggacagaaactatccgctccgttttcatccctaatctctgtacacaagctccatagatctgctggtagcagtccacaaatctgctgccgtacatgggcattaggcctcaatgagctagagggaacattcagcccattttcttcgtaagaatgagccaagcttgatttgctgacatgcttctatgttacggagtaacttataaccagcatatacttttatgatgacaacattacttatagctagcgacataatgaccattattattcgtaaattatttttttgatttaatttgatgaaaggggactgtgcggttgatgctaaaatatgggaggtggcaacaagtgtacatataaattaatgaggatatttatcccactattactaaatggatttttcctaacagccttgtgttttctacggtggccagcgctgccgtcaatgatcaataaccaatgaaaatgcaccattttcactagcaggtaaccttgcctagccgccagcggaaatggttttcgcaaggagctaggttaagctggccatctatggaagtttgactttttacaggtccaccaacatagatgaattttggtaataaaataaaaataccatatgcatgcagctacccatttccacataacaaacaaaaaatacaaatcaaatcgtttacattgtcactacatcaaatggatctgcaaaagggaagaacaaacacataaaaattcaccacttcaaccctagctcccaagcatagcccccttcaatttacaagaaccctagacagccaccgtggacgagccgccaccagagccaccccctctactatagccgcgaccaccacccctgattttggagaggagaggggaggggagtgggaagccgttgccagtgccccctcttttgcttctgccatcaccagtctcctcccatcccaccatcggatccgcctcccatcgctgtcgccgagagcacctcgaggctagagggagccactgttgccaagagcatgcacctggaggctggatctgggacgagaggggattgtaaagctgccgctgtcgctccctgtattgatgctaccgccgccgccggcctcctcccatcctgccatcggatctgggagaggggagggcagggtcaccgccgctgctccctctgttgcgccaccgccggccattggcctcctcccatcccgccaccggatccgcctcccatcgccagcgctgtcgttgacgcggtcgccgttgccatcaccgtcgcacctcaaggcgggagggatcaatgactaagatgaggaggagttgagaagatatatctggctgagaggtatggggagaagtcgctatttaatactacctccgtttcatattataagtcttttttactttgtttctagttaaacttttttaagcttgaccaagaatagaaaaatatagcaacattttgaacataaaccaaacgtattgtcaaaatatattaaatattagttttaatgaaactaatttggtattatatgttgctaatttttttaaaaaataaacttgatcaaacttaaaagaagtttgactattaaaaaaatcaaaacgacttataatatgaaacggagggagtatggtgatttttttaggcagtcctctttaacagtcgccaacgaaaaatcaattttcactgcaaggggacctcttaaatgaaagtgatttttgcctgtagttcgtgaccggaaaccctctgatatatatccgccggtaaaagtaaaagtgtggtgtcttaaacaatggccttttatagtgtcctttcacaaacaataacttttttttattccccaaccaaataataacaatggcaataacaattttattaataacctgtagaaacgaatatgtgaatgctggtcaaatagtgcttttattctcctaacatgaacctattatataagaatacaattactcaatgatagtatggttgctagatctccttaattagtccttgccctaattattttgctcgcagcatcttgcttggatatatacttggactgagcatgtgtacaagaatctaataacggccggtactctgtattttagtatggggattaccgattatatatttgtgatatactttagatctcggcaggcagagatcgatgtgcttataatataaatttagccccatgttccattgtctgttgtgcatgtgagacaagagatggttagcagtagaaaagaacacaaggatactttctctaatgcagaatcagcaaacaatcatttcttggatgctaacagaactttgcatacatgcatggagaaatctcttccaagctccattatatatatattgatccaagttctaactgacaattccctcttattagtttctgttgtaatgagaataagtatatcaaaatatcatggcctcctggaaattaaaagaaaaaaaaattaaaacaggggtaccataatgttgcaagagctaaattctacattaataaatgaggcatcttaatttgattggtgactaattaggacgtttgtttgcaacatactccctccgtcccaaaataaatcaactcctgtaattcgaactttgtcctaaaataaatcaacttctacctttctcatccactcttggttagcaaatcgaaaaattttattccttcaataccacttatctacctatcgaccaatactaatatgctattaataagggatattttggttatttatctacctctttaattttatattgggaagttaggagttgcttttttattggacagagggagtatactaatatgtttgattggttatgcctagctagcagcaggctagatatagatactagctagtagtacctactgaataactaccaaaggcatgtttagttcgcgaaaagaaaatttttagatgttatatcgaacgtttaaccagatattagaaggggtttttagacacgaatggaaaaattaatttcataactcgcctggaaaccgtgagacgaatcttttgagcctaattaatccgtcattagcacatataggttactgtagcaattatgactaattatggactaattagtctcaaaagattcgtctaacgatttcccctctaattgtgcaattaagtttttatttttatctatatttaatgctccatgtatgaatctaaagattcgatatgatgtttttgggaaaaacttgttggaaactaaacggagcctaatcattgtgcacatcgcataatatcactacatgatcgatactccggaatagtagtaagattattctttgttgccacaggaattaagttgagacctatagttagctcacaagatatgatcgattgacagggtacagttataacgacaaccggtagcttgcctgttgttaattggaggtttgttaagggaagaggtcctattctcgcaacccgtattattgatcacagcaaaaaaaaaagaaaaaaaagaagaagaagtacatattgtcatgcactaatgccgcagattcgcatgtccctagagtgcctatcattatttctggtgttatatggagtatatatgctaacaacactattgctatcattgacagcccccatcagtatgatcgaggagggtgtgtgatcagtgatcacactaacaaacaattttatgtgatgtattatctcaaacatgtacacctaactctcaaggcattcctgtgctatatagcttgaacatacaccaaattatatgcatgcatgctacaattcgaagacaaccaacaaaaagaaattatcatgtattcatgtgtaaagcgcgctagctatagctttatatctttgaatccatctatctcacacctaaaaacacatgatgactacatgatagtagaagagaagaaacaatagagcgtcgaggaaaccaaatatcactttccttggcacttaaattaattaactagctactttcctacttgcttaattaattagtagcaggtacaataggaggctataagccagctataaacatattttaaagagataaaggaagagagagaatagtaacgggctacagatctgtagtcaactgcagcatagactccaagacgtaatgtgtgtatgacaagtgggaccagataatagtatagtgagtaactattgtatgaattgactattacattggttataaatgatttagagttagcagtgggctatacaattaaatttgctctaagcgacgttaattagaaatcagaacgtcagggtcgacgtcgtacgtcgtggttttacccgacaagcatatcgataagcatctgcgtaatctgctaaagtaatggggaggcagaggctccgaatgatgcttagctacgctttcggccaaaaacgctgcgctttggccttagtttattgccggtcaaatctccccatgatcccctaaacccatcctcgatctcctccattatcgtcttcttgcccacacacgcagcagcttaattagtttataatctctctttcttctgttaatcttctattagggttttgagagagatcgagcagtgattcatgcatcggacatttcctcgtgcccactatctagggtttccgcgcaggcagtactacactatagctagctatgtatagcgctagcctttgccggaatgccattgattggctggatgggctggatgtgttggaagaagcttcaaaggttttaaaaaatggtgaggcctacaggggttagggtttgattgatttcgtgggaagattccaacagaaaggtgcatgatcatggacgtttttcaggaatggggcttctcatttgtgtgaaacttaacattacacacatcagaacttcataagtgcatgcattgccatcaatatatatactatcaatcagtgcgttaacacacggtgcatttcgcatctacagcggtaatgcacaataaatcatgtgctcatcgatgagttgtaacttgtaactagagctactagcaatcttgcagttcttcaacatcttgacatcttgtacggttgtaccatggggttatacagcaaattaatggatcggatgggcaatgaaaaggaaaggtagctagtagctaggagaaggagatcataaccagcatgggggttgtcagcgacggcgtgatgattgctccggccgccggcgactcgccggtcgccgtcgccggtgaaggaaggagaggacgaaagggagaggcatcatcgatcggggttgggttgtcgtcaaaaggcgagcaaagagggacagcgcgccgacatgccaactgccccccaaccccgcgtcctcccgcaccacgccgcgacccgccgggtgcctacctctagtgacagacaagtggggcccacgtgatggtgcgggtcacttgtcagtgggtgggggattgaggtggcaggggagcgctgggtaggggatctcgtcgtcgatccctgtcctttgtcttctcttgtactgcagccttgtttgttcctgggttttccgttgtaccccctctgagtttctgtatttgcaatttcatatatgggtgtgtttagtacgtacaaaaattggaagtttggttgaaattagaacgatgtgacggaaaattaaaagtttgtgtgtgtagaaaaattttgatgtgatgaaaaaattgaaagttagaaaaaaaatttggaactaaactcggcctatatatacaagcagcatgatttgatttgattattatagttgtagtaatgtttatgcagtgtcatgcaccaatgcattgcccatctctagctcgaatggttaggcaaaatggctcaggtagtacttaaccgtcacactatttataatgcaaatgtttgattttttttttcaatcatacatatagaaaattaattgaaaatgaatacacgagaaatctatcggtataattttaaataaaatacttacatagtgatttaagattgtaaaacttgactacactactggttgaaccattactacatgagtaattaagtattaattattttaatcgtaaaaatagattaatatgatttttaaacaactctattatagaaacattttttataaaaaaatacagtgttctgcggctcgaaatgtgagcacgcaaaaaatgggaattctctcacatacgttgctcactaagatggtgtttgaaactggtgaagatgaagattaagttagcgcacgtaaaacgagaaaatcattagcacacgactaattaatttttaattattacaaacttgacaaatgtatatatttgatattttaaaacaacttctatatagaaagttttcgcacgaaacacactgtttatttatagtttaaaaaacatgctaacggaaaccatggtaaattctgaatcttttacgctgaccactgatgtagagagctgacaaaatttttaagcagcaagcactctgtcttagggcctgtttagttcccaaacaaaaattttcacgctgtcacattaaatgtttggacacatatatggagtattaaatgtagacaaaaaataattacatggttcgttaggaaattacgagatgaatcttttaagcctaattacgccatgatttgacaatatggtgctacagtaaacatttgctaatgacggattaattaggcttaataaattcgtctcgcagtttcctggcaggatctgtaatttgttttgttattagactatggctatgtttagttcccttcaaacttccaatttttccgtcacatcaaatgtttggatatatgcatggagcattaaatgtggacgaaaaaaacaattgtacagtttgcatgtaaattacgagacgaatcttttgagcttaattacgccatgatttgacaatgtggtgctacagtaaatatttgttaatgatggattaattagacttaatagattcgtctcgcagtttacaggcgaaatttgtactttgttttgttattagtttacgtttaatacttcaaatgtgtgtctgtatacgtcaattttttttaccaaaacaactaaacatggcctatgtttaatacttcaaatgtgtattcatatgtccaatgtgtcatgtagggattttttttttttttgccaaaatatgtttggttttatgggacgaaaggagtactgtggaattctccgcacccacgaggaccttaaaccaaaaaccgtccacacgcgcgcggcgcgcgccgaaccgaggacgaggcagcacagcaggtagcgcgcggtgggccccacccccaccccccgaccgcgcgcatctttataggcagcatccgcgcggccaccaccacccaccaccacaccccttgtctccgcaaactcgacgcgccactcgacagcgaccccgcagccgatccatcccgccgccgaagcagcagcaaccgccacggtgcgccgccgccgccggtaccgatgtcgacgagctccggcgccgactcgtccccgcccgtctcgggcctcgactacgacgacaccgccctcaccctcgccctccccggctcctcctcctcctcctcctccaccgccgaccccgaacgcaagcgcgccgcccacgccgaccacgccgacgccaagccgccttccccaaagtacgtatagcttatgctctctttatggagattcctacgttcccgcgggtttctgacctggcgatcgatcgatgcgtgtgcgcagggcgcggccggtggggtggccgccggtgagggcgtacaggcggaacgcgctgcgggaggactccgcgagggcgaagctggtcaaggtggccgtggacggcgcgccgtacctgcgcaaggtggacctcgcggcgcacgccggctacgcgcccctcctccgcgcgctccacggcatgttcgcctcctgcctcgccgtccgcggcggcggcggcggcgacggcgagggtacaaagctcgtcgacttggtcaccggcgccgagtacgtgcccacctacgaggacaaggacggcgactggatgctcgtcggcgacgtcccctggaagtaagcaacgcgtgtacacatctcaatcagttcttgccgattaattcaccgaaatcaaatgcaaaatctgatccgatcaatcaacacaggatgttcgtcgagtcctgcaagcggatccgtctcatgaagagctccgaggccgtcaacttatgtaagaacttgcgatccaatccactataataatccaataacattacattaccaactatactaattactgcaacgatcgatgagtgaatgacatttcgattctgaattttttgatgcagcgccaagacgatcatccagataatcgatcctaccacacgcaacgatgcaatgccgcaattgatctgtctgtctgtctgtctgtctgaattagttcgtctgaaagtgtgtgcaatggaagaggcttggctgtacaggtcctccatgcatatgtacctataccgtagtaggatcagtgatcgatgagccaaattggtgtgtgtactgtacaggccacaagaacgaaaatatcctctctctttaattcaggtgtgctccctgctgccggatcacggccggcccggtttggtttttggacgacggcggcgaggatcgatccaagggaggcgccgccacgccgccgcggcggtgtactttaattttcaagttgtcagctactttctgtaatttgtttcatgatggttcggtttcctgtgacagccagcacttttgttgtatgtcaaatgcaatgtatacatgatataccggttgttatcgttgttgttgctgttgttgactttgttctgtccattgatgcattgcaaggtcaaatataggagcacaataatctgtcatttctgtcaggcttttgatgtctccttttgcccatttctttcgatttggtggtgctgaatgttgttcttttggttggaaaattgcgagcttggttaggtagatggtggtgattgcggctgtggaaatcattggcagtgggaataaccaatccatttttgcgcatggacaaattcatccactgaagagagccagtgcagaatctgaacccaaaaagggaacaatccacgaatgcacgaactgatcattgaactaggcagctagcggttgcagtccataaccagcattttctcacggctgggaagaaatctactgcctctctaatctgaaatactggcctgttcacgtgaattgtgatctgttgatgcatgataatctgtggcccgatcaggccgcctgcaaattcagtttctgcacatattagttgatgctcaatcgctacaacgagtactgttgggttaaatctattgatgatgacggtattttatataggtccgacacagataactgctatcggtgacggtatctgacctgacacagataacttttcacatcactgaccaataatacgtgacgtagcctccctccgacacagatgatggttcctgcctcacacatatgtcctgttttgcactaatgagtgtacacagaatactgtataccaaattcaggtagtccacacactaccgcatagacaaccccattctgagcatgtttacacttgcggttgcccaaatatacatgtcagtactagcagtgacatcctgacagcatgtcagaccgcttgctctgcatgttactgtagttaaggaatcaaacttgcgatgcagcatatgcggaagtaaaattgccctggacggcaggacccctgtggtgatgatacatgcgctaagtatgtgtgcccatagtagatggtgtacaagaacccgtactgtttgggttatctgctgtcagttgagttggagaaattggatagataatacagcacgcgtgcatcccagagatgtggatgtgttaaaagaaaaaaaaactcgaagcttggctcgtcctagatggattcgagccacaaacgagtcaagctcaagcccaaactaaagctcgcgagctttgctgagacaagctcaaagtttataacgagctggcccaacctcatatatgctgtagataatagcccaccatagaaattaggaagcacactagcctaaggagaggaagaggcacacattcctgaaaaaatttccgtcgatttggcttccttccgtgtgatcactcatagctgttcgcctcatcgcctattccgtcgcccttccagccgcgttgtcttgttccgatggtgcgacctaacctacgcagcgtagctacgtctacgactgcgagccagagatacctatgcgcggctacgcgtcgacgacgtcgtgctctgcggcagccagcagccgattgcaagtctctccgtttagttccgggaggtatctaatttagaagaaattattagatgaaattgatattgatgccatagtgaatatgacttcgcatcagtaaacgttagaagaaaattttaaggtaagatatataactcatttaataagaattgtttttatgcattacatttattagaaatatcgttatattattatggttgtattaaaggaccttttttctagatttgctccagaccactaaattgaaatgaccgggcctggtaaacccaacgagttcaaatgaaactaaggatgatttacaaaatttaccagtgctatttgtgatttagcggaacgtgctaccggaactcccatcacgtgcaccctgatccctcgcagcactcacagctcgacacgtgtcccgcatcacgtgtcctccgcccgtccactgctttgcgccgacccagcaaaacagcgtgagacccgcacaccggatcacgcggcccacaaaaactaaccaccacatcctaatccagattagagagcgcgattagtctaaaccgcataataatttacagaaatgcccctcacctcccctttttattttattttttttctattttttttccgcagccacctccccttctcctctcttatcgcaccacgcgcactgttcacactccacagtatgttcgctgcgacgacgcagctccaaatcggaaccctaaccctagtagtcctcctcctcccgcgctcgatccgaggtcgtcatcccgctgattccgaggctctctactgcggcggcggcggcgatggaagagcataggcttggcggcggcggcggcggaggcggaggcggggggaggccgccgatcccgggggcggcggggaggaagcttccggggctctcgcggcacgcctcgttcgtgagtaacccccgccctaatcttagctctttctcggcgttgtaaacttggttttggtgtggtttggttgggtgcttgctctgttcttcgctgggaaggcggcgaggtgtgatatatatatattttttttttggctgtggaggatttggggataatgtcggcatgatgtgatgggcgatggagtctaattcggggatgaggggagtgaggagaaggaatcttgggctctgaaattgccggtacatccttgttgtacttgggtagtacaccaacctggggcgagatgtttggatccgtgcggtttatgtggaagcagcgtattgggaaacattgccttgggttgtatgaaatggttggttttatcaaactgtacacagagtgtcctagaatgttttgcataaactatgttagtgctttgtactatcagtgtattttggcggcctgtattcttttttgcagaatttggtggtgaatttgatgttttaactttgctaactcattaggtatttcttccttgaaaaattgaggcaacaatttttcagggcactgtaaaagtgaggggaaaggggatcagactggtaattttctgtatgtgtcatgaaagtgtcttaattcttttggtactttttgctcttgtcctgactacatggacccataacatcattgaaaagaaataaattgaaaggtacttcgatgtctctgctcaacagtaattgcccatttaagttgtccacagtcaaaaacagcaaagctgttctaaatgatattctgtactccttccagtttcaaaattcttgaccttttagacataatctcacataccaaggagtgatttattagggtgcctaatccttgttttgcccatattaaatacggtcttgtcctaatagaaatcagaaactcgtgctgttccaagtggtttgggcctatcattagcgtctgtgcatgccgggttcgagttctattgaggctattttttttaaaaaaaaatcatagcgttatcttggtaatttttggctcgctcgcgcttgctttagcacacaacggttgctacatcatcactgtcatcacacccgctctcaacgagcaagcggtcgccgagagcacggcgccagcaagcagcccaagaagccaacaagcgattaattaggagatgagacaacggcccgcgtgtgatgtttaatgacatacacgacgctagaaacaatgcgttggatttttatgcatgcatgcaggagcaagcaggtccaagatactttgcttcaagatctaaaacgtcaactattttgatactggagggagtaaggggttggcaaaagtggtaattgacttgatatcattgccttgctgattttggtttcaatctcgtcattctttccggtattgtttagattataacagtggatcctttagatctacactgcacattgttttttcaatagaagctagatatggtgatacacatagtatgcttccataacaaaatatatgcacttgcctgtccatttgtagttatgtacttgtctgacactgcatgttgcttggtaatttctagtagatcacattatttgagcaaggagggaaccattataatgtcacacttaattcacatgggaggggacaagaatagttgtttcatagttacaactaattgcaccgcttttgggcatgtggtagggcaaacttaactatagttagtatttgctataaaaattttctcttcaatccttgcaattaaatcattttaattgggcatccacggacgagcctaggcagccattgggccatggatcagccagtgagtatgagtgatattcactttcggaagaaccgaatgtattccctctgtcccaaattataatagatatattttttacacaatctttaataacatactttgatcattaatttatttcatattatgtcatcaacaactataaaattattatcacatgaaaatgttttaaaatatgaatctaatgatataacatacataatacttggtgtagatattgttagtgtaattattagtcaaaagttaccgagtttgatttttctaaaaataagagtgctctacaatttgggacagagggagtatatgacagtgcaatttttgtttttgccttttgttggatcaacattgttaatatatgtatgagataatctggaaaccctttttgggtcatggtagtgcaacttcaaaatgaaagagcatacaacatagattctgtgcagtatggttaattatttttttgtcatgcttggcattggttttgcaggtgaggagtcctgcaaacagtacaaaatctggaactgagaaaacttttgaaaacatggatgctgttgcatatatgcctgttgtaaggtctggaggttgggctgatattgggtcaaggcacacaatggaggatgtctttatttgttctgataacctcatgaaagagtttggagttgaaagttttgaagatggtccgagcgcattttatggggtatgcttttattctactgtattcaaggcccagacttgtttcttgatgtatgcgatatatgttagccatttcatgactagactaacaataacaactttcctttatgagtaatttcatgcccctggcaggcattttatttatatatacccttcatatgattttaatgtcttaggtttttgatgggcatggtggaaagcacgctgctgactttgtgtgcagcaatttggcaaggtttatcgttgaggatgaggattttccaagggagatagagaaagctctgtcctcagcgttcttacagactgatgctgctttcgcagatgcttgttctgtgaactcctctcttgcttctggcacaactgctcttgctgctcttgtggttgggaggtattggcctaacttcttaaactgtaaagtgttgtactgactactgagttcctggcagcatatctgtttaactactatttgatgattgtcattacttattaatggtaggagccattccccacccccaccctgttatggccatgcagttcctgtttcgttgcctgtggccttgtgcaaattataagtcttcagtgcactcaattgtgcatgaacagacaggggcttcaaaacttatttctctcatgaatagacagcattgattcttgatctttgtttctttgcaatcgtgtgaagtgcatctatagcctttctattttgactatcttgtcggccacggttaatatcagcgtgctttagcctattgcatgctacagtattctctttcatgaaagcaattatatagtataaattttggtacccaaaaatgggactgtgtgcccccttttatagtccattatgtagttctcctttctgtctatttcagtctctgctttctgtcttgctatgatctctgagagaattatgcttccacttgggataaccaactttcttgtcttaaccgttttgccatttttcataggtcacttctggtagcaaatgctggtgattgtagagcagtactttgttgtcgtggaaaagccattgaaatgtccagggatcacaagccttcttgcaacagagagaaggttcgcattgaagcctctggtggttatgtttatgatggctacctgaatgggcagcttaatgttgcgcgggcaataggagactggcacatggaaggaatgaaggcatgtgatggtcttggacctcttagtgctgagcctgaggtgatgatcaggaatctcactgaggaggatgaattcctcatcatcggttgtgatgggatctgggacgtattccgcagccaaaatgcggtagactttgcacgccgaaagctccaggagcacaatgatcctgttacctgttgtaaagaacttgttgatgaggccatcaagaggaagagcggcgacaacctttctgttgttgtcatctgcttcaactctcggccgcctcctgtcctaacaactccaaggcctcgtgtacagaggagtatatctgcagaaggcctgagggagttgcaaagctttcttgatagcttggctgattgacatgaggcttcttccttgatagaagcctgacatactgtcgctagtgtacttccattgcttagcatggaatttttaggtttagtgcggctattccaaggcttaatgccagctatctcacaaattctctgagatagcagctgttgagtgattctggtgttgtaatgtattatgcggctaattctatctgcagtttaagtatttattggttcagggatatgctgtcttaaagagtctggaattatcagggaacatttctaagatatctgaaatggcgagtgatgttgtctattgactgtattgcaaattttgacatactatgggaacaaatgcatgtttatttactgtggttggagcacagtgattctgtagtgtctgcagtgtggtgctctgaacttgtatggtcagtcttgcacttgggtaagatcagttacacagtgactgtgccagaagaaactctagctccacagtccacactacagtcaatgtgacctcagatggttccaacagcatgttttttagtatgttctccccatgacatcaggtgcagtagaagctgaagctctgcatgtgcactctgccatccctgcttctgaatctgaagacggagaccagcaacgatgaggaggtgatgtcgaagacgtgcgaatccatctactactcccatcagcagctgttgtcggatgatgaagcctctcgccattatgaacgctctagccatcagcaatctgatcctgatatcactacctctgaaactggagtagtaggagaaaagaaaagctggagaacaaccaatcaatcattcatgtgtcctgcgatggaaatccagatcggcgaatggctctctgaagattgtttttcgattcagattttttttattgaactatacggagatcagtgatcaatccctctagcttcgctgaaacgaatccacctactctctctctctctctctctctctctctctctctatatatatatatatatatatatagcgataaatcactagtcacgctaaaatgaaatgaatacactcctaaaacatgctcaaagagactatggacaaaggataaatcctgatctcgctacgctagtgcatacataattttcgtgaacatcagaatttatattctaatagatagaattatgcaccgccacatcatctgtgcttcctgcttctctctgaatattagtggcatactggcatcgtaggatcaatcaggctctacccactccctcgctttatcgtgagaacttgcagcttttgctggcccataatcgcaaagagatcgatgctggcccattgcaaatggcagccggggcccctgcctcagtcactcagggcctaggtcactctacttcggctacagttggatgatctgttctctctttttacctttggagatttattatggtgttggtgtgggtcactgggtgctctgacactccaacatctatgctccatgttgggacatttcactttgtcctgtagctctagctagtaactaatctagatttgtagcttgtttccccgaaaaaaaagaaaaatgtagcttgtttaggacttccctaaagaacatcaagcaccctcaaaatgtgttttgagatttaggtaaaaaatggtagggttacattgggttcatgtcatctaagtaaattaaccatattcagatgctaagggctagtttggttctctacctaccaattcactaccaattcattggtagtgtaaaaacccatgtaaattttggcactatcaattactcctagttggagggtagaattctcaatttgtttggatttagattgctaccaaaaatgccaaatctaactagagtataaaagaaggtttggattgctaccaaactgagcttgggtatagccaacgatttggctccaattcaaacgtacatgattactattcaagctatcaaatgctactatttggtagggcaacaaaccaaaatgaccccaagtttgccttttaccaccgtcacccactcctctcacctgaggttatgtttgaaacacagtaattttgtacacaacaatctgattatgttagaaccgcaaccaagtgtttgcaattttgataatttcgctccccaccggcaagcacatatcgtgcctgaaatttccgttttttttctatttttttgtgaatttggtcaaagtttattcaaattcattcaaaatctattatatactaaaagtccattaaacttcctacaaacgctctcaagttgccacgtggcgctctaataaattagagaaaatcctagaaattctaagaaaaaagcaaaacatctacccttgattttcacttaaattagtgggtccaatattatacaccgttagataaaattgatcttaaaacaaaccaaataatatgggtcccacctctcctttttctcccgcgtgcataggtataggtcacgtacgtacatgcatgtggacctgttgttcgtacgcctccctccatttttttcctttttttcttcttttttccatttatacaatttgatatatatttgtttaaataataataatttagaaaaaaagaaaataccatcatataactctttataaacacaggtaactaaattagctatgcagactttgaaaataaaatttacaccatattatatgttaattagctctaaaatcaataatgtaagataatttactaaatactattattttcatataatgcactattttaaaataaagcttacacaatattatattgtgtacctatcaaataaacaatttaagatctatattaactaatatatacatgtacttaaacagatagacccattatttaaatcatcggatctattttttattactttggattattattctcaaataattcagtgttttaaaataaaatctacaccatcaccataatgttgtgtacccattaaattaacaatttaatatatatatatatatatatatatatatatatatatatatatatatacacacatatatattaactaagttacatttacactaaaaccggtggacccattatttaaatcatcggatctattgttaataatgtctaaagttctctttttggcccactccacaatgcacatctgcacctttgcctttcgcacatgtgacagagtgtcgtgtttgaggcatcttgggtgatcacgaccgctgcagtgctaccgttgttattaatagcatgaaaataaaattaaagatgtgatgtagcgagagaagaattaagtaccgtggaacacttaactctgtttaagctgaaatcgagagttgattaaataataattataatgtattgtgttatgttgtatttgcattttgtattatttgttcgtacagttgaaagaaatcattatgttataattgtgagcacaatattaacgaatatcaacagaactcttactaggataagagtgttataagggagtttaaggccctattttttccctgattccatcttttgaattttcgtttgcacgctccatgctttcaaagttactaaatggtgcttttcttaaacaactttttaacttttcagaagtcaattcattcgtttataatctcaaatagctatcacataaatcagataattcatcaatttcagttgtcatatcccctaaagtacatatttttttcatgcgagtcatggtgataagtaaattggtgatcaacgcataatcaaagtcataagataaatctgttagaacaactatgaccaattgtaaataggtgtcaaaattaattgctattaattaaacaactaatggcttgctagcaacatatttaatttttctctacatgtatataaacatggacgaagctaaaacgaatatgaacatacatcccatacatatatatattacatcttaatattctaattacatgtggtaagtccactaaaatttcttaaaatgccctcaagatgtcacgtggtgctctaataaattagagaaaatattagaaattctaagaaaaaaagcaaagtatctattacttgattttcacttgaatcgatgggtccaatattataaaccattagattaaattgatcttagaacaaactaaatactacgaggtcccacctctccacctttggtacgcacctacgtacgtgggtacctacgcttccccacccttttttttttatttttccctttcttctttttctccatgaatatgcttccctccctttcttactatatcatgcaccttcacgagacgatttaatctatttacttaagaaaaaaatatgattcaaaagtcgtaagtacttaatccatctcccactcaaaagcttgcgaatggacttttaagataccttaacaaaaaaaatagaacccttaaattattacaaaataacagtatccgaactttagtttgcccttaatctatgtgataatttttttaacaaacaataaaaatcttacctttcaataatatatgtgcccgcgcatacgcgctggccaccttcctagttcataaaaaaaattaaaaagaaccgaccaaaaataccgaaaattctgaaatttaggttcttttagcccccaccggcaaaaacctttgtttcaaaattgcaaaccctgccggaagctccccgttctaaaaaagatataagtttaaaccttaaagtaaggcgtgtgagaagcacaactctcattaccacctactcccttccctccgtaccataaaaaatcaacttatggagatgaacctagacaaatatttgtccaaattcatccttagaagttatctttttttggatggagggtgtatatgatttgcgtattcacggactaaccacgaaactttgaacggcgaaattgatatttctctcttctcaatcattgatctacactatggctagatgccacaccacaagctcttgagtgaacaccaagcattgacattttcccttgttgcaccatatgtgggactcaagtcactcaactccaagggacccatctccaccactaaaaactgccaactcccctgcatgacaccacacatcacggcccaagaaatttctccatcagccattgccatcacatcgctggccgttaactgcatccctgcaagcaaaagccatcccttctctctccattggattcttgcttctactactccacgaaggaccaaattaaatcaattcacacactgtctatctctctgaagcagcctggtactactagcagcgatatgattagatcctgggccttagtttgtcgatcgtctgaatttttttcacagtagctcagctgcaggcatttgcaacttcagtaaattaatggcagcagaggtagtagttactgtagttaactctgatggtttcgtcgacggcaacgacgtcgacgcaggaggacgaaaaggactagacctgggcaggcaggcaaccttgccgtgcccgccattgtcgaccatagtgggggtggtggcccagctagcaaaagccccatcttggatgcagtctcggatggctgctagcctgctacacgtagacaccaccacatcatcttcgccaactatgcgctgttgcaaactactcgctttcaaattacttatcgttttagctttgtcatatgttaaacattcataactttaaatattgatatatatatatatatatatataattcactgagaaatgttttcttaacgatgttaaactatatgagttctataaattaatggtcgaagttaaaaatgtttgattcgagataaatctaaaacgataagtagattgaaacggatggagtagtgccaagaattcagagataagccagtgctggtaaaatatgtgtataggtgttgtactgctactagttggttgagcacttctgagctttgcaattgcgccctggagctggagcagtatcttatcagaatcagcagcaatggcgccatcgctttccttagtggaaacatcaggtttttcaggtcacaggcatgtaaacaaagaacaatatatactttcttttccatggtttaaccatcaggcaagagtggcaagcggccatgcatgcgtctagtagcagctagtttgatcaaaagctcaaaagcaattctgctttgtgggggacgcgttgttcagagttcagagcagtgaaggtgatggaggagacctcaatggagggccggcctcctttggtccatgcgtccatgtctccatagggtaccatggctaacaccatattatatgagtgacagtggtatcatcaacaggacatcttatgttctcaaccctcaaacatcgagaaagagattagaggacatggaggtcttagctagcacgcatcataatgcaggtatgtgttagaattggtgttgagtatatgagttgtagtagattattattggagctcaaattgtattatttgtaagtttagggtagtaaacgaacttccatctaaaatttagggatgtatttgaactttttcctacaaacaaatatcatagttttgattgcatcatttgatatcttaacagatcaataactatacagtagggagactgtttgatccacaatttcacaacaacgtggagtaggaaaaaaaatcgatttagggcttcttgatacgaaaaaatgatggaatatgagaaacacgtgaatttggtaaagatggtgtttgattacttcatacgaacacaatacaacggatctagccaagtgtcttataagaaggatagagccgtaataatggcagccacaagaattttgaatggaatacttcatttgaacatataaaaaaagagagataaagagacaagttgtatttgacttatcaaagaaaatgtaaaacacgagcttttatcaaatgtatgtttgaaatactaaaaagcggaggaaagaaagaaatcctacatgaatttttgaaatatatccctacaacctaaaagggcttcatagtaatttttccaacaggttttcaatcctttgaaactcctaaaatttcattgtttccagagaagacctttaaatattgtatacataatattttttaaaaaagggttcatggaaggtattgtgaggtagagatacgtacattgaaaatgtcaagcttgaaaatacttattttagaagatttgtttggtctatctatgctacttcaaatatgccaccaccacacttttcattggcgtgtaggtccacaatgctggtattgttggtgtttcatcctatagttttctcgctctagctaactcagtaagcatccaaaaaattgatggcgaaaatggctagataagtagacatttttaggctttgaaataaatgctaaaggtttgttttttttttaagatttcgtggcaacgcacgggtaaatcaactagtagtttttttacccaccatgagaaactgagaatcaacatataataagtcgtgcaaatgtaatttcattacttaataacatgcagcaataacaatttaccataagatcatttgccgaaagacaggattgtagtatagtgatcatttgccgacagcggcagtacagcagtagtagtacgtatactcgaatgtatcggcactttggcaggtgaacaatgatcataccgtcctctactcacccatacatatacaaacatcatgaatatacatacggccccacatttcgatttttctggtactactagtagtaggttgagcctaggaaatgacgatatggattccttatatctgggtggtctgcaaccttaataattaccatgataacaccatcaacctaattgctgtactttagcctctgattgcaatgatgaggacgagcaagatttggatcatgggagaataatcataaattctctctgccatggcattgaagctttgctatgatttgcatgcttggtttgatctttctggtgggccagattggccgtgcaaaggacatcatctccatgaatgcactggaaagttttgagctcttgtgagtaaataacttatttttagttctgacgaagaatcaaaagatttttgagacaaatgcttttggttacatatctaaggagcttcaataatcaatcagattacccagacattggtggagtattgtatagcacactatagctagtgcttggtctactcatctgcataagagcaagtttaatagtatagcgaactactaattctaaatcatctgtagccaatttaatagccaattcatacaatagttgtttactgtactattaatacctggtcccacccatcatacacacgttgcatcttgaagtctgtgctgcagcgggctacagatctatagcccgctgctcttctctctcatcttttatctttttagaatatgtttatagctggctaatagtctgctattgtacctgctctaacggtgcgattttggtggatttgtttagctggcatctcatatgaaataattgtcattaattgtcaatatgtataattttctattacatagaagattatgcacatatacacacagcattacatgctcgtacatcttatgacacacacctgaatgcatccttaacacatgctcgaagagatagagtccaacaacaaatatgtaaactcattaatttttatgcaaagcacatctacatcagtagacaccgtaatttaaaatcctaacgagcccaccacttcatcaccttacactagaggagaagtgagcttttgtaccggttagtaacccctttttaccggttctagcaaccggagataaagtaaccgagactaaaatttttgatctttagcaccggttgaaataaccggtactaaatatgcatacgaaataaaaaatgagggttgtggaattcgatctaaagatctctcacctcagctctcacgcgcataaccattccaccaactctacacatctaactaggatagaaatactttcttttatctaaccctggagacatcttttgtatatttagtccggttggtgttaccaaccggtactaaaaatattttaccaatcggaagcaaagatcctccagcattaatctggggactaaagatatatttttagtaccggttggtaataccaaccggaattaaaggtgtttttgtgactttgacttttagaactggtacttaaaaatatctttagtaccggttcttaatttaactgagatatttatgttttgggtaacgtgataaaagatcagttctccattagtgatataaatggtgctttcctaacatgtgcaatttttcctgtctcctaagtttgtacttcctctgtttcacaatgtaagtcattctagcatttcccacattcatattgatgttaatgaatccatatagatatatatgtctagattcattaacatcaatataaatatgggaaatactagaatgacttatattgtgaaacggagggagtaaaaagcatgtcacgattttgtgttaaacatgttaagcgatcaaatccggcaacacaacacaatgaatattgctatggacaatgattttaaggttgggtgtacactcaacaactacaaatatcctatttttagtgtttggtgggttagagttcaaagatttaaggtaattggctattggggtagaagtggtatgacgtaagaggctacgaggaatggatttgttagaggaaaagaaagtcaagactgaagtattatatccagtttgagtatatacacatgttacctacctacgtatattgaatttcgccgtaagttttctgggaaaaaaactttcaaatataactacaactatactaattcctatgtttttcatgcgctttatccaaacaacaattcctgcagtttcctatgttttttcaatccataggatttaagatgttaattagggcatttggggaagcaccagtacacgaatattggacacatgtaggtgagttttcattatattttagtgagattaggaatgtgccgccggcttttgtctcgtagggtatgtgtttggtgggaaaatatcctaggcacactccatgcataccaactagcaaatgtcacgaatttttttttaaaaaaatagacatttactaaattctcatattcaaatccattatattttagccataaaaaaattgaaaatctaacaattttaaggataaaaatatgtcggattttttgactttttttacggataaaatagtaatgaatttgaagataagattttacatgtaggtgtaatactattggaagtatgtgtccaattttttctagaattttttgtgcatttgctagttgatgtacacggaaaacttgtatgcataggatatgttactgtgttaggtggtgtatttgcgagggtgtgagtgtagcgctacgtgtatagtggtgtgtctgcgtgtgcgtctatcatgcaaacagaaaaaaaaaaagatgttatggcatttcaatcatgtatttgttttccttgtttctgtgtgcttcagaatcttgagttccaaaaaaaagcccaagagtcttctcatgattatgacaacaaatcaaataaaaatctaacttgatcaaactcgctaaacattaagaaaaaagtacggcgaattctgaaaattaaataaacctaacagcctctgaaatagaaagatattttagctcaaagatagggaacaacactcccaaaaatatttttggaaggatcgatgagaggttcaactgaaatgcatacgagaaagagataaagagtgaatccacgtagacatgacaggaaaagcatatctctctgaagttctgtcacgaccgagaactgaacgctgaacagtcaccgtatagtgtctgggtgtgtttagtcggggaaaaaggaaattttttgctgtcacatcgaacgtttgactggatgtcggaaggggtttttggacacggatgaaaaaactaattttagaattcgcctggaaaccgcgagacgaatcttttgagactaattaagccgtcattagcacatgtgggttactgtagcacttatggctaatcacggactaattaggcttaaaagattcgtctcgcgatttcctctataactgtgtaattagtttttttatctatatttaatgcttcatgcatgtgtccaaagatttgatgtgatgtttttgagaaaaaaatttggggaactaagcgggcccctagacgacctagaaaagctttggctcttttccttttgtttttgcacaaccccaaggctggctgcgtgtgttgatttgatttaggaccaaacttcctgggagcaagctccaaaatggaggacgacatgaacaaactaggttagcttcgcctttaccactttacataattacatgtagatgagcatgcagctcactcagcagttgggggcctggggctagttttttttgcatgcataaaacaagcatgggtcatatgggtgagtgaagtgagtgagtgagcagcatgcaggtggtacagagattgtagaggaggggatcagacgttggtgggccgaatcactccgcacgaactgaaaattattccaccatcaaaagaccccagtcaactcatcatcgacgctctcaactctagatgggctccctttctcgtacgcttgtcggggccacgggacagtgacaccctctggagcaaaatttgtacggcatcgatctgtggagcaaactttggagttaccacgcatttcggccgttggtaatccgatgcaagtttgggtcttgctatttgctactccctctatcgtaaaatataactagtggtaaccttaaatattaaagacagaatattaaagacagggataaaaaaactttgttgccttttcaaaataggtgaggcttaagtttaggccagtcacaatggaggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccgcgccacgcctccttcccgcgtgaacattcctccttcccgcgcgagcgattccaccatctcccccgtccggcgcctacggagtacaccgcaaccggtcgccccaatccggcgcctagaccgtgacccacccgccatcttccgcaagaccgaatccccaacccacccaccatcttccgccgcccccgtccccgtccccggccatggatccgtcgccggccgtggatccgtcgccggccgtggatccgtcgccggctgctgaaacccggcggcgtgcaaccgggaaaggaggcaaacagcgcgggggcaagcaactaggattgaagaggccgccgccgatttctgtcccggccaccccgcctcctgctgcgacgtcttcatcccctgctgcgccgacggccatcccaccacgaccaccgcaatcttcgccgattttcgtccccgattcgccgaatccgtcaccggctgcgccgacctcctctcttgcttcggggacatcgacggcaaggccaccgcaaccacaaggaggaggatggggaccaacatcgaccatttccccaaactttgcatctttctttggaaaccaacaagacccaaattcatggtacatgtattttcttctttttctgttactttcaacctacggtaactctaattcatggatgagactactgccattgtgcagttcaatgctttttcttcatgttatatttcgtccagctgtgagttatggtttgaagattgctgtggttgtttcattgctgagtatgtgaaagatagatggatgaaagagagaattatattttagtctgtaatcttgctcatccagttgctcatgtatgaccttggttctagaatgttgccctgactgtatgcttaatgttcagagaagtgatgcctaaagcagtgagatcagtgggatcagattagctatcgacatataatattagctatctcagttgtgaaagagagatgggtgaaaaggcaccccttggattaattctgtagtatcaaattctgcaccttgtctgtccatatgttctgcttggttggtgggtgcagtgcatttgtaaaaaatagtttgcttctgatccttaatatatgtaacagggaatgaattttcacccatctcagttgtaaaggtactgtcttgctatgcaatatgtgtaaattgacaaacctgaaaatagtctgtttggaatttgcaaaagcaattcgatagtttggaatttccaaacctcagtcagcagtaggcaatccattttagttcttgctatgcacaaaaacagtacacctgatatgctcattttaatacaacttttttgtctctgttacagtttggtcaggggttatcctccaggagggtttgtcaattttattcaacaaaattgtccgccgcagccacaacagcaaggtgaaaattttcatttcgttggtcacaatatgggattcaacccaatatctccacagccaccaagtgcctacggaacaccaacaccccaagctacgaaccaaggcacttcaacaaacattatgattgatgaagaggacaacaatgatgacagtagggcagcaaagaaaagatggactcatgaagaggaagagagactggtattcatcggatacttttacatttccatatgtctttgttttgactaatacttgacaggtcattaactgattcttgtaggccagtgcttggttgaatgcttctaaagactcaattcatgggaatgataagaaaggtgatacattttggaaggaagtcactgatgaatttaacaagaaagggaatggaaaacgtaggagggaaattaaccaactgaaggttcactggtcaaggttgaagtcagcgatctctgagttcaatgactattggagtacggttactcaaatgcatacaagcggatactccgacgacatgcttgagaaagaggcacagaggctgtatgcaaacaggtttggaaaaccttttgcgttggtccattggtggaagatactcaaagatgagcccaaatggtgtgctcagtttgaatcagagaaagacaagagcgaaatggatgctgttccagaacagcagtcacgtcctattggtagagaagcagcaaagtctgagcgcaatggaaagcgcaagaaagaaaatgttatggaaggcattgtcctcctaggggacaatgtccagaaaattataaaggtccacgaagaccggagggtggatcgtgaaaaggccaccgaagcacagattcagatatcaaatgcaacattgttggccgctaaggagcagaaggaagcaaagatgttcgatgtgtacaatactctattaagtaaggatacaagcaacatgtctgaagatcaaatggctagccaccagagggcaatacggaaattagaggagaagctatttgcggattaaggtgagttttataaactgaccactattttctgaaatgtatgaattctgaaatttatatacaattgtgtaaacatggaaaattagataatgtatgcatgatgcacaacatgtgcgtgcagcactatttaatggcagtttcacaagtgtgaaaactgaccactatagtactattgtggtgtgaaaactgaccactactattgtggtgtgaatgctactgtggtgtgaaaactgaccactatagtttcacattcctggatgcagccctcctctatatatatagatacagtcctcatctcttcctggcatacacacagccctcttctctaattcctggacgcagtcctcatctcttcctggcatagacgcagcccttctctcttcctgtttagttcaacaacattgaggtgatctgcctttctttgaagtttctatcttttttcactgctgtgaatgattatttctctgctgtgaatgattatttctccaatcttcctttgttcaccttctctctttctctgctgtgaagatgtctggaaatgaaaatcagattcctgtgtccttgttggacgagtttctcgctgaggatgagatcatggatgagataatggatgatgttctccatgaaatgatggtgttattgcagtcctccatcggagatcttgaaagagaggctgctgaccatcgtttgcatccaaggaagcacatcaagaggccacgagaggaagcacatcaaaatttggtgaatgattatttctctgaaaatcctctatatccttccaatatttttcgccgaagatttcgtatgtacaggccgctgtttttacgtattgtggacgcattaggccagtggtcagattactttactcagagggtagatgccgctggtaggcaagggcttagtccattacaaaagtgtactgcagcaattcgccaattggctactggtagtggtgctgatgaactagatgagtatttgaagattggagagactactgctatggatgctatgaaaaattttgtgaaaggaattagagaagtatttggtgaaagatatctcaggcgtcccactgtagaagatactgaacgactactcgagcttggtgagagacgcggttttcctggtatgttcggtagcattgactgtatgcattggcaatgggaaaggtgcccaactgcgtggaagggtcagttcactcgtggtgatcaaaaagtgccaacgctgattcttgaggcagtggcatcacatgatctttggatttggcatgcgttctttggagtagcaggttctaacaatgatatcaatgttttgagccgatctactgtgtttatcaatgagctgaaaggacaagctcctagagtgcagtacatggtaaatgggaatcaatacaacgaaggttattttcttgctgatggaatttaccctgaatggaaggtatttgctaagtcatatcgactccctatcactgagaaggagaagttgtatgcacaacatcaagaaggggcaagaaaggatatcgagagagcatttggtgttctacaacgtcgattctgcatcttaaaacgaccagcccgtctatatgaccgaggtgtactccgtgatgttgtcctaggttgcatcatacttcacaatatgatagttgaagatgagaaggaagcgcgacttattgaagaaaatctagatttaaatgagcctgctagttcatcaacggttcaggcaccagaattctctcctgaccagcatgttccattagaaagaattttagaaaaggatactagtatgagagatcgtttggctcatcgccgactcaagaatgatttggtggaacatatatggaataagtttggtggtggtgcacattcatctggtaattatgtttttattttgcattattagttatctatggtactaagatatgtacaagtttctctaaattgcactaaatctgtggttcatattggatatgtgtaaactatgaatgtagcctgactaaaaccatcattcatgctgaactggtttttgttttgtatatgcaggatgaaacaaggaactaggtttctgaacgcattacggactgaaggttgaggggcagaatgatccacccagttgcttctatcagatcactaaagtttcatttcactgttttattttggacacttgatgcttgtgtgcatccgatgaatgtttaatttggtcacctgatgcttgtgtgcatccgatgaatgtttaatttggtcacctgatgcttgtatgcagttatctatcttatttgttaatgttgctggtactgaggatttttagaagtgaaatgcacaagttgctgtgttttttgactgatccttgtgtgcacttgacgttgtatgtgacaaatgatggttcccagttgtgcacctgattcatgattcagttattcagtttaaattgacgttgtttgtgtgcaccttttgtcagttagccagttacggctggaagttgtgtaagtttgtgtgacgcctggctacaggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttagactagttaaagctataataaatacaaggggtagtagggatagtatggttaatttaggttgcgttcattctttatacttcccagcatgaatgcgtatagaaaacggagcggtctattagcgcatgattaattaactattagctaatttttttaaaaaagaattaatataattttgtaaagcaactttcgtatatatttttttaataaaataccgtttagcagtttgaaaagcgtgcgcacgaaaaacggcaggggagagttgggaaccagctggaacaaacacagtcttagtgtgtaaaagtcattttttgtaagtactaggtttgctatatttcaaatgaaatttaaactccaaaagttgttgtattttgggtcggatgaaatatttacaagttgtatattaatattttaatactttttttactctagtgtagatagtatcaagatttatggtgtgttcgggaggaggggttgggaacccctcctcaccggcacgcaaaacgaagtacgtattattacatgattaattaagtattaacttttttaaaaaatggattattatgattttttttaaaacaactttcgtatagaacttttttgcaaaatacatactgtttagcaatttgaaaagcgtgcgtgtggaaaacgggagagttgggttaggaaaattggggaaagaacccagtcttatggacacacctaactctacttctgtcctatttaattgtgcctgacgtttatctcgactccacgcgatcacctcatcgttatcgaagtcactcctcttcaccaactccgacgagattcctatgcccaactctcctcccctaactttggcaacttgctttgctggatatctgttgtcgtccctgatcaaccgcttgtttcttgtttttccccaccacatccgccatccatcacccctccttcgtccctacgggtttgatgatgacatcatggttttctcctacttcaatcatccctctaaagctactctcaccgtaaatctactccatctcaccgcctctaaccctaactatctaatcgagtgagatctcaccatctctatccctctagagttcaggtgtcatcctcatcgtcaatgagacctcaccatctccatccctcttctttttttttcctacgcccccgctctagaggtcaaagacaatgctcggggcactgaagatgtacaaaaaagcatgtgagtcttttttatattaccacttatcgatgttgagtatatcagcttaaaagctacatccttctcctattgagttggagtagccttttattgttttcattctagcttatcactcatagccaaaattttaaattttaaaaattaaatttagacagttaatttcgagttattttatcgaagtttttagcatctacttttaaaatcgctagaaatcttaactaattaaaatattcgtaattttccgttcgccacaagacggatgaaggcgccttcgtccgtcggcggtgcgccttcgcagcccccaaatcccaatcgctcttagaattggatacagggaaatactttctaaaatcggcgcaaccaaaactcaaccactctgtcacaaaaaatcaaccacaatcatcataaaatcacaaaatacatcacaaaacttcacaaaaatatacataaaaaaagaagaacaacaacatacatcacaaaacatcacttgcctgctgccggatccaccctcggccatcgccaccgcggccctcggccgttgccaccgccgcactcggccgtcgccatcgccacccgatccatccgcggtagccgccgacgccaccaccgctgccggagggagaagagaggcggcggaaggagccgccgctccttatccgcccacggacgccgccaccgtcactggatctgctgcgggaggaagacgagaggggacggagggagccgccgcagctagatctgcctgtggccaccgccggcggatctgccacgggaggaaggctagagggagtggagggagcccaccgccacaaccctcggatccgcctgcggccgccgccaactctccgccatcgccgctgtatccaccgcggaagggaggcgagacagggcggagggagcggccgccggctagggaggtgagatggggcggagagagctgctgtcgccgtccccgccgctcgcgggaaggggggaagggcacactacaaccactcggggggagggggtggagggcgctaccaccgctgctcggtgggggaggtcgccaccgccgtcgtcggttttcgattgatcgagagagagagaggatcgggggcgggaagggtggaaaagaattttaggattagggtttttgctgcagacatttatattggttgtgatcaatctagaccgtccattcgatcgaacggctccagcttctcgcgcatcgggccaccggactattgggcctccgcattattgggcctacaaatgggccgcaattaaaataaatgttttctctctcagtaattttaagcaactttctattttcaaaaatagcaccattttaattatttatgactgcttattaatttaattccaactaaattgaataaactagaacattggctagatttttctcatgatatggatttatttttcgactaaaaatgtaattatttatttgtcatgatatagaatttaaatttagactaaaattaaataattttaatttttaattctatatggactctattcttcttccaatattcctatttttttattgttctaattagtttctatatgaactctaaactcttctttcaatatttttattttaaattttaattatttttctaaattgtattcctatatgcactctaggctcttttggagaatattctagactcctcatccaatattatttattttataatttatactttatattaagtcgtattatttatatagacagattaatctatccagtgtagggtttttttttgcaaaaagatttgttttatgtagatatccgattggacaacgtgattttttttaaaaaaaacaaaatgaaagagtcctggtctacaatgagttctccttatttttttatattttactccaattaatatgagaatttctatttgagacttttctagcaagcaaaaataccaaagcagtgtgaaaataacttcggttaaaaacaaatatttttagtgttattacaccgtagcgaagcacatgcattttgctagtacaaatataaactttttacccatagttatttggttccttttttttgcctcatcgcagggagagaacgacgaggccgttagttttgtgatctaacggcgacgatgcaattatgataactagtatggtggcccgcgcagattgcgcggctagcatcattatattttctctcatataatagcatatatgttttctcattatattattaaaatatattacaatgacaacataattttaaattttgcaataactttacgaaactactaatgtgtaatattcatattgtattttatatacatgttagttattaattatttttaatatcaaattttagttatttgtgaattatatatattcctatatggactttagaatcgtattttaatatttctttttttaattctaaatgtttattatttctaattgtatttctatgtggactctaaacttatctttaaatattctttaatttttaatttcaaatttcacttacttctaaactgtattcctatattggctttaaactcttcttcccatgtttttcttaatttcaaattttagttatttgtaaaatatatttttatatggactctaaacactacttttcattttattatgtttattccgaattttagttagttttaaattcttatatggactctatactctacttctaatattccttatttttaattctgaatttctatttttttcttaattgtatttctataaggactctaaacactacttttcattttattatgtttaatccgaattttagttagttttaaattcatatatggactctatactctacttctaatattccttatttttaattccgaatttctttttttttcgtaattgtatttctacatggactctatactctacttctaatatttcttatttttaattccgaatttcagttatttcctaattgtatttctatatggactctagtctcctcttctaatatttcttatttttttaattccgaattttaactatttctaaattgtatttctatatgaactctagtctcatcttctaatattccttattttttaattctgaatttcaactatttctaaattgtatttctatataaactcatctttcaatattctttaatttttaatttcaaatttcagttacttctaaattgtatttctatattgactttaaactcttcttcccatgtttttcttaatttcgaattttagttatttataaattgtatttttatacggactctaaactctacttttaattttattatgtttattccgaattttagttagtttaaaattcctatatggactctatactctacttctaatattccttatttttaattctgaatttcagttatttcctaattgtatttctatatggactctagtctcctcttctaatattctttattttttaattccgaatttcaactatttctaaattgtatttctatatgaactctagtctcctcttctaatattccttattttttaattccgaattccagctatttctaaattatatttctgtataaattcatctttcaatattctttaatttttaatttcaaatttctgttaattttaaattgtatttctatattgactttaaactcttcttcccatgtttttcttaatttggaattttagttatttgtaaattgtatttttatacggactctaaactctacttttatttttattatgtttattctgaattttagttagttttaaattcctatatggactctatactctacttctaatattccttattttttaattccgaatttttattttttttcttaattgtatttttatatggactctatactctacttctaatattccttatttttaattccgaatttctattatttcctaattgtatttctatatgaactctatactctacttctaatatcccttattttttaattccgaatttcaattctttttgactgaaattgcgaatttcagttatttcctaattgtatttctatatggactctagtctcctcttctaatattccttatttttttattccgaatttcagctatttctaaattgtatttctatatggactctgctttttttctttttctccgattaatgcgagaatttctaggtcatgagagcgaacatggaggctcctttttattccgaattttagttagttttaaattcctatatggactctatactctacttctaatattccttattttttaattccgaatttctattttttcttaattggatttctatatgatctctatactctacttctaatattccttatttttaattctgaatttctattatttcctaactggatttctatatggactctatactctac

SEQ ID NO: 82313 - DNA, 1310 bp, Oryza sativa
tgatactactggagtatcactgggatactcagaaggatatccatgtatgaagagaaaactcaagataaaatcaacgtaaataatttcaatgctagaaaatcatatgtttatcaagagagggctcaataaaaaccaataagggaaatcgattccagaaaaaagtcgtcatagctgtagaaacacccatagaacatgtagaaaaacctaaatcaaaccccaaagcaagccaaggcaggagcttgagggtcatgaacccagatcttggtctacatatctacaccacaaaagggcattgtccttgatggtagtgacctcgttgacgatggctgcatcttggaacgtggtgagcagctccacctccgtcatgtgctcggacacctaccccacaaacaacttcgtgatctcctcctctactcagtttacacctccaccaacagcaacggcggcgatcaagacggcaacttcctcgacgcccgacgcgccaccctgcatgaccagctgccgtcattgcctccgtgctcatgtgggtggtagagagagagaaagagtgtggggaggggaaggggaagagattaaggagaggataagattaaataggtggtgtgagtagtggtgctggatatttactagtagtatcccgtgtctacgggactccgttctctagattttctgattttttaaagatttttgtcaatgattagtagcggaataaatgttttacatatacctagatgtgattaattgtacaaactagaaaggtatcaatccctatattttccgagaagattttatataggttcatgcccccattcaaggaaatacccctacggcccactaggatatatatacaaagtataaaaagtacatatatgacactaatgtagactagtaatctgcccgtgctaactctacggtgttataatacatttttgttaacgaattacacgttatttcctccgtttcatattatagaactttctagcattgcccacattcatatagatgttaatgaatctagacacataatgtgaaatggaggaagtagtaaaaatatgtttcctagaatccacccaattgagctttattttgatctaggtcagatattaaggcaaagtacagtgatattatattatctaaaatattaattcaaaaccatcaataatcatatttaatcacttcaataccaatatattagacaatgcacatccacacttccacaaaaaatggttgagaataaattacatgttccaagcaattccacgacttctgaatcattaacacacacggagctggcaaaatggagctgggaa

SEQ ID NO: 82314 - DNA, 2536 bp, Oryza sativa
tggaagtagtgggagaaacgctacatcactagtcgagaaccaggcagtagtcgtaactcgaccacttgaagtggagatagtgggagaaacactacatcgctggtcgaggaccaggcagtagtcgtaactcgaccactgaaagtggaagtagttggagagacgctacatcgctggtcgaggaccaggcagtagttgtaactcgaccactagaagtgaaagtagtgggagaaacgttatatcgctggtcgagaactaggcagtagtcgtaactcgaccactagaagtgaaagtagtgggagaaacgttacatcgctggtcgaggaccaggcagtagtcgtaactcgaccacttgaagcaaatgtacgagagatcactacgatcaactggttgagaaccggtgagtaggtgtccatcgatcatttggagtcgtggtacgaggaccgctacgctgccggtcgaagaccagtcgtagctgttcctcaaccatctgaagtcatggtgcgaggaacgctacgctgccgtagtcgtacctcaaccatctgaagttaaggtgcgagagattgctagagcagaattatctctcgaacaccaatggaagttgcggtgtgagagattgctacgtactggtgcgagaaccagtgagcgagcagaattatctcttgaacaccaatggaagtgctagagttggtttattgcaagtgtatctcatgtggccagcatgacttacgtacccaacttatagcatatctggatgtccgttcgcaatcatgtcgggtgatcaagccgacgacgttcgcgaggaattatccgttaacaaccttttctcgagtagtccagccatggccgatgctatgagataggtcatcggtctttgttggtaggttgggtgcgatatctccgcatttgtcgagaatgttctcgataatggagtgtactcgaccataacctactcgagtgctcaattgttcctgaaattattttctagaaggcaagacatatagcagataatatcgagtatgtactcaaaaactgtgtggatcttctagtattatcatgatataacgagcagattaaatatcaggcattatgtaaaccataaacaagcatgatttatacagaagagaacggagtgagcccctagcgttagaccatagttggcctatcatcggaagtactcgcacaacggatattgtataagaagcatgctctaggtaaacataataaattatagatctgacaatgctgtatgatctgaataggtacgataaattgcatataaaatattgcgtacctttgtagatatatgccggatatatctacggcattagtagatcaatttgaaaaatcaatctaccaattaccttattgcgtactcgttcgacatcatatgatctgacatcttttggtacgccgcggagcttgagggttggataatctcgatagaccaagttgtcgatgacgatgatggttccgatctggtcggaagatgtattttagtcgggttagatctcctcacagccgaagtcgtcgagtagcttgttgtcggagagtccatctcttaaacctatctcgtcgaaatcctagagcaccaaaatccccctacctggcgcgccactgtcgacgtttgatgtctcgactatggtatttggacagtatggggatcgtcggtactaggatatacacgagactgaggtaaaagagatggagacaaagatttttatacaggttcgggcccctgaattgtcaggtaataaccctacatcctgttggccgaagccggtattgcttttattcaccataatcacaccagtacaatatgtgggtagcctatctaactgttgtggacatgtcggtctgaaggtctgactcgtagtcgacaacagggtagtcttcctcctcgaatctgtgcccggcgagatcagagatagcgctttcgtatctcctgacggtatccggagacaccgtaggggaatagccatgcctatccttcaagtcgatatccggcggcgtgtcttggcgtatgtaggcttgtatgttgtggcttctggtaggcgtgtgttgattgtcatgggtgtctttcactttcatggtggttgtctctccccctgtcctcctaggagggcttgtatttatacctataggtgtccccttgtccaagtagaactagggaaaccaatatggatacaatctgagtagtacttgtcgtttccatgtagaactctggttatctttccttatccagaactccctcgaggtcagtttccgtataagacatggtatgtagtgtatcctgccgatatttagtcaactactattaggtatatgtggtatctataaccctgacatatatatatatatatactgttatacacatacgtatacgcaggggcgaagctacagccattcataggggtcagttgaccccgacgatgtttcacgaacctctcgtacctctctttattttaccatctatgaccccagcgaacagaaaaactagaccccggtgattttgttgattgttccgggctgcaggaat

SEQ ID NO: 82315 - DNA, 664 bp, Oryza sativa
tgttcgatatctgctagcttgtattgacacttaatgtacaacattatttactcaaatgttctgagtttatggtatattattctttttctatgttatcgccatcttgccattttgctttccttattccttgtgaagttctgcatgatccactaacaaccggatatattggtacacttggaagttgtcccgctttgccatgcctgttgtataaactgagaattgtacttgaaatttcgcaagaagatatatgtctattacataaagtgttttttattttgtaactcttttgattggtatttgagaagtgggaagcaaacaaagtgtgcatgcactcgagttgtaaaaatccaccaactccctaaggtttgaagtgtgcaggtcatcaggctaagaaagtgtgactagacatgactaaacctttgcatgtctaggttagacacgaaccaaatggccattgtatttttttttttgaaaaaaaaaagacctttgtattgtatgttagcgacaacagtagggaacctctgtagcttattacaatttagatacctgttcatcagccatggatggatggattatcaacaggagtcccacaaggattgagtagcctaatttaactgaagcaagacactgtacatggtgccaaatgaggaattgttgttttgca

SEQ ID NO: 82316 - DNA, 682 bp, Oryza sativa
caagatgattaattagcatgtttgtttgtgtcttcgatgatatctttccctattcaatttttgttgttgcagggtacccgcgctcgccgtttcatccggtgagcatttcgtcgagcagttggtaggcggggggagttcggggtttcttgattcatggggaggagctttgccgttgatttcctgcgctgaagcagttcatcgtccagtttcttgggcaatcgtttctagggaagcaaatgagatgtctctgctgctagacgcgagctctgttcctcgtttttaccattctcagaacttgacgattgagcatggcagattagggtcgtagagaaaacggtgttcgtgtcagcttcttgaggtcagagagccaagaagccatttgggtttttcttggttcatggaggaaatgggctctgctcagctttctgccctagctgtgtgtgtctgcattttcggatgcctagccatggctgatggccagaacgtcactggaggtgatggttcaaggccagctgagctgcgcatcggtgcattattcacatttgattcggttatcggtagagcagtgatgccggctattgagcttgctgttgcagatgtcaatgccgatccaggtgttcttcctgggacaaagttgagcgttataacgcaggataccaattgcagtgggggctgcaggaat

SEQ ID NO: 82317 - DNA, 21899 bp, Oryza sativa
  unsure (1)..(21899): unsure at all n locations
cctgcaccccctagtgaaaccacaaacctgcattgcaaattcttggtatcaggatcatttcaagtttgacataaagatacaccatctggatgatgcccactaataaggaaataaatcaccagcatgaacgcatatttctatatatcatattttggactatgaatatgcacataacagtggtgttccccatatttctaaccatatattgtagccaattaacttacccgacaagcagcaaaacgaatgccacaacccacaaaacatattggtatgctttgtatttgggaggctgattagtttggggcaactcatgtcgttccatccaaccaaactgtggccttgccaacaaaacaaatcccaaaaggaagcccgtcacaaatccaccgatatgagcaaagttatcggcatgaggtagtatcccaatagccaagttgattgcgattataaatagaagagttattatggctgctgcctgcaagagtggattagcttgatcaaaacaaacatcaagcaactgaatagtgaaaatgtatgtgcatctatctcatttactaaccttgttggaataaatagtccagttcataataagctcagaaagcattgatccaagcagtccaaataaagctccagaggctccaacagagatgtagttattacgaaggaaaagcgcagacaacacactcccgccaaaaccagatagcaggtatatggcaccaatgcgaactagtaggtaaggaaactagtgtcagtttacagattattaacatgcacggagtggtgacatcaaaatagaataataaatagagcactaaagaaagtcttaagaagaagcaaaaggtgacacaactatggagacaattagaaaaatgaagtcatttatgattttattttcatataagaatggcaacccagcttcgactactagatctgctagaagtattgggatcctatccgtttgagaaacataatgtcatcagaacagaaaccatagccatgcatttcaaaccaggtcaggagtgttcagtgtatatcttgacattgaaacatccacaaaacagaaattctatgagatggcatgtattcaaagatatatgttaacactaagaacgtattctcatagttaaaaatgacactgaatcagcatagtaagaaacttaccgaacccaaattgctgttcaaggcggattccaataaacagtaaactcagcatgttcacaaccaaatggattaggccagcatggagccagatacagctaatgagacgccatccttggtgctgatgaacaactttgttccagtcaagagctcccattttctgcaaactgccaatcaaaaagagagatgttaataggatcaccaatcatgttgttcatccaagaaagctgggtgcatcatatgatgcagagtctgggattttcattccattatctaataaaaatcttgttcatccaagactatattagtcagacctatattaaattcgcaaataaaagcaaacagcagacttctgtggccaactggccactgagctattatgttccttacaaaggcgttacaattaaaataagcaggcagacaagtaccgtcaaagagaaagctccaacatttaccagtctttggcttacgtttttttctgacagaactagtacactatacatattgttagtagggtatcagtatataataacacatgatcctaggcctgtagcaaccatgtcatacaattcccagctgcaatctgataaaagtatcaatatgaaatgtactaggtctgtagcttaaatactgacagcagccatcacgaatatcataagagactgtcgaaatgagttagtattgtgccacaaaaactacacgatttaaggcacacgctctgttccgaggttatatcccaaggtgccctattagcaacaaattgcaccacagggagactgaagctatgagtggattaagaaaccaaaagcaacgaagctctagatcagtccaagctatagtccggattgagatctgaatggtcaccatcggagcacagagtcacagagttccctgtctcctgaacttaaaaacattaaaaggtgtgaaagattgaattgaaggaaaaggaagtttgttgcaaaatatccttgtttggattccccttgggcaaagcttcggccaccaaagaaaaagctcggagatttcctcccgctggtcatactttaagtacacagaatcgcgcgctttcagttcatcatcagtgcttaaagatgagagtacttttaattagacctccaaaccacacccgagaaattctaattttactcaaaattgaccagttaggcagctgaaaatctcgtcttcctattcctggcagcgcctcgatcaaactgcaagatccgaaactcaaaaataaaccccccaatctacccgcacaattccgcctcgagcgcacccaaaacgcccccaatttgagcgacaccatggacaacggcaacaagataaaacaaaaaaaatctcaggagagtggacagaacgtacgtggcggaagacgggccgaggagcgggttctcgcggagcggctggaaggagaagcggcggaggaagccggcgaacgcaccgccgagcgcgctgccgtgcttggggcagttgttgacgtacatctcgacgatgaacaccgcgatgcaggcgacaatcacggtgggcacgagccacggccaccacttcctgtcgtcccgcccctcgtacccgccgtacccgtaccctccccccgccgtaccccgccgccacccggctcttctcctcgccgccgttgctcgccatccctccgatccctcttccccttcccctcagtggcgaagaagaagctcaagtggctactagtggtttccccggagctcgggtttggcttcgaagcgaggggaagaagaaatgatgcggcggaggaggaagggagaggagacagcgaccggcgtgggccccgcggtgggtggagggcctgtctcgctggcgcgtggggtcccccgcgacaccgggcggtgagccgttgctgtctccgcctcctggccccgacgaggcgtcgagagagaaagagagagagagcagagtggttggtccggctcgctcgcagtaactgctccacacaggggaggcgaggaggcgaggggaaggcgagcacgcgacgcgggcgaaggcgaggactcggcgtacgtgtggcgtgtcgtggcgagacgaggcgcgaagcgtgtggatccgagaggggggatcgttccacgccacggcaccgcgacggacgcgggtgcgtgttgcgggcgggggtgagctgttgcactgtcgctcggcccaggtggcgtctcctcttgcatacttcctcccaaaaaaatatttagattgatcttattttaaatcataccaatttttataaaactgttaaatatgtacatacatttagtctttgtactaaatattgataaatagataaaaagttctgccaaaattttaataatattatcaattaccaaaattttggtattgttttgattacagtctaaacatcctcaaaatcaatctagataagaatgtgatataacctaagataacgaatctagatatattcgtatatagattcattgtcttggattatgtctcgttcttaatttttttgagttatgtctcattcttaatttcttatttagggtcatatttttgagacggacgagcatagtatagccacctgctctgcacgggcgcccgcgccgactgggtaaacggcgctccgccaccactgtgtcaccctcaccgtgccagcgtagccaatgtacagtacaaacagtctacagtagatgctacgtactactgtactactactgggatccgtggaaaaggtgactgacacgtcgtcgacgcagccgcatgcagcagcagtggaggctgtcctcgtgtcgcgcattccgcgttagatctgggaagaactgtggtgggatcatatgcaagctgaccgcgtcgtaaatggaacttttttgtgtgtgggtgcgtactgtgcgcgtgtacggccggtgttgcatttaaccgcgccgtgcgccgcccgcgtactgtgcgtgcgtacgtacgtacgtggtggcgcacgcaacgggagaccccaagtccccagcctcggccacaccacaaccccaactctccaaggctgtgccttgcacgcaccgacgccgtgcgacggtgcgagggcgtactactcagttgcattgcatgcgctcgcgtaggcgtagggctcacaccgagctggtccgtcacgtatgagtacgtgctccagcttacccaggtccccccaccgacgagggatactacgactgcaactttaggagttacagtgcagccgatggataaaaaatcaacggttcaggtggcaggaaaatactgttcagaaaatactatagcaaatctgtacggcagcgattactgtagcatcgatggtgcaacaggatgacagagcgaatcagggcgttggctccatcgatccaacggctataacgtgctccgactggtaaagttagagtcgttactactacagcaccggatctcaattcaatgcaagcaagctcatcactagtgatgccggagaacgcccgcgaaacggtcgacgcattgctatagtattttctaaacagtattttcctgccacctgaaccgttgattttttatctatcggctgcactgtaactgctaaagttgcagtcgtagtactgcaccagatcttgatccgcttgcattgcagctggctgcaagccctgcaagctgtgtacgtgccttcaatccccgtccgtctcggcgtctcgatcgatcgccggtgaatcggcgatcgatcatggctctgcgatttctgcatgcattcaagtgtcgcaggcgaattgctagctggaaaatggagttagcaagcatgcatgatggatggatatgctgccaatggtatacggccgtggccaacaaatccaactgtacgaacagggacggctcgctcactttctttcacctcagccttcgtcgtcctggcctcctggcccgcatccaaagggcatgaattgaccgagcaactcatcagccaagccagacccccaatccattcctgaactcgtggtgactggtgagggctccacatgtcggatcccaagcttttgggtatgtttcgttagtgattggttactagccacactataccacgcctcacttttcactgccacaatttattatgtatgtagggatgaaaacggtcggaaacgatcgaaaaacagcctcaatcatttccgtaaccatattctcggaaacgaaaacgatatcggaaatatcagaaaaccggaaacggaataatacggacggaaacatgtcggtgcagatcggaaaccagtaacaaatatggaaacattaaactataaaaacatatatttaactttacataagtatgttatatgtatacataaattcaagcttatactatataaattataaattaactttattttagccatgcataaaagttagagatttgattgaagagtcagtcaatctgtaagctgtgggccaagtatagacatgctctataaatatcgacatatttagaatacggtaattaccatattataagaaatggtaatttccacaagaatacggtagatacggaaacgatcgatataacagcaaaaccatttccgtttttatttccatatgttttgccatttccatttttgttttggtcgactaccatttccatatcgctcggccggtagaaagtcgaaaacgaacgctagtcggccggtaatttccgttactgttttcacccctatatgtatgtgtttggttagcttaacttccttaccaatttcaccatacttaatgactagcaatttattcatcacattttatggttgtcacaacttatctaacattagttgtggcaaagtataaccggtaaccaaacatatccttactactgtagttaagacttctttcaaaatcaccagtttttaaaaggtcaaagaataaatagttaccccccttcataaaaaaaaactaatatatttgtagtagtattatatttgtttttaggcagaaggagtatatagtcttgacaataaattaaaagccagaaatcgaagaatcaaggttattcagattttcacaatttgcttaaaattccaatctctgtacttagccctttgccttattttacaaaacacatgacgccattgtaaaagattccacataagttaagtggctattagaagctgtggtgtcacgttgtctcgatggcaaaatcattttccgcagggcagctgtactgaccccatatgtcgcctctcgctaccggtggtaccgactaccgacgatgccacagcatttgctgctgaaagggaatcattggcttgccaagttaattagcagcagcagcagcagtatattttggtcctaatcaaaagggattatgctacttggtggttatctccatattgtcattgagtttactcctaaacaatctgatcttacttcctacacgccaaaggaacctcctagtttattgttgagctgcattacgcaaagctaaacaatgttggattacgcaaagctgaactatgctatagttctctttgacaggactgaactactgtaatattttcttctttttttttttgaccggactgaacttgcgttgttcatcactccaacgtccattttctaagaatcgatgtgaatgatgtgatcatttcagccaatgggccaggctccgatggcatatccatttcattgccaaaataaaccctatcactatttatttcaatgggccaggctctaaggacatatccatttcgttgcaaaaaaaaaaaaagtgaatgtgacgggacggcatcccgttcagacgggatgatatatctgagatatcgcctaataccttagtatcagccgatacttaccagtatcagtatcaggctgatactaaggtattaggcgacacctcggaggtatcataccgttcaaatgaggtatcaaacaatacttactagatatcaggtgatacatcaatgttatcattatgtccgaacggtataccttcttgtatcatttccaaaaaaagaaacttattattattatttattggtaaaaccaaagattgataatgccaaatgttgccaatataaaagatgcaaatgtgttgttgtctggtttgattccctatcaaaatttaaatttggtgtagttttgtaaatagatggagttcggtaaagttgtaatggtgaaatcatgttcagtttattgtcgtacaaaaatttggttgacaacaaagtgaacaaatcttaaatataattatgtaccgtataattggctgtatttagattggtccaaagtttagaatttggttaaaattggagacgatgtaactgaaaaattatgtgtatgaaaggtttgatgtgatggaaagttggaagtttggaaaaaaactttggaactaaacacacgcacaaacgtgacgaaatatcttataggccttgttgcaatgagccttttcggtcaaagagcccaattgtgtgctacaaggcccgcatcacgaaccacttgaacccaaagatttctcatgccaattcggcccacaccaaccaaccccgcaaaacctcccctaacaccccgatgctccgccgcatcgccgcactccggccgccgccgccgccgcagtcgcggcgggatatgcatccaagtccaccactgctgcttctgcgggaccacgccttcgacggcatcatggagtgcgccgctttctcgtcctctactccgtcctcctctatgcggccacccccaccgcgctcgccggcggcggcggaggggccatgtccgtgcccttctcccgtcttggcgccagctccgcctcgcgcccctcgacgccggccgtttcctcctgcgccacccgcacgcgttccaccgcgtcctccacgccccgcctcaccccgcgcgccgccacggcgctccgcctcgaggccgacaccatcgcctcctcgctgccggcctccatcatccgcatccgcaagctcctcctcctcgcccccccccccgcgcacaaccgcctccgcctccgcctcgagcacatcctcctcctaggggaaaccagggtaagctgcacgctgtgttccttcgggaggcgtattacaaaggtcaactcgttgagcccaatgagatttatgcggcgaggcggacaatgtaagagctgctcatgtggaattgaacccgcagaaggcgaatttggaccggatgttcactagcacgggtcgtggatgggatgagcttggtggcggtcgtcgtgggggagcagaattgagggaggagttccttggtgaggcgagtgaccggagagcgaatattaaggctgatggtgattatggtggagattgtggccatgactcgggagttgagtcactctacattgagtgaggactgaggagcagaatcatactgtggtactaacatcaactaaggaagcttgccttctagaacaagtattgacaccatctataagctctctttcttctgatggtgaattaacagtcggatgcagcaatgctgattgaggagaagatattgccacccgaggctaaaactagtgagatatcttgtgctaaaactgttgatattgtcaaatgaagactctgggtgtcggcatttaacttcactgcaatggtcggatggcatcttcgttttgcactccgttgtatgaagaaggaacaaagagagaggcatgggaactgaaaacccctcattattttgagcactcgttcttctgataatttttactgagtcttgtgagtactctcagtctctcacactaggagtgaatctctctctctctctctctctacctattggggattggcattgccatctcaaaattctgtgactatactacctatcatttcttatacatcgtatagaaacaattgaacttttatgtgtaataagtgttgcacggaaactccacctaaactgaattgtccgatgtcagtgttaatgtcaatatttaatcttattaattgttttatgttttccttgctatgtcttgagtcttggctaagaaatctggaaatacagtccaaaagaattaatttccagagttgatttcaaggaaaagtaagactggccttttggatcctgttgtcgtatctactcatagactggcactaatctttaccttctacttagttaacgaaggatcattgcatccgactacgatttgatgcataatcagtcttgaactatacattgcagacatgttatgtcttctgtccattgtgaatttgtgattgctgaaccttactatttagtatcatattttaccctgccagttttgtagttctcagaatgtttaacctgactgcaaggtctaacctattagatatgtgtttttcactttaggtatggtcgacaaccatacaggtagtgttctttaccatccaaagataataagatattggacttttattcagagcgtcatggttgtaaacagcatgctgattaaacaaaaagagtttctatttccatttccacttaaagtgactaatccagcttngactgttcttcaaaacattgttcaagtttggaacttctgcaatcccttgattaataatgattcttctatgcaaaacaacaaattttcacatgtgaatgtaacctcagcggctttcatatctgcaatgaaggaacgcggtacagattgaaagggcaaccaatgcacagtgcaaaagacattgatgaaaaatcagaaaacaaatattacaggaaaagtccattcagtttggaacagaatgatgaaggctcatgtagcactgcagttggcatgccttattgaggtctgcagcttgctcactgtttcaaatgcacagtgctggaatgtcttgtgttgtggttgtgagttgtgactgtctctgccatatgcacttttataaaagactttaactcttcaatatgcactggaatgctgaatgtaatgaattggcagtctgtaggatcaaagttcccgggtcgatgggatcgaggaacagggtcgagaaacatggtacgctacttacaagatgggaacgaaaatgacctcgtgttcctggacggtgttcccggattgaggatcgctgccaccgaccccgttttctgtgactatgggatttgttcttctgaatatcatttgaaacctctgaatttcaacttgcatgatattgtgaacccactaattggtacgtgatgtcatcatggttataatgtctgatattatctgccaaatatgctgctatcattgggctccattttactgctttgcagatgtttttactttctaaataacctgttttaggattttttttatgtcattgactgcctactttttttagtttgagtttttaagtgttaacacccaattatactttaattattctgaattctgaactaacttattgtcctcttgccacctgaaattgtcagctctcccttcaaataataatactatgatcctcaagtaatatcaactagtagtagcattctctgtacatatcagataatcgtgcttgtcatttttcttttggccttcttgtgtgatgggacttagttctgatttgtgtctcctatctagctttatgtccttttctgaaaatttatttgtttgatagtgtcattagatgcttatagtaaatggtctattcttgtaacatgtattgatgacagcatgggttaaaggatataggtctagtttagcaatcgagcataacctcatttatgatgttaagtgctgatgaagattgaaatgtataaaaacaatctatgttgtccacaatccaacagacatattaagcaggtctctctcgctctatttaattcaattgatagtaagcttttctatcagcttttgtacctctgctatcattttcgggtatatcttttgtcctctactttctgtctgccttgttgttgctacttcttatgggaaaaacatacaggattacttttgtgcgccaaacccatattccttttttttttctcaaaccattatgcagtgttttgctatttgtgctcttacatgggtgttttgaactgagctaactatttttcttgaatgatacagagcaaagagaggtgatatatggtctctacattgcacttattattctggaaatatcatctctatcatttatgttgcctatattagctggattcttttggcccacaggtatgttgacatcacataaacatcttattcctaattaattgtgctgaatggaattaagagcgtatggacgaattacgtaagttacgtttggtatggtgtgattaattgccgttgctgttaagcctttccagttaggtgtgctgggttgatccaatgcaaggccgtatttgtatcatcaataattgccattgcagccgccgcacgcacgacccacatgacccatccactcttggtcactcatatcagtgtttcagctttcagccttcagcctacagaaaaaaaggggggtgttattacaaacagctttttaactaattagtaccaaggaataatcatgtgggtaatagtaacaatttttgggaacaggtccacgtgaagattactattgtccagctctgtaggcacagctaacacatgctgacatgcaatactactgctgctctgcttctccctctcttggggttaaacaggatgtcatcagcattaggccaggaggtcgacgccaaacctaatatcccagtccagtgaacagtggccgacagaattagagttagagatcggattagattgaaccctatttagtggtaaattcatacaatcgatgacagtaaaaggttagtatatccttaaaatatagctgagctcaaactgagcgtgcttaaaagctcgaagacacagcttgagctcgagcccaaacataccagcaatgtagagggatgtattactccctccgtttcaaaatatttgacaccgttgactttttagcacatgtttgaccgttcgacttattaaaaaaatttatgaaatatgtaaaactatatgtgtacatgaaagtatatttaacaatgaatcaaatgatatgaaaagaataaataattacttaaattttttgaataagacgaatggtcaaacatttactaaaaagtcaacagcgtcaaactttttgagatggagggagtatctttttactcctgactccccgatgctagctttggacatggagggagtactaaagtggttaagtttagcatcactttgattaaagacaatagtactctcgtatcatctagttgtaaacctaacttcagaaagcaatgtttggcctaaagcaaaaaatatgtggattaaaaattgtacacgcgtgtccttgacgatttaaaagatcacattgaaaaataaactacaataaccccctccctcctctaaaaaaataactctaattgttttgaatggaaaattaactctaaaactatgtttgaaaatttatttatttattggctaacacttataagccgaaaggcaactgatggccacattcctcttttttatattgttcataggttaccaacccatttggccatgcacagatatgctaagctcaaaccataattgcccagggcttgttatctaacaccagtggtgctaattgtttgctccaagttgatttgcatccgacatggtttgaaggggaaataaatgctcagatggatgcttcaaatgaaatttcaaagagggagaaacgtccaggggtcttccggttagctccataaggtggtgggctagacggcctgngttcgaagtccccttctaattatttaatattagatcattccctaatattcatgtttttttaaaaaaaattcaaagagaaatgctttgttgaatttgttgaaagaataactgaagatcccccccgaaaaaaagaataattgaaggaagaatttatgtacaacatccgtcccaaaataattgtaatccaaattgtttagtaaatattaaggggtctgttcgctgcagctaaattgtagttgttgtgtagctgcgctacagtgcatgatagagaaaatatatgcactggctgtacagcgcagccagttacagctgcatagcagcgttgccgaacagagccaaggtttgagaagaaagactgtaatgccccttattaaatggtatatatagatgagatagataggagtggaagggtagttgagggtaaagtagagagaagtgatcaatgggaccattagtactctactgtgacaattattttggaacaaatttaagtcctttaaatacaattattatgggacaaagttagcagttaagttgtgcatgctcaaacatctttcttggtttgtcaccatgcaaacttatatgcaaacttatgtttagggatgcaagcggggcaggcaagcttttttttagcctgcttatctcatttatacttcattttttcttctaaattttgtattaccatgtggaaaatgaactcgcaagcgaatttttatgcggatagcgggactacccacttgcatccctacttatatttggcgaatgacctagctttgcaagtagggagtaatttatccaatgatcaaccggtgatacaaatgtgagaaaaagacacagttgtcattattagtatcgtcttgattgtcatcttttacaaagaaggctttttggacactacctccttttctaagtaataagccatatgtagtaccactatactaagattcagtccttcaacccatagtagaaaaaactagaaccagaggtgaccacggttcggtttcctttaaagaccggacatgtaatcgaactgctctgaaccggctgaaccggcggtttttcggcgaaccggacactaaaccggcactggttggaccggctagccatactaatgggccacgatgggctgtctaaaggcccaatggtgcagctagtggttttttttttagcaaaaatagcaagaaatggtgcactgggtgggattcgaaccctctggtccgggggttgaaagagccaagtgctagccatcaggccatccaacgacatgtgtacatgagcaaatatgtaatatacatgtagtttgtgaaccgcagttcaaccgcctgggtcaccggtcggaccgacggaccgctgaaccgagaggtcggctgggtcacccaccggtccggctttttttactatgcttcagcctccttctaatttcatagtttcattgaattaaaaggtaacctcccccctcaacaatttagtttaagtttcaattaacttcatttataaatgaactagtaactcctttgataagtactactcctatcaagcattggtcccctcctcttgtttaagtccattccaattaaaccttgtgcatctcttgaaaaaaaagagaagaaaaccggactttttttctcctctggcagataagcatttaggcccccatcgtttggcttacttcctaataagccaataggaaataaaaataaatttgtagctaaaacttttataaatatgttcttggtgacttaaaagctaatgttgaaaaagaaactacattgaaaatatatcaaaatcaatctcaaaattaagcttgaaaatttaaaatttggctttttctttagctgattaggctatccaatgtgagccttactctctagaagccgattgaaagaaaaagaaccttccaaaaggacgacaaacaaaaacgcacaaataccaaagtactccagtacagtgtatacatacacgaaataaaaaaaaaggccacgtcgtatcgtagacgagataaaatcttatcccactcgccatccgtggccgagcaatcgacacgtgtcccgtctaccgtgggccccatccagccccgcccgcgcgcctacctgaaccttccagaaggccgaagcgcgaaaaatcgaccgaaccttctcgccccttccgacccccaattgccccatccccatcccatcatccccccgccgagaacccaatcccgcggcctcgcctcatcctggccatccgtgccacctcggtgggttccgatacaacggcgtggatgcgcccgccgcgggggcgagagatatctatcactgcggccgggcccacctgcaccgccggcgccagcttggctttctcggtacgagtggtgggtcgcatcgaattcataggccatgttttagttccacacaacctatcacatcgaacgctaaaacacctatataaaatagtattaaatataagcttaaaaaaaaactaattacataggttgtgactaatttatgagataaatcttttaaatctaattgctccataatttgataacgtgacactacagtaaatatttgctaataacaaattaattaggcttaataaatttgtctctctatttacttatagattctgtaattaattttttattagtacccaaacgtacagtcaacgatataatacccgatatacacgaaaaaacaaaactttacacaactgaatcttaacacccacatacgtgcgttttctctttaaaatcgttttttcttttggtgctttttttccctcttttttatttgtttctctcttgctttgcttctcctcctcccgttggagtataaattttcctaatccgcaaacgaagtttccagaagacttccggtccgtaccttcgttttcacacgcgaaaactgcctttcttccggcatctggaagctactactactacggtcggtcctcgccggatcagatccggccgcctccccggcggatggcggagcagggggcgggcgaggcggatgcgggcggcggggagcccgccgccggcggcggtgatgacggcggcggcggaggcgttggcggggcagaggtcgctgccgacgccgttcctgacgaagacgtaccagctggtggaggacccggcggtggacgacgtgatctcgtggaacgaggacagctcaacacctatgtacgcgcccccgggattattcctcctcctcgtcgtcgtcgtttgcttgggatttagcttggtttggtttggccatgtcggtgatgtgtctggattttgcttgcttgctgtatgacgtagggatttaggaagatcgtgccggaccggtgggagttcgccaacgactgcttccggcgaggggagaagcgtttgttgtgtgatatacaccgccggaaggtggtggcggcggctgccgcggcgccgccgccgccgtcgccggggatggcgacggcagctgccgcggtggcttcgggagctgtgacggtggccgcggcgccgatacctatggcgctgccggtgacgcgggcgggctcgccggcgcactcctcggaggagcaggtgctgtcgtcaaactctgggtcgggggaggagcaccggcaagcgtctgggtccggctctgcgcccggcggcggcggcggcggctccgcgtccggcggcgacatgggcgaggagaacgagcggctccggcgggagaacgcgcggctgacgcgggagctcggccacatgaagaagctctgtaacaacatcctcctcctcatgtccaagtacgccgccacccagcacgtggagggctccgcggggatatcctccatagcgaactgctccggcgagtcgtcggaggccgttcccccgccgccgcctctccccccggcgatactcgatctaatgccctcgtgccccgccctggccaccgccgccgccgctgcggggctcgccatagacggcgagcccgacccgagcgcgcggctgttcggcgtctccatcggcctgaagcggacgcgagacgacgccgccgccgccgccgacgaagacggcggcggcgaggatcaggccgagcacggcggcgcggacgtgaagccggaggcggcggatccgcatcccgccggcggcggcggcggaagcagcacggaggcgtcgccggagtcgcacccgtggcccatataccggccaacccccatgtaccacgcggtcaggcccacttgcaacgggccggacagggccgggtccgaccaagacgggtccagctccaggtgagttggcccccccaaccctgtagaagcttctagacccctatattacttaattgcccctcccctacactattataagcaactaattatgattagtacgtaattagcggcgaaataataattactaccactagtagtactagatgctcttttgcttcttggcgaggaagaacagatgagagctcaccttgtctctcgatcgatcgccttgtaatccgtctgcctctttctcttgattgtgttgttgtaaatcatcagcgtaagatccatcaggatgccggtaaggcggtaattgcaacctgggtttaccagtgtattggctgcctgctgcggaaatgagaagtgcatttccttgatggtgtggtgtttattaagttgctcacctcaaactgttgttttcttaggtgcacagtttggtcagttttacaagtgttttaggtgttagtgccaaaaatggtggtgacatagggcggaagcactagcatatgttttgtactagatgtatgtattaggtttgatgctagaaatagtggcgatatatactcccccttctttctcctgtcactattcaagttcctttttagcaatttttttagttctttatttacccaacacagtttgattacaatccatatgagtaaacacattagaaatcatccaagggctaacactgaaatcatccaatagcactagcatgcatgttttatactacttgcatgtataagttttgctgctagaaatagttgtgaaatttaggggttattcggatgctagtgggtagccgcagtcaacacgaacaatgcagcaagctgccctcgcctgccgaatagccccgtagagtagaaagcctcaattaaccgtgattttgttttagagaagggatcatattagtacaacttttggaaaaagtcataaccaaacaaaggccttccaaacaattagccgtgatttgcatggttggctcctggaaatggaatcgtgtgttcacagaatccactaatcaagttatcatctccaaacgccgcgtgtagaagttgagtcaattcttaattttgaccgactgggtcgtcgaccacagagggtcgtgtcgaacacacgtagtgaaccacatagcgctagatttggctgtcaggcaaattaatcatgtcaatcctaggggggggggggggtccatgcagagagggattgattactcacaatttcgtatattttctggcttagccaacgttaggcagcggacgtcatcgccactagaaggcactggatgccctttgttccccatttttcttcttccaagctactcgtattttgtactacatggcatcagacagcgacgcatcgtcgaatggttgtaggtcaggtaagcacggcccggcctattttttccccctctgttttcgatcgatctttcttgctgcgtttcttcaacgagtagtactccgtactaataattttgtccacgacattgccacgtcgaggcgtcagagatgttgcgtaaactagtgggttcttacatgtgttgcccatatcacggagtattcacgtttgcctcgtcctacatgtgtcttaaaattgttgaacatcccaacacgaaacttgttacactttctcacatctaaaataaaagaaactaaagattgattcacgtaatttcgtactctccattctacaatataaagatgaaggtagtattggtatcaaaatgtatgtttccacgacatacccacccatatttgaccatagccaggcaaggatgggaaacggcggtaaaggcaggtgtatgtcattctggtcggttccatgtcattctaggagagatggtcaacctcattttttcgcttatacttattcttagtagtcaaaatttaaattttcaaccttaaatttggagttgattttgagatattttcatcaaagtttatttttcagcctttgcttttagatcgttaagaacacacatataaaagttttattcacaaattatttttcgtttgcaaatatgcctgaataagccaaacgatgggacctggtgaattcgacgatctgcaaaagatgatggtggtgcaacagagcaacttcgtgatgcactggggacgctcggaatgcggtagtggcgtaaggggttttggatggtgatggcagacaacagcaaatggtgttgtgatccacggaggcggagatggtgcggtgatgggtagctgggactagttccaattctccctttccatcctctcgggttgcggcggaaagttcaagtcatcgttgaaggtttaaagctaactcttcaagctttgtgtgtgtgttggtgtgtttgtgtgttttcctctgcatgaggattggagtctaagaacttgtatgttatggttgtgtgatatagaggctagattaataaaaaaaattcattatctaaaaaaaataagttgagatgctaacttcactatttagaaccgatcttggtaatttctaactatgtgcattaatgtacataaaatttcaaaaagctgcaactattttatcaaaataataatatgctacagctttagctaagtatttcaaaaataaatcaccataatatcatatgattttaccagaaaggtacaactttatatcacagacaagtgtgatccacatgtcatacccatgtgaaggataaaattactgttcttttaattttttttctttgcttttctttttgcagttttcttaaatacctagttaaaaatatcaacgttttcacaatgaagtcattattgatgagtaatttttttaaaaaaaggggtttactgcaagctaatcacttcctttgctaatatgtggcctactttggtatctgcacagagaaaagagcatgacgaaatagagaataacagtacttttttgcaatgatggaaggtgattatttatgtgtagaatatagtggaagcactatactatgtggatccaaacacattcctacttccctgtgccgatgtcatcaaatactgtgccgttagattaattatgaggggattaattttggtgtgtggtggagtgttggtgtaaagtccgctcacaaaaggattctcatcccagggtacactatgaacaggttagcatgaactagctattctatggttgttgatttatccttgactgcttcatcaaatgctcgcgtacttaggtgtgtgtgcatatggactgagcagagtgtatgatggtgagctgtgcacgcatttgcttttcttttgtagcgaaaaaagttttaatcatgtgtgatgttgtaatggttttattggtttgtatttggttttttgtgttccatcgctaaattttccaaacagctgaatactcaactctagatacttgagacaccaatttgagctgtgaaatcaatactccaccaatccctaaaaaacacaattctaaagatgaatttgaacctacactttcagtattaaactcttttggacagagggagtaataatttagagcaatctgatcagtcaagcatggtttcatatccgagcctgcactctactccactcagtacgaagtacgaacatacagagttacaaacaccgttcaaattcggaggttcaaataggaaccatggaatgatggaaacaatatcagaggtcatctcaagcaaagaaaatcacgtccaaacataagtccacccttcagtgcttttgtttctctcaaaagaaaataaaacttccagtttggcttttccagttatgtttcaaaatataactgggcgctcctaccgtgcacgcgcggcgataggctaagttgcgtgcgagggcaggaatcaacgggtccgcgtcacgacaaagaaaatcctccacatgtttttctatttttttcatcttttctttttctttcgggataaaacaaactttcaagtcaatattttttgaaacttttaaatcagatttgaaaacttttaagtcatgatttgaaaactttcgactcagatttaaaaactattaattcagatttaaaaatattcatcttaaaattcaaaacttttaactcagatttaaaaactttcatctcaaaattcaaaaactcaactcaagtcttaaaagctttcaattcaaattcaaaactttcaactgaaatttaagatgaaatattcaacttcgaaaattaaaaaattgtgaaaaaatggcaaaaagaaacaaaaatgacgcgtggaagttagcttttccaaaaaaaaaaaaaagaatgcacgtacgtggacgccattaaaaacatgcatgcacttaggctaagcgtgggccttatgggcctaaaacgcacgtcaccaacgcgcgcgaattagcttctctcaaatatacctttaagtgaattgaatactaaatatattctaaaattacgaatctaggcaaaatttccaaattcatagttctaaagtatgttctatccacatttaaaaattgctactccctccttccaaaagtctaagtcctatttctttttcaccaagattaaggtgtagttaactcatttatcatgtaacaaaatcaatgaacatgtaatcaataagtattaaaatgacttcttgagttttgataaaaaatttaatatagcatatagtgactacaaatacaacttagacttttgaaaaaaaataaagaatgaaatatgatttagatttttggaatgaagaattatattttaagacggataagccagctctgaaagtgtgtcatgtattctgcgaaacattccgtccaatggtggaagacacacgcatgacgcatgccggtcaacacggggtaaaagggttaattaaccacgccccacgaccaccacgacgataaaagttaaactacttggtactcaaaaactaccaaaaaccggcgactcgcaggaaatatcgtccacagtt

SEQ ID NO: 82318 - DNA, 672 bp, Oryza sativa
caccaaagctaagaatcctagcattcctactactattaacaactatttcctggggccgttgatttgattaaataaaactagaaaaagatactcctctagtacaacttattgttgcgttgcgtggtgtaggtgcgtgggtcgcctggcgtgtaatcttgagtgacagtgccatcctatatacggcttggcttattagtgtgcctgcctgcctatcatgcttagacgcaacagggatcgacttgcaaactaaactagccagtggcttatgcagcaccagagactcgccatctaatttggaactcgatcgacccggaattaataaacaagtcgtcatctcctacgctacgctctctgcatgcttcctatcatatatacggctgcatatatacgggatttgaaggattttgcatcacgtaagtcgctcaagccctgctgcacgtaactattgtaatttcaagagtaaatttcacaaaactacatgttttatggtccaagttgcagaaaaccacccacactttgacacttagcgtttaagtatatatattttgatagtatagtttcacaaaaccacactatcaatgaatagatttacccgtgatatgacatggctgttctacttaggacaaagacgtggcatcctattaccagccatcgcacgaaattaataggatg

SEQ ID NO: 82319 - DNA, 6303 bp, Oryza sativa
  unsure (1)..(6303): unsure at all n locations
acacatatgctacataaaagaacttttaataaataataaataagtattaactttttatatcatatgtaaaagtaaatgtatcgcaaataatatggtgcatcacatactcataaatataatagtatcatccaataaatttttacattccaacaatatacttcattaatttattatgtttcttcatagcaaagggcaaaatggactttttcaaaagaatttaacggtcaactaacggtcaactagcggaaagggcatggaagggatccaaactaaaattcaggagtatgtaagggattgagcaaaattcaagggtatagaaggaattaggtgaactttcatgcatacataggtgattttctcaatttaatactcagggtggccatgcaccatggacagagatgcagaatcaataatttcaactcaagaaccttttatttttactgacaaaggaatgcataaaaaacaagtatactcttttttttcaacatattataagttctagtgagtgtttaattatgatagacatcatgttgttggtgctgtttatacttatttagttggatgcataggacaaactattatttgtaattacaccgaataaatatataaggctgccactagtcagaacacaatataaatgttacacctgtatggtgataaataggatggtcttaattccgagatgtgatgattgatgatcgcaagtagtaggagatttccccgcacaaagcaaattttgcgcgtgctaattgaatcggatttgttatacaacttttagctcatgcttacgtatatgcaattatatttaatatcttaactaattaaaacaatcgtcacctcgtccgtgcgctttttcatccgtccaccccccccccctcaaaaaaaaacccagaacacaaatacgagtccacatcaaaatctaaattggacccaaatcatagagaaaacactactccaataacacaagaacaggaacaacattaacacaagaacacaagaagaaaaggggagaatgctgccatcgccgccgtcacagggacacatggacatcggtccgccgccagcttccctcccgctggatccggcgaaggggaggacaccgccgccgggtcgccaccgcctcccctcccctcccgccgtatctggcacaccgggccgccgccgcctcctcccccgctggatccgcggaaggggagggcgccaccgccgccgagacaccgggccgccaccgcctcccctcccctcccattggatccaggacgtcgggccactgccacctcccctcccactggatcggtggaggcgagggcgccgtccctgcccgccgcctcccctcccgctagatcgaccgccggtggtaggggagggcgctgccgccaccgcctgtgatgagggaggacgccgtcgccgccgtcggtggtgagggaggacgccgtcgccgccgccggtggtgggggagccgctgccgccgctcgcgggggaagggcgacgccgccgccgccgccgtttgggggagatcgggggcgggggggggggggggtttgaatcctagggttagggttaggtttcgggtatatttatttaggttaggattaatctggaccgtccattcgattggacggctcaagctgctcccacgtcgggctgcctattgggccgccgaatggaggacacaaaatggacatcaacgaagaaaggaaacaggccagaaacttaggctgcgttcgagcgcaggagaaagagagaaagatagttttgttttccgcgcgcacgcttcccgaactactaaacggtgtgttttttgtaaaaaatttctataggaaagttgctttaaaaaatcatattaatccatttttgaagtttaaaataattaatgctcaattaatcatgtgctaatggctcacctcgttttacgtatctttccaatctcctcaatcccttttttctcaacacaccctcagggcacccacaatggttatctatagactctctataaaagatccatgtaagcatatttttctacttggaagagattaaatgaagagagagagcaaagctatctactaacctgaagatagtttatagagaaaaacgaggcaatttattagagagctatagatacccatgtagacatactattgagattgtttattattaatctagtctattgctgagatgtacatgttttatagatagcaccttactttaccattgcgggtgctcttagaatagataaaagggaaggaatataaacttttctatattcggcccaaacctaaaagggaggattttgattcctttttccaattaaataattgctaaatgatgtttgtattatttaaattagcaattaagctctgaaaattccaataaaatttcaaagagtgtaactaatcatggagaatttaataaaattaaatttaaccatgtcattttatttctcacttactttacttgtaaattgatttaattatacacctacctacttaaaaataccaaatatttcagcaaatttgtattttaattaattacataatgtaaatttttcttaacttttcctcaattttttggtctgtacattttccgttgcaacgcacgagcacttttgctagtatacaatagatattaaaagtagggaaaagctggaatacggtgcccccaactgcattcacaatttcatcctgaccgccctgtcacgcacgtgagagggaaaacagaagatttcccctttcctctctactccacgtcgcctccaccgccagttgcacttctcccaccgtcggtgcaagaagatgctcgacatcaaataatactcctgttcgcgtggaggtcagcttccgaaccaccgaagaaatcgatttgtatcggtttttaaagtaaagagatacgttatacctagctttgtggttgagggatacaatttgctggtgagggatacaatttgaccggcaagagatgaggaaggcaaaatagacttactcctaacaaaaatgacaatacattgctagtacttcagtaagtcacaaatactgtaatcatgatattatttattggctcaataatcatcatttttatccttgttatttcttattgcaacataacagggaaattgaagagggtattccggtaccaataatattacatgtttgctgtgaagatcatacatttaactcagcctcagcagctaatggttcaaaaactgattccacctcacccttgtccacgtcttccagagttgctggcttccactttggattctacaaattgaaaaggaaatttagctatacgtttagtaaatatatatctatagagttcatctccaccaagtttagtaaatattatttctctcctctcttattaagacacatcacctcgattatttctagccctttgataattgatatgtggtccaaataatttccctccttttcttctcttataagtcaaccccctagttttgtcccccttttttttttttgggaaaaatttgggaaatttttttttaaaaaaatttccctttaaaaatttggggtttttaacccctttttttccccntnntnttntntntnttttntntcccctttncttcttcattctaaagccacatcacgtaagttttgcttttgattgatcaatccatatatgatttaaattgttataaaccacaacattttaattgtttatagctttcttttttaatagtcgatcatagatgaaaattatacaaagtgtagccatcttacatgttatttcgactaatatcatacaaaactccgcagcaatgcgtggggttttatctagttctattaatcctaactctagagacataacaccattagttaaacaaaacacaccacacatgtaactatgtgcctttttatattattactaggtatatggaaaaagaacagctatgtgcctatgtctagcaaggcaaaggagagtgaactttgcaccgtgccacacatgctataatgtctgtatccctctttcccagaagtcgcacagtgcgcaagacatggttgaattctaaggtctacctctactggtttacttcttattaacaactcagagaaatgttcaaactctgtagtacgaagtgttcttcagaatttcattgacagaagtttcgatccattagtggatagctccgcgaaaagtagctcaaggcttaaatattagggagtggcaaataaacaattgattttaaacaattaagcttcttaagtttaattacaagttgaataagctggcggatgatacgccacaaaagcaactatttaatgtgacattcatagtttgtaatttgcaacccatgtgctagacatgtggccctgggacccacagacacaggaggtgtctaattatcactatggagaggcaaatgtcagaagatggatgtcctttgaattatggaaatgtgatcctaaaacatttactatacgctatggtgattataaattgtccgccaaacaatttaagtaatcggagagtaaagagatactaagtcacatggataacttgcctggtccttgtcaactaagacagcacgtacaccttcaacaaaatcatttcgaaccgatgacctcaaggcaattcgatattcaactttcataacaccagccaactgaacaaaccaaatgtcagaattagcaatgtccttgcaaaagaaaaagagaagcctgaaaataaaatagttaaccaaataaaagtattcaattgtacaggatagcagtcataccttcgatagatagtgttcattattcctatatgctgatgcaacttgagaaaaatgtttttgagttaaacatagagaaaatggagccccttttttgagtcctgccaaggcctcgttggcccattctgccactgcagacaacaatgaaaaggatacacgtgcaactagtcagtactaaactgaatttataaaacggtctcaatatagaaacactgttggcacttgtgcataaatataacaacattctcttgacgccttagcttaaaagcagagtacctgcagcatcatcactttgactacacttcttaagctcttccacagattcagcaactgatttgtcaggaccaaaggaagaaatgatatatggtaaaaacttatctagctggggccctgactctggctcgttcttgaactttgtcagcaatgactcaacatctctgtgaggatcatctgtgctgcaaaaataaaaaacacgatatcagatgtcaagacactatcaaacagaattataaccgagttttgaatgtgtcactattattctattaatgaaaaattatggaatttatacttctttaaaagaatggaatggtggaggcagtgaatctgacatcccacctactcccattgtaaattttgcaaattgccccttgaatctaaatggatagccacatataaaatcaaattaagatggatgttccctatagaaaaaggatgggtaacacatatcatggaaaatatgtttttatttattttcagtagcaaagcaggggcattcagctagtagtaattaaaagaacataatgatcttgctagcatttagtaagtttttaccaaataacagttcggaacatacaagttagcactcaagagggattccctgagaggtcccaggttcgctgaaggtacataatgagttccaagaccaaagaaaagggcatcagcaggtgatgatatccttttccctgtcatcccaaggtaagatcctgaaagaagcagaagtgagcagtgacccgtgttattaagcgggtatggcgaagtatgccaacccagcaccgccttaccgcaatagcgataagacgtatggggtggcgacggcttaagtgcattgaaaaataagaaagtattaagtaatatggcgcctaaaaatactaatggggtactccattcatcacagcccagcccaatagtagcacttacctagcttagtccaaatactttgctcttttgacctagcaaacaacattttaaccttacccaacagcttccctcccagcagccgccacctcaccttcatctagatctctctcccccattgtgcagcacggctcctctcctccacctttcttctctccttgtgcacgatgcagcaagcatacaccatcatcctatcctttctctcctctattgcagccagcagcctcctctcctccaccttttctctctcatgtggcacagcagcagcaggtggtgcctctcttgatctccctgtactccccatcagcacaagaagggagagggcgatgctagggaggaccagcagcaagacaacagacttttcccctctg

SEQ ID NO: 82320 - DNA, 1232 bp, Oryza sativa
tatgagaatgagtagttaatgcttgtgtgtcactctacccttggattatcttaacccctgcttagaatatgattatcacaagtaatatataaattattagttgagttctctctacatgatcttttcacgggataaaataaatatgatacccttggaatactctcgggtgaaatgctacaatggtatatccgtgcgcttgcggatgaactctctaaccataatataccagaagtatttctgcggcattgctggaaattatatttctagtaatgtcgttaagaaataccaacagcctccactaccaccgccgctaccaccgcccgcaatgacagcatcctccccacccacaccatcatcgccatggtcccacccttcataacccacaaagacgtcgaactggaggcctccaggaggacgcgccagcaatgctgcctatgctgctgttgatggtcattagcgatcagtttcttccgtcaatattaccgaaatagaggagaactagttttgcttgtaatgcatatccatgttagaataataatattccactagtattaggttcactaaccttttgtagagaataatcattaaatggaggagaatcgacatcaattcaaacgataaatcaatcggacgatgtcgagaaccagacttatgtatgaatgggccaagaactcagaattgacacgacaaactaggccaaaattcaaaagtctggagaagaataacagaggaggccgccagccaaaccatgggctggttgggccggccccaggttcggcccaaccagggggttcgaccgaacctccctcatcgccgctggatgcagggtttcttctggacgatgtggattagctcccaatgatggttggagggtatttccgaccattccaaccatcacaatcgtcattgggaggctatataaaccccttaccttctcacttcactcacacacctcaagcaatagctctctcatttctctcaatttagtttggtagtatctagctggtggaataggaatagagtagaaatcaggagtccggaagccttcggaagagttcgggtatggctctagtagcttttctcttctcttttgtaagctttgtacttttattagaatactcttctatatacatttatggtattgaaatattttccgagtatatgagtacctattttacattatgttcatgttatagtgaatatacggcgagcctatctggaaaatgggggat

SEQ ID NO: 82321 - DNA, 2274 bp, Oryza sativa
  unsure (1)..(2274): unsure at all n locations
tacattttacaaagcacgtgcttgtgaagttgtgagcatataagttgactgacggattactagtatgattcataccaatagcattaaatatctagcgaagttattccaatggtttgagctatattacagtactgtgtctagcgaagtagagatgtgactactatgatttgaagcatattgtaactgaaaaaggtgttattactgcttggtaatgcaaatactgaggacctgttcgtgagtaaatacaagggaaatgtaaggagctgtgggtaaacttttctgcccgtaagtgaaggacatgcattacacattacacgttcattttaaaaaaggatccatcatggttactcatgcttcaatcaatcacattatgaacatgaaacaaaataggtggactgtgaagccgtaggcttactttgactgagaaattgtaaagaaaaaaaggaataggttatccaccgtgataacaccatcatgcttcaattattttaaggatataaatatgtgaaactgtaggattaccttgaatgagaaattgctgaaagaatagttgacatttgagctagattcaaactcagtgaagccactagactcatccccctatttgcacaatttgcacaattgtttagtaaaatgactgaagaataaaaaggcagacaaacaaattgtagttttcttttcctctacttatataaatgctgatgattcataccatatcatcttggtgattgctcacacagctactgctgccactaaggcttccattatcactggaatcctcaaattcgtatgcttcatagatgttttcgtccgatggattccaagaataacggctggtgaagtagctcgtgtcaaatgcactatctgaggaggggacaaaggcagcctgcatatgattccgtgttatcctcggtacacctttacaatggagatgcaactatgtttaaagaantaaatagttaaccatttatcccaccttttgcctagcaagggtattcccccagctatatgntnnctttaaaaaattgatgctgcttaactctgaagggaataggaatttaaatnntaagctatcaatcatttatgtatcataagaagttttgaattaattcnctattacnnaacggatgaaggtttctaaaacctcaaagtcaaaatacctcagaggcgccatttgcacctagccgttggtgagggtcttctgtcaataatcgtgggtnnaaagcagtcataatatcacattagttacattacaaacaaaaaagaaaacaataannaccacnnaataaacttcacaaaggattttgaaattgagcatgaagtagatagggagtattgtaataatatgcttaaattgcatgcgtaaagattccaaaaatacaaatcatattgaatagttctacctttgagcaaacagatgctataaaccatagaacacaactgaacacatataatatagcagtgtgctactgttaccctataagctgaaactggaaaaaagatagggactgacctatggcaatataaaatatagcgagtaccaagttatcaagcaagaaaatgtaatattttagagcagatgtgtccctgcctagtttgacccaaaatcctaattaaccccaacattcatttgtgttatttggaacctgaataatacagctaacaatctgacgtacattaattcacaatgctgatacgagcaacttttgggtggtgattttacagtacaaatgagggagctcacttcaattgttattgatggtgatgatcatggcaaaaaccctattgactttagtatagaaatttcatgcttgtcattgggataacacaaaggaaaatgcagtataaagacaacaatttattatataattggtccattgaccctaaaagtgacgtaaaagctgtgcaatctagcataatcatctatcacattaaaacttggaagcaagaaatagtaacatgcaatcctgtaagactgaaacatgagttactgtgtattcagaatactcgaaacatttcttacttgtcaattagatcctgagcttcagaactcatctcttctgggacatgtggccaaggtattttgcggttcagaatgttgtcgaaaattgtctacaccaaatacaacaagaatgtcaagttgccacagtttcaatacagcaaaaaacaacattgacttatatagcgacattttgcattaaatagatgaaaacccatgtgttttctagcagaccaaaacccatgtattttctagaagacctctttctctcatat

SEQ ID NO: 82322 - DNA, 15972 bp, Oryza sativa
atcatgcaacagccacaggcaataattttgttcctttttagttcttgctctgtttgttgtgaaaccaacttttctggaagcaagcaaaagtgcaaaactgcgaacattttctagtcgagtaaattgttaaagtggcgttcctggccttgttgtttcgttgataggtcggtggtttgcaacattccatttgttatgttaaacttggtggtgaccacacagttcagcaaattttgcatctttgatttcttgaatgctgttatcctaagtgcaagcaatgttcctcacctggccaaacgtgacaacgtactatactaccgttgaatctagaatttgctgggaagctgagaacgcactgtctccgctcttaaaaaaaaacaatctaaaacagtccccccgtccttagaaaaagccaacctaaaataggatgcgaaattttattatctcatactccctccgtccttaaaaatgctaggatgctgatatttttttgacggagggagtaatacagttctagaatttgctgcgaggatgggaaccaatgtttgctgtcatctagaatctacatggcgttaatgtatcacgggctcggtgtatttaggccctgtttagatctcatcctaaaactttacaccatgtcacatcgaacgtttgaacacatatataaagtattaaatataggttaaaaaataactaattatacagattgcgactaatttgcgagacgaatcttttaagcctaattgctccatgatttaacaatgtggtgctacagtaaacatttgctaatgatggattaattaggcttaataaattcgtctcgtgatttactgaccgattctttaattagttttttattagtgcccgaacacctcttacaacaccatatataatatctaatgtgacacgctaaaactttacgcccctgatcttaaacacccccttattctactgtcccatgaatccatgtctccctgacggcaagtcggcaacccttagaaggtgagcgagctagcgaccgatttccgtttttgacggggctcggtgtgtcaggctcggtggattcagcttcggtgacattgatatggcaagtcaccggatgacataccgtgcatgtgagccatccaaaacgaatccaacgtctgctttagttgggcccgcacgcagggcaaaaaatcgccgttttcatccccgtaggccgtagcggagacgtactggcgggagacggcgcccccaattcctcatcgcgcgcgtccgcgagccagcggggagagtcgccgccaccgtgaccggagaggtgacattccgacgagctcaccacgagtgtggaggcggtcgggcggccgccgcgtgaggttggggccggggcctgccgtgccgccgtggccagaggcgcatggaggcgaccggccagaggcgcgtggaggcgacctggagtcgacgaggtccagccgcctcccggtgtggaagaggtgcgtgcgcggccctgtgtttcatcaattttgctgtgtgttcccctttcggttgggtgctttggctctgttgctcgattagtgctagctgttggattagctagcatatgttcagtagaattggcgagatgtaattagctagcatattttacagttggggaatgtgggctgcacttgtagagcgaactgagaagtagcagtaggaaataaataccagtaggaaataaatacatcagggtcctcgcgcagccaccggccggtccccttcctagtcgcggccgcctggcgcggcggcagcctgaggcgggcgaagggaagcgaaacggcgaggcggcctgccgccttttcgggctggcgcggggacggctgccaactagctcgcgggggcggcttgacgcgggcgaagggaagcaaagcgacgaggcggctgcccggtccccttcccactcgcggcggcgcggtggcctagcgcctctccggcctggcgcggggaggcggcgaccagagcacgtgagattggggcgagactgaaggagacgtcgtctagcagaaagggtagcgcgtggggtgaaaacggagtcctgcaggtgggctagcgcaccggaccgttggattagttttcaacgcctcagattgctccaatgtcacaccgtgccatgccatagcaaagtcaccgaatctgaatccgccttatccaccaacgaacccaccccaacccacaccgcgcacgcgcacgcgcaatcgcagcatcaccagcatggcgtcccacgcccactgcgcccccgccgccaacctctcgccgtccccgggcccgtgcctcccgctgcgcctgcgccgtcgcgaccgcgagctccctcgcccagctcgcgccgcgctccagcgccgtcacgccgtcggcattgtgcggacgaatcgccgccgcggcgccgtcgcctgcaggaggcggcgggtgcggcacgaggaggaggacgaggaggagtacgggcacaacgaggagatggcgcggttggagcggtacagcgagggcgcgcgcgaccaagcactcctcgtcaaggccagggtcgacgacgaggtggaggtcgtgctcgtcttcaaggtagaagcactgcactaccactggcagagctgttctatccatcctaaaataacccaatctaataaagcatgcgatatatcatactacactgatttggatagtcacatttcagcactataattttgaacagtatagatgtgttatattatatattagatttgtttattttaaaatgaggaaggacaatgattctaagtctaaattcagtttaggatgtgtaggtttatttattttattttagaatggaggaaggacggcaattcgcaatctaaataccacagtttaggatgtgtcatgttctctcagatttgttcattttagaaggaagaaagaatgtccgggaggcgattcggtgactgatctttctttaaatatagtttaagatgtgtcataattctcttagatttgtttattttagaaggaaagaaagaacgtccggaaggcgattcggtgactgattttttcttttgtgtgggcacagggattctcgtcgaggctgagcgggagaacggcggcggatccagcgatgagcgtgctgccggagagggcgatcatacagacggtggacgtggtgaggggcccgttcaatcccaccaacatcgagtacctggagaaggatcttccatgggacgacttcaagagccgcctccattagcaaaaaatgtagctctaccaagaatgcggatcctttcagttggcaacaaggcatctaaaatctctcatgatatatcagtggaggtgctaaatcaacaaagaatatatatatctgcattcatatcagtgtgatcccggaggaccagctcatcatcatcaacatcatacaaaaaggccaagatggccaaggaaatatacttgtctgacaaggtagaaaggacactcgcatgaaagaaaaaagaaagaaagaatagtgtacggatctccatgtgaatccagacgtaaatggaattagagcattctacggcaatgatctgtgtgtcgcagatgtatgtctatctcttccagctgtgacttcgctaaccgatcatttccacgcgactgagtcgatctcgttccgggcagatttgtacagctctagcctcttgactaaggaatccctcttctccatcaaagcgggatcctcatccaacatcgcgctgagctgtttcttctgcgttatggaaataaaaagcaaatggtgtccaagttaatataaatgtgcaaatcaatgcgacacaaggataaaacaagaaaattttcatttagccacaaatacagtgtacatatattttgaaatggatggttaatattttgaagtagagtgcaatttactcgatattaattatgagccaactttctaatcactatgaaacacgttatctttttttagttttgaactaaggtagtataaaacatacctccttgcttcccacatgagcatagaaacggttaagcaagtttctttttgcctccttcacttgacagtgcaccacagcttttggaatggtgttcctcaatgtctcacaaaccatgttaatgtaagatgatacatttgaccctgaataaaacaatgatgatgtcatgaatatactttgtcgatttaaaaaattagttcgcataattgttgtcatcgaaattcacatatggtcatatcttgacatgtttgctagtgtcagcactcagcagaacgtgaatggcactagtaccctatgttacatcttagattctgcttattaagtcagtttgttaagtacttcgtgtgacctctgtgttgaggtcttagaacagttgactcaatcaattgccattaaagaaacaaaatagaatgttgaattgttaccgattcttcttaaatggttgtcctgatatctgtcattggctggagtgttattattagcccccttatctggttctgtagggagttttctgaaaaattctacagttaggtagctggcctccatctcaacaagacgaataactgtctttcgaccatcctcacgaaatctttccaggctttcatttgctgcagcagctatatctgtctgaagtgttgggaaacgcttcaactcctgtggcatccaagataaccaatgtaaacagtcaatgcaggagtgtcattgagtgatcagtaatatctactgaggttcactgagaattgaaaatcaacacaaacctctgttgctgcaatcgatctacgaacaagttccttcaagaccaaatgaacctagcagatacgagaacataatcaaccagatgtagtgaacaaaacagacgtagtgcaatatggcttgacatatgaaaatgcccccaaaagcactggaatcaaatgccttcctttgttgaataaacaaatggtacattccaattaaatctatagtatccctctctttccgcaattgagcacttgatgaacttaagcactcttatattcactactttgacaagaagctcgtcatggttctgcaatcttctcatatgatgttttagttgttcaacacagggggaaaatgtatatattggataagaaaaggctagtttatgtaagtctatatatcagtcattggaacaggatcctacttgcttaataattaaattaaaagtgcctaaagaagatctattgatgagaagtataccgcatcaactgaagcttccgctggacccctgaagtagtggagcgaactatctataagccttctgtacccttgctcaggggcaatcaagtggggttgataaccatcagcctctgaaatgactttccgaacattttgcaatgaaagatgcttatcaaatggaagctttttcagtgctgctggtaattggtggtcaaagacaccataaatacgatctccacctggccgactaagagaacaaaaaataattgagtgttattaacatgcctgtagattctttgccattcatctatgggatactatttatcaatatatatggcataaaaagcaacagcactcaagaaaagggcctaataaaatatcttacccgccatctaggtgctctttaaaaactcggtcaaacgcacgacacatgtccaatattgtgtacagttgtgcctgtagattatgataagtttatgagacagcatgatgtagacatggtttgggaatagataatgtgctagggtgccattcaaatgaatgttgcaggttgtggcacgaacaacatgaacctgaacacttgcagaaagttacaacaagcaaagtacggtttttcttaccccagcatcacctccaattggcctaccaaggcgatccaactcagcttcaatttcatcaattgttttgttaatcatggctataatacttggaatttttgctctgatcacagcctctaagtgctgaatgtgtaaatagaagtgtatcagcagtcagccttttcaatccagttattttttggggagagggaaagtacaccacaatagcaaaatgccctgacctgagacagaagcttagcaaggtactctgcacccattttatgtgccaagtgaccataatctgggctactttcaaagtactccttttctttgcgtcttgctgctagcatgtcgacattcctgttgatatcagcttgtgaccggttgacaattcccacccaggggtgttgcaaacgatactgcctcccttcaagtacctaggattacatggcgttgaaaatgagtgctgtgtccatagcgtacaagagttaagaaaaaatgacaagtcacatacatcaacagcattggtacccttatccatcaaatcaagctttgtcaacactccaaaggttctgtcacctaaaaatattatgaaataaattgtcaacagataagaatggaacaagacagatcactgcaatactgctgtatggcaataaaataaaatatgcataaaattattgtcatatgtgagaaatatttgaaatgccacagtgaagaaaatataaaatgtacctgaaggatcaacatccctagcaagcttgatagcatctgatgttgctatatcttgattagctggagatatggccagtatgatagaatttggctgaagtttccaaaaagaacaaatgtaggaacaaaaatgaacagttttaatcagaacatgaccaagcagaatttgcagcatatagaaatacattaagttatattagcatgaccataagacaggccagagaacaaaagaataatgtttctagacttgactcgtagtacccactacccaccccagaaaaaaaaactgtcaccacaaataaacattggacaagaacaatagtaaagcttagaattgatatggcagggtggacagtactcattaagtgaatgtagcacatggagctaaaataaacatggcactaatggcatgcaacagacttcttttaccttatcaacataagaccgaaccatgttttcaatatcttggacaatagattcttgttgcccctctgttaataaaaagttcgtgtcacaaacaatcacataaaaagagtacgcatagaaaactagaagcatccaagaaaacatacctacagcaaccttcgtcaatccaggaagatcaataagtgtcaggtttacaactgcaagaaaatgggtgcaaaattacattagtgaaaaaatttatgacaaggactaggatctgctgagcacaaaacgtctctatataacaggtcatatgctgcagcacaagcacaatgtaactactttcaaattatcataatatgattatttgttcctcagggttaagaaatagatttccagaatgattccttttatgtacaccttttgaattgtttctatagtcaatattttgatgcttaattttgttgcatataaagcagggtcgattattaatatcaaacatgaaattttgaagtgctaatataaatctgcagagatgcctcatacagtttggtgtgattagtctgaaaggaccacaatggaggggtttagaccaacatcagaactaagaacaggtggagagcagagcaaatatacattttttttaaaggaaacatatgccagctctcaagttttgaagaattataagggataaatcctgaaaggaatccaaatttaaaaatgtaaaagtaatagtagaaattatcagtctacatcctattgatcccaaatttcatccacaacatacaatttaaagtttacaggcatttgggggagctgagagcgagtcagcgaagcaggttctgtttgaatgaaacattcatagtacacatcacataccaaaagttcaaaacaagcatcaagacttaccatgtggagaatatatactcaaatggatgggaatatttgatatagctttcgtttttccagtaatgcgatcggtttcatcagcaatctctttcctaacagcagctgcaattatacaaagaatttaaatatttcaactgaacatctcttgcaatagctatgttaggacactagtaatgaaccgggaaataactttgctcagatactcactagtatcctacagtgattgtgacttgtgagatctactcctaaacgtcattagttccttagttcacactgcatatagcaatgtgtggatgctaattgtatatgttcttgtttttaggttgataggcaaacttcagtgaagtaaactataaccagggaaagcggtatcatcctccttgctgatctctcgtggaaaagtctactcgttggaattaagacaactttgaagtttgcacaacactaactctaataaatgaaattgaatacacaaatcaacctgctggactgcaaagcacaaatatggcaatgatcccttaccaaagtcagtgaaacgcttccgcggggcgtggaggaactcggcgtactcctgcccaccctccgtcttgtgcagctgcagcacaagaggcctcctcgtcacgattcctaatcaaaccgagagaatgcgcattaatccctcgcaaaccaagccgatccagacgaaatggcgcgcgaaaaaagaaaaaaaaacgagcgatccagcgtcggcattaccggatccacgaggcaggaagtccctccccactatgctctcgagcaccgacgacttcccggaactctggatgcatcacaaacgcaaaccgaaggggggtgagcgccatatccagatctggccgccatggctttggatctgagaggtaggtacgcagggtggtggcgagcacgcgtacctggcctccgacgacggcgacggagggcagcgcctcccagagggaacccccctcgccgccgcccccgtggtcgccgaggacggtgcacgcccgctggatccggttcaccagcccgatcaggctccccatcgtcgccatctcgggcaaagcccccaaccgcctacccgcccaacggctctgcgcgacgtcgctgtagtctccggctcaccggcggctcaccggagcacggcggcggcggcggcggtggagggtgggatctaccggagagtggagaagcggaggcgagagaaatcgaaggaaaaattttttttagtaccagcggattttgaaagcgaggcctatgtaagcttcgcgaggagggtggtggtgatgacgaacgctgcgtggaccgggtgttggtgcaccgggatgtgtgagccgggtcactgcatgtggggccagggttgcagaggaggactgcaggtgggccccagggagtgggagagcagaggaggcgtgggggtaggggaggtttgggtggaccgggtgcatgggacggaagccgttggattcgcgttgggagggagccgacggggggagtggtggtgggaccatgatgtctggtgcgtgacgcgtgagccgcaccttacctgggaggctggagcgtgcgctcacgttggatggggaatcgacggtcacggtgagatcggctaacgttcggaaacagccgagaggagtggcgaaagagaggaactacctccctacaaaatattggagctttcttatatcttactattattagcttcgttctaaaatataatattttttaaattatttaattaaaactaagattaagaaagaaaactttagtattatgaatactaagataagatgagaaaacatttgaatgggtgataattaatagaacaaatactattatgaatagtgcagcaaaccaatttcatatcatcttaccttatattatcacaatctcaaatatagttacttttgggttatgtaggtggacaagcatttgtccaagtataaaaccaaaagttctcgaggaattagaactaatggcccttttatttggaggaaaccataataattttggaggatttcaaccctatggagaaatttcctatgacctttgaaacaaaggattgaatcatatcatatcctttaaaatttctatagaatgaacaatcctatcagaatcttatgttttgcacttgtattcctaccataattttgtgtttttcctatccctccgtttttccattcctacaattcaaagaagctctaaaggaatgctctagatcaactgtttagatgccatacggtaagagagaagcataagcgtaactccaacaaactatctatcttactcttcgaagcaaaatttgacaaacttagataaaaaaatcctcgaacaaacttgccaagccaaatgagtggccaaaattctcacttggatggccaaatctaacaagttgatagcctcatcggttgtccatatccctagtaagtcgttttggcttactagggaataaaaattaatttaaaggtaaaatttttatacatttgttcgtagcgatttaagttaatataaaaagaaattacgttgaaaatatcttaaaatcaagttaaaaaattcaaattttggcttttgttttgactcattaggccgaccgatggggcacacctcccccaccttctctcttccctcccccatccctctcaagcacaacatataggtcccactgtcacaaactcaacggagggtgtagatggagaggttggagcacaaatgaaatatggagaggaaattttttttatcaacttgccaaatgtggagatggagagtttgatttgggtatgctgttggagatgctcttaggtgaagatctcatgtttatttcctaagaattcaaatagagctcatctcatatcatagggacttcagtttcaaaccctccaaaattatttccttcgttctagaggagccataaactcggaacgatgtggttccaagaggggaggaacgggaagggcaattaggatcaaattagccataattagtgatatgccatgccattctattgctcaatggaagcataggcattagctgggggagccattgcccattggtcaaagaaagcaaagagaagagccaatccaagagtaatatatctgcatccattttccattgttagatacaaactctaaaaagggggagataagtaaaccatttccattatctaatggggagataggaaccacagacataacatgacccagagttacgtgaatacaaacttattatcattattcggcagattcttggtgaagtacaacagagaatcagatcaataagtacaacacatacattacattacatactcaacacatcaacaaatggcacacccaaaattctggagtacataaatagatgaggcgacgcctttattccaaaagatgaagcaaatgaccctactacctgaatggatcgatcttggtaagcctcaccaacttatgggagcaaaggaactttaacagtcggtccggttttgattcgagtcagtggcattagatcttcggatcgcgcaagaggagccggtatatctcgttgttctgctccgacatgtactcgtacccaagattgtcagcacggctcttgaattcgtcaaactcctccggcggcacttgtatgccaaccaaaacattcgctccggtttcaccctgcagatgataatttacgtatatgctggagttcactaagatgtttaagggttttgcaagttcggcagaactaatgtaaccaatatgttaagtctcaacacaatttagatgtacatttttgtcaagtgaaaatggaaagggaatattgtacaggatagatggcaataaaatgacgatttcagatgcatgagattgcaattttcatacaagactactttacagcagggaaactgatgaataataaatctgtcacacacctgtgcacggtaatggaaaaggctgatattccagcgggggctgaatgcatccaaaaatttcataagtgcaccaggcctttctgggaaaatgaaccggtaaacaagttcatctgttacttctgacctgccaccaatctgaaaatagatggaaaggaaaagcaaattaaggtagccgcatatttgaatataaacaaattaaaagaacaccatcccttaagatcagctgcaacaaaatttagcagaggttcacaaaattaacttggacatatctgtgttttgggaggtaattttttttatttgaatcacaaggcaaaaccagaggcacggacatatgattgactgctttgtgcaccaaacaagttcttatttacaatgtagcagttgataatttcatcaatttatctgcagccttttcaactggaacatctctataaaaccagttgtaacatgtttgcatgcacaaattcagtaatgaattttatggcacttgcaatgctatcactgaggatgtttagggacctagatgaaactgtagacacgtttaatcactgttagtgtcatttactctaaaagtgattagatttagtttccaaaaaaatgtgtggcattgttataaaattggcagagaaatccaacttacaaagtatcttagatgatcctttgccaaatcattgtcagtaagatcaacagttctcaattttgaagattccatacgttccaccattgctttaagttcatcgtcagtgtagatgccaacactgggatatataaaatcaaagcaatcgtatagttagccaggagcccaagaatataaaagagcaagggacgccatattctttccataaataagtgtcaacagaaaatagtaaagaaattatatgttggatagtgagcccaaagatccttgatgttaatgcacaatgctattaacatattagtgtccatgtacctgtaaaggacaagggcatcttttgcattgcaatcgtatctgtatttgaattcagtaatattcatccggccaacctgcagagagttggaagaaaagaaatgaaattagaagttgcaaatttttacatattggtagaaataccgcaaggcataccagctctgcaaactttttgaagcttccctgctcctctggcaaaaatgtggcaagaactgcttctcgttttcgaccaacatcagccagctcagttactaatctgagccgatcaaagttcatatttgctccactagttattgcaacaacattttcccctttcaagccatagtatttgcagtaagcttcagctcctgccagcgcaagggcaccagcaggttcaagtatgcttcttttctcctcaaacatatcctgcagccatgaccaaaaaaaattatagggcagaaccgcagaagcattataagggtaagattggaatatagcagtagtccgatcatagattcctagcaccctataaagaatgtcaatggaataggattatacattagttgaaaaccaatgcccacaagcaactcacaaaaaactaggctagtgtacaacatttataagacatgtccgctacagagggttttgaacaagtaatctttttaaactatggagcatagtattcacagaccactgcaatatagaattttgatgcaggaaaccggtgtatatttctttttcttttattgaaaccagtacctttaatggagcagttgggatttaagttagttgagagaaacaggttagtgttcagttttaacaacaatctaaaatattatgtaaaacaagacacaaataatcgtgagttcatacctttattgaagcacaaatagcatctcgactgacaagaacaataccatctacaagttcccggcacaagcgaaatgtttcctcccctacaactttgacagccacaccatcagcaaacccaccaacttgctccagcatgaccctttgaccatgacacaaggacaatgccattgcatttgcatctgatggctccactccaattattttcacctgtagaagagctgctgtaaaatatacagaacattccatcccaacctgactagagtgcaacaatgcaatgaaacacatatattaattgcaacactgataacagctacaactaggtccgaaaaacaacttaataccccccaatttgggcttaaaactattgccatgctccatgatgacatttataaagaggtttgtttcctcttgcattaaaaaaacgaacttggccccaaagggaaagacctcccaaggtattataattaagaagcacctgaaactagaccgaaaatggtcatgaaagccagcccctccctgtggatcagtccttaacccgtgctttgaggcttaaagaaaactagtctagaaaaataggaagctaacctctgggcgaaccctttttacataggcagcgatcccagcaattaatccacctcctcctacaggtacaaatatggcatgaagtgggccttgcaactgccgaacaatttccatgccaatcgttccttgtccacttataacatcaggatggtcaaaaggaggtatgaatgtgcggccttcctgctcgcatctttgttttgcatatgattgagcttcatcatatgagtcccctttgagtacaactgttgcacccaatctctccaccgatcgccactagaattcaaaacaataggtttactatgtaatgagcaaaaggtaagataaatcacatagaaggacaggcttaaagtgatgaaatctgcagatcaagaaccttgatttcaggcgttgtcacaggcatgacaataacagcatcgcaaccgagtctttgagcggaaagggccactccctgggcatggttcccagcagaggagcagatgacacccctctccaactgttcacgcgagagctttgccatcatattgtatgctcctctcaacttgaatgagaatacctacacaacaagtaaccaaaattatatctggccagtaaaactgccaattgtactgtcagaagtcagaagagcaatatatgtaaagctacagaaaactaatgctaaagtagaaactaatgctaaagtagaaattgcgtgtacttctcaaatttcaatcaacatgaaactagcattcaataacattaaaaaaacagtagacaattatgaaaaacaataacaataacgaacaatacatgtacagtgcatgtgtatagagagataattaaatatgcaatcaaggatatccccttggtgctattgctatgtcaatattttcttattattttgaatgaacaggcaggagaactgccaattatactgataaagcaggagcaaataaaataaacagaaggcataacaccaatacatcatgctagtcaatgacaatgataatgacggtagaaagtccttcaggtatatcagagtatgaacaaactttcacgttccttgaaggcttgaaacgggtagcccatccatgaaacataataagttcaaaactttgataagactccaacaaaacccaagcgcctaaacctgatgactctacattcctcagtttaatattagcgcagatgaacaaaacattgtactccccccgtccctaaatatttgacgccgttgacttttttaaacatgtttgaccgttcgtcatgttcaaaaaatttaagtaattattaattcttttcctatcatttgattcattgttaaatataattttatgtatacatatagttttacatatttcacaaaagtttttgaataagacgaacggttaaacatgtataaaaaaaaatcaactgcgtcggagggagtattttccatacaggaacatcaaacaagcaccctacgagtcaataccctgtccagcactgaaagtgcactcatctcaaaatttcagcaatcaataggatgtaactatacaaaatcccttaaaaattgacacgataagaaccctgtaaattaaatgtccaaccaggagtattggttataagttgatgaaaaacatttaaaattaaaccaatttgagaacaaaaattcacaaagaagaacgagcaaaagcaaaacacccttaaacctctattaccccgagaaagtttgacagcaacgtgtccaagcgaaggtggacaactaaagaaaatatcccaatacttatccaacaatcaaagaatccagagaatccaaacattctattcaagcccactgaaaacaacacaacacaccgattccgaggtaaaaacccccccgaaaacccctaaacttatcgaacgaatgttctatctaattacacgattgtgacgatggacaatgccaaatca

SEQ ID NO: 82323 - DNA, 2176 bp, Oryza sativa
cggccaccaaagaaaaagctcggagatttcctcccgctggtcatactttaagtacacagaatcgcgcgctttcagttcatcatcagtgcttaaagatgagagtacttttaattagacctccaaaccacacccgagaaattctaattttactcaaaattgaccagttaggcagctgaaaatctcgtcttcctattcctggcagcgcctcgatcaaactgcaagatccgaaactcaaaaataaaccccccaatctacccgcacaattccgcctcgagcgcacccaaaacgcccccaatttgagcgacaccatggacaacggcaacaagataaaacaaaaaaaatctcaggagagtggacagaacgtacgtggcggaagacgggccgaggagcgggttctcgcggagcggctggaaggagaagcggcggaggaagccggcgacgcagccgccgagcgcgctgccgtgcttggggcagttgttgacgtacatctcgacgatgaacaccgcgatgcaggcgacaatcacggtgggcacgagccacggccaccacttcctgtcgtcccgcccctcgtacccgccgtacccgtaccctcccccgccgtaccccgccgccacccggctcttctcctcgccgccgttgctcgccatctcctccgatccctcttccccttcccctcagtggcgaagaagaagctcaagtggctactagtggtttccccggagctcgggtttggcttcgaagcgaggggaagaagaaatgatgcggcggaggaggaagggagaggagacagcgaccggcgtgggccccgcggtgggtggagggcctgtctcgctggcgcgtggggtcccccgcgacaccgggcggtgagccgttgctgtctccgcctcctggccccgacgaggcgtcgagagagaaagagagagagagcagagtggttggtccggctcgctcgcagtaactgctccacacaggggaggcgaggaggcgaggggaaggcgagcacgcgacgcgggcgaaggcgaggactcggcgtacgtgtggcgtgtcgtggcgagacgaggcgcgaagcgtgtggatccgagaggggggatcgttccacgccacggcaccgcgacggacgcgggtgcgtgttgcgggcgggggtgagctgttgcactgtcgctcggcccaggtggcgtctcctcttgcatacttcctcccaaaaaaatatttagattgatcttattttaaatcataccaatttttataaaactgttaaatatgtacatacatttagtctttgtactaaatattgataaatagataaaaagttctgccaaaattttaataatattatcaattaccaaaattttggtattgttttgattacagtctaaacatcctcaaaatcaatctagataagaatgtgatataacctaagataacgaatctagatatattcgtatatagattcattgtcttggattatgtctcgttcttaatttttttgagttatgtctcattcttaatttcttatttagggtcatatttttgagacggacgagcatagtatagccacctgctctgcacgggcgcccgcgccgactgggtaaacggcgctccgccaccactgtgtcaccctcaccgtgccagcgtagccaatgtacagtacaaacagtctacagtagatgctacgtactactgtactactactgggatccgtggaaaaggtgactgacacgtcgtcgacgcagccgcatgcagcagcagtggaggctgtcctcgtgtcgcgcattccgcgttagatctgggaagaactgtggtgggatcatatgcaagctgaccgcgtcgtaaatggaacttttttgtgtgtgggtgcgtactgtgcgcgtgtacggccggtgttgcatttaaccgcgccgtgcgccgcccgcgtactgtgcgtgcgtacgtacgtacgtggtggcgcacgcaacgggagaccccaagtccccagcctcggccacaccacaaccccaactctccaaggctgtgccttgcacgcaccgacgccgtgcgacggtgcgagggcgtactactcagttgcattgcatgcgctcgcgtaggcgtagggctcacaccgagctggtccgtcacgtatgagtacgtgctccagcttacccaggtccccccaccgacgagggatactacgactgca

SEQ ID NO: 82324 - DNA, 4788 bp, Oryza sativa
tgggggggggggggaggaggcagccgccctgcgtttcgccagcgtgtgccgccggctgggcgagcagcggcgtgcgtgtggcggccgtggccaattattttttagtattactggagtattgcgttcaggtcggctttcggtttggttgggttccagaggacagttgcgctgctgtgttggcagaggatgtactaatccatctcggattttgatgagtgtgtgacatgggagtatgggactactcgagctctacaagacatccaagagctttttgatgcaaccacgtttgactagccctttgtttttttctgccccctttgggcaaaaaggtttgttggtgcttgaccggcttcacgccctcaaaggcatgagacgtgtcagttcgtgtcctattgcagagtgcatactgcatgctccctccgtccaaaaaatataaactttagttttcgtgtataacatttgaccgtccgtcttatttgaaaaaattatgaaaaaaattaaaaagacaagtcacgcataaaatattaatcatgttttatcatctaacaacaataaaaatacgaattataaaaaatttcatataagacggataatcaaaattgaacacggaaacccagggtttgtccttttttttttttggaacggagggagtactactcaactacttgtacgagcaaagtttttaagaatagatgaagctgcttacttccttttaagaatagagcaagagtgggatcttattggacaaagaacatatctagattatttatagtcctagcaaatatccagattttagttttacatatttttgaacatccagattttagatttttatattttaaaatagaggtagtagtaattaagaaaatagagcttcgcgtgttgtaatcttgcaagagagcaaaatgggaagtaaatgcttaacacagtccaagcaagcaacatttggatatacaccgaaaaaaaatgatgggtctattaatcttttgaacagtttctaatagcgcacagcagcaatccacaaaagcacaagtgacagcccactgtgcttcccgtatggcccatgtgacaccagtcttacaaccacaacacgagtacacgacgataaatagcgtccacggcatatggcatgccgagttgacatgaactcgttcaacttcagctctactagaatcatactactagcgacacaagaggaccatgtaataacacatattctgcctggctgaagaccaaagctaatccaacctcccggagagctactgctatatagcagcaaccgaagaaatgtacatcctggtgttacggtatttatttgttggcttctcgttcgaaattacatgttggcaccactcctggagaatcatgattgttgacgctaacatccacgccctgagtctggtttgtcatcagtaagggaagagcatagaccagagaggaaaatgtgagtgatcggtaaaggtaataatagatgagcccattgcattaacatggagaatgtgatgtacctgtgagtttgaaccttgtccatgagtacggacgggtctcatattaagatcaatcattttggaatcgatgttaccctggtcatcgcagttgccatctgaggctggatcatcagacacattatgatggtttgccatttgctcctttgttactgagtgaggggccttcttttgatccgtccggttttcaggatctttctgttgcatagcaacatcatccatatgacctggtttatctcctggaaactaatcaaaatttcaaacttcaagcactagaaaataaggcgtgagattacaatacgaagttggtttctaaacaataacctacttcaacccgttgccttaggagcaggtatcttccatgggttcgtttcccaccaacatgaacagtcatatcacaactaaggcaaagtgatgtaccatctatctcgcaatagaagaaggctgcatggacagcaggacataatcacaacaagctttaacaggcaaaatatgataagaaactattcataaataagaaagaataccgggggcattttcacatatatcacagcgttgaactttattagggtctgcaagcccaactctcacgtgccgcctagcaagcttgttacacatatgcacctgcatcacaacattggaagaaatatcagaaaatgcagcatgaatatttaatgggttattgagaccaaagctgtaatatttgtttttcttcatgctaatgataccacatgaaggatattgcacagctactaaaataacttgtatagactgattgttggtcaaaatctacaaagtttggcctcttcaaaccaaaatacatcttataacaatcaatggagcgagtaattttgttgatcgaagttctcatagagctgaatatggatatgcatctctaacatacagagtacaacaaccaatctggcaaactttcagtaaacaaatccatgcaaaaatgtcagctttattaacagtatctgatttcttatgttgcctgcacataatcagcatacatcgtgttcttcagcagatccattactgacaaaccttattaactcattaaacaggtgctcaactgacataaagacataagtaaggactaagaaccagaaaagatgacctttcatagttggaagagaacttaactgctcaaaacatagtcgtaaaacagaatagacgtacaatgttttaatgggtaaatcaatataatataagaatgtgagagcacaatgggatatttgaccaaaagatctgcccacgaaggatgtttcataatgtttggcctcattagggatggggccacccacatacaacaattccatttccggttggaactttcatctacaacctggttgcacttttgcacgtactgatgatttttaatcatgtcatcagttccaaatattataaaaaaccaaagaaaccagtgtcatagcattggttacggagcgcaaaactagttgagcagctaaagaatgagtaaaggatgctctcatgtatgtttttattagcaattgaaggtagcgactggaatcatgtacagtaacatagtataagacatactactctgtcccataaaaaagcaaaccctagctacgaatctggacacgaatgtgttcaggattggactttttttgggacggagggggtattcattaactctagaaaatctgcaattcagactctgcattctgcaattaaagtgaggcagaagcataatcttggctacaaataacagtaaacatatggactgaaaaatcgtgtaaacacaagtgcaaaatctatacctaactatttctttactattgaagaatttcaacaagggaaattcaatcattacttctacagaacaatgatcgacttaagtattacacatagccaataaggttaacagaaattccaaccaaaatggcaaaatcacgacaagctcatctcgcactgtcccacatatggccatgaatgatgatgcctggaggtgtctaacgaccaccaagctagatatagaactcagggtagtgtgatcttctaagaaatcccgttccgaagtaacccaattgctggattcaagtacttatttgaacttattatgtatgttttatgctgtaaaagtgcctccttcgataacaacatcatagaattatgctttgttttccagttctaaagttggccagctttaatttcaagtggaattctctaggcaataggcctcattttgaagtcagacaagaaataagtggataccccataaggcaatttctcggttactacccaaacaagcactacagttagtcactatcaatgcacgctggcatcctattataccataacttcgtttggtcataagtccacaatactcaacgaatgaaaaaaaaaaggccttaatgaatgaattgctccaggccagtgagcagtacgcagttgattcgcagtcaaaattaaatggctttctgtacccaaaaaagaaacacgcagatccacacgctaattcgagcgtagtaaaccatctcgtgagatcttaattgcacaatcaaacaacccgatcgcccagcgtgaaacaagcgaccgcaattgaagcatcgcataacccgatttacgattcggcaagcggactccgacgcgtgcgcgttgtagagcagaggacgaaggcagggttagagagagggggcaccttctcgtcgcaggaccggcagagcgcggcctcgtcggccacgcagaagagcaccgccggcgcgctctcgcacacgtcgcagatcgtccgcatcccgcccgcgccgagccgcgcccgctgtcatcgccccccctcccccatctccccgcccccccactccctcctcctcctcctccggcggatcggtcctccccgcctggctcttcgccgtcgtagtcgtacacacagcggcggcggcggcggcggcggcggcggcggcggcgacgaggaggagcagagcgggagtcgcggggcgagaggaggaacgaagccgggagagagattgtggcgagcgaggagggaggaactcgagagaaacaaaaaaaaatactagaaaatagaagtaatagtttttgatttcgatgtggtggtggggcgagcaggagctagcttggtggtggccccaccttctcgagggatcgagccccaccgtcgctagacccggtccacgaggaccacacgtccaactcaccgcgcccgcgggtctaatcccgtgagccgggttcatgccgccgtagacccgaggaaagcgaaacatactgtgtagtggctactttcaccagatccgcacggtac

SEQ ID NO: 82325 - DNA, 12736 bp, Oryza sativa
tactccatccatttcataatgtaaaacacaactattttttttcatatatttcataatataagatgtgcatacatacaattaattagtatcttctcaccaccaaattattattttttttaaatcctcaatcttcaacatctctaattttgttggatgcagtattatatttatcacgatgatttaacttaggagatgataataattgtttcttggtttttagattaaggttgttgttctatatattttggattgtagggagtaaaatttaatttgaatatagtaacttcttcacctatttcagagtacgagacttaactgctgtgcaacagtgctagggcattttctttttgtttttgaacttaaagatgagaggaaaatcaagataaaaagatgtcgatttcatttgggctctccatatacggagtacatcttgaattcctgagatatcctctacatcggatgagtccagatgagtcaaacatgggatcaatcgtcgtcatcgatccgtccgacctgcaggataggagaggtcgagatcgaataggccggcgttgacgcctcctgttcattcctggacatgtcactggtccgagaaaccatgtccattccacttctgctaaatccaagctttttctctgcacatacacatgtactgcatgccaatgccaagcatctctgcattcacgacacggatgcgaccctgttcttttctccaacaaaatttattggataaatttttaaatatttgtgacacgtttttcaaactgctaaatgatgtgttttgtatgaaaacttgctatatgaaagttgttctaaaatatctaattaattcatttttcaagtttgtaataattaaaatttaattaattacatgttattgccgctttcttttacgtgaaacacttaacctttattttatctttagaagattcaaccaccatcgcatcgcaatgtaccgccacaaagagagatcactgttacactgtatcagtctcaagaacattgggatggagaggggaagaaaaagactgagatcactgtagtggtgcatatatatatatacacacggaggagaaaaaggcgatgacagagatgaacattggatgccagtactgtatctactagttgggtcggcatggagcgtagggctcaccggcggtggccaccaccacgacgtacgtacacgacgccggtcgtagcaggtggccgtgccgtcgtagcgtgaccgtgcacgcaactccggccggccggccgtccgcgacactgcagtacgcagcactgcactgtagctaggatattggtaagatcggtatcactttggcgtgacaggataccatgtatcgtaagatatattatgattagtgtcaagatactgacaaacttggtaggcagcattggcactgtggctagtataaccacagaattcttaggtccgtttgcttttcgattaacacatactccatccgtcccataaaaaacaaactttattactgaacatttgaacatttttttagtacaacgaattttgataggctcctattcggatttactacctccgtttcaggttatgagatattttgacttttcagagtcaaactgcttcaagtttgacttaagtttgtagaaaaaaataataacattttcaatccaagacaaatttattatgaatatatatttaattattgatttaataaaactaatttggtattataaatattacaatatttgtctataaacctagttaaacttgaagtagtttgactttaaccaaagtcaaaacgttcagtaataggttggtttttttaacaaaaagtagattttacctcaatttacattagcacatttttttaaaaaaataaatggtgtatttgtgcgaaaactctagacaaatattttttaagtttaaagtaattaaaagtcaattaattattcaacaatgattttctcgttttacagtgcactaatgactattatgcagtaggattggctaggatatgcggtaaagattggtatcattcagcttgataagatatgataagatactaggatacgtgttgggacatggtaaagagcctcgcaacactgttacttctttcatcttaaaaacaccataaatctaaatatagactacatttagggttgtaagcgggccaacccgcgaacccgtttatagacaaaatttatgagtaacctgtgggttgactcgcgggttaactactaatttggcctgtaaataggtttatgggttgatctacttgcatctctacgacgcggcaagccgagccatgacgtgaaaacctgcagattaccctttatttaacatatatgtaggttcacggatcggcccgcttaccttcctacctacctatattagaatttagtattttatatatgcgacggagggtgtaaccgtgtaagcggccgcagttgccagcaattctgcatggagggtcgagggatagaagcagtatacaagaaggtcacaaagctgtagaaggagctagggaaggttggcagcagcagggcggcatggggggggggggggggtgacctgaccaatggggtagagaaaggtggacggcgacggcaacggcatcatggaatggcgatggatggggcggagctaatggccaaatccacgcactgtggacggggacggctgacgagatggcgccacagtgccgccgcggcaatttgtcagattccccgtcctacgtggaccatccgcgcacggctcgacctcctcccaacgaccaaactccctccgtaaaaaaaaaaaaaaaaaaaaaagaaagaaagaaagaagagagaggagtaagagacaaaccttgagtttccatgtccaacatttaaccatccattttatttaaaaatattatgaaaaaaattaaaaagacaagtcacgcataaagtattaattatgttttatcatctaacaacaataaaaatactaattgtataaaaaatttatataaaacagacagttaaatattggacacggaaatacaggcttactttttttttttttttactacgaagggagtacacagctcgatcgacgcggtcgagctctcgcgttgctggccgattcctcgcctctcgttcgattgtcgtcgccgttcgcaacgcaaaagggagatttgtatatagtacaattttggttagtacggagtattagaaaatcttagcagtggagatcttacaaagttcggtcgactaggttacaagatgcgatcgggagtcaaaaaccgattcctatttttctaacagtttcatcgatatctatgataatcaagcgtatatggaaaagataagataaccgatgaaactttttttagtagaataaaaaaccgatgaaacttaataaatattgctactccgtcctaaaatataacaacttatatcatttaaaatctaccttaaaatataataacttttcaacctgtcgaggggtgaccctctctagcgggaggctgtgagatcccctttgtgagtttagtcgggggaccgggtgcaatactgaagagcgtgttctcgtgcgagcgaagtgagtcggtgggggtcaagcttgcgaggcagaaggcgagagagcgagagagagggattatacaggttcgagccgctacggagcgtaataccgtactcctgtttatatgatgatcttcgtgtggttacaaagacttcagatcctaggagtgctagctagggcttggccggtctcttcccagaatccggttttctaagagacgtctctttactcgttgggtacggtcctcctttttaccatatgcaccgcccctacgctctcctcacaggaaatgggcccacattgcctatattaacaagcatctcatgccttgggtcggaagcgatccacgcggccgctcttgggtggctcccactgaagcttttcgtctaacacgggagacatcccctgtcattccctattaaatgtttggcaacttcgtaggcacacgcgcgtgggaggtggcgacctgcatgtccttcccttgcgcatgatgggacggggcataccagctcccacgccgcctgacacgaaacgggacatggatgcgttgcctcctgtcccatccatccgtcgccgggtcacagaccggtcaaaaagtggtcgccaggcgcacgtctatcggcgtgcggcgcacgacctgccacaccgtattaaatgcaactggggcggttagggcgctgcccataaatgcgcctggcggacggtactcccgcccgctcaagccctcacacagctgccacgtggcagccgagcgagggcttcggggcgatccaacccctcgggcccgaggggtgtgacggggcacccttgatcccgagagtggggggggggggatggccgctccttttccgagggcgcgactcactcgggggaactaggcccaccctacgtgccatacggaaagggatttctttccccctagaccggggaccccgtgcccatatcaccgacacaacctatatttttcttctcaaccaattataattttctaccatttaagttcttcgtccacctccttccatcagcaaaccacaaactctttctatttaatttcacatatttattgatatccgtgtctaacataaaaacccttatattcttgtaagaggtagtactaaattttcgaaatttagtttcttttacttttaatttttttgccattttagtaagcgatttctaacatggtaatattaataacaagtagttctcgtcgcattttcaaacatgtattcttgtcaagttataacctcgttcagattacctgcacgtgcgacggtggtgttatcgcgtcgtgtccttcttataagtgtcgcttaggaggtttgttattgcctcttcgccataagatagttggatcgatgattttggatgcggctggtctatacaaaggatgagtggatctttttctctcttgctctctccagatgcgatctttctctctcgctctctttataagatagttgtttggaggcgttggtggacggtttagtggcggctgtgttataggtttggcagtgtccatctcgcattgtcaccacaaattggtggtttttcttttctttttcctgttaacaatctctcaaggatgtagttttcaaaaaaaaaaatactatatcgatataaaacattgcaccatcttatactatttgttttaaaaaaaaacactaagatgcatatacataccactatacatgcaagcacccatgagtgtgcacactttaccatacataataaatgaagactagcagtaaatttctaacctccatatctcacaaagttttgattgaaaatatatatgcatgtgtgcaggggcgttcctacactatactacccgggtaatgaccccgggtagaattttaatatttagatggtttagtctatattaactatattattagttaaaaattaactaataatatacatgttatgacaggtaaaagacctcggtaattttcgttctggattcgtcctgcatgtgtgaaattctaaccattaggtttttttaccctgatcaatgtactcataccatcacgaaatttaccactgtcgcttcttctcttatcaaattttcgaggatgagaaacatgttagtaaaccttttcttgcttgcacaaatgctcgaaaatgacatggatgagacatatgttatttcggttgtgtatgaaaagcttttagctactgcagcttatccaaaatcttaagcttcccaaatagtttagattattacctaaatcctaaatcaatactaactacaaaatccaaagaaacaggctagtgataagaaaccgggaaacacaaccttttagattcttactagctggctttttattatttcccgtcccaaaatataacaacttttagccttttaaatttgtcccgaaatataacaaattctgcatcaatattcacttctcaaccaataacaacattccactgttcaatttacccacctacctattatcaaccaatcacaatctcccaccatttaattctacttactttctaaataaccgtatacaactctaaaactttttatattttgagacgaaaggagttattgtttttcataatctctagcttctcaaacataaccttgtaaaaaagggcagaaaaggaggcatttccttttcttagctgtccaaaatgagagcaaaataagattaaacacggcagaaaactcaactatatgagaagaacatgacacctaaaggaaaccttcattgcggctggtccataaaaaacaaaaggcaaaaacacatgttcagtcaacgataagtaacttgccaagacacgaaatttggagtgtggcgccgataactgataagataggaactggaaaagcatcaaaccagcaaatcactaatcagcaaacagtccagctttggttagtggatctaaaaggaccaaacccaagtgcgtcgtcaaacttttctgcttaacgatcacacgctgcccaaacaaaactcgccagcggcatcgctgggaaaggacacctggtgacatgtgcgagactaacagcaaatgtggctatctttcactgaatttccaattcaatagtaacactggaagagtgagagagcagcctaatccacctgctcactctacctgtctttttttatgtcagggataaggtacctgtgtttacaaattacacatcaataaactgaaaattaatgctccacgtgggcaccgtgtccacataacatagtgtcagtcaacagagtatttgatgttgattacacacaaagatgattttccagagtacagggatgattactgcacggaacgtacaaggatcaagggctaattaagtttggtactgtgccaggtagtacttgagggtatatttggttgccaggcaggttgtcgcaatttgctgacagaagtagacaaacttactcaaggtttggtgttcagagttcttaacaagtctaacagaatcttgtttcttttttaacataagccagcaaatgcttatgttatattgagcagatgagtagtagaaatatgtataacttcaccaaagatgaagaaactgactccagtagcccgaagacagccgagaaaagaaaaacgcacacatatgcatcagttttgtaagttattgatgcctagtaatttgttggaagtgaattttcctacaaatatggctaaccaaacagctaatgtttcaaatcacttatcatccaaattttgtttgaagttaaaacatttatatctttgactatcaatatttagatattaatatgatttaacattacaatatttatcttttttcatcatgacaagtatttttcataaataatattacaattcatatgttgttaagctatataatttttttaaagattgatagtaaaaaagataacatcttttacttaggacaaagctaaaaagataggtaattgaaaaaaagagtatttaaattagtttaactttagacgcatcagattgtgacaagttagcaagcaaacatcccctagctagtgagcctgagtgtttgctcaggtggttagtgtcgccggtgggcacactacctgcgagcgttcgaaccctacgttcgatggctcgtgctctcctggggaggttttgttttccctttttttcccgagactgacttcggttggttccggttaggtataagggtaaacatacacgtgagcgttcactggtactgcacgtttccggtgcctccaatttcattcttagcgtgtgttagggatacgcaaacgtgtgtgcgtgtggcgtggacttgtggtgtatgtgtggtgtgtgttcatgtgcatcctgaattttacttccctctaaaaacacatcccctagctagtagctgctggtaaactaccgtcctgagcaacagagaagcaaagcaatgagttgacgcgaccgaatccgcgacgccgccctcgcaccgcaagggccacgccaatttggtgctcgatcgatcggaacgcgcgcggcgctccacggccatgtcccaccgcacgaaccgcgcggccgcccgccaaccgagctagcgcgcggccccggccgccgccatgctaacacacacccgatgcgttgcattgcatggccgctccacgacgcctcccgcccgcctcgcgccaccacggccacgcggtgcaccagctatagctagctagctaggcgcatggggagacgctccacgacgcccactgcactcccgacacgtttcccccaaccaaccaccacgcaccaacccaaaaccatccatccatccagccagccaagccaatctcccggctccctccgctacgcgccccacgacctttttcccatcacccgcccgcgcgcgcggtcgagcgcaacgcaacgcaactccaccgtaccaaccgcggcgcggccgatcgatcgacgcgaatcccgcatgcgtatacgtactattctacgtgaagtatatgtgtagccgatcgagccgtctcccaccgcgcgctccctccctgcccccgcgacagcgacgccgagcgagcgagagcgcgcagctagccacagcctccagagctatagctacagcgcgatcgagagagaaggggggagacagtgaggccgagagcgagagggccagccacgcacgcacgcacgccaccgcgctccattggccaccccctcgccatcgccacgattaaactactctcttgctactccccctccatccatccacacactccaccatttcctcttcttcttcctccatatcacacggttttcgtccatcgatcatcagagctcgatcgggcgccatggatggggaggaggacagcgagtggatgatgatggacgttggagggaagggcgggaagggcggcggcggcggcggcgcggcggacaggaagaagcggttcagcgaggagcagatcaagtcgctggagtccatgttcgcgacgcagaccaagctggagccgaggcagaagctgcagctcgccagggagctcggcctgcagcctcgccaggtcgccatctggttccagaacaagcgcgcgcggtggaagtccaagcagctcgagcgcgagtactccgccctccgcgacgactacgacgccctcctctgcagctacgagtccctcaagaaggagaagctcgccctcatcaagcaggcacgcacatcgtcgtcctcatcgattcttgatcgctttctttcttgcttgccttttgcatcgattctgacgcgtgatcggtgcgttcttgcagctggagaagctggcggagatgctgcaggagccacgggggaagtacggcgataatgccggggacgacgcgcggtcgggcggcgtcgccggcatgaagaaggaggagttcgtcggcgcgggcggcgccgccacgctctactcgtcggccgagggtggcgggacgacgacgacgacgacggccaagttgatgccccacttcggcagcgacgacgtcgacgcggggctcttcctccggccgtcgtcgcagcatcatccgccgccgccgcacgccggtgccggcttcacgtcctccgagccggccgccgaccaccagtccttcaacttccactcgagctggccgtcgtccacggagcagacctgcagcagcacgccatggtgggaattcgagagcgagtgagcatccacactgttactactaggctactcatggatgatccatcgatcgccacagatcatgcatgccacgatcagaatttcaattcgccgcgaggacggatcaaacctgtactagatcggatcagagcaaacatagcagagaagatgatcaaaccaacagtgatgtgtacatagctttctgtagatcaaaaccccaggcagtctcctctccatccagccatcagcatgcgaaaattctctctctctttttttcccctccaagtcttactcgacttcgatgttgttatcacaacaccacatcatgtaatccagcaacacgccgagatgaaaaaaaggttaaaaagcttatagagttcgttcatttgatggatccaatggccgcttcagttttcgcctttatgatttcttccaatggatggatcaatgaatctttatgctttcttccaatggtggatcgatgaatgctacaaaaaaaaaaactagataggttcaagaaagaaagaaagtgaagagaggaaaaggatgtgtgcatccatgtagatcaagattcccgagcaggtgaggggatgagaatcgaacaacacacattcgctcactcacacgtactacgctacagtacgggacaatacagagtggcacagatcacagaacatgcgagccgccattgttaatttcaagcaaatgtaagaggcgcgtgggattagtcagcccaaatatatatatatcataccatttgatcggagattgattttgtagtgtagtgtagtcctgatcagtttagcacaccccatttagacacaaacctttgcagagttgggacaaattaacccgaactcatggcacctttggaacctaattaagatttctacagagttttcatatatagtagtttgattcctacgaaaatctttcaaaatcctcctgttccaaacgagcccttcagcttgctgcgcttacaggataaacgactgatgagtagtcgcatttttctgcaagatcagaaggccattttttatgactaaagctagaattttgtgagaaggctgaagagtgcaaggctgagtaatcaatccggatacaagcagtagcagttttagtcaaagacaagacccacccaggacaatgacagccaccatgttaatccttcgtttatcctaggtagaagtgatagtaataatttacccggcatacttcttttccatcctgacagcgaccagctccaacgtgtcaacaatccagtacatgctagctcacccacaaggccacaaactaaaatggtgatccaaaaccaaaatttcacttatcaattaagcaacttatttacttacagtaattaatggcgatggtatcacccactgtttcttgggcacgtacgtaaccccggacgaattaggttgctttctctggcgaacgatcaggtctctttctttcgtcttcaactgttgtgtgggctccatggcataattacatgtcactgttcagacacagtgacgatcagaatcgttgaacacaaattctatgttcgatgggcactagccaagcagccaagagtatgaaactctgaaaaagaaaaatggagaggaaaaaatattgagttgagcttgctagctccagaatatcacaggcgcttgtcgtgttatcttgagggtggttagcattgcttccatctaaccgatatgggttccactcaaatgtgacaactcatgagcccaacatattataagcaaattgcaatcctgtcaagaacaaagaccccatcagtgaaggcaaagggcaaagcaaagcaaatataatggactagcaatatataaaaaaaactcttcacctagtcacagaattgtagccacttgtacaccctgtgatgtgaatgcaagggttctgtcatcaagccgttgtccacgtggattgcttatcacttactcgtgtgacattaccttggatgagttagaatatacagaggcttttctcagtggatgcttgatacactccaataagagactgaaagactccaagcacgcagtttcaatttggatattcaactttagatgcgattaggtgtcaactccagataagttgcagatcattcaaaagatgagcaccacgcatggtagtacatcaatttactacatatctggaacacatgatttacgtaatactagtaataattaaaacaaagatttgtatggaattcctagagatgaaactcagtggaacaaacagggtcttgcactctcatcttcatccatggacgtgttgtactgggagtttgaaaccaatagcatctttgacttgattactgatgcacaacgactaaatgatttggactaaatgatttggatacatagcttttgggacttatctgggcaggcgtgactcgttaatttaaaaagctcccatgcttggaacaatccaaagactgagggtagtacagccatcaaagaagaaatatgagaaaatgatctcaaattattctcacatatctttcaaaataaacatatggactacatcatacgatcgctcgctacaagtcactgttacgtcctaaagatactctgcatctcatatatgcttatatacataatattccaggctgatgtcaagatcaaggtttacttctaatttaatgcagtcttgtattcataatatatcttccgtccccttaagttccattagaccatagcaaattccatggtagctcagtagctcaccatcatagtatccacgtcactttaggagaaatcaccaaacgatttaagtacctgaattaattgcattcatgtgataaactggtgataatagtcaaaatcataaataggaaagattagacattgaagcgccccaagtatacagatgaatttcctaatttcaactagctgacttcgaaagggaaatcgaccagccaacacagcataagacaaccgtttctctgtttaacaaaccagaaggcaatctatcctatgtactatataggaccatagactacattgcagaaagaatctaggggcaactgccaactggattagcaaatgaatggagtacacagcagtatccagtaggaccagaatgaggaaatggttatcagatcagacgaatgataagatat

SEQ ID NO: 82326 - DNA, 1693 bp, Oryza sativa
aaacaggagcacagaaattcagactatcgaaaatacatttatacttgctggacatcaggacacaacacacttgttatactagtactagattcgaaatcttgagtcacttaactgaccacaagtcttaaggacaaaccatttaacaatggaagtattgaacatgcagatcaaatgacaatacaaataacagatgcagcctaaagtcctaaacagcattttaacatacctcatcatctcgttcaattacttgtgcctgcaataagcaaacattgacacattactaacatgttccataatgctagagaggactatatcagtgaaggtaataagagcataagacatcagtgcccatttcctcaggtatgtaaattctagcatgctaccaaagctcaggctgctgcaagttcagacaatcacctcttcaatgtcatcattgctgtacattccataccggaatgcctggctcaggttattagcaagtgccgccacatcatagtccctgtctcggaagtcatcatcatcgctatccctaccacgatcatgtagagaagtcggacgactgcagcacaaagcattgatagccaaaagtcagcgaagacaagtgtacgcaatcacaaaagcatcacaaaacatggtgataacctacccacaggcccaatgataaacgttctcaacctcattgcgtttgaccagggcagttgtctgccattcaacccactcgctgttctcctgtaaagacattattcaccaagttagctaattaataaagtttagatgatattatgcacaagaagtacatcatgcaattgctaaagtgataggctaacgaaagaagagaaactcaaagtacctgcaaatgagactggattatgctgttgctatttcccagttgaataagcttattagctattcgagttatgtgcccaatattcccaatttttggaggcaccttcccttcagatagtaatgttggctgcacatagaagataagaatactcaatatacaggaccctgtgtatatctggtcttgcaacaaggggtatgaaggacataagaattcaggaatagattactgtgttagattctgttgacagggaggaacttctttcagcagcaagaattttgccaacaagattgcattcattaagggcatggtcaatcagctgggatctattaacttccagacaagaaatgataatactctcgacatgatggtgcagaaagttattgtaagggtacctgcagcacgaaccaatatgtgatgattctcttgcaattgttaggaagaagagcacataaaatagccccacttactggaagaacaaatcaatggaacgttttactgcagattggttgattagctcctgttccgcagtttcactaccaatcgtcagcaaaacagagatgaattccacaatctgggaggaacaaacataccgcgcattaaaaccaaaatggaacaggaaaggactgtgaaggaacatgtcaaaagaacagaaatgattcattggacattgcaagcctagactaacaaaagagacttatgcaagggacacgatagttttagaccatcagaactcaattgcatgcatatatcagaaattacttcgccagaaatcccgaggcaagattaataaaagtaagtcaaggtacccataagcaagatttttgctttacgtcaaataattagaaa

SEQ ID NO: 82327 - DNA, 12949 bp, Oryza sativa
ggggggggattttgggggtgtggctccgaatcaattgcttggctgctctgccgccaatgggcgccgtcacgactccctgtctttctctttcttcttctctccctgctggcctccgggctccggtaccctgtgtccctgtccgtgggccaccaccaccgtccaataggagtacctgttggacctagatctctgcaaaggaatactagagttcttgggctggttataggccggcccagctatcctttgcagaactcctccagtgatccggtctctaggctgagctgcatgccctgtgcagtccagtaaaccatcttttttttaatgctattgtctctattgtaaaatcaaagtccactaaacacattattctaaatccagtactttattataaatccatcctcacaatcacattccatcaacacctccaatcatataggtctaggcgtattagcccgttgaatagttgcatacttatactccattcacttcatattataataagtcgtttggattttttttccatagtcaacctttttaaaaaattgactaagtttatagaaaaatataggaacacttctaacacaaaacaaacatattattaaagtatattttgcatctaatgaaactaatttggtgttgtagatattgctatttatttttataaatttagccaaacctagaaaagtataactagaaaagaagatcaaagcaatttataatatgactaaacagatttaggaccaaaataatatagcacagacgtcactatatgctactagcttcgtttcaggttataagacattttgactttgatcaaagtcaaactgcttcaagtttaactaagtttatagaaaaacatagtaacattttcaacccaagtcaaatttattatgaaaatatattcaataattgattgaatgaaactaatttggaattataaatattattatatttgtctataaacttagtcaaacttaaattagtttgattttgaccaaagtcaaaacattttttaccctgaaacggagggagcactatgcaagcacataacaagcctttgaatgtcacccttgccgttatagtccctcatgtactaatcgttttttttaacgtaaagagagactttgagcttgtttgggggagtttctagctgctgcagattcttttagaatcagaagctccccaaacagtccagcttttgatctagattctaaaaagctgtagttgtagaatcaaaaaaatgaactagaagctaaaaactaggaaacccaacttttccatattctcagaagctggctaccaaccaattgcttctcataattttaagcttttcaaacagaccctttattaattactaaaatttggattacattccttatttaatagctcaagattttctgctggggcacacaatcttcactccaagcaaattcttgaactaaatgccagctgagtcaatgcatgcaaatgcacactatctttatgtggatcactttcacttcttgtagacgttgcatcgctcacagattattccttctcacggatgagcgtttcattgtcaagctagccacaacctctacgttgtcagatacggagtacattactaatcgtattttcacctgtgaacttctcactccttcccgtattttcagcgtaaacgattctatcgtcacatcgacaaaaacctttcgattgcactttgcacatggctggtccaatgcaactgcattttcattcatgcacaacgcttgcttggccacgttaatgtgcttgtgcagcgtcactgtgcagagagaacgtgcgtcctacctgctacacgaatgaacgatattaattacttagcgtatgtatatatggcgtaaaccatgtatcagccgtacatagtacgtggattattactgtgcgcagcggcgcttaagtcttaagtgccattttgccgtacgtacctggttgttgactgtgcgtacgtgtctctggtttagtttattatgtctcgtccgtcggccgtcgctaagactcttgctgacaactgactgactgcaatcagcggcggagctagaaaattaattcatcggtatcaccgagatcagaatacactaatcttgtttaacttttagtgtcatatataacacacaattcattgggaggattgactcaacgacgacaaagctaatatggaaagtatggacgctgtcaaaatgaaaaaaaaaaaaactttacatagctcctcattcgaaacaaaatctggatgacagatcggctgcaaatccgtcaatgtctatcagttttgctatagaaacctttaaacggcacaacaccttttcaaggattacactttcgtacatcaaatctgagagaagatctttcaacagccgagacacaatacactaaacacacacgatggcgacgagccactgcttgactggtggatcaagggacatcccaatggaaaaaaacacaaacgaaagcaattaaatcaattcatatggtggtgccttggaaaacctgatgcgaatgacacaaacgagtgttccacaatcaggagactcaattgtctcaactagtgaccaaaatcacagataagaatgcgaggctgtcggttttcttgttgttctccctcttgttcggttctttttcggctttgtctctttcacctttggtgagtctgtaaataatttctatcctacctaatataacaccagcaaaatgctagctacggtttcaaaatataaaaatttatagtgtcatcttgattgcctaaacaatataaccatagatttcgccacaggttaccggggtcagctgacctcgatagttctactgtaactccgcccctgcctacaatctcattatcatttttattatttatcatgtcgtgatttgtaattcacaataatccgatccataatgtttgtaatagttgactgtacattatttaaattaaagactggaaactctataataattaattgtggtctttttaaacaaagtccaaaatgaattaattacatatatcttaaaaaaccctcaaaaagaacacaaggaaaataagcgagatttaaccactgtaccaaatgttcagcaatgaacagtgaccatataatccctggaaatccgtgcttaaaccatcaatcatattctctccgtctaaaaaaactcaacctataagtgtatgtgacctctcctacgacaacgaatgtgggcaaaggatagtccatatttagggcccctttgatttgtaggaaaaatgtaggaattttggaggatttcaatcctatggaaaaaaaatcctatgaaggcctttgagacaaaggattgaatcctatccaatcctttaaaattcctatggaatgggtaatcctatgcacattttggaggaaagttagcaagaggtctaacctcttggaacatttcctctgagtctatctctctcatctgattcctgcgttttttctgtggtccaatcaaacagccattcctgtgtttttcctgtgttttgcaatcctctgttttacaatggtattcctgtcagaatcctgtgtttttcctattcctctgttttttcattcctacgatttaaaggggcccttatagtcttaggagagatcacatcccctattaagttggattttttctgtgatggtgggagtatatcgcaccccagactggacgatgaggcactgattgtagacaggtgaaagttaaaagcgagaggctgaatgtttggtaggtaggttggcaccagtacttggccgggtacccatctgcattcttctgccttcactagttcactgccaatataatgcgacatctgcgacacagtactgtacgtgcgacgggctctgaagcagagcaatggcaaaagcaataatgtcactcatggacatggacggcgagcgatctgccggagcaaagcaaagcctagctcgcccccacagggacagcattcatggcgctctcgtctcgtgtgccccccctcaatcgccattgccaaccagaaagatcgtactcttcccgtggtttctactgctgctctccggtggccgccgccgcctccatattagggccatcgccttcctggcgcggccaccggtcaaaacggttatttttggtccggtctctcctttttcttttccttttcttaccaagtcttttttttaaccattccgtgagcttcacatggcagacaggtgggccccgtgggagttagccccaaccaccgtccactctgctgcctttttcgcggtaaaaaaaagcgagtaaaacgaaaggggaaattcacctgccccattgtgaatagtcccgtcgtccccttcctcctcttcctcctccctctctcctttttcttcttcttcttctttcgaggagaggaaggaggcagccgcgcgcgcgcggaggcgggcaacctctcctcgactcctctcccccaccgtttcgtcgtccccgcgtgagaggtaaacgagctcctcatcgatcgatttctctctctctctcgccgcgaattcgcttggtagccatgcacgcgcgcatggagggaaaccttttctcttttgttgttgtcgtcgtcgttggtgcatgtagcttcgccgtcgttagtacgtgacaacctccggcgacggatggatggatcggtggcggcgaggcggccgcgcgccggccggcattttgctatttttttttcatcatgatgacatgagcgcgactgcgtacgtgcttggtggtgcaggaaggggaggaggcggagatggcgggggaggagcggccggagcggatcgtggtgtcggtgcggctgcggccggtgaacgcgcgcgaggcggagcgcggcgacggctccgactgggagtgcgccggcccgaccacgctcacgttccgcggcgccgtccccgagcgcgccatgttccccgcctcctacagctacggttcgtacgccgccgccgccgccgaatgcaattgcaaaccgctctcccgctcaccttctcgccgtggtttccagacagggtgttcagccatgagtgcggcacgaggcaggtgtacgacgaaggcgccaggcaggtcgccatgtcagtgctcagtggaatcaacggtaaccaaaaaaaaaagaacaaatccattacttgtttgcaacgacgagctcttcgtcgtcttcttcgtcgcgatgaactcactcgcgagaatctgctctgacattgctgcagcgagcatattcgcgtacgggcagacgagcagcggcaagacctacaccatggttggcatcacggagtacagcatgtcggacatctacgactacatcgagaaggtgatcaatcgcgttgactgaattactgttgattttgtttgcataattgcgttcggtttttgatttacgagtctctgctctgcagcatcctgagagagagttcatcctgaagttctcggcaatggagatatacaacgaggctgtcagggacctcctgagctctgacgcaacgcctctcaggcttcttgatgatccagaggttacctttttccttgacatggtttgctgattaccttcaacaaaaatcctgcaaaatttatcacattttgctgttctttctgaatgcaaacagaaaggaacagttgtagaaaaactcaccgaggagactctgcgagacaaaggccatcttctggagctccttgctgtgtgtgaaggtgtggaaatgaattttctttctttcttcccagtgaacctggatatagcaataagagtagcagctcatttgtttcttcagtctggtgatcattttgtttttgcttgtgtgacagctcaaagacagattggggaaactgctatgaatgaagcaagctccagatctcatcaaatactcaggatggtttgtgctcatatcaagctaaattgtttgcaacagactttttttgtaaaaaaaaaaccggttcttaacctgctttgttaactgtagacggttgagagttcagctaagcagttcttggggaaaggaaactcgagcactcttattgcttgtgtggtattgatgaaatacctgcatcttgtaagctttgtattattttgcacatgtttttccatagaatctgagtttcttgtggacagaattttgttgatttagcaggaagtgagcgtgcatctcagacggcatcggctggtatgaggctaaaggagggcagccatattaacagaagcctgcttactctaggaaaggtcattcgccaactcaggttcacagaattctcttctgtgtctttcaaatcattctacaagttcatttttctctctctttcttttgaaacaagacatcttcatttcatttaaaatgatttctgaacaacttcttggtggtgtagcaaggggagaaatggccatatcccatacagagattcaaagctcacccggatactgcagtcatcactgggaggcaatgcaagaacagcaatcatctgcacgatgagcccggcacactgccacatcgagcagtcgaggaacactcttctgtttgctaactgcgcgaaagatgtcgtcaccaatgcacaggtcaacgtggttatgtcagacaaggcactggtgaagcatcttcagagagagatcgctaggttggagaacgagctgaagtttcctgcatcagcctcttgcacttctcatgcagagattctcagagaaaaggatgaactaattaagaatgtgtgtactgctcttggatccttctgttttgatcttcacatcgatgataatttacagttcttcactttcaaatgtccccaagaaaagtactgaagttcttttttttggggggtgaattttcagctggaagaacagttgaaggaactgatggagcaaaaggacaccgttcaatctcagcttgataatttccgcaaagttgcgagcgacggggatatcaacaatcacttagcaaggcgatgggtacttctcttatgcactaatgtgttatctaaaaaaaattaacaacgcaacagtgttttagtatccaactaatttaaccttactctgatgttcttcacagagtcggtcttcagactcgattccgcgcattgtgtcagaaggtgcattttcatcttcagatactcaagacattgactatcaagatcaaacaatggatgaactgtcagtacctcactcgtttccaccaagcagccaaatttctgacatcacagaggaacacgaagcacagagagtagctcatcgagctgaatctgagccccctgaggagcactgcaaggaagtgcagtgcatcgagacaaacaagctcaggagcaggagaagccaagaattcttccaaacacctgaaaagaagacacacactgatgatcaaaagcatagcgaaagcatgtcaaattcagcagaaaatgccatcaagctatatgcgtgtgattttgagccgtcatttgatctcgagaagcctgaaactgaagaatctcttgccctgaagaggtgtgtggttagctccagggacagtgcgcttactaggagtagaagctgcagagctagcttcatggtcattccgaacagctggttcgatgactcggcgagcacgacgccgtcgtccgaaaccttcagatattctaccagaaggccagagaaggtgaggaaaagcctgagtcctgatgagatcgcagacaagagcacgggcaacgctgaagaagacaagagcacctgcaatgctgaagaagagactgctgtgaatgacatcggctgcgtcacagaagtgaagcagaagacagaaatgaaccatgcaccccaatcttcagagcaacaccaggtacagtaaaaatgggaaatctctcttgagaattctctctccataaaaaccattgactgcaacatttacatttctcttgtcaagccgatttcactctggtgtactgtctgtctactattgattcatgcagccgaaaattgctaaagaagttgccacggtctccctttcgaaatggcacatcgatttcgagagaaagcagcaggagatcatcgagctgtggcatgactgcaacgtctcgatcgtacaccggacctacttcttcctcctcttcaagggcgatcagacggacagcatctacatggaggtagagcacaggcgactctccttcatcaagaactccctcatcgcagacggcgagctccacgctaccaccgcatcaaggttcagagacgcatctctgaaagtattctgaacaccgtcttgatgagcagcatgacaaacaacattcttggtggtctttgcagcttgaggaatcttcggcatgagagggacatgctgtacaggcagatggtgaggaagctgcacctggccgagaaggagaggctgtacggcaagtgggggatcgacatgagcaccaagcagaggaggctgcagctgtcgcggcggatctggacgcagaccgggatggatcacgtcagggagagcgccgccctcgtcgcgaagctggtcgagcacctggagaaggggcaggccatcagggagatgttcgggctgagcttcagtttcaagccacgcagatctttcagctgggtcggcgtctactcccgagactgaattcttgcccggccatggcgatgaactgatgatgatgtctcagtggtagatggatgcgtagtggaggagacgatgctgcatgtcaggaaggagaggagagagattttgccgccggaattgaactgatggattgccccgttctatctatgcatgtgaattgtgattcagattttttgcttctggcgtgagttcctgagttgtggaaaagaatcggcgtcgagctcctctccggcgaagttgtggcacgccgccgccggaaccgcgtcgctggcggcggcgcggcttctgctcggcggcgaggcagcaacaacgacttgggccggaacgagcttctcactaacgtgtgggccgaaatgataattgggccgggcagccgcatggacctaactgttaattctaagtaataggagggacctagtgaaaataatgcagccacgacgcttcctattcccaagcccaatctgatccgcacaatattagatcggacagtacagatagtagcgatccaaaactggagggtataaaaagacaaaatctaatattacaagggccttatgaaaaaaattccaaccgtacgttctttgacccgatctgagccgcacatccgagatccaacgtctcacagaacaagccaattcatattgggccaatggcctatcagattcgactgggccgagaggacacggacaagtgggcctttgcttaactcgacgtgggcccaaaaacccttcgtccctctcacttcgcttctcttgtcccctcccccatctctgcgatccaaaggcggcggcggcggcgagctcggtggcatggcgatgcggctggcggcggcggcggcgttcgtgcgacgcctcgtgccggcgcgaaatccggtgatctcggcggaggcggaggcggtgacctgcgggcgcggggacaagaagaccaagcgcgggaagcggttcaagggctcctacggcaacgcgcggccgaagcgggagaagaagatcgagcgcatcaaggaccgcgtcgaggtgccccgctccaccccgtggccgctccccttcaagctcatctgagccaaagcccagcgcgagctcccccccgtcggttcgtgaggctacctagggttttcctttccctttttcgatttggtactcttgtccaactcttgcgcctgcgcccacgcttgcgtgggcacgcatcgtttttttagttcctcatattgggctgtgtcagatatgtattgtcgaatcaagctgccatatcgcaacattgtagaatgcagtccatatggacgaaaatatcatcaccatgtttgtttgtccagtgtccttttgctgggtgtcatctggatggtgataatacgcagtttatgataattggaaatggaatttacggttttggattgattgttttgtgcagttgctgataatgtgatccacggttgttaatacgaacacaaaatggatgggtaacaaacgacttagccaattagccttgttttgtttcgtttggcagttgattagcatatattcagtgaattatattttcttttaagaaaatgatgcctggtactttgatcaatttatgttgtaaactgaaataggtccgagtagtagcgagcagccaggcactcgaatcactagtataagtctttgtttctttgttatcgtcataactggattaatatgtgtggattcatggtgataaaaaaaatgttttggccgaagccaacatttccgtgcattgatgtttattcataactggattgtatcaaacttctgatcttaggttattctgcacatcgcatcttgatattcctaatgcattcctgatagattagacttgaagcttgccctgtgttgagattggtggatttcataatgataaaatatgttgactggtgtttaatataccatcatcttctagtgcatgagcttacgctccgctatattggtaattggtgataacttgtcttgacattcatgtcgggctaaagagacaaccttactgtttattaatactacttacttgattgtctttacaaagtcagggaaatgtatattattttgttgcacgtttctagctggagataggaccccgacactttatactcagctctcacatcatgcttgaagaaacatattcatctcattgcattgccaatccgaagctctggaagaattttagtgactctggcagtacaaagctctagaattccatgacattcctctttgcttagcgatatctgttgccattgcaaaatagacaaaaaaagaataatgctatgtgatgtgtaccaatggcttgctttgcacgtttcacgtggtgaaactttgtagcgacaagctgacactctaatgttagtttaagctatgctgcgagataaacaaattttttagtctcctttttcagtgctagatagggaaatagggaagagttccagaagggtaatttgttctggtcttttggtagatcaacttttgtgcatgcaacagcttacatatgcagatatatgctcatattagcaagtgttcctttatgcttttctttattgttatttgagacatcataatgtatactaattactgtaacagtgttccttttcaacaaatcctcatcacaattgtgtttgtacaagaataagagctaatagatctaaagcataatgaagaatcaacacacatattagtgtctttacatctataagatatacatggtatggagattttaaagaaattaaattatgtttataagttcagattttcagttcaatagcaattaagaatactaatggaataccccccccctctcctttctctcttttttaatttctaatgggtaacacagactggctgcactttatatagatcacaattgtgtttgcttccatctctagttacaacgttacccctatgtagatctattccctgctgtcggagaacctgttgattctgcatgtttattatgtaagaaatagtaaatcatactcgaacccgtttttccttccaaaactctacttggtacctatatgggtttgatgctaacatggacaaggtactggagtggcagagcccggatgataattggcactagtctatgtgttactttttatgtgctgttgttatcagtccatgtcatttgacattcacatttcacgctgaagttgtcggtaacaaattcggtgcagtgaagattaacatcttgaatgcacaatttgggctactctgacatgttggcaagttgttgatagtactagtaaattctactgcaattttctttgtgaagttgacaacttaatgtttagaaccaagtcttaatttacaatttatagatcatgctgtgtcaaagcttctgattacatatttggctgtgtactactgttagcagtcatcaccacatgtccacacactgttttgttgcttagatttgcaataattatatgctaggatcccaggttatccgcatggaaatttaacacgcctgtggattagcctggttctgaccaagaatccgaccaatcctgttcaagtacttactcgagtgaagtttagacattacataaataaaactaataacaatctgtctggttttgtcaatggataatggaggtgtattactgacgagtgacgaaccaagatggttgccgtcaggtatggatcatagatcgatgaacagctcctgaccatgacaggccagcgaccacaatggaaagattacgccgtacgtacgatcagtcttcattcctcataatttcattgttcgtactcctttttgtaacaccatttctcgtagcaaagcaaagaaaagcatcatgcgaattgactaacagcagcacacaccacataaattctgctcgatatttcaacgtcaccattgtcacctgagggccaatgtaagggggtgtttgtggttatcagtcacattttgttgcatctagtattagggaagtttaatcacactggcagttgtttagttgtagctatagttgtgacaagatttttttttaatatattgggtcaacttaaaaaagtttggtaagattcacttagacttgctaatgtacgaccaagaatttaattgtctcaacttaaacaagtgtaacaatatttattgacaaatggacggagctcctcttacgtaaagtcagagggacataggtccctgataggtggggccggcccatacgtcggtgaccatgtccctctaactttacgtcagaggagccctcaatggtgataaagtatgactgggaaccaaatacaaatactccgtgctttctccatcctaaaatataataacttctaatatttactccatccatttcataatgtaaaacacaactattttttttcatatatttcataatataagatgtgcatacatacaattaattagtatcttctcaccaccaaattattatt

SEQ ID NO: 82328 - DNA, 7377 bp, Oryza sativa
ctgtatatatatatgtatatgtatatgtatatatatatatatatatatatatatatatatatatatatatatatatatatatatatatatatatatatatatatatatatatgtatgtataacggcacgcgcacggcggtagccgtacgtctttgtcgtcgtccttcctccgatccatcccatggatccatggagtatgattatgttttagccggctccaccgcaggctaccatccaaacccccttcaattcatcaccctagcctaattaatttgcttacatatatatacaattgatcgactatatatgacacgaaataacaagtacagtactacgtcacttctgcttaattagatttattatactaggacatatctaaccttatcctaatttatagacacgacatagtatatccaacatagacgaaacttaggtggctgtttcagttctcccgctagcagatttgcagggagacgacggtgtggtggccacgtaataaagttgtttacatagtggtaagatgtgttctgggtaaaaacccggcctgatttataagccggcaacagtgacattctcaaacgccgccaccccgttgtgggcattgtcgtggctttctccttccatagtggattccttcaggtggaaacgtagtctcaatttaccgaggcgacggcggcatcctcagtgtcattttgaaggtctattttttgacaatcacttcttgagacggtttgtcctcttgcagtgccacttctgaccgttacaagatggccatagtgggtttgtgcaaagtaagaatggatccatctccttccttgccctctccctctctaatctaaagatgtggatggagatgagtacagttgggatgttgcgctcctgtgtattccttagcgggttgttttgctgtaggcgtgtagtaggtcttgtttttttttttgccaaatcatagtcttcaccggttatgacttgtattttttttatattaataggagaacccatactatcttatgcggtttgtttaaaaaatatagtatattgtgcatcagatgcaatgtcctctttggttgctaacaaacaattaagtgctgctgcttggacatatatatatatgatactagtacataatatgatgccggggccttcgatccagtaggctccgagaggaggggagaaacacctagccagctgtttggttttcataggatggaacaagattagaagaggacacgacaaactgcctgcctacatgcatattcgtgtgtggttaataattaatgcagggaaaattgtatatactatactgggtaggatgcatatgtatgttgtgtggtgccaaggacgaattagaggaagcaaagcatgcaactgtggatatgtgattattgatggtgtagatgcgcaacgatgaaaaggtaaaagacccccatgtgtacctcccagagacccagactgacgtacgtactgcctgtctgtcctacgatgcagtggaggcgcaggcacggttgattttgtgtccacggccgattattattaattaggattaatttgatacatgcaattacaattttacaaatatcaatataattcataaaatcttctacgtgtcactgaaatcttgtgaaattcaaatcatactatatattgcagtcttgtgtccaaacctctatctctgtttaaggacatgctatttcttcctccttggtcttcttcttcctatggaaagatattttgaagcctccctgctcctttcccttccctagctagctcaggtcgctcattctgccgtcgccgccaaggcctagctcggctgcccgttaatcatcaccgcctcggctttcccctacatatctagtactccacaaccctaggaaaggctcagtggcataggggcagtggacatcgtcaccaccgctgcctgctacttgtgtcggagctgggaaagaaacgccggaggaaagagagagaaaggatagaatatggaaagaccgtgcaattttgatggagttatgggcgacaatagcacggttaaattttacaaaatttcagtgacatgcaacaggtttcacgagtagtaatgatatatatttttttaaatacgctaaaattacattagtatatggatcaaacttaccattgttattatttagtggaaacacataacgggatactctaccttaagataagtgactttatagtcacttgcatgagttcactctgctattggtccgacgcattagcggctcttaagtcaggtaataacataaggtaaaggatctagatccgtaggagtggtacagcttgagcaatagtttctaagagtaattctcaaagagaagaggtaaagtagtagtttgaagcagatgaaagggagaggtaggtagggaaaattggcttgttgctagagtagcaaacggagtagtgtagtttgcatgtgggatgaatggaagcaatctgagtggagatcagggaagggaagggagggaatcacctgcaaagcggccaagggaagctccacaagaggaggaggaggagcacagaacaagacactctgccttaaggcaagtgattttataatcaacggcatgagttcactttgctgttagtggacacgttagtatgtactcccttcttcctaaattgatcatcatataagtttatgcaccaagaccgaggacaatttaaatcacatcaatcaagacaccatgcacacattctcccacaatgtatgcatcgattaaaaccccatgccgattacatcttagcatgcacacattctctcatactgcattaattgtattccgatgaaatccgtgtccatacagttatatgatgatcaatttgagaaattttggattctattacatgatgatgatcaatttaggaaggagagagtaataacgtaagtgaaggatccaggtccgtaggagcggtgtagtttgagtaatataatagttaataggagtaactctcataaagagaagaagtggtaaagtaatttgaggtatatgaaagagagtggtagctagggaaaattggcttgttgctggaatagcaaatggaggagtagtctgcatgtgggatgaaaagcaatccgggtggagagggaagggagggaggaaagaggaggaggagtagacctgtgaagtgcacaataaatatatataagatacgatatattttaatactataaatttagaaagttttctagcagtattagtagtagtaataataataataataataattggaaagaggaggagagaggggaggggaggctggcatcagctgtggtgtggaggtagagtggtgagtggcactgtagaatgcgtgggcccatggaccgcgacagggggggcccacacgccacacatatactgcaaccagcttttggcgtcttgtactccactgtctccgttcattgtcacgcgctccttcgattcctcttttctcctcctcctgaaatgaaagacaagaagagctggttgttttcgttttggctataaataaatctgttgcataagccctctccctgcttccgccttgttcaataatcaatatactcttctcctcgatctcttctcttgtccatctccaataattctccatgtacgccgccatgtacccggagaccttcggcttctctgcttacccccagcagcagcagccgccgcccgacgccgcctcctgcatctacaccaccgccttgccgctcatcgccgacccgcctgacatcctcgtgagctgcctcctcctcctccttccttgcacactagctaatccgcatgcatgtatccatggaatggattttcctctaatcgctctttctcttacccatggttcatgcatctgctctctctctctctctctttctctcatcacatcacacgtatgaagatatgaaatgaatgaagaaaaacagtcgctttctcttgttcctatttctttctgttttttcttgctccgttatgattaagatggcttgttggtccatgtactatctatgccaacaaaagccctcaataattcaccccttcactttcctcttttaagcaaagcaaccacaacatgtatgtacctcagacatttcatgagtgagatgactaatcgaatcgatccatccatcatccttaattgctgctgttgctttcctaatttctcttcaaacgcaaacgcttagctagcttcctaaacagagcaactaaaaattcactcactcacctttgagatttcttttcttcttccaccactactctactacatacatggcgtggcgaatgaatgaatgaattaattaaaattcatactctcacctttccttttcgcactcagctaataagcagctaagccaccgcgcgagtggtgcaagcaactggtcatgttggctgcaacttttcctttcctttttgtctttttcattcacatctttcttcctttttcatacttttttttctacttttctgcgcgcgcgcgcgcacacacatatattggtacatacatgcatcgcgcatgggttcagtctttgagatatttagtttagtggcagggaggggggatctaattaggttgagtcttaatagagcttttttggccaggatttctgatgcccctcctgtccatcagtatatgctctcggagcatgacagggacctgtaagttgacatgtactgcaccatcaacatactacatgcttgtagtcgtagatgtacccaaaaaaaaacaaaaaaacaagagagaggcatagcactacttgcaaatgcatccatatatactcacttttaattacttgccagccacactccacacacacactttgttattgcctcgcgcactgcttcctctcttctgcaatcttcccctcccctccccattgagagaggctacacttttctctactcaaattccctaggagtactttttttttctcgtcactctccttgccttaatttggagggaaaagaatatctacttactgctgtcgactcatgtagacaaaacaaaacaaagcacagtcattaatctgaccttaatatcttttggccttctctactttttttcccatagtaaaaataaattatgttttcactcctgaaacaaaaagtaaaatctactgaccagaaaatagaatgcttgttagtaacatgtttgcaattaagaacgttacatttcagtacttcattcattttaaaatgaattaactaagtggactgaaataacctctttgtcatctgtcgatcctacagggaaacatggcacaaccatcctttctatcagagtatgaccttggaggggaaggggacctgttcaaagctcctgaacccatcattgaagaaccagtgcttagccttgatccagttgcagcagccatttcgatgatgtctggcagtgagaacgtaatggatgaaactatagaggttgcagatatcagcgacattcagaatgactctcttttaagcgaagtattatacgagtgcgagaaggaactcatggagaagtccgcaatcgaagagactatttctgaactgctggacgtcaagattcctatgctgcaagtggaagagttccctagggaaacccaagtacaactaccggccatggagaaggagaagccatcagttcctgaatgttgttcactccagaaaagtgtcagttctgggtgcctcaactcagctgattggatcaatggaccagccaggccaaacttcctggacttccaaggattggactttgagacagcgtttgggttgaggagggcatacagcgaaggagacattcaggtttgatcatttttctcttgcggttatgttatgtacttactactgtatataggtaaggtagtgatagataaggaatcgttgtgagcaagcaacggctgtgtattgtaaagtgtgtttccgaaacacaggtgtcgagaaaagaaatcacctttgcccttgtatgtatatgtgcgtggtgcttctttactcaaattaaaggccatcaaagctatgacactgattttactatttctgcccaaagtaggccttttccttgtggttttaattttctttcaagatacttttacatgcaagctcctgcatacaaagttggtttctaagagactacctaggtgccaaagcgtacgtgtatatcctatggttttttgtttttatatactgtattattttagaaaggccgtgagattgttcgagtaaacatttgcagaccctgctaggttgttgaagaattgtacttacgatgctagttgtctttccaacagaatcttggagctagcacccctcgacccgggaactcaggaaacgctcaattagcatcttgcgagaggcttgtaaccatcagtgacctgaaatctgaagaaaggaagcagaagctatctaggtacagaaagaagaaggtgaagagaaactttggcagaaagatcaaggtaaaactatatattgtcctcttcctttttaatttttcaaagaaaagaaaaaagagaacataaggacagagaaggtactactacatgattaattagagaagctgattgaggctgatgaataatagtacaaacaaggagactgactgactgactgacactgactgatgcatcgtttggcatggttgcagtatgcttgcaggaaggctcttgcagacagccagccaagagtgcgagggaggtttgccaagatcgaagaaggcgacttgctcaagccaaggaagtagtaagaggaagaaacaaattaaagtaactcctggagaggacgagctgccagtgaaggaaggaaccttggcttctagaagcttctagctggtggaggaggaggaggaggaggaggaggagaggaaaggatccaaggtgcaaggcccagcctttgtgtgtagggggagggcgaggccaaggtggaagagaggcgccgtagtcgcggctgcacttgtcggaattaattttagctgctttggatcgtctccttctactactagactagtacttgtaattctattttccttccaatgcatgtgtaataataattagtaataatgctagtagtcggtattacttgctgcgagctgaaggccgcccatccatgtacaaatggctcgatgaagaaacttatcactagtagtaataaacttcagctcccttcaggcttcgcactggcactggaaggcatccattatctctctcatctcgtgtgtacatcttcttcttcttctcttgtcacgacgactctcgtacaagttaaaatgccgtactcaatcaacgcctatgcaatctttaaactagtaatacctccatctgtacaagaaatggagcttccaaatgctgcactatatatcttattattatgattaacaactcctttcctttcagttcgagaatgctccaaatta

SEQ ID NO: 82329 - DNA, 1720 bp, Oryza sativa
gtcgcgctgattcacagacacagtgtaggagtggcagcctttggcgccagcaacagctaatttgtggtcgttcgccgtcgcaggtgatgtatccatgtagtagaggtccaggctctgcggtgcgagcgccatgtcgccgtactgcatgacgtgggagccgagcgtgtaggtgccctcgtcggacgtccggttcttcaccgtcctgtactgctgccgcagcgtctcggcgaggcgcccctcctggtgcgcctccgcgtcctccatccacgccacgctgtagaggtccccgaggcaggtgtcgaactccgccgccggggcgtcgtggtcgtcgccggggcagtaggtgccccagctgctctcctccgcgttggaggccgtggtggcgtacacggagatgtcggaaggcaggaggccctcgaagatgctgccggactcgcacgcctccacgtacacgaccaggctcttgtacccgccgccggcgtgcttcttcttgagcgccttgaccaggtcgtcggcgtacaggtactcgccgtcggctggcatgctcaggacgccggggccgccgtggtcggcgtagtagacgaagacgtggtcgttggggccgctggcgacgaccttgccgctgccggagccggtgagggcggagcggttgccgaggaggacggcgaggaagttgttgacgttgacgtcgtcgccggtgtaatccttggggacgccggcgtagacgtcggggccggaagggtggttgaacatgagcccaggcctggggttgtcggggttgtgggcgatgtcgtcgtacatcatcaccacgatgttttgctcctccacgcctcccttcctcatgatctggtacgcgtggcacacgtccgcctggtgccggtagttatagaacccattcgaccccgcgatcagcaccgcccacctcgtcgtctcatccgacgacggcagccggaggaactcctcctgccaccgccaccgcccaccgccggcgacgacgaggccgacgagctgcagcagcagcaggcagaggagaccgcgccccatgattgacaagttgtgcttgatgatcgatcctgcaatcaagatgcttgttatatcgacattctccgatcctcctcgttccgtgcgtgacgtacgtgctacagcatactcctgataatagtataaaacaaaatcctactactacaagagggacagattgattactccatcagctcagctggcaccaaagctaagaatcctagcattcctactactattaacaactatttcctggggccgttgatttgattaaataaaactagaaaaagatactcctctagtacaacttattgttgcgttgcgtggtgtaggtgcgtgggtcgcctggcgtgtaatcttgagtgacagtgccatcctatatacggcttggcttattagtgtgcctgcctgcctatcatgcttagacgcaacagggatcgacttgcaaactaaactagccagtggcttatgcagcaccagagactcgccatctaatttggaactcgatcgacccggaattaataaacaagtcgtcatctcctacgctacgctctctgcatgcttcctatcatatatacggctgcatatatacgggatttgaaggattttgcatcacgtaagtcgctcaagccctgctgcacgtaactattgtaatttcaagagtaaatttcacaaaactacatgttttatggtccaagtt

SEQ ID NO: 82330 - DNA, 90633 bp, Oryza sativa
  unsure (1)..(90633): unsure at all n locations
cccccccccccccccccccccccggggcgcgccacggcgggaggcaaaagaaatcccacgagatatccccgtctccgcacggcaccgccacgtacgtacttacgctgcctgcgctcgtgcgtataagagcaagtttaatagcagagttaaatgttagctccaaattatttataggtaatataataatctatttatataatagttatctataaaaatatattacaccattaatatttggtttcaccttttatatatacaatgtattaaaatcaactgaatgtaacccgttttcttctgactttttcctcctttcttgatacgcgaggctatagtttcttctgtctctttccttctcttctcgatactaggttattgttagcttacagctgttattgtacttactctaaatgctggagtactgggtttttgtaaccgagaatgggcgtgtgggcgcgcgcggggcacgatgctcgtgcttgcctccccggtgcgcggctttttgccggcgatggcgaggccgcgggccgggcgggcgacggggcgcaccgcaccggagcgtgcgatgtgtgacgagactggcaggggtgggtgaggggacgccacggcacgtacacggtacaccactggcagagtactgggcttggtcgtctcatatgtttgctgctgctgctgctgcgtgcgttgcacctggtgggcaggagggcgcagcggagcatcacggcgaagtcggcgagcgagcggaacaagcacgtggccacttgcgggaaccctgtcccctacccccctcgccagaatccggatctactgtgcccgttcgctctccattggtacggagtaacagcctgcctggctgcctgggtggggtggcaatggcacggcggctatttttttttaaaaaaaaataaaattcagtttagtgtaagctttcgtgcgaacttggaatatttccataacgctgtcacaaattccataatgagttgtacgaatggtgtccttctaggatgatcttaacaacccctaaatcatgcaccctaccaattacttcctccgttgttttaaattataattcattttacattttagtcaaactaaaactgatttaaatcaatagaaaaaagtaataacaaattcaacaaaagacaaatatactattaacacatattcaattatagattcaataaaactaatttgttgctgtagatattgactgcattctttggtgtgggttgggaactaatctccaagcatagaaaacggagcgatagattaacgtattattaattaagtactccctccgtttcgaaatatttgacgccggtgactttttagcatatgtttgaccgttcgtcttattcaaaaaatttaagtaattattaattcttttcctatcatttaattcattgttaaatatatttttatgtaggcatataattttacatatttcacaaaagtttttgaataagacgaacggtcaaacatgtgctaaaaagtcaacggtgtcaaatatttcgaaacggagggagtattagctaaaaaaactaaaaaatggatttatatgatttcttaaagcaacttccctatggaacatttttgagaaaacataccgtttagtagtttaggaagtgtgcgtacggaaaacgagtaaatgtaggttgataaccaccacaaacgaactcaagaagtggaggctagtatatctctctgcaaccttaattaaaatcaaaatgccttataatttaaaatagaactatggagtactctctgtcacgtagaaaaacaacttctaaagatatatttgtccagatttatcactagaagttagtatttttttttaagaacagatgatgtattatactagtcgtacttgcaagtatcccatattgttctattcgcttagatttgcaattcaagtttgctacgtccaccagaacaagattcacttgtctaggagtactattgacttgcagaatgcacattgaacagtagtggcggccacagattataagacggtcacacctgattccccgcgcaaggcagccacgacgcaggagaccagggcgtccacctggcgccccgccggtcgggtcccacggcgacacggtgccatccccctcgccggcagcctccggtgccaacccaaccggcccaaccgccgatgcgccgcctgtcccagccgctgcaccccccccccccccaccacctccggatcctctgctcccgcctcgccctcgccgcctgacacgctgacacccccgctcgcccgcagaggatcccactccgctgccgcctccgcgcttgcaccaacggtatatatatatagctcgctctgtgcagcccacagctcgccaccatcagcgtcttcttcgtcgaggtcagcggcggcgacacggtgttgggtcatggcgagctacggcgacgacggcgtggagctcaccgagctgacgctggggcctcccggagccagcgctcgcagggccaggcgcggcaggaagaacggccatccgccgccgtcgtcctcgatgtaatttctagtgttcttacacggctaatggttttgtgatgatcgatcaatgtcgcgtctcctctgatggatgggtttcgttgttcggtttaggattcaggcagcgtacttcgtgaaggtgagcatggacgggacgccgtacctgaggaaggtggacgtcgcggcgtacggcgactacctcgagctcgtcgaggcgctcaacgacatgttctactgctccaccattggtgagctgctagtttcacctcgctgtatatgcaagagtaatctgccaaacattgatcagtaatggcggttaataatgttttgtgtacggtgatcgagcaggactgatggacgggtacggcgagtgggagcacgccgtcgtgtacgaggacggcgacggcgactggatgctcgtcggcgacgtgccctgggagtaagcaccgctgaaaccgcatcgctttttttatacattactgaaactgcgtcattgcactgttcatcatcgtttcaaaattatgcgaatgcaaaaactaaaggtaaacgtggaaatctcaacctgatgcatcttgaattgcaggatgttcgtgtcttcgtgtaagaggatgagagtgatgcgagcttgtgaggcgagaggcttgagctcaaacgcgtgacagaaacaattgcaggtgaggaggattaactccaattcgatcagattggtaaatacagaatagtgcatgcagtagcatagtttcctttgtctggaaaaaaaaatctgcaatatgatcaaactaatccatatagagaaccaattaagaacaaccgagtaatcgcactaagttcactaaccactaactgatcagactgaaactttgacttcttgagttctttctcactgccaagagtttcagactttcagtccatttctttactagggatgaatatacaattgattcagggtttggcattgttcagttcttttccactgataaactgatttagagttttcgttgttaattcagttcttttatactgcaataaactgatttggattttgcgtggttccaggttgaccagtgcgttgtagataactgaacctggacatcgatcgctcatgcaagtggtgaaagcgctgacgaaaaggatgacgcaattttctgaccgaccaaagctatgctgcgcacacatgattgatgcaacaacatctacagaaagaccagcatatcagcatctcactagctagcctggaataaatgttagttaagtagttgacactgcagatgcggtcaatctctccagcttgctgcttgcttctcacatgagcctgaatgcctctgatacggttgacttccctgatgagatcccaacattttagctcccttttgcctctagctagttgtaagttgtttcggctgtatatgtatgtatgtcgcatcacatgtacatggatcaagagttgttcgttgtacctcccaaattttgatacagctagcacgaagatcttttgagtctgagatgaggttcaattctgttcatgggtgtggtttctgcagacaggatcatggtgctcaactgctcatcacgtttctgtttttgctgcaccagtgcagaacccagttcatctgtcggagcagcgtgcggcaaggactgcgtggaattgatcttcatggaagatgttgctaattgcagcagcagcggtagtggtatccatccaagtaggcaaatgtaacagctaccgatgagcaagtggccatgttgttttcaggatttgtggatcatacataggtaggtagttatgtaccagttgccattaggccaactggagtggatggatcaaaaggagtccaaaagcttctgcgcgtccatttgttcggctcatatggctgcttgagctgcagcaacagtacccactacacaaaagacaacacgatcgctgcagctgctgctatgtacagccgcacttagggccggtttatttcgtgaacgataattcctggcgtgtcacactggatatacggacacacatttgaaatattaaacacagtctaataacaaaataaattacaaattctgccagaaaaccgtgagacaaatttattaagcctaattaatccatcattagcaaatgtttactgtagcatcacattatcaaatcatggcgtaattaggcttaaaaaattcgtctcgcaatttcctggcgaactatataattgattttctttctacatttaatactccatgcatgtgtctaaacattcgatgtgatagcgtgaaaaattttgtttaggtactaaacatgcccttattcagttgatgcagcagaattgcctcggtcaagaataggaatacgaataacgtcgctgaacttctgttgaaataatgtgtttgtttcatgaggatgggaattaattcctttcgtacggaaaacgaaatgatctattagcacataattaattaagtattatctatttttttaaaatatgaatttttaaagcaactttcgtatataaagttttcgtaaaaagcgcaccgtttagtgtttgaaaattcgtgttcagttcagtaagtcgatgattggaaatgcgaccatggactagctcatgttcatggcttcacggtaaaacaccggcaaagcattgctggctgccgtgccatggcagacagctgctcctagttgctggactgaccggtaagaacgggttgggcaacgaaaactccggctccggtgggtcggggattaaaactccgaacctccttgacctccacaacactgtcatctccacacaaattaatggagtttttacgtctcgatcagtcacccacgacgtgctcggtgctatgctcgtcggagacactcaatcaccagttcgatctttaaaaaggccaacggggtcagaaatgaaaactccggcgccagcgtttggagttgattagtaactccgaaccctttgacctgcacaacctggtcatctccaactttctctgggccgaattctggtgttgggcctagctttctagcccatacagtgaagaaacggcccaaatatggcatcacgaggccacgcggcccactcacaggtgcgcctgaatggtttgtatatgaaataggaaaaagtccacgttgcgcttatgtggcattagaaaaaccgagctagcttgctctgttagctaagcgacgaatcatagcatcacgcacgcgtagataatcacagtcacagatgaagaatctaaaccatttcttgtcaatcaccaaatttacaatgttttacatgcctaatccttctctataattgacaagaacgcgaggtgaaatgatgtgaatgtgtaataatcgatatgtcgaaacaaaaacattacacgagcgaacatccagtctctgtgtgtcgctcacgagcaggagcactgcgagctcttcttcatggcgctggtctccatgatggagccgacgtccagcgtggtccccttcagcgacagcacctcgccgccgccggcgccgccgtcgcgcatccgccgtgcctcgtcgagctccagcgccctgcgcgacacgacggcgaagatctcctcgagcagcgtgaggaaggcgcggtccacgttgtcgcccgacagcgcggacgcctcggagaagaagagcccctgctcctccgcgaaccgcgcggcctcgtcggcggcgacctcgcgccggcccgccggcatgtcggccttgttcccgatcagcgccaccacggtggagccatcggcgtgcgcccggagctcctccacccaccgcgccacgttctcgaacgtccgccgccgcgtgatgtcgtacaccaccatggcgcccagcgcgccgcggtagtacgcgctcgtcaccgccctgtacctgcgaaaccaaaaagaccaaacttcgctcaaatttcctccaaaaattcaaatatttccgccacgaacacatcagtctccctcgggaacacacgaattgcacacagaattcccgctttgttgcattgaaaacagatcaaaatcttaattaggcgacaactgcctaatccaagggcaggttagattaggcaggtaatgactgatttgctacatgacagtttctatcaaatcttctcctgcaaaaaggaggcattagtggttcttgcagggatcactttcggtggtcggcgtgctctgttctgacgcgttgtctttagcagaagctactagtagtagcatcgcatttcatagctttaatttcagctggcttcatgaaaactgacagccactatacatgcatccttatcttcccaaccaatacaaatccaatcttccacgagtccttgtaccgatccaattagctcccggcttaattaatcacaatgaaagcaaaatgaagctggtgtcttggctgacatgcatgtgacaccatctccctcgcagcaagcaacagaacatgagtcattgacgctatgtaagtatatggagtaagtatatggagtaccaaattactaatcaaatgcaagaacagccagatcagttgggatagcttgaacacgtaaacgctaacaaaaacgcagcaacgatcacgatttcgcagcgactatcattgcgttgctctattatatatactatcagtattatcacaagtaaaaatgatctttccagtatttctaagtcatgagtctagataactgcgtatgaactgatgcgtttgcgaggaaagaagatgatcggtgtgtgcatggatggttaccgttcttggccggcggtgtcccagatctgggccttgacgcgcttgcggtggagggagagggtgcgggtctggaactcgacgccgatggtggacttggagtcgaggaagaactcgtccttggtgaacctccccagcagctgcgtcttccccaccgccgagtcccccaccaccaccaccttgaacacgtagtcgatctccccctccttctccccctcccacaccaccaccacctcctcctccgctaccatcctttccttcctcctcgatcaccttcctctcctcttcttggttcttgattacttcagctatatatgaactctctaattaactttctttctcttcggctaagaactgtggtgatcgagctagatggatggctagaggctaggcttatgttgaaagcatgcagtgcttgcttttgagggaggctcggtgtgctggtggtctactaccctagtgatggtgtgtcctgcttttggagaggaggattgctgcaatgctgcagtgcagtgtgtgctgcacaaagggaggctgcagctatcatcgctgccttttgctgtccattccaaggccacctagcttggctaatacccaggccttcttttttgtttaaaagaaacaaaaaaaaatcaagatgagtccttgttttgttgccttttgcttttaacttttgtgcagacaactggacatattacaaaaatgtttatatgttgcttccggtttaagaagggtacaatagatagatatcatactttttttctttagatctcatacatgtgttaataataaaaagccagaaattctttaccatgcactgtggttaatctccattaatttaccattagtagagtagtactagactatcttttctttctgtttagattacccggagtacgtatgttattaaactgaaacagtgccaggagactgtttgctttttagaaaaagaaaaggaaagaaaaagtagtgaaggaacagggcaacatgaagaccttttgttattatgattaaacaagtgttcgagactatagctgaattatatagcagtggttgaccaacttggcttattactactacctccgtttcatactatatattccatccgtttcaaaatatttaacaccattgactatttagcacatgtttgactgttcatcttattaaaacaaattatgtaaaactatatgtgtacatgaaagtatatttaacaatgaatcaaatgatatgaaaagaataaataattacttaaattttttgaataaaatgaatggtcaaacacgtactaaaaagtcaatggtgtcaaatattttaaaacggagggagtaagactttctagcattgcctatattcatatggatgttaatggatctagacacatactccctccgtcctaaaaaaaagacaaaccctggtttccgtgcccaacgtttgaccgtccgtcttatttgaaaaaattataaaaaaaattaaaaagacaagtaacgcataaaatattaatcatgttttatcatctaacaacaataaaaatacgaattataaaaaaatttcatataagacggacagtcaaagttggacacggaaaactagggtttgcttttttttttaggacagagggagtaaacatctatataaatgtggacaatgttagaaagtcttataacctaaaacggaggaaacggaggaagtagttcccttagccgtgccacttcacatcacattttatgctattcgattcgatcgaaagtctgaaatgtgattgcaagttgcaggagctctcaagaactgaaagacccaacatgatgacgtatcaagaaaccagatattattagcagtctcattgcttcacttccaacggattataagtgcaatacttattactccctcctatctatctcgattcattaacatcaataaatgctataatgacttacattgtgaaacggaggaagtaatgatcaaaatataatttgtagataaaaaaatatatatttcccatataataacgtaatccacaatgctactgtgccacgctaaaatctctctgtggttatggaagtgacattttttacatgtaatccacaaaaaagtatcatacatctgtctcaaaaaaatactcaggctcttttggaacaaaagaaaaatagagaaattttggaagattcaaatccattagaaaaatttccctacatgatcctttggacggaatagcttccccaaaatcctttaaaattcttatggaattacccattttgtaagaattttagaggaaaattaacatgagactagacctcatgttttctcatccttgtgactcaaagtccctttaccttttctacggtgctaccaaacattttttttttgcaaaatcctatgaatttatttcttgtggtattcaatatggcatgacattatattcctatgattttttttttattttcagaatcatacgttctaaaaggagcccttaagagatgcacttgatagtacaagtcccgtatttaatccttgacatactcataattttttcttaaaaaatatttaaaaaatatttgaaaggatgtctctcctttcaaatctcattttttttaaaggaaccattaactgtgttgatgaccagaatgaaccagtgaagaataccacaccttcttgagtgtttagcagtgaccaattcagatctttgctttgtcaatcagcagtggtccatgcagaccttcacactgtacgtatgccgtccaagaacagaaaacaccaagaaaaatccaggtccaaacaaatcggcagtttcctggataaaccgatcaacaaatcacggttggaattgcgacagggccaaggtttcttctcctctgaatctctgaagtctgatccggtctcatgcaaggccttccaagtgtgccgtcgctgtcggccagtatgttacgcaattgcagcagtagtcatgcgtgtcatacggtattctcttcctgaatttgcaagcaaaaggaagagacgggaccaaccgagatgttgggtacgtgatcccggtggaaattctgttgatttcttggcaggtttctaaatttctggtcaagtagaatgtgtcaggtgcctgcgactgggtgaaaagtctgaataatttctttaatttgctgaatattagtagcagccaggttgatttttcccctattcttttctggaaattttgagggtaatggctagtgtgcagagatgagaaattgatcggaaatttcagtgtcacgcttaattaaggtgaaaactcagcaaatgatcaaagtccttgatgtacaagcaggtgtcaggactagttggatgatgtcgctatacaagagatagtgctaggaccagcaaggtttgcatcaatttatcatatacaaagtacgtgtatgtttaatgtccaatcaaattaatgccgactaagctcgacactgtagcaaaactatcatgctgacattatttgagcatcaactttattttttgatagaaatacatgttctggattatgaactactgataccaataaggacatgtacttaccaagttaattaagctagaatagacaagatatgatctatctttaaccaacacgctttgtacgttcaagcagttgcatgattagggcttgtttagaggaacttaaaattccgagaaacaaacaagcaactaattggtagtcagcttttgataatataaaaaaactgagttttccaatttctagcttctagtttattttttggattctacagttacaacttctcagaatctgaatgaaaaactggattgtttgcaataatttctaattttggaagaagctgcagctgtcagaaccttccccaaacagacccctaatgtccttgcagagcatttcttcactcaatcacaacctgcaggacagttatgcaatgcagctttcttcacatgaagagaagctatgcttaccgttgacggtacacatcaattctcttgtaccagatgaatgcataaaaaatgtcaccaacaggttttatttcaaagtaatccaaggacaatcatccatgactccatacttacagtactactacatggtaagtcaaaagttacatgttacaacttcagtatcagggagcacaagcaattggcttacatgtcctgcagatgcaacaaaaatgcatctcaatctgtgcctacagagaaaaaaaaactgaggcccagaaaccagtattgaacaactgctaagtacatgctgaaattcccatacatacagtagcttatccatctccagaaaacacatgcatattgttgtttctagtaatgctacaagtctataggtgtgccctgttgttgttgctggggattcagtgacatagcatcttccaggcacaacacaacatttttcagccaacattgccatctgcaaaagaacacatagagcctctgaacaagatatcagcttatttgaaggacccattccaatttgattttgtcaaataccaaggatataggtggtgagatactcttgtccttacgaatcactgtaagactatttcaggcaagaaaaactactatgaaaaaccaatgaaactcaccgaaatcctttttgtaagaaatggtacaggagcagtcttgcaccatgaaatcaacctgcaaacaatctaagccagataacacattcataactcactactatacatgtgccgatgcaccatgtatgtactcattgcaatcatccacagaagaatagatgtaattcagatcacacagcacatgattaaacaatttttcagccccatctactttgtttccatccaaccaatagttatcaacacatccataccaacctacacggcagaatctttgcaaagcaacaacatacaacactaacggtgcatcagagtcaagtttggtctagcattgtatacaagtctccctagagattctccacaaattttgctctgcattattaattcaactccacccaagaaacttagtttctaacacgaggcccaccaattggcctcctgcgaggagtgagagagaattgtatgcgcaggttggaagactcatggtcatgttcatcaaacttatagcctgcaaagcaaaacgtcatagtttcagagccaaattcaagcttataacctgaacaagtattagaagctcaaagtttattctctccctaccaatgaaacgtctagttttatgatggaaagcactaaagttgatgtgcacacaaatattattacatatgatatagcacacatagaatgacagtaagctggtttcaaagtggaacaaggaaaaattatgatatttcgaaataacaatcttagttttcagcaaaaaaataataataatcttagtttagttatctatggactacactctacatagttcagtcatcacactaaaacctactggatgtgggacaaagggaaaaatattaagaaaaataaacagatttttaataagactaaaggcacacaaacataaaagaatgaaactgcgcgcaagcactatctaacgaaattggcaacataactacaatgcatatggatgcagaaaatatgatgttataattaccttgcagagtctccagagcagcacgagcttcaggaggagatgaaaaatcaacaaaacacaagaggttacagcttccagcctgcaaaacagagaggggatttgacatgtaagcatgcttggctttgcaaaaaataacagggaaaatttggttcacaggtagcatttaacttacatgcctaatctccttgttgaccaatctcacctcacggaaaccagaaaaggggcgaaagatatctgcagaagaaagagttaagggcaaaagcacctaggaggtgtaatatgaattacatcgcaaaagatacctacactaattatagctaggaaaatgtgattttagtttacaagcatagaaaaggatacgtgcaacctctctctttgtgcagttcgaaggtagtccttccacatagagagttcttgattcagttattgtagcgccatggtttccactgtccatgcctgctgaatatgtggccatcccaccaagtggaatagcactttggttagcaccagcagcataggacatctgcaaccagcactatgttagtaagaaagttgctatcctcaaattaacaagcttataattgatataatacctgattgttcaagcgatggacataatgggggctcattgcttcgtggaagaggctgtttccctgtccagaaggcatgtctgcaaacaaagtgtaaagtgttaaaatatacaaatgcacatcttttttttttgactgaaacaaatgaacatctcacttggagaaaatacattaggaagaaactactgaacagtctcgtcaatattttttccctgtccatttaagaagcaagctatgacaaaaatggggttgcaatagaagcaaacatgtgaagaattaatgatgtgcggtaattacaacattatctaacaactaaaaagccgccaaatctatgtgcaggtaggcaatcctgatacatagtttcaggtagctgtgcatagcaagcaatcattttcccaataaaatgatactaaaaaaggactaaactttattgttgtgatgatagatgcattcagaattggcggcaaacaacgtaacggcatgcaagcagcaaattcctttgtagagattattagaacctttttacacaacaaattcctttttttttctcttgttttagatttcagaatttacaaaccatttagccatcaaaatagtcagaccgactactctataatagaagccgaaaccttttgcctagagcctaccaatgatagtgaaatattagcctaaccagagattaattcaatctaacatatcatataaaccatgctacaccatctaactttaaagaaaacaaagaatcaatatgatcttgtagattcacatatgaaaattactagttcccatcttacgacattgaggctttatcaggaaatgaggaatggtttcatttttatgtattcatttcaaacaaacatctaccattggaacaattcaaaactacaagcctgcaacttctcctaccatttccttggacaggttaatagtacagcgtggcagggaaaacacaaggccggccctgagtcagggcagtcagggccccagaccacacacgtattgtttggaagcccaagcctcattagcagatgtccaacaagcatatcagtctgcgcaggtcacgaagcatcgaagctatctcattcccctcgacccttatctattcccgaaactacgctgggttagctagcatgactaaagcctaattaagtgtgtcatttgctgcatgtaatcccgtcattcagccactgcatatgtcgtactctttaagttttttagatctcactcctttgcttcagggttgaataacaccccaaagaagattgacaaaaaaaagatggaactttgatttcttttggttctaaagattgccattagagttgattggttatgaattcctcattcctgtgagttgttcataataattagtttctctagttagtcagcaagatctccttgagttgagtggttggttggtttatctcatagctttgcactgattttctatagttggtgtgtgtgtgtgttttccctttttaggagtcctctaacagattatacccttgaggagattggcttccacgagttcttgatgatatttcggtttctacaagatcacaaaaatccaggtgattctgctccctattattcagagtttcagacttataactgataatatctggatctgtaattcaaacatgagggatatttgcaatttattaagattactgatgatgatacattcaaataaaaggcctctgattttttctcgccctgaaccccaaaagttcaggacaacaagatctgcttataaaaaaagactagcttccactatcatcatctatatgttctatagcctaaagccctaaaccccatggatacccacaacaaagctacctatactttcttacgactaatctagcaggcaacacaaaattaacaatcaagaagaggaggaatgtgtgggcgagcacgaaccgaagtactccgggcgctggcgcttgaacgacggcggggggccggcgggcagtggcggagcagccatcgggggcgcgaccggcgccacggcgggctgataccccgcctgctgctgctgctgctgccacatgagcgcgggcgtgggcacaggcaccggcgccggcgcctgctggcgcgggtcgacggcggcgtactggtactgccagtagctctcggcggccatcgcgatcgggagggcggcggcggcggcgcggtgggggctagggttcgggaggggactaggggctagggttcgagagataggggaatggggaatggggaatgcgtgcgcagccgcggtgaggggaggagggggcgcgtgttttgtagccagcgagcgcggcttcggttactggtgctgacgccagtggcgctgtcgctgccccccacacagctgtcgtcgcgctccggggcagcgcgcgctggcggcgagcgcgggcgcgcgtggagcgcgaggaggggggagcaagcggcgcgcgggcaccgcgttgcgccgcgccgcgctggtgtggacgcgcgctacggcgcggcgcggcgcgcgtgacggctggagggagagagaagttgtgcagtgtgggctgccttcgacaagcgtgtcgggcctgcatgggccgtgatgatgggctgggtagtttttgcgtggggaaaagtatacctgaggtccctcctatggcggcattgactccggttttggccgacgtggtagctgacttaacgtgggacctacatgtcaatgacataaactcttctcattctccccgttctcacatcaggccggtgcagagcgacagatgccggcgtgacgaggcagccggtcgtagcaacggggagcggcggagaggcggcatgggaaagggtcgtcgaggtagataccggcacgggtagtcagccggtcgcggaggtggcgggggagaggcggcacaggaagagatcaccggggctggtcgctaggcaaagcagctcgggaggaggcggtggccacgcaacgaccagccaaccacactgatgtcgccgccaaactactcctccctcttgctcgtcgccgcccgatatccaacaccttaggccactcctcctcctccttgccgctacgagtagtgaccgatggagaggagctacacattggcggcggcagcgggcctctctacttcccctcctagatcttcgccccctcttctccggctccatcaagctctcgctgacggcacccctgcccagacatccttcgtgagcccaccgtcgttggggggatgggctcccgctttcctcgccattaccggtcaagcttagtgacgctgctgactcctagctcctctccaccggccaccgttcttctccttgctcgtcgtcaccaacaagcgtcgtcgctgtcagcgagggccaccgtcgggcaccgcgcgcctccagttctccccgcccgtcgccggtcgcgctcgccgcgctggcccttctcctcgtcgaccgttgcacacctcagatggagaggactggagaagagatgaagagaggtggagagagagaggaagggaagtagtcactaacatgtatggctcatatggggtccaatactgactcagctatcacgtcggtaaaaaccaaagacaaaatcacctaaagacctagagagcctagttttctaagttgagagatgctatatatctcgttttttggttcagggatgattttgtaattcagcgacaagacgagggaagtcaggtataacttttttccttttgcatgggattcgctgggtattgggccgggcctttctttggaacatggtggaggcctgcgcctatagggctgggccttgccttcagccacagttggttttgggccgggcctttctttggaacatggtggaggccagcgtctatagggctgggccttgccttcagccacagttgtcatcggagcgttggatgttgagccggccaagcaaaagcctgaaaaactaatggcaaattttgccacatgacatcgtgactttgtggttttagctgtaggacatcgcgcgaagtaattttttggggaaaacactctcaaaatgtggttatttgatggtggacaccgcacccattaaattaatgatttcggtgctgagtagacgagatggctccacttttttacatgacttaccaaattgccccttattcctctttctcttcctatcttcttcctctctctccctcgatggcgcggctcgcgatgaccgtgcggcgcaacgcggcacgcgatgcaggcgactggcgacgcgacagagggcggtgggtgatgcgatggcacactcgtctaggagcagcggccagcgcgaaggtggagcagcggctggcgcggcttgcggcgaccgtgcggcgtgatgcaggcggccggcgcgcgacgcagggacgcactcgtgcaggagcggcggtcggcgcgatggcggagcaacgaccggcgtggctgctcggcatagggcagcgggcgatgcgagcggccggtgaagggcattgggcgatacgagcagcccgcggcacagggcattaggcgcacttgtgcaggagcggcggctagcgcgaaggtggagtagtggacggcgcggctcgcggcaactgtgcggcgcgatgcgggcggccggcgatgcatcgcagggcagcgcgcgacgcggtggcgcactcgtgcaggagcggcggctggcgcgatggcggagcaacggctggcgtggctatgcggcaccaggtacagcagaagaaggccgccgccgccgccgtacacgactgccgccgccgccgtacacgactgccaccgccccgcccccacgcccagctcttctctgctccgctccctgaccccacggcgtcacccagcgcgtggcgctccctccctcgccggcgtacgactccaatcagctggcctccctcttcggattcctgcttgtgggttagcccagcacgagccatctccttcgcgttgacatagaggacggagaagcgctagccattgcagtgtggaaggaggggatagagagaagaaagacctgacatgtgggccaaaggacattttagaaatttcacacaatttatctctcctattcaaccggaaattactaatttaatgggtgcggtgtccaccagcaaataaccacattttgagagtgtattcctccaaaagtcacttcgcgcggtgtcctacggctaaaactgcaaagtcacaatatcctgtggcaaaatttgccaaaactaatctacacagctataacagcaggtacaatagcaagctataagccagctataaacatattttaaagagataaaggaagagagagaagggcagcgggctacagaactgtagccagctgcagtacgaactccaagatgtaatatgtgtatgataggtgagaccagatataaatagtatagtaagcaactattgtatgaattggctattacattagctaagatgatttagagctagtagtgggctgcactattgaccttgctctaattgttggtggtggtgatgacaaaatgttggtagtcggtgatagtaaatctgccacaacaactgcctatcactgatatatttaaccctctatcattgacatatggcgtcggtgtaattttgtgctccctaattcaaacactcccgatccctaatatgtccgttgattccgtagatcagtaacctgttaatatatgttctttaaaaaggaccttggctatttgctgcggcattcattcacactaaaatactaacaaggccatgaaagatacatatggtaagaagtacaatggtgcctcgagcaaatctactagtaagaagtaaaatggtgcctcgtttacggtattccaaaacttgagcatatgagccaaattcaaatttgcttacaagtttaagcatatgcataagatgattaacgaagcaggtccgagttgaaacgaattcgacagtaactgaaatctgtcccataaaaagttgaattttcaaggggtccaccaagcaattaacgaaaggtcgcaaccaatcaaggggcttattggatggcttcgacatcttttcatcatgatgctaatttgtccggaattttgtaaaaatcaactcttcgtggagcggagtaaacttcatctcatccgctcgaagtagaaaagaggggcaaatcaatatacttctgtagttacaatgtctttgtaccatagccatatactccccgcgttgcgtttcataccataagtcattcgttttgacatttttcctaatcaactctttttttaagtttgtctaagtttacagaaaaatataacaacattttcaatacaacacaaacatattatcaaatatacaatgttatatataatgaaattaatttggtggaatagatattgctaattttttctataaacttaactaaacctaaagatgtttgactataaaaaaagcgacttataatatgaaacaaagggagtacttaactcaaacaaaaagcaaaagtttttaacttaagacattcactccaagcattacaatttaaattcagttacagtttagaccttgagaaaatacaattcacgctagaatacacttgcaaccatacgaagcagtgtttctgccaaactgaaaaaagaaaagtagatagacaagcttaaatatgtttaggatgaatggagtacatcaaaacgatcataacataagaaccattccaaaatctgtatgatgcataagctgttgcaccatggaatagaccactctaagaagggtaccacttaccaaattcacatagctccgaagagcaattcccctttgccctgaatgagaacctcagtgaaacatgttccattgcctttgcatcgtccctggaaccatgatcttagtggcatcaccgaacacctttccttagtagtaactggtgatcactgcaaaacacacagacctttgagcgtatcaggcagaagttgaggtcacatcctatgaatagatttcgtatcaacatgtctgatagttacaaccacattagtgttgattttttttcaaaattgctgcaggtagtgacaaaactgtgctataaatggtagtactattattacactacgtccattaaacatttcaagtttgtctagtcgaatgaatttatattgtcatgctggaacttgaagaagcaaataatgcagcaggagcaaaaaaataaatttgccttattcttctagtcagaaattaatgttgcaggatagattttagaattttgctatcaatggcagttcttttaccgcaatatccatgtcagtttatttatggtggaaagctggatggcaatggccatttcgacaatcagaaagaagaaacgatcactacccacagttaattgctagaaaagtaatatgccgtgtttatcttgtctaataggaaggacaaaattcttctctcttgacaaagaaggaaaccggcgtttcatttattagtcagtgagtataaatcaataaatgttctattaccctgttgctacaaacagccagaggttgaataacctagcatcagcctacgaagatacagccaagtaatggataatgataacaggtggtaaaggtggttaaggttgcaggataaccaggaccccctttctaataccatctcgtttgtttaaacctctaacaacaatgttcagaacggcctttcttcccaacttaaactttcaatttattgcaatagtaaaatacaaaagatcattaaactcacacaaccacactgatttctactcctgcttgccaacacatctataaaggtaattaggccctttatctagcatgcacgattcaataaactggaatcacgcttgcatgttttggcagccatatgtggttctcacgttcatgaaacattgagactaggtgaatatccacgcaagattaaaagtatacagcacaaccaactactgttcctggtaatgaagctcaaaggataaattaggataggttcattcatgtcaaagagcatgatttgtctaatcacaccagcaactgatatgagcctatgtaacaacatcatgcttctactcaccaagaatcgcaagtttgcaatactactaagggcgtgctaccacataaaaaactccagtactttaattagcagttcctcaaaacacaaatgcattggtagaagctgtatacagtcaatgccaatgggaacaagtgacagaactaagattttttaaaaaaaggttattacttttatctttttttaacagaaatataccatgggggccaaaaaaaacaaaaacaaatctagaccctgctgacttacaaacggttggaaggggttacaggttgttgtagaatttaaagggtattgaatgtataatttagtaacaaaatagaaaaatgtagtagtaattttgccatttcaacggccaattgacaaattttactgatgcgtagaaatggttgatgtacctttggggaaatatgagatgcaaattagacgattgttttagaaagttataaaggaggataaacccccttctccccccccccccccccaagatcaaaaggactaaaaacaattgcctattgccaatgggaacaagatcaaaggaggataacaccataaggacggactaggtgactattgtgagcgaccaaacaagtagctcacgaagtgcggaggtgccagcccagcaccacaggctgctctcttccgcaatagaatgcagaaccacctgaacattggggctttgttccctcaaacacacatgcattccggtgcttctatatttcctagcttactagaatgatcaaggagttgagcccctttctttggtctttaggaacacctctgttaacttaccaccaactagagagacacgcggtagaccgaggcacggaggccaacatattcagcttctgtagaatacatgtccagacatggcggggaaatacacatgagatgagaaagtgccgaatagattcatcatcctggtcgcagaagggacaagcattcgggtgcgataaacctcgcttagcaagcctgtcaaccatccaacaccagttgttaaacagctaaccaagtgaataacttgcagcgaagctagcccaacttttccaaattcacttccaaggagcaaacttgatagaccacatgaaataagcattataggccaacttcctgatgtagatgccttctcaagtgaaataagcacttgaacaataaaagcaccatgtggcagccaaccatcttctgttattcagcgcttgagccacagtgcattgtttaaaggtgcacttagagatcagctagcacaagtttggagctaattcaaatatcgttttgccatgcagacaccgatccaaccaaaacttggtggtttccctgttaccaggggtgtatccaggattttggggcaccggtgtcaccactcacttatacttatgcggtgtttggaagggctccatttctaaatatttctaagctaaggtgtccttgagctgatctttttagctagagttgtcggtagaatattgctgttgtttcaatgagcatgttcatttgagactaattaaagtttaaggtttgaatcacttaattttagacttaattctgtattgagcaatactttgagagttagaacctaataagacatacaaatcctttattcttttggtcagacaagcaagttattgaagttgtttttactaatagctaaaaatatggttaacttttaatagttgataatagaattattggcctaattacatggatagaaacattagctaaaagaaataattatagtcaacagatcaaatattttaaactgcgacattagtggtggctgatggtaccaaaacatatactccctccgtttcacattataaaaagttttggtctttttatctcttgtctaaattcactaacatacatatgaagttgagcatatatatgtagcgcatgtggatgcatgaatgaatctattcaaaatctaaaacatcttataatgtgaaagaggaaggatgatggatgcatgaatgaatctattcaaaatctaaaacatcttataatatgaaagaggaaggatgttggaaaatagattcgggctccagcacctaccacaccagttaaactgtttaagttttcaaagatggagctatattgtttagcctctgagctgctgcaatttagcggctggggtcaacaagcttgcacagttgcactgccgggggtaagtgcgtaaatgcgtacaaatgctagcaatacactggattggttggatggcatccatctgagaccagtgatactactgtacatatgcccctgcctgtttccaacaatggtttccatagcaactccaaaagcgcactgacattgtataattatattttaactgaattactgaaatgacaaaatagtgcctggtttcacaaaaaatcgtgaaagtagataagcctgttggcatgtggtttaagatagaagagcttgctactaagttgttcagaatagcaagcatatcctttaatagtcgtagacatgcaacaatggtctatatagggtgaaacaaaatgacagaaaaaaaatgtactaaccacaaatgaagatggcatacattaatcattgtatatagcactttagttggcagccacacttttttgccatgaaaagtgtggctggcacaactgtggcaatttttggctgaaagtgtatgacgggtgaaatgggtgcctatgaaaactaaactgctatacttcaatgcatgttaaagcacagcaaagaaaagcatctaatgcaggtgcagagacattaactagagaaattggcagcataagaaaatgcatatggatgcagacaatcataaatttcataggtaaaaatgatgttgtaattaccttgcagagtctccagagcagcacgagcttcagaaggagttgcaaaatcaacaaaacacaagagattatataccttccacctgcaaaagagaacaaaatataagcaatgctaggctttacaaaatatgaacagggaagttttggttcataagtagcatttaacttacatatctagactccttgttgaccaatctcacctcaaagaaaccagaaaggggcgaagaatatctgaagaagacagggttaagggcaaaagcacctaggaggtgtaacatgaattacatcgcaaaagatacctagactaattatagctaggaaaatgtgattttagtttacaggcataaaaaggatatgtgcaacctctctctttgtgcagttcgaaggtagtccttccacatagagttttttattcggtccttgtagcgccatggtttccactgtccatgcccgctgaatatgtggccatcccaccaagtggaatagcactttggttagcaccagcagcataggacatctgcaaccagcactatgttagtaagaaagttgctatccttaaattaacaagcttataattgatataatacctgattgttcaagcgatggacataatgggggctcattgcttcgtggaagaggctgtttccctagagtcaagtttggtctagcattgtatacaagtctccctagagattctccacaaattttgctctgcattattaattcaactccacccaagaaacttagtttctaacacaaggcccaccaattgacctcctgcgaggagtgagagagaattgtgtgcgcaggttggaagactcatggtcatgttcatcaaacttatagcctgcaaagtaaaacgtcataatttcagagccaaattcaagcttataacctgaacaagtattagaagctcaaagtttattctctccctaccaatgaaacgtctagttttatgatggaaagcactaaagttgatgtgcacacaaatattattacatatgatatagcacacatagaatgacagtaagctggtttcaaagtggaacaaggaaaaaatatgatatttcgaaataacaatcttagttttagttcagtcatcacactaaaacctactggatgtgggacaaagggaaaaatattcagaaaaataaacagatttttaaaaagactaaaggcacacaaacataaaagaatgaaactgtgcgcaagcactatctaacgaaattggcaacataagtacaatgcatatggatgcagaaaatatgatgttataattaccttgcagagtctccagagcagcacgagcttcaggaggagatgaaaaatcaacaaaacacaagaggttacagcttccagcctgcaaaacagagaggggatttgacatgtaagcatgcttggctttgcaaaaaataacagggaaaatttggatcacaggtagcatttaacttacatgcctagactccttgttgaccaatctcacctcacgaaaaccagaaaaggggcgaaaaatatctgcagaagaaagagttaagggcaaaagcacctaggaggtgtaatatgaattacgtcgcaaaagatacctagactaattatagctaggaaaatgtgattttagtttacaagcatagaaaaggatacgtgcaacctctctctttgtgcagttcgaaggtagtccttccacatagagagttcttgattcagttcttgtagcgccatggattccactgtccatgcccactgaatatctggccatcccaccaagtggaatcgcactttggttagtaccagcaacataagacatctgcaactggaagataattactatgttggtaaaaaagttgctagcctcaaatcaacaaacttataatcaatatgctacctgatcattcaagtgatggctatagagggggctcattcattcatggaagaggccatttccctgttccagaaggcatatctacaaacaaacgtgtaaagtgctaaaatatttaaatgcacattccacttggagaaaatacattaggcagaaattagtgaacagtctcgtcaatatttttctgagggcaaaagcaccaacgaggtgcaatatgaattacatcgcaaaagatatatttttacctagactaattataggcaaatatgatcttagtttagcagcacagaaaaggagcaatccatgtgaattgaaaaacacattcctagatatcagatgcactaaatttgcaaaaatacagtaatagaaatgtttacatgaaaggacacgtcaatcctctctcctcgagcaatgctaaactagtgtacatcccacttggagaaaatgcattaggcagaaactagtgtaaagtgtcattaacatttttttccctttccatttaagaagttacaataaatgggagtgcaacagaaacaaacatgtgaacagtcccctcaagcgagaggggaaacggaaagagaaaccttaacggagaaacaaaaaaccacagaacccccacttcagctcacaccactgatgaatcctgcaagactgcaacaccaccagcgagcagatcaaccaccagccagccagccagtaagacgcaccagattactagagaattagggaaatctctgacaggttgatcctatattttgtacatagcagttaccatggcatctatttataaaaattgacgggttcaccaatataattttgtgaaacaactaaaaaaagcaaagaaaaaaaatacaagagaaatttctttgtctgggttatgaaatcaggcaattgaggtaaccattcattttaaagaacaacaaagattgaaagccattagtgagaaatgttagtgttgtactggggaattgccattatataaaaacaaacaaataggtaggaattgcccacaaacaatgacaggtaaaatgaatgctaaatagtgtcttatgaaggaagaactgataattcactggattacatgttactccaaagtacaaactacactataactttccatcatacgtaacacctcaataaagcaagaataattacacgaagcaacagaggcccagctaacaataacaatcagcatacaacatttacactaagaaagaaaaaggataagaaaccagaaatgttgtataaacaggtgacttaatgcagatataggccacataattttcagggtaacatgggttgattagtcaaaactattttggatgccccaaaaaattgccggtattgcatcatccattgttattaggatcgatatttcttctcacacttctctttctccgccaaactttatctcccaagttgcaattttgagcattgaagaaacaacaacaacaacaacaacaacttagtaccaacaaggcaacaactgctacaaacgcacgcatcaaatgcagaacaatgagagatcaaactgcaggtgcatggtagaagcagtggtggaaaacattgaggtgtggccatggccaaatatcagagggcataacaacaagagaagaaacaaagtttaaatccaaaatttctgttccatttctcacctaatttttaattcttgcattctgctctgaccacaagaaaagaaactcaaaacggcaagaaagacaaatcggaagcttcttctccatcatataaccacataaaagacataactatgtaaaaaaaagtaaaagacataactatgtaaaaaaaatgtaaaagacataactatgtaaataaatgtaaaagacataactacatagatactaaataaaatgtgaaggacacaacttagggacataatggcatattgtagtaccacatgaaaaattaataaggccaaggccaaccaaccacctagctcaaaaaggcctacttagttggtgaatgaaatggtggatgcagatgaagagagcacctctaccagatgcccacataaaaaggcacagataagatgagactgagatggggacagtggtgtggtcagtaactggggaggcattaggtgagtcacaatttaccggtggtatatgttttttaatccatattcgtatacggtggatgtttctttgatagaggtgtgttggtgtggattgaatgggcttaattgtgcaaaaacatgtagtgatttgttggcagttactattcatgtgttgtttgtcagttacatgtgccgggtggtgttgcatgacatggggttagagtgtgtccatcaagatggaggtgatcaaataatacatcatgaaagtgcatatacattaatgtggagaaaaagcctaggtcaagggcagagccagggaggggtggagggaggtcaggcctcccccaacggcgaattttttttcttaagtaccggctaattaatcatcaaatacatgattatgtcatgtacttggtgcattggcgtattcaggcttccaatgctaccactaccagctaggattgcatgcaaacaagttatttgggagacatagcagtatatcgtttttagatggtgatgactgcttcctaggctaagcagacctaacaagctaacacgaagaacacaacacacttggacagctcagttgttccaatgtccgcataccgtgttctaaatatgcatttttttgtaagccctaatacttatttttatttacctcttcactttaatttgaaatactaaaatcttcaaaacaaaaaatatgtatgtagccaatgactaaataataggcaggaaaacatccttttgtatggtcaaaactaacaaatatattcatatgatttattatccatgtcaaaatgtttcaattttgtgcgtattatgatgcaacttttttatggtcattgtcactcggtaatgagcttaagttggccccctcaagtttaaatcctagcttcgccaatggcctaggttctctgcaaatcatggtaagaatgtgtatggtgcatatctaaacgagaaatttcagaatttgccaccgaatatgcaggcttctaaggatttgccacgcaatccacactcctttcaaaatttaccacttagggtaccaatttcttcgttccataccactccgtttgcccgtgaagtcatgccgtctatcttttgcattggctccatcatcttccatctgccaccaacgtactttgcgagcccagtgtgcatcgccaccatctatgaccacaaccgatcccaagctagccaactgtgtggaagaagcaccagcccgtcgaatttctagggtttgggagggacatatacgccgcacttcacatgtgaggagccagagaatgggggtgaggggagtccgtgcaccgccgctgccgcttcctattcccgcggtgcaccacggatgtgtgctctcccgcgtcgtaactcgagtgttttgggggatgggatcgacgagagggaagagggaggatgggaccccatgcgtcgcagcttggtttctcctgcggtggatgctgggaggtgagagccgttagagaaggagggaacacgagcgtgtcagctccaccttgcccgtgacgtccgcccacgcgacaccctcgaagcggacagattacgctgacacaggcagcggatggatgacgttggcgccgagctgggttcgcgtgtatggcggatggacgaggatggagccagcggaaggacagaaggctcagctgcacaagtggacgaagcggcacggaatgaagaaattcgcatcctcagtggtaaattttgaaaggagtgcggattgggtggcaaatccttaaaggcctacgtattcggtggcaaattctgaaatttctctctaaactacttaaaagggcaatcgttcgtccgccctccccttcctccaccgcatgcaatgcaagaagaaataaacatgcagggcacatccttgcctccccccccccctcccccacccaccacaaaaaaaaggttttaaaaacaacccaaaaaaccatcccaatgggctaaaaacagaaacatgcacaattaatctttcacaaatccattgcaatacacaggcattgactagtattgggaaaaccacaaccatttctttcgaatatgtatggttcatttttatcacataagcatatggctattgagttgaaaaattaatagatggccatctgagaatggcaagttatttgaaccatcatgctgtcagcagcgctataattgtgtacacacaaatttccaaacaattgccaaaatggcaattactaatgctcttgctcggttcgagatagcaagtgtaacaagaaaacatcctatcgataaatgatactccaatattaaaaggaaacaggagattgcattactgcactttcaataactgcatgaagtaagagcggcaaaaaatgcagtatcatgcaaatcctaagctaaccgatcagatctacgtgaaatcgccatcaacagattataaattgcatcgtctctttggtccaaacagacattccaaatttcttcacaagagcagttgaaaacatttccctaacccaaaattgaaactctacaagaaaaccttatgtgccattttgcttaacaaccgaaaagggtaggctacactgaacaaatgtttaaaaactgtacaagccaaagcataaaaggaaaaggcataacctcaattctaaaacaacaactgttcctaagattatcttgaagcttaccagaaaaacatagattagagatcacagatcaatgatcagtgatcacttatattctaaagttcattaacaaagccaaagatcacagatcaatgatgatcagtagataacaccaagcaattgcagtcatgcttaagaaaagctacaatcaaaacaacgaacaaaacattgcatacctccatgttgaaactacatccaatcactgggttacatcttaacattacaaggaatataagaggctaatcgctgatgtgctatgcagctcacttcatttcttgcttatttatttatttatttatttattttagacaaaagaagcttatatcaacctgacaataataatagctacgactagcaacattaaaaatatctcatgtcttatgttgccaatgtaaagtacaggggaggtggagtgttagaacgaaccaaagtagtccagatgttgaagcttgagtagaggagtgccatggccaaaggcggctgtgccaacaatggcatcataggtccagcttgttggggctgcaataccatgtcaataaggtggaaggcctgcgcacaaaggcagcagctccatcgcagctctggcatgtgggtacggcatcacagcgacatcgcagtcatcgatgaatgtgctatcatactatcataggctgcatcatcatcacaaattcgtcttgcggaggaggcggtggcaaggtcacaagtccaccatcacgaatgaaccaccaatcgtgggcaccgaagccgcttgcaggggcatcagtgccaccatcgtcgccccaagcatagccaagggcgccatcacagcgacaatcgcgcctgcggccacatcccatctcatgagttacttcccccatggcgcctgcgccaccacggacacccccatcacaggcgatcacaggctcacagcagcgactcgcgggggcgccgccgccgcagcgatcgaccagctgggtcggagccatcagccctccaccgaatccgaggtcacccctccagctgacgcgtaagcacggttactccggtaaacggcggctccggtggagatcatcaaacagttgtggatgcccttctctcgcatatagcaggttggcgtatccgacaacggaggagcgggctagggtttgggggtttagggaatgcgggtgcggggacgatgtggggtaggtgaggtacacattcccctaggtcgtcgcgcccgccggtcaccgtctttggctccggtcgccgtggaagggtgggagcggcgaccggcgaggcggcgcggtggccgtcggcaagagcgcgaggcggcggcggcgtgaacgaaggatgcggcgtatgacgtgtcacgtgcggcggtggagtagccaggagagtttagtggacttagaatgatgggcctaaactaaactgcaagtgtgtttggcctgtttgttgaggcccatctagaggagatctccacgtgggaatccgttccggctcaagtagttacgcccaaggttggcaaggttggcagtaccctgattcgtattagtatcttacgatactacgatcctatcaagccgaaacaataccgatcccacctagtatcttatcctactattcattactacacgatcatacgaaatcttaggtagtatcccgattctacgatccctacgatactacaaaatattattttaaataacatggtttgaaaataatgtaactaaatatgctcaaatttatataaaaatcagttaaatatatcaaaaccaacgtggtttctcttgataaatatctctatttacatgatatatatcattactatatttttttatacaaaatggctatatataattaacataaatattaattaaacttaaaaaaaatctcttagtatcccgatactacgatacgatcctacgatatgacattactttgagcaaaacgatactgtctagtatctcgattctgacaaccttggttacgcccatatatctgctcccaaagtttgccggatcgagttatcacggttgtgcagtgcagctcagatcgagtgaaagaacgcaatgctggagtgttttcactgagaaattctatctctcgacctctgaatagtaagctccaaagtcatcgaatgtaacccagtatcttctaattgcttgtttttaatatgtaaatcgagttgccagttgccaccaaggtttatcttcccgtttcagaggtgaaaaccactctttgacgaaaacgggtgaagactgattactttcagtcaacttgctaaatcgatccgtcttttgtaaaccgaccattagcaatttcatggaaaatgggtcgtttttgttaacccggttttcacactcgcactggtggtagtgtatttcttcttccgttatccactctctccaattaatccatatctgttttgttgggaggtaactccgggctcggatgtccaatgttcggagaaaaatcggacactgacgtcagcatgacgtcagcgcccgatttacgtgaaaaactagtttaaactgatttttctcttaaattacttatccaaatcatgattcgattgcaccattaaattcgttgcaattaaatcttcaaaacaagaccacacatggatatattccgatgaaattttttttagcttattattaaattatttttaaatgttgcacgatgtttcaccatgtatatcggaattgtttcactaaatatatcgaaaatgtttcactcgtttaaatcgggtgttatttcaccttatataaaaataatgtttcagcaaatagcgaaataatgtttcagttcactgcaacatttgatccattcatagtgaaacattataagtacactaggtgaaatattttttttggaacaaaaaatgaaacgaattcccttaacagggggtttccaaaatatgtgcgtttttttgttgcaatggaatatttcagttcactacatcattagatctatacatagtgaaatattgtgagtacactagatgaaacattttttgtggaacaaaaaataaaccaaattcccttaatagggggttttcaaaatatgtgggtgatttgtcacaacggcacgttccataatatcaaaatccactgcaacatttgatccgtacatagtgaaacatcgtaaagctactggttgaaacatcgaaacagataatatgcaatattcaaaaaaaaaatcaatagagaagctaaaatatttttttgtcgaaatataatcatgtgtggtcttgttgtaaagatttaattgcaacgaatataacggtgtgattggatcgtagattggataattaatttaagagaaaaatcgttttaaaggcgcaggcgtccgaggcgtccgatttttccttctaacgtcggacgcccggcgcgcagcatttaccgttttgttggatcaactgcatggctgtgcactcctatcgctcctacagtgtaagtgcgtgctatttattttgcaaaatctcagaaaaatgacagtgcaagagataagctaaaactgaatatcacatcgatcgactcgagtccttgacgcgcgctgaaaccgaatgatgttcagtgttgcaaattggtggctgcatgaaatttggtttgccgcatttttttagtcccatcgtattatatcgacattgttaggtaaaagaaagttttcgatgatttgatcgctcaatttaattatctcctgtttctcagctagactatgggatgctgacactgtttgcaatgaacgtccatgataataagagattagtgttcgatcggtggtcatttcaacttttccaaagtcatattggcaccatcattattcggttagctaaagtgcagtgtcgaaatcatcactctcattccgtctaaacaaacgtcagttcattttgatcaaatcttttagcatatgtttagtttggggactacgtgggatgggatgataccatccctagttttagggatggagtaatcccatttacttgtttgatttattggatggaatgatctcaattttttgtttggtagaagggatggatagggatgggatgaatgacatatggagtcacgttgcaccacgttagtgagaaaatgtgtcgcagctcgcaactcgcggaggaagtagagtggcagaaggatgagcggcgactagtggcgcaggcggaatgaggaggggcgaccggcggcgcgggcggaaggaggagcggctaccatcggcgcgggcggaaggaggagcgagtcagaggcaacgacgatgcggaagtggtggccggagcactcacccttgcccgccatcactgtcgccgccatcggagccctccacaccgccgcagccctcctcgctaccagattcgctaccaccgccctccccgcctccggattcgccaccgccgccatccccgcctccggattcgccaccgatgacgagccctccccgccctccctgccttcagattcactgccgccaccctccccaccaccggatctgccgccatcgtcatcactcacgatgggtggaggagcaagatgcgagtgagaggggcgagcgagtggcgtgcgacggtgcgagcgaacgagcgtggcgaagcggcgcgcctcacgccgtgcgctcgtcccaggtgggacgagctcgtccacgagatttttccggatggcttggttccggatctgagaggaatattcctgtccaggaaccaacccatcccactcacccctaaaccaaacacctttaaaagtgggttcgtcccatcccatcacatcctatcccaccaaccaaacactaccttaaagaaacatcagtgacatctccatcactccatcagcgagtccatgccagattgccaggtgcccggtactccggtagggtcagggcggatagctagggcttgagctctaggcctacctttaaattattgtttaaattttattaaaataccgtgtaatttttataaaggaaaatcaatgctccattagttaagttatatcttagctatagccttcaaaaaatttttgacttcgtcacttataaggtggatgttgtgagctcgtcatcagatcgtccacggcggatggcgtgactggagttggcatcctaccaacctgcacagctgaactgcacgagaacctcgcctgattgttcttcaccttctcatcaccgtgcagtttcacctgtagtaacatcagtaaataaattattcaccataggctgttcatctcaacaagttgtccgtgcaatgcagccgagagtaggcaaaataaaaaaaaaagaaaaaaaagagagagagggtaatttggcctttgggtcatcgcacacgatccgaggcttccccccatccacggctgccggtttttaacctcacctactccgcgcgcgccgtcacgcatgtgattttcgcaacatttcctcgccgttacccgcataatttcctcgagccgccgagcccggtggaaccgggtgtgaagtggaagcccagcgaccgaagccgaggaggcgacgcactcgtctcgacgcaacggcgggtgcggtgccttgtgcgccgtgacagcgacattctttacctgcccaaccccaaccccaaccctctcctctccgcccacgcctcgccctcgcgctctcgctctcgctctcgctcgcgcacatcacatgcgcctcctcccgttataaggagagccccgcgccattggccgccccactcaccctgccatggacgggtagaaaggtacagtggcggcgccgacacgcggtggaggaggaggcggcggcggcggcggcgatggggctgctgtcgaacagggtggagcggtcggagatcaggccgggggatcacatctacacatggagggcggtgtacgcctactcccaccacggtacgcgcgcgcccaccccctccatcctcttcctcctcggatgccatcccggttgcttgaattgttgtcgccactcgccaatggtggcggcggcggcggttgcgggtttaggtttgggaactaatccggcggcggctctgtggctctcctcctccggcgctgcttcgaattttctcgtgcgattgacgtctgatcaatggttgttgacttgaccgggaaattctggctcggcgagtcaacgggggatttttttcccccttttttttggtctgtgcggctactggatcggaaatttcactgcgattgctgggtcaggaacaaatgcgatcgaaattgcctagttggactggaaattttgttcggccggctcaatggggggaacatttgcgatctgaattttcgagttggggttgtctcttgcttagttcatcggtaactgaagggcgtgtcttcgtctcagttttccattctgtcggatttgggatttctttcgcctcatacttcctgcgtgatgttctcttctcgagcaaacccctctgcttgaagtacggatcacgtggttggttggacaagtgcgtcaatcatccaactctctgattgagtgattgttcagacttttaactgtttacagattcgtagtagaactcagcagtaacacgcaaatcatcgtgcatttgtactatcttcagttcataattaattctgtaggtgtagagttgacaacattagtatggtagaatgatggctgtaaaatagtggcaaaatgggtacatgcatgaaaaagatcgattcaatgtttctacttctctgtgtgggttatgcgtagaattgagggttcaactgaattgcccaaactctatccggaaatccttccagatggatctgacgccacatgctgtgtttgttgcttcccatgtagaacaaatggcacttgttgctgctcacctactgctgaccaacttgtctgtttgtatctgtgctttttttatctccgtgtggaaattagcctcttgtttttttataggaatccctcttgttaattcaaggttgctcgcaataaaataagtactgtaaggttggttctataatgtactgaacctgacaaatgacttgtttagtacactattgtactattagtgattcagtagctgaaaactcaagtcaccatagtatcctatgataagttgataactactttgattaacagttgatgtcaaacttatctacgtggctacgttcattttttatccttaccttcaggtgtatttaccacagtaattttgctatgcatctttgttcttttacagcagaggtctttcatctccattcagttcaggtgtatttaccatgggtattttgcaatgcatctcttttcttttacagtagaggtctttcatctccattcaggaagcgtaaaggacacttctgctctgtgttgctatgcactctgtagttctcctaaatggacagtatgtcccctcaagtgcattttattggcggatgtagagctccttttattgtagtggtcctgtgtggacatttgatcagggccacatctagggaggacatgctgtgggttttgctgtttttgcacatgacagcctggatgaaagggctgcaatatacaagaaaaactgtcttgtctgcattcaactccttaaaacactattttcaccatcaaggtgcatttttcatgcatcgataaagggattgacaggttaacagcatgccgattcattcagttatcatctagtgtttttttaaccttttgggatgataactatcatccagtggatttaattgttcaccttaaactttatagccttggtgttcccttaattgcatattctttgaaatgttttcaagaacttactcttctgttggtcatgttctactggcaaacaggcatttatgttggaggaagtaaagtggttcattttactcgaaagaaagaagcagaaggatcagattcatccaattccacctccagcctattattagagccttcatcagagtgcccaacgttcccagattgtgggtttcagctgcctgatagtggtgtcgtcctcacctgcttggattgcttccttcggaatggctctctatactgcttcgagtacggagtgccatcagccgttttccttgcaaagctgcgtgggggaacctgcaccattgcccaatcagatccatcagaagttgtggtacacagagccatgtacttacttcaaaatggctttggaaattatgacatatttgagaacaattgcgaggactttgcactctactgcaaaactgggcttcttcctgttgaggaacctggcattggaacaagtgggcaagcatcttccgccattggagtgccattggcagctcttctgtccactccacttaagctttttgctgctggtccacttggaatggccactgtcacagctgggatgtactgtgctggtagatacatcactgacataggagtaagaaaggatgtggcgaaaattgaagtggagaatttatcatcacaccttggtagacgcctgattgaagatgaaggatcagtgaacgtacggtcagagaaaccgaaaaccttgctgcctatgaagagaaagcgtgagaggtgatggcgactatataccgctcttcgtcgataattggttcagaactgtgcataatttaaactttactcttcgccataataagtttgatatagatatgtacctctgaagcgtgttctgattcagttaagaccacacttcacatgatcaattgagctacattccaaactgaatatgtgatggaaatgtgataattgaatcgttggagtcaaaagtagatacttactgttctttgaatatgatacctcacattctagtgcttttattttctgtttattttcttttatcaatattttttcttactggtcacaatataatgtaataagtttcagtagtggtgaagacttcttttgtatgggctgttttctctatgatgaaatccatagactgaatagtgcagagagacaaggcagactgtcggcatggcattgtttgctttcattttcatcaggtataatgtaccggtagatcctccctccaaacctgatcattgtaaaatgacagcttgtcaggactccaccatatgtatccatccaaggaaacttcgtacctttctgcatgtgggagagatctgcaaagatgcatatgcttttctctgggaattatcacactcgcatagcctttttaccattctctttgcgctcagcctttaatcattggattgatctggtagaccccatgatcagttacctttctcctgttttccatttgacattgtcctggatggttggatcaaaaggatggccacattgtatattcagatctgggtatggactgagacagaaaagaagtaaccagtggccattgctgggaccattgttgcattctagttgtactctctccgtttcatatcataagcgctttgacttttttttaagtcaaacttctttagatttgataaaatttataaaaaaatgcatactatcattttcaacataacacaaacatattatcaaaatatatccaatgttagattcaatgaactaattttggtgttttagatgctgctattttttttaatatataaacttgatcaaacttataaaagttaaactaagaaaaaaagtgaacacctaatttctggtacatcatctgcgaacaactgaacggagctaccatttcgatgcatcagcagcacgccagcacagcacaggaaatgaaaccatttctacgacttcagtaatcaacacttcagcagcggataaaaaactttagttctaccgggatgtactgtgtgcgcgcacgtacgtaacgtatgcttcctgaaagcatcactatgtgccggtcgcaaagcaggcgcagcgacggcgagcaatggcaagcttgatcggcaacgccggcgacggcggacggtggagacgccggcaaaaaaaaaagttagatgataaaagggctttacggcccatcaacatctcactggatgcacgttccagcccactaagaaagacagataaaagggctttacggcccatttgtcatccctggatgcacgttccagcccattaagaaacacagggaaagggcatgatagtaagttgttattacggcccacgtcatctcgctggcggtattttacggccattaaaaaaagcatcacagagaatcatcccatttaaaggcatcaaggaagtttgttctgattttgcatatcttctgcattgatagggaatcagttttcgtgtctatccaattattgttgggcatcaaaaccgtcaccttgcaattggtagtttttgtacctttgcttatctgcgattaaggtggtgttcggatccagggacttaactttagtctctatatttagacactaatttagagtattaaatatagactacttacaaaactaattatataaatgaaagctaatttgcgagacaatttttaaacctaattaatctataattagagaatatttactgtagcatcacataggctaattatagattaattaggctcaatagattcgtctcgtgaattagtctaagattatagatatgttttattaatagtctacgtttaatatttataatcagtgtctaaacatccgatgtgatagggacttataagttttagtccgatctaaatagggtctaagtcttggaatggtcaagtagccaaccatgatagaggaagagagaaaaaaaaaaggagcaagaatgtgatgccaggcattaaactatcgctgtggttgtttcttatactccacggctttctgaaatctgcacagtggggagtaaagcccaccttccttttgctctttgccttgctgtagcgctcctgtaggtttgcctatttataagccgaaaacaggagaacaaaacaatgaaaatatttttatggcaaaggcttttgtacacatggtttcaaggcaaaagctcagtattgaaagcgacaaaagaatctgtctaaattaaactctaaatcaaatttagttgcatcataagccacggttttaagaccaggtttgagaaactaccgacagaagatgccaaagaaacttacattatcactcaaatctgtggttataaatcttagaaaaaataataaactagaaaccaaaaaccaagaaaaaccagctattttaggattctcataaatgtctcggaatctcgatctcgctggccccgacaatgaccatccgttttgcgttatgtaatcaaaactctgatttcttataatataatgatgtccaattctttagtttgttcgcgaaaaaaaaaatcgatctccccggcccaggcctaaattgacccctttatcggaacacatatcctaatgacgtcatcaagcgacgtgcactctaaacaccatggataaacttatttggataaacttatccaaatacaaatgacatggacacgcaattatccttcgatcatactaccgcctactcgcagaataccgtgatcacgcacgcacgcacaagatacagtatatctcaccgtcagttagcccccggattctcactcatccccttccgtattaatctccgttgggatccgacggcgatgcgtgcactgccgatcgggcggacgcgccgatgcaaccggccattaccattgcagctgacacggctcgcgcgcgcgccgcgggatattccagcgttgatacgggtcaaaaagggcacgggcgcacggcagctgacacgggaactcgccgcgatccccgccgttttattttccaaaccagcacgcgatccatccatccacccggctccccacacacgagaaaaaacggacgccgccaccgccccgcaccgcgcgtgatccgtcacggtgcggtttccctttcccatataaatcccccccgcgtccgctgcgaactactaaaccgagagagagaggcgcacacacgaagacgaggcggcgatggtgagcggcggaggagtagcggcggagaacggcgagatggtggggaacggggaggggaggaagggtgcgggggcgagcgtgctggtgacggggggagcggggtacatcgggacgcacacggtgctgcggctgctggagaaggggttcgcggtcaccgtcgtcgacaacttccacaactccgtcccggaggcgctcgaccgcgtccgcctcatcgccggcgccgccctctccgcccgcctcgacttcatcgccgtacgtgactcacccaaacagcacgcgtgttcttcgtcttgcacagttgaattgaaccgagccggcgaggttgagattgagattcatgtttgtgttcgttttcagggggatctcaagagcaaggacgacatggagaaggtgttcgccgccaagaggtccggattggatcgttttgcttcgatcaaacaagccatctaactcaaatcctttttgattttgatctcaactcgttcgtttccacacgtaatcaaacgcgtcgtcgtcgtcgtcgtcgtccattgatcgatcaggtatgacgccgtgatccatttcccgggcnntngaggcggtggggagagcgtcgcgcacccgcagatgtactacgagaacaacgtcgccggcaccatgaacctctactccgccatgaccaagtacggctgcaagaaggtcagtactatacatctacacgatcacctgattgattccattccgatgcatgcttcgatcactgaaatcaacaaacctacgcgcagatagtgttctcgtcgtcggcgacggtgtacggccagccggagaagaccccctgcgtcgaggattccaagctgagcgctctcaacccatacggcaccaccaaggtataagacatgatcgcatccattgctcgtgataagcatgcacccgtcacgcgccattcggattcgcttcgccgattcggtgattacgatgccgaattgcgatggcgatgatcacaccattgcttttttgctatgcaagcattgtttctaacggcatcgaattcgattctctcgttggggcagctcgtcctggagaactacttccggcaggtgcaggccgccgacccggagatgagggtgatcctgctcaggtacttcaaccccatcggcgctcaccggagcggcgacatcggggaggaccccaggggcatccccaacaaccttcttccgtacatccagcaggtcgccgtcggccgccgccccgagctcaacgtctacggcgtcgactacccaaccagggacggcaccgcggtgagcactacactgttcaagatcaatttgtatggatgagatcgtggagcgaagcaaaattttgacaatttgatatatcgtcctcagatcagggattacatacatgtagtggaccttgccgatggccacattgccgcactggagaagctcttcgctactcctgacattggtacatcaatcgatgctacaaacacacatgttcttcactccataaactggttgatgtttgacaagtttaattcatccatgatgtataatttctttattttcttctgtcaggttgtgtggcttacaatctaggaacagggtgtggaacaacggtgctcgaggtggtgaaggcgttcgaggaggcgtccggaaaggtgactgatgtagtattatttatgcatccatgtgtgcatggttgatattcgcctcatctgaaatcccaatctgaaaatgtggtcgaaactgacgtttctggctgtgaaaccacagaaaattcctatcaagatttgccccagaagacctggagattgcactgaggtttacgcttccactgacaaggccaagaaggagctcggatggaggtaatttattctctgattcgctacagaacgatcacacaaatctgtctgtccatttttccagctcactgttcaactgacagttatagtttgtgcttatgatagagatgctgattgttttatgcttgtgctgattgcagtgctcggtttggaatagaggacatgtgcagggaccagtggaattgggccaagaagaatccgtacggatacagcgccaatgctgagcagaattagggcgatcatattaccacttatatagtactagtatcaaaattgtccatggtcttatgaactgtgtgactagaaaatgttaataagacatgcgtgcctcttaagtggagtataccaattcttatttagtcgaatccgttgtgattttagatactggcaaatgttaatcaggtttatttaaatactatactagtagcaagatcaaattgaacaatagttcactggctcgtttttggattggattggactgtgccgccctaagctgggctagatttattctatactgccaggagcatactaattagtttggcccatgggccacggtatgttgtctgcttaatagtattgactgctcaagtgctcagtttcctaatccatttgacaaagccacaaatccatgaaagatgaaacacaatcaggggtggaggcaggcctaacgcagataaggcttgagccataagctgaccttcacaatcaaagtttattttttttaaatcatcatgtaaattttacaaaaaaaaaaatcaacagtccatcaatcgagccctaccctagcctttagtaatttctagccacgcaattgtgtctaatgctacatgatttggtactcaaatacgaaaagtgttgcccaaatcattaaaatcatcgcaaaggaatgcaaaatttggctagtgtgtactataaaagtgtcaatggttactaaatatagacatcatcctggcaaacaatgagaaacgtactaacaaacgggatttgttctccattgttagttttgtatcagaaacgtactaacaaacgggaaacattggtcctccattgtcaattttgtatgcacagtacacttgcagcttttggaaatagaagtgtaaagaaagatctgaagggatataaataaccaaacaacttttgtcatctcattggcattttcaagttctaggtgaaacatttgtcttcaccccagtccgattgtccaacaacctttttgtctttaaacattagctagcacaatccatgcaactatattaccttgtttctatccaaattgagcaaatctactatattaataagtaatttctccatactgctcattaacacatatttctcgaattttcgttcgtgtgtataccaatatcaccattcgtcgccgctacacttggtaaatatcaccgcaactacaaatttcccctaatattgcttaacgccccgaatctgtcaatagcacgaacaaatcaggcttggctagaaggagtatcattcatgcacaagtgagatgcaaaaggataagggtcttgtttggatccggagggctaataattagtcctctgaaatcttgctatttagtagtctatattaataagttaatttctccatacggctcattaacacatatttctcgaattttcattcctgtgtataccaatatcaccattcgtcgccgctacacctggtaaatatcaccacagctacaaatttcccctaatattgcttaacacctcgaatatatcaatagcatgaacaaatcaggcttggctagaatgagttttgtcggtaatctacgtttggatccggagggctaataattagccctctggaatcttactatttaggagtattaaacatagattaccgacaaaactcattccataacccctaggctaatttgcaagacgaatctgatgagcctaattaatccatgattcgctacagtaatcattcactaatcatagattaatatacctcgttatatttatcttatgaattagcctaggggttctgtaagtagttttgcacatatactctattaaatactctaaatagcaagattttagagagctaattattatccctctggaactaaacaaggccaaggtacgttacgaaaatgtaggaacgtggggacataactctcacaatagttgaacaagctgcattctactttccatttttggagaaaagacttggtggcttactttccattttgacaactttactactcccttcttttctaaatgtttgacgccgttgactttttttaacatgtgtgaccgtttgtcttattcaaaaacttttgtgaaatgtgtaaaactatatgtatacataaaagtatatttaacaataaataaaataataggaaaagaattaataattacttaaattttttgaataagacgaacggtcaaacattttttaaaaagtcaacagcgtcaaactttttgagatggagggagtatctttttactcctgactccccgatgctagctttggacatggagggagtactaaagtggttaagtttagcatcactttgattaaagacaatagtactctcgtatcatctagttgtaaacctaacttcagaaagcaatgtttggcctaaagcaaaaaatatgtggattaaaaattgtacacgcgtgtccttgacgatttaaaagatcacattgaaaaataaactacaataaccccctccctcctctaaaaaaataactctaattgttttgaatggaaaattaactctaaaactatgtttgaaaatttatttatttattggctaacacttataagccgaaaggcaactgatggccacattcctcttttttatattgttcataggttaccaacccatttggccatgcacagatatgctaagctcaaaccataattgcccagggcttgttatctaacaccagtggtgctaattgtttgctccaagttgatttgcatccgacatggtttgaaggggaaataaatgctcagatggatgcttcaaatgaaatttcaaagagggagaaacgtccaggggtcttccggttagctccataaggtggtgggctagacggcctgggttcgaagtccccttctaattatttaatattagatcattccctaatattcatgtttttttaaaaaaaattcaaagagaaatgctttgttgaatttgttgaaagaataactgaagatcccccccgaaaaaaagaataattgaaggaagaatttatgtacaacatccgtcccaaaataattgtaatccaaattgtttagtaaatattaaggggtctgttcgctgcagctaaattgtagttgttgtgtagctgcgctacagtgcatgatagagaaaatatatgcactggctgtacagcgcagccagttacagctgcatagcagcgttgccgaacagagccaaggtttgagaagaaagactgtaatgccccttattaaatggtatatatagatgagatagataggagtggaagggtagttgagggtaaagtagagagaagtgatcaatgggaccattagtactctactgtgacaattattttggaacaaatttaagtcctttaaatacaattattatgggacaaagttagcagttaagttgtgcatgctcaaacatctttcttggtttgtcaccatgcaaacttatatgcaaacttatgtttagggatgcaagcggggcaggcaagcttttttttagcctgcttatctcatttatacttcattttttcttctaaattttgtattaccatgtggaaaatgaactcgcaagcgaatttttatgcggatagcgggactacccacttgcatccctacttatatttggcgaatgacctagctttgcaagtagggagtaatttatccaatgatcaaccggtgatacaaatgtgagaaaaagacacagttgtcattattagtatcgtcttgattgtcatcttttacaaagaaggctttttggacactacctccttttctaagtaataagccatatgtagtaccactatactaagattcagtccttcaacccatagtagaaaaaactagaaccagaggtgaccacggttcggtttcctttaaagaccggacatgtaatcgaactgctctgaaccggctgaaccggcggtttttcggcgaaccggacactaaaccggcactggttggaccggctagccatactaatgggccacgatgggctgtctaaaggcccaatggtgcagctagtggttttttttttagcaaaaatagcaagaaatggtgcactgggtgggattcgaaccctctggtccgggggttgaaagagccaagtgctagccatcaggccatccaacgacatgtgtacatgagcaaatatgtaatatacatgtagtttgtgaaccgcagttcaaccgcctgggtcaccggtcggaccgacggaccgctgaaccgagaggtcggctgggtcacccaccggtccggctttttttactatgcttcagcctccttctaatttcatagtttcattgaattaaaaggtaacctcccccctcaacaatttagtttaagtttcaattaacttcatttataaatgaactagtaactcctttgataagtactactcctatcaagcattggtcccctcctcttgtttaagtccattccaattaaaccttgtgcatctcttgaaaaaaaagagaagaaaaccggactttttttctcctctggcagataagcatttaggcccccatcgtttggcttacttcctaataagccaataggaaataaaaataaatttgtagctaaaacttttataaatatgttcttggtgacttaaaagctaatgttgaaaaagaaactacattgaaaatatatcaaaatcaatctcaaaattaagcttgaaaatttaaaatttggctttttctttagctgattaggctatccaatgtgagccttactctctagaagccgattgaaagaaaaagaaccttccaaaaggacgacaaacaaaaacgcacaaataccaaagtactccagtacagtgtatacatacacgaaataaaaaaaaaggccacgtcgtatcgtagacgagataaaatcttatcccactcgccatccgtggccgagcaatcgacacgtgtcccgtctaccgtgggccccatccagccccgcccgcgcgcctacctgaaccttccagaaggccgaagcgcgaaaaatcgaccgaaccttctcgccccttccgacccccaattgccccatccccatcccatcatccccccgccgagaacccaatcccgcggcctcgcctcatcctggccatccgtgccacctcggtgggttccgatacaacggcgtggatgcgcccgccgcgggggcgagagatatctatcactgcggccgggcccacctgcaccgccggcgccagcttggctttctcggtacgagtggtgggtcgcatcgaattcataggccatgttttagttccacacaacctatcacatcgaacgctaaaacacctatataaaatagtattaaatataagcttaaaaaaaaactaattacataggttgtgactaatttatgagataaatcttttaaatctaattgctccataatttgataacgtgacactacagtaaatatttgctaataacaaattaattaggcttaataaatttgtctctctatttacttatagattctgtaattaattttttattagtacccaaacgtacagtcaacgatataatacccgatatacacgaaaaaacaaaactttacacaactgaatcttaacacccacatacgtgcgttttctctttaaaatcgttttttctttttggtgctttttttccctcttttttatttgtttctctcttgctttgcttctcctcctcccgttggagtataaattttcctaatccgcaaacgaagtttccagaagacttccggtccgtaccttcgttttcacacgcgaaaactgcctttcttccggcatctggaagctactactactacggtcggtcctcgccggatcagatccggccgcctccccggcggatggcggagcagggggcgggcgaggcggatgcgggcggcggggagccgccgccggcggcggtgatgacggcggcggcggaggcgttggcggggcagaggtcgctgccgacgccgttcctgacgaagacgtaccagctggtggaggacccggcggtggacgacgtgatctcgtggaacgaggacgggtcgacgttcgtggtgtggcggccggcggagttcgcgcgggacctcctccccaagtacttcaagcacaacaacttctccagcttcgtgcgccagctcaacacctatgtacgcgcccccgggattattcctcctcctcgtcgtcgtcgtttgcttgggatttagcttggtttggtttggccatgtcggtgatgtgtctggattttgcttgcttgctgtatgacgtagggatttaggaagatcgtgccggaccggtgggagttcgccaacgactgcttccggcgaggggagaagcgtttgttgtgtgatatacaccgccggaaggtggtggcggcggctgccgcggcgccgccgccgccgtcgccggggatggcgacggcagctgccgcggtggcttcgggagctgtgacggtggccgcggcgccgatacctatggcgctgccggtgacgcgggcgggctcgccggcgcactcctcggaggagcaggtgctgtcgtcaaactctgggtcgggggaggagcaccggcaagcgtctgggtccggctctgcgcccggcggcggcggcggcggctccgcgtccggcggcgacatgggcgaggagaacgagcggctccggcgggagaacgcgcggctgacgcgggagctcggccacatgaagaagctctgtaacaacatcctcctcctcatgtccaagtacgccgccacccagcacgtggagggctccgcggggatatcctccatagcgaactgctccggcgagtcgtcggaggccgttcccccgccgccgcctctccccccggcgatactcgatctaatgccctcgtgccccgccctggccaccgccgccgccgctgcggggctcgccatagacggcgagcccgacccgagcgcgcggctgttcggcgtctccatcggcctgaagcggacgcgagacgacgccgccgccgccgccgacgaagacggcggcggcgaggatcaggccgagcacggcggcgcggacgtgaagccggaggcggcggatccgcatcccgccggcggcggcggcggaagcagcacggaggcgtcgccggagtcgcacccgtggcccatataccggccaacccccatgtaccacgcggtcaggcccacttgcaacgggccggacagggccgggtccgaccaagacgggtccagctccaggtgagttggcccccccaaccctgtagaagcttctagacccctatattacttaattgcccctcccctacactattataagcaactaattatgattagtacgtaattagcggcgaaataataattactaccactagtagtactagatgctcttttgcttcttggcgaggaagaacagatgagagctcaccttgtctctcgatcgatcgccttgtaatccgtctgcctctttctcttgattgtgttgttgtaaatcatcagcgtaagatccatcaggatgccggtaaggcggtaattgcaacctgggtttaccagtgtattggctgcctgctgcggaaatgagaagtgcatttccttgatggtgtggtgtttattaagttgctcacctcaaactgttgttttcttaggtgcacagtttggtcagttttacaagtgttttaggtgttagtgccaaaaatggtggtgacatagggcggaagcactagcatatgttttgtactagatgtatgtattaggtttgatgctagaaatagtggcgatatatactcccccttctttctcctgtcactattcaagttcctttttagcaatttttttagttctttatttacccaacacagtttgattacaatccatatgagtaaacacattagaaatcatccaagggctaacactgaaatcatccaatagcactagcatgcatgttttatactacttgcatgtataagttttgctgctagaaatagttgtgaaatttaggggttattcggatgctagtgggtagccgcagtcaacacgaacaatgcagcaagctgccctcgcctgccgaatagccccgtagagtagaaagcctcaattaaccgtgattttgttttagagaagggatcatattagtacaacttttggaaaaagtccataaccaaacaaaggccttccaaacaattagccgtgatttgcatggttggctcctggaaatggaatcgtgtgttcacagaatccactaatcaagttatcatctccaaacgccgcgtgtagaagttgagtcaattcttaattttgaccgactgggtcgtcgaccacagagggtcgtgtcgaacacacgtagtgaaccacatagcgctagatttggctgtcaggcaaattaatcatgtcaatcctaggggggggggggggtccatgcagagagggattgattactcacaatttcgtatattttctggcttagccaacgttaggcagcggacgtcatcgccactagaaggcactggatgcccttttgttccccatttttcttcttccaagctactcgtattttgtactacatggcatcagacagcgacgcatcgtcgaatggctgtaggtcaggtaagcacggcccggcctattttttccccctctgttttcgatcgatctttcttgctgcgtttcttcaacgagtagtactccgtactaataattttgtccacgacattgccacgtcgaggcgtcagagatgttgcgtaaactagtgggttcttacatgtgttgcccatatcacggagtattcacgtttgcctcgtcctacatgtgtcttaaaattgttgaacatcccaacacgaaacttgttacactttctcacatctaaaataaaagaaactaaagattgattcacgtaatttcgtactctccattctacaatataaagatgaaggtagtattggtatcaaaatgtatgtttccacgacatacccacccatatttgaccatagccaggcaaggatgggaaacggcggtaaaggcaggtgtatgtcattctggtcggttccatgtcattctaggagagatggtcaacctcattttttcgcttatacttattcttagtagtcaaaatttaaattttcaaccttaaatttggagttgattttgagatattttcatcaaagtttatttttcagcctttgcttttagatcgttaagaacacacatataaaagttttattcacaaattatttttcgtttgcaaatatgcctgaataagccaaacgatgggacctggtgaattcgacgatctgcaaaagatgatggtggtgcaacagagcaacttcgtgatgcactggggacgctcggaatgcggtagtggcgtaaggggttttggatggtgatggcagacaacagcaaatggtgttgtgatccacggaggcggagatggtgcggtgatgggtagctgggactagttccaattctccctttccatcctctcgggttgcggcggaaagttcaagtcatcgttgaaggtttaaagctaactcttcaagctttgtgtgtgtgttggtgtgtttgtgtgttttcctctgcatgaggattggagtctaagaacttgtatgttatggttgtgtgatatagaggctagattaataaaaaaaattcattatctaaaaaaaataagttgagatgctaacttcactatttagaaccgatcttggtaatttctaactatgtgcattaatgtacataaaatttcaaaaagctgcaactattttatcaaaataataatatgctacagctttagctaagtatttcaaaaataaatcaccataatatcatatgattttaccagaaaggtacaactttatatcacagacaagtgtgatccacatgtcatacccatgtgaaggataaaattactgttcttttaattttttttctttgcttttctttttgcagttttcttaaatacctagttaaaaatatcaacgttttcacaatgaagtcattattgatgagtaatttttttaaaaaaaggggtttactgcaagctaatcacttcctttgctaatatgtggcctactttggtatctgcacagagaaaagagcatgacgaaatagagaataacagtacttttttgaaatgatggaaggtgattatttatgtgttggagaaagtgggagaactatactataagaaaccaaacatattcaaactttcctgtgcagatttcatcaaatattgtgtggttagattaattatgaggggattaattttggtgtgtggtggagtgttggtgtaaagtccgctcacaaaaggattctcatcccagggtacactatgaacaggttagcatgaactagctattctatggttgttgatttatccttgactgcttcatcaaatgctcgcgtacttaggtgtgtgtgcatatggacttgagcagagtgtatgatggtgagctgtgcacgcatttgcttttcttttgtagcgaaaaaagttttaatcatgtgtgatgttgtaatggttttattggtttgtatttggttttttgtgttccatcgctaaattttccaaacagctgaatactcaactctagatacttgagacaccaatttgagctgtgaaatcaatactccaccaatccctaaaaaacacaattctaaagatgaatttgaacctacactttcagtattaaactcttttggacagagggagtaataatttagagcaatctgatcagtcaagcatggtttcatatccgagcctgcactctactccactcagtacgaagtacgaacatacagagttacaaacaccgttcaaattcggaggttcaaataggaaccatggaatgatggaaacaatatcagaggtcatctcaagcaaagaaaatcacgtccaaacataagtccacccttcagtgcttttgtttctctcaaaagaaaataaaacttccagtttggcttttccagttatgtttcaaaatataactggggctcctaccgtgcacgcgcggcgataggctaagttgcgtgcgagggcaggaatcaacgggtccgcgtcacgacaaagaaaatcctccacatgtttttctatttttttcatcttttctttttctttcgggataaaacaaactttcaagtcaatattttttgaaacttttaaatcagatttgaaaacttttaagtcatgatttgaaaactttcgactcagatttaaaaactattaattcagatttaaaaatattcatcttaaaattcaaaacttttaactcagatttaaaaactttcatctcaaaattcaaaaactcaactcaagtcttaaaagctttcaattcaaattcaaaactttcaactgaaatttaagatgaaatattcaacttcgaaaattaaaaaattgtgaaaaaatggcaaaaagaaacaaaaatgacgcgtggaagttagcttttccaaaaaaaaaaaaaagaatgcacgtacgtggacgccattaaaaacatgcatgcacttaggctaagcgtgggccttatgggcctaaaacgcacgtcaccaacgcgcgcgaattagcttctctcaaatatacctttaagtgaattgaatactaaatatattctaaaattacgaatctaggcaaaatttccaaattcatagttctaaagtatgttctatccacatttaaaaattgctactccctccttccaaaagtctaagtcctatttctttttcaccaagattaaggtgtagttaactcatttatcatgtaacaaaatcaatgaacatgtaatcaataagtattaaaatgacttcttgagttttgataaaaaatttaatatagcatatagtgactacaaatacaacttagacttttgaaaaaaaataaagaatgaaatatgatttagatttttggaatgaagaattatattttaagacggataagccagctctgaaagtgtgtcatgtattctgcgaaacattccgtccaatggtggaagacacacgcatgacgcatgccggtcaacacggggtaaaagggttaattaaccacgccccacgaccaccacgacgataaaagttaaactacttggtactcaaaaactaccaaaaaccggcgactcgcaggaaatatcgtccacagttccacacgcgtcttccctgcaaattccgcccaaatttcactcgaattccaccacttatacgtttatactatttttacatgtgacccgaaccccgaatactcatcaacacgtcttacccatttactcgtatatttccaaaccagccacgcgctaatcttccatgaatatatcagatcaaagggcgcgtaaattcgcaacaaatactaccgattttagttcgtctttcaaatttccgattcggtttctaacctctcaagtctcaactcgatataagcagcggtcgccgtgatccgcaccgatcgtgccctaggttttccttccgatccgcaagctcgcaaacgcaacgccgcgtgcaaatggcgtcgaggacgatgacactggaggtgacggtggtgtccgccgaggaggtcgtgctgccgccgacgaggcgcccgctcggccgcggcgcgtacgcggtggtgcgcacggcggcgtcggcgtcgtcgccggcggcggcggtgtgcacgcgcgtcgacgaggaatcgggcggcgactgcaacgggtacccctactggaaggagacgctgcgggtggcgttgccggagggggcgcgctggctggacgtcgagatctgccggaggaggccgaacggccaggtggaggcggtggcggcggcgagcgtccccgtcggcgacttcaccgtcggcccgccgggccacctgcattgcctcagctacaggctgttcgacgcctccgggtgcaggacgcgccgcaacggcatcgtcaacatcaccgtcaggaggacggacgtcaagtacaccgcgccgccgccgccggtgaaagctccggcgtacgccggcgcgagcgggagcggcggctcttgctacggcgtgccgccggcgggcgcagccatgggcttccccgtcggattcacggccaatggcaaggcctgcgcgtagaatggtaaatatcattcagttaggaaaggattaaaccgaaattgggattgggtctcgacattgcaattttttaattgttgataaagattctgatgaattcatcaggaaattgaaacaaattagcacatcagttttttcttttctgcgaggagagcagatcagattttgttcatgtttttcttattcttcatgtgctgaagaaaaaagaaaagcagaatcctgctcaggttgtaaaaaggattacgttgattttttttctacgtggtatttgatttgtttgattgtttaagactaaaacaacgtgtgcttgggaaattgacatgtgattcatcattgtttaaggctttaagcccgtttgacttgactgaatgtttatgcattcagtatagaaatgttaagtgatttcgttgttccgacctgttactttgttacgactctgaccaaattttcgttggagtctatgtcaacatgcacattctcaagtcaatgttaaatgcacacgttagtctgagtactaccgtgtcatttggcctctataattagagcaggaaaaggaacctgaagtttctcttgtaagtacaaaacattttcagtatagcagagtctatacgcgtttacaagtcacaacgcggtcagatgcgttgcagcaaggaacttctgcatgaagctctcactcctatagttttgtttgcctgatcacacacattgacaattgctatcagtagattgcagacttgatgaaaatggtgtctgctgggtaaagacgcaattgatattcactctgaacaagcttggatacactgaagtatgaattctgaaggttccgggtgttcactgttcagagggccatgaattgccgatgaactggtcggtttcactctctgtagttactccggcaaacctgcaggcatccagcagagagcaccttgattgcaaatgcgccagaaattgttgtaccttgggagcaggagaatgtcttcgtcagatgccacgtgctgatggagaacaaatcagaggtaaattagagcaacctcgttcagttgccacagttttagcagagtagcaggggtaaaaattgcagaaattcagaagaggaagatgttttcttttacttgatccagcaattcacacagaattgccatgatgcataggaggcaacaacagacagcagcacaccatattcagaccagaacgacgcaaaacaccacagcgaagaactcaaaagccagcaagacaatgcaaagcctgcaattgcaacgagttgagtgatgagagcttggtcgttttgtattcagtctgaacttactgttgcctgagttaaaagtgatgtgaaatgcactagacataataccaggagaactgtgtctcatcttttgttagaacttgagcttcaacgatgaccctgtagactccacggatccaccatagaaatgtttcagactccagatgatttgtttacttaagctgatgaatacggtaactgcctcattcagagttcagagaattggtctttgctgcaatctagcttccagcagagcacgtcgagcgccgttggcaatcagcaagccggccgccttacgccgcggcgccaccgacaccggcagcatcgtactactacctaccggagccgatcagctgcagtgcgtagtacgatgcagagaacagccgcgtttcttgggatcactcgcgtggtgaactcccaacttttaacaacatcatcagataaactgttaatggtagtttgtcacatgccagtgtcataatcacttaatcagaagaaagtactgaagatacacttgtcactgatgagtgctctctgaccaatgagcgaaattgcgttgaaaatgtgtacaagtacacgccggggacataatcatattctgcttcctattctgcaattcttctgttcttaatcttcacctagtctggcagtactcttgatcttgttcctgttcttcttgtgggacaaagccatgtgcctctttgcttactacttgtatcacccaaggacggggagcaatgtgatcatgatcagctgtccaaagttccgatagggtcatttcgctttcagaagagttccttgtttccttcagtcttggctgcgtgccaccacgagctaccaataatcaatgccagtctacacgctctgactatatgacatgggagatgatgcattatttgcaaggacttgttctgttccatgtccacatttcgctcaccgaattcagacgagcttgactagcaatatgcgccacatacactgcgccctgttctttctgatcctgaatttttagattttcgtttgcacgcttcctaagctgctagactatgtgtttcatacaaaatatttatatgtaagattttcttggcatacttctctaaaacattttttcaactttgtatgaataaattaaaaaatagctaattcatttattgatatcctcaaatggatactacaaatatcagattatccatcaatttcagctatctcgaaagcttatgcttggctgtgatggttgtgaggaaagaaatgtgccaatgctggctatgccaaattgccaagtctggaacgaaccggcaggctttgcttcgcttggcattggctttggcagcgccggcgtaaatgaatgtccgcactccaatacgcatgaatcgggtcaggcagtagctgtcatgttgctccctactggcacaatgggaaactcacattcatggtggccaaccaaatccgttacactttaaataacttccatttcctgaatgttgcaactctgaaacgagtactaggagttgagttgaatggcctcgcttgttttcagttctagtgaaagtttgcaactctgaaacacccaccagtttacgacttcctgaaagcctagttcgagtagtaagtagtaacccaattccttttctttttcgccgggtcggagatggaggaaagccccgaacaattacatgaagaaaatgaggagattgtcacataaaacaacaaacatgaatgttgtggaaacaacccaatcctaagataaggaatgtattttgccggtaaatacctaactacatggcacaactaggataacaaatgggtcttatatctctttgatcatgatgcctgcaaaactagcagcttgccgtgctcaccattcttctggtatgcattaggagacctcggtggcggttttcctcactccttcaaagatcttgttgtttctcttcttccaaatcatctaagggtgagtttgaggaggggattgagaagattggtaagatatgtaaaacgaggtgagccattagcgtataattaattacgtattaactattttaaattttaaaaatggattaatatgaattttgaaagcaactttcctatagaaattttttacaaaaaacgcaccgtttagtagtttaggaagcgtgcgcgtggaatacgatatcctttctcaccctatgtcaccagaacgaacactccctaagtaatcaagatcacttgtgcgttgaagattttctgctatgatttttgtatggcagcctgagaagattgccaccaagtttccatgtcagttggtagatgctctgaatgaattgtaactggctgtggatcatgtcccacacaggtcatgaggagaattttttttttaacgcataagagctttgcatgtcaatatattagcggggggagagaattttgtatgactgtaacctgacatagtggtcatggggatttacacgaggagaaaattaaaaagacgagcaaataatggctgtgctattgctaggcaggctccaaacaagcaaaaaaaggaggaaaaagaaactaaaggtaacccaattcctttttgaatcgatcgtgcaaggttattatgcgaccttgcatggatgatggatggtgcatggccatgagacacggcgtcgatctagcgatcggctttggcgtgtcccgatcgcgccgacgcaagccggacggtatgggagggcaccgccgcaccggggcaacgcgacgcacgagagtcgagagatcgaaagcaaaaacagccgagagatactgcgccgcgccgcgcgcgtccgcccatgcatcccaattatggcgcaaccgcccgcgccaccgccgccgacgtcgcgtcgcgtcgttcgttcggtacgcggtgcgtagcgtacgtacgtcctccgcgccacgcaccgcgcgcgcgcatcacgcgtgtgggcgatcgatcgatcgcgcgcgcgcgcgccgagctgatgggctgatgcgccgcggcgccgggcggcctcctctcctgaccaattcaacacacacacacacacacacacatcccgtagcctcatcgcagttaacgcgcccgtgtcccgccgccgttgcggccggtcgcgccgagaaagtagtggagtacgtgatcgatcggctgccgaattctgataggatcagagtatcagacagacgtcgtcgttcggcgataatccctatgcatgccaagacctgcaggtcggatatacaaacacatatttaaattattaaacgtagattaataataaaataaattacatattccacgtgtaaactgcgagatgaatttattaagcctaattaatccgtcattagcaaatgtttactgtaacatcatattgttaaatatggagcaattagacttaaaagattattatcacaatttatacgcaatctatataattagttatttttttcgtttatatttaatacgccatgcacgtgtccaaatgtttgagtgacaaggtgaaaaaatttgccggaatgtaaacaggtcctgagatcaaagccatcaaacacacattgattctctctgagcaaaagaagcatcttttaatttagatgctgggagttaatagagttcatgaaagccgcgggggcctccccttctattgggnnntgggggggggggggcttctgcaaagattcacgttgggtcaatgtcattcatcagagctgcaatcttaatatataggggcggtagatgcttgcagtagatttttatcaaacttatagtacggttattactagcacagagggatactcatctgtgcacactgtttgttcagttgctcgaagcaaatagtgacctcagtcctactgtacagcgtatgtctttgctagctgctttagtcattacatcatgaacgaaaacataaaaataagacatgaaataaacgcgataactttacaaagcatacaatcaagcaaaaagaaagtgcattctcttgtaggccgcacgcctttcaaatgatgccaagttcatctattcaaatataaaaacgatgggcatgatgtacaaattaattgagacgcacaatttccacatgatttcattactagcttgcatttatgcattccatgcatcgtgttcataatcccaataaattaacatataaaatcgcaagtgttcactgattatattaagttttcgttcgtcataattggtaatcagctcatatatctcttgattgaattccattataaaaaaatcaccttatgttgtttttactcatctgtcctacaaacttgtcgtcctagtgggcattcataactgttaggaattattcgcttataaatatcatacaaaatggctttgatctcagaccctgtttagattcccggcaaaatttttcaccctgtcacatcgaacatttggacacatgcatagtgtattaaatataaacgaaaaaaataactaattacatagattacgtgtgaattgcgagacgaatcttttgagcctaatttacgccatgatttgacaatgtgatgctacagtaaacatttgctaatgacagattaattaggcttaatagattcgtctcgcagtttagaggcggagtctgtaatttgtaatttgttttgttattagtatacgttttatacttcaaatgtgtgtccgtatatctaaaacaaattggcacacgaactaaacacaacctaagctgaaaaggaaggaaggccgaggagagataggccagatagaggtagaggactgctctaggactgagctgaaaaggaaggaaagaatgaatgttcggtctaaaaataagtaagcattcagtccaaaaccaagagagtataatgtataggacaaaaaatgtttttacccattgcaacgcacatgtgttttttctagtaatagaaaaaaataatatattacaaccatgtcgtattgtggttacaatagctgaaaacaaaaatatcccccaaaatgaaaaaagggttgtacatcctgtaatgccgtaagagatgaggttgtacatcctgaaagccaaaaactatcaactaccatattcattcactgaacaaaataacaaaataggtccatcgaacaagttagcaacccagaccttaaagtcaacctcgcagattcgatcatcgatgaactgacaaaacaaacagtactaaatatcctttgaggatcctatgtactccatctagttttgtactccatctagttttgatagtcatattttatcttggcatacagaccaaagataagtaattatacttatcatccatttaaacatgatattattggttattcctcgtaaacaagcgattcattaatatttatatttctcaatgcacatgtagccaatcttatgtagaagagtggagagtcatacattaaatccagaaaaaatcattaagatgataggttgttggattgaaatatatctatcaaaaataaatttttcagatttagaaatatgcatatgaaaagtagatggacggagtacaaaatagactcgaacaaattgaatagatagaaaaaagcacactgaacaaatctaactctatcatgaaagacaaatcataaacatggagtgaatgtaagggttttttcagaggaccttgcggcagctttagtttctctcgaaatcaaaatttgacagatttgcgaccaaaatttatgtcggatgttaaatagcaaatccgataattgaaagcatattgatgtatgcagtcacaagaccaagcaaggagtactagaaagttcagtgatacgaatattggacgaatacctgtttaaatgtagcgagacgatcaacgcctgatatgatcgccactactagatctatatagcgtgcagcggggacatagtcgtcgatcagctgcttcacgcacgcatgcttgtgcgttgctcatcagctatgactacatatgacacacaccgtgtgtccgtgtgtgcattgcgcccatcatactgtccatcccttgcagagtcgtcctagtactcgtatattattacgtcgacgccgtacatggcaagatcagtccatatataggtgctgtacatgccagccagccagccagcccaatggggaaaaaagcggcatatcgtcgcattaatccagcgtccatactccatactactgtacgcgccaggcatgcagccagcatgtcgaccagcacgcaccgaacagttacaccaccacgtcaatgaacgtccaagcaacgcatcccaacaccaccacgttaaccccgcgacgacttcctccgatcgaaccacgcgcgggccacccgaacgaacaagcgaacgaacgagcgatcatccacccgcgcgcgggggcctcgcgatcacgtacccgcgcacggcgcacggttgccaccaccagctaggtagctgcccgtgccgtgccgtgccaccaccccccacccccgcgatcagtcgatcgatcgatcgatcgcccgcgcgcacaccggggccggcatccgcatccatcgtcacggtgggtggcgcaacgcaacgtaacgcgcggggccgtgtgaccgtgcggctgccggcattaaaaacccacccccgttttgccagcgcggccccaccgcaatcgatcggcaagcaaacgcgagccgcctccctcccgcggacgttgcaccagaaaaaggaaaaaaagaaaacgtcccaccccgtttactccgttcccgcgccgcaccgcacaccgcgtccatttactccgctctccctcgatcgcacggaggacgggtcgggcgggcggggggcgcgtttgggccaaaatctgttgcgtctcggcgcggtggcggtggggggaccgtgtacgggcgtttcggggggcgtcggattcaaagccgcgcccgtgagaagtccccgtcgggcacctccaatcccacgcttttttccacggtatcgcccgccacagttctcctcttcctctctctcaccacagcacggctgacaacgagtggcgaggtgtcaccaccaatcaagggaaatttaactatttgccactcttatgagtgccaactctccatatgccactattagatttggcctaacatatttgccactagagagagattacatcctaattttttgccactttcgctgagttggagcgccacatcatcatgccaatgtggactggcctggcgaaattacctttgtgcccttgtgcagaaacgagaaaacagggggaaacagaaacgcatcggcatccatctctttctctcgaccacagctgctcaaaccctaccgtcgccgccctgaaactctaccgccgccgccgctgcgcctgaaacccccgccgcctccgccgccgcctggatccctattggcgccgccgcctgaaccctactgccgccgccgcctggaacccacacgcgccggccggccggcgaggccgctactgcgtgacgcagagcgagtcccgtcgcggccggcgggagcctcacgcggccgccccgctgccggccctgacgccactgcgtcgcggccggctctcacgacccagccggcagcggcagggcgagtccccccgctagctcctcccctccaccgcgcctgcacgcgacgccaacgcatcggccggtcatccgggacgtatagctggcggaggtgaagtggatctgatcgtgatgaagccctcggagtgtcctccttggtaaattcattccccttctctgtattccccttctcttgactttgtgtgaggtgtgcagcatgctgttagaattgatcctggctccattttttttgtcaggattgatcctggcaatgctgttagagttgttgttaaatgtgcttcatatgtagcaaacttagagtatggattgctatcaatgtcagagcaagagcatgattggtgggttgataaatgcaaaggttatagtttagataaattctgtgatgatatgactagcaaggtaatatgggggcctagccaagaaattgtagtgtggggattagactttgatagtgggactgaatggaaggtaaccaacaatgaacagtttgagaagtggtttcagtctgggtggaaagagaaagtggtatatcttggggtagaagtggttactaaaaagggatacaagcctgctgaaagctatgtagatcgagttgagtcaacaactcaagttgtcactagtgttttaagtgtagatcttggggttccatcaattgctgaaggtagtgtgataagtgcaaaaccaactggtcagtcaattgctagatgtggtgtgataaattcagattcaattgatatttgctctccagttcaaatgaccaatgaagaagatactggtgacacttgtaaccatgcaccaaatgtagaagactcagctgctcttgtggactggagtaagttggcaatcattttggatggcttagatggtgatgctcatgcattgttggatgaggatgaactatttgatgctatgggtttcaaaaaaacagatgagagagcagcagcaacagcaatacaagaagaagctgcactccctgttattccaattgagattcaacaagatatgatagatgcagccattgtagttagtgatgaggtacctgctgacccagaacttgtttgggatagggatgatccaccaatggaagtagggacaaagtatccatcaatgaatgagttcagaatggcagtgaaacagcatgcaattgttagtgagtttgagcttgagactgaaaaatctgatccagatagatttcgaggaaagtgttctgcaaatggttgcccatggaaaatcagagcaaagacacaggctgataaaagtgtcagggtattatactaactatttaattgtaaaaaaagttttcccatgggctgaacaaagagagtgctttaggcacttgatggagaatatgaagaaattgtttcatgggaacatatatgggaaaaagatgtggcctgcagctaggacatacatgcctcagaagcatcaaatgtggatggatgaagtgtttgaatatagctcagatgtcaagccatggcttgacgaacatcacaacctactgtgggctagaagcaagttttcatgtcagagtaagtgtgaatatatcaacaataacttggcagagtcatggaatgcttggatcaaaggtttgaaggacttgcctattgatgctcttgctgatgcaattagggagaaaaccttgattctttttgagaagaggaggaggatctctacagccctcaatggagtgattcttcctgttgtgattcaccagttgaatgcagcctcaaaggggttaggccatctaaaggtcactaagggtgatccttaccaagctgaggttacagagatacataatgatgaggagctaacaaggcatgtggtgtaccttgacaagtgcacttgcacctgcagggaatggcaagttactgggaaaccttgccaacatgcattggcagtcatcacaaccgtgaggcaaccaaatatggagaaatatgttgataaggctttctctgtgctcagatttcaggcggcatatgcatcaaccatccctaacattacagacaagaagcaatggcctcaagttgagaaagaattcaagcttcttgctcctgtgtccaaaaaaagaaaagtgggtaggcaaaggaagaataggatcccatctgctcttgagaagggcaaggggaaggctacaaggcaaattaagtgtccacaatgtggtgtctttggacacaggaagggaagtgctagatgtgaactaactggcaccaaaaagaggtgtgctgtattttcatctcaattattattcattttcttgctgttatatgctaactgtttttcttttggcaggaagaggaacaagaaaacaacaacaaaggtgggaaggaagaaatcaaagggtgttagtgatgaacaagtaactacaccaagaacaagagcagttacagctagagaagagctgcagaaacacaagtgcagccatcacaaacaagcagccctggaccagtcactaggaggtaagcaccattatgctcttttcatttttctctagctttcattacttattatacactgaactaaacttcttttattatttacaccatcacaaacaccaggaggttggcattggagcttgaccaaagctctcaagtagctccagctatagtggagccacccaagaagcttacacccagaaaaaagctcgcaagcaagaagaaaagtgcaacaccacctaaacttttggattgaaatttgtcaacctgctagtgaaattggttatttgtggtctactatggcatgatattttggaaaaactaattgcaagtaatgtgcgatgatatgtgcactttggtatggcatattttgctatgtggtgtgaatatcttaagtgtatggcctaacgaacttaagtgtatggcctggcctgatgttgctatttctattattgtgcttttgtaatgatgtatggccttgcgtaatggcatgtaacttgttatgtatggccttcacagtaactctgaacttgatagtggttatgaacttggtagtactatttctaacgatgaagaagttattatgggataaaaattgatttttgttgcgcatgtgtgttaatgatgcagtatgttatgtgttgagttgttctcaagttattatgttttatcatttattcatgtgtgcgtagttgatttaattgtattatgttggctattaaccacttgagaatggaggggtaaaattgtcatttcactaggccggtccatgctggcatgctgatgtggtgctccaacccaacgaaagtggcaaaaaattagggcgtaatctctctctagtggtaaatatgttaggccaaatctaatagtggcatatggagagttgacactcgtaagagtggcaaatagttaaatttcccaccaatcaaaggtagtagtcgcagtaacacaacttttcacctatttccctttttagggggtgtttatatggggctaaaactttttagcccatgtcacatcggatgtttggacgctaatttggagtattaaacatagactagtaaaaaaactaattttataaatgagagctaatccgcgagacgaatttttttaagcctaattaatccataattatcaaaagtttactgtagcatcacattgtcaaaatcatggcgtaattagactcaaaagattcgtctcgcgaattagtccaaggttatggaatgagttttgtaattaatgtatgtttaatactttaaattagtgtctaaacatccgatgtgacagggacttgtatgtgacagggacttgaaataagtccctgaaaccaaacagacccttacactacaagtctatacacaaccggctgcgggtatggagaagtactctgcacacgatatccgaagctgatcgaataaaataatcgtcgttattcgccgggatctgaggcatataaaaatgggcaggagtatatgcatggacctgcgtctgcttacgttcgttcatcatcggtgagtgagggtgagagtggggggccgcccatttgactctcgccgtcgacgccgcgtgcgagtcagccccacttgcgattgattttttttaccccgtttcatcctctgatcgatctttaccgctagctgcagttttcttgggcggtaacagcagtagcggcctctgttttatctgcgctgctcgtggactctccacatgtccagctttatctaacacgcttgttattatagccattctctccagccaccctctcgcctcctcctcctctcatcatctcccatccttcctcctcctcaactcctctcctctcttcgcttcttctctcatgctagctactactactagcttctccttctcctgtcgcacggtgcggcggaagtggtagtagtagtagctttcttggtttaagcaaggatcggcgaggacggacgccggcggcgaccgagcttggggtgtgtgtgtgtaaagttgtcttctccggcggatgagctgttgtttcttggctcgcgcctccggcgtgtccggcttgttgccttccatgtccgcgacgctgcaataattcgcttccatatttgctgccgccatgccatgtatagccgcgctgctgatgcggccctccagccgttttaatgcgtgccaaatcctctccccgaggctcataaaaattattgaattgttgggatctgaggggatccgccggagttggtaggatcacggtggagtgattttggccggaggaagaagaagaagaagaaaaactggtgtttgttttgtcatttgtagtgagctcgcgtgatgagcttcggtggcatgttcgatggcgccggctccggcgtcttctcctacgacgccggcggcggcggcggcggcggcggagtacacaactcccgcctcctccctacgccgcccgtccccaagcccggcggcgggttcgccgctcccggcctctctctcggcctggtagattctcacgagcttttccacttcttttgtttgtgattctttgccgtgcttagatattgatttacttttttaaaattttaatcttgtgttggtttagcaaactatggacggtagccagctcggcgacgtgaaccggtcgcttgccatgatgggcaacggcgggagcggcagcggcggcgacggcgactcgctgggacgcggccgggaggaagagaacgacagccgctccggcagcgacaacctggacggcgcctccggcgacgaactcgacccggacaacagcaacccgcgcaagaagaagaagcgttatcaccgccacaccccgcagcaaatccaagaactcgaagcgtaagcgtcaaactctcgatgacatcaggaaaaaaaataacgaagcaaattctgatttttgatggttttttttttctctacgtgcgatcgtgcagcgtgttcaaggagtgtccacatcctgacgagaagcaacggatggagctcagccggcggctcaacctcgagagccgccaggtcaagttctggttccagaatcgccgcacccagatgaaggtttcgcttgctgttgcacagatcaatccatgatgatgtttgattcttctcgtgttcgtttgatcatgattttgaatttttttttggttcgatttgtggtggtggcgagcagacgcagatcgagcggcatgagaacgcgctgctgcggcaggagaacgacaagctgagggcggagaacatgacgatccgggaggcgatgaggaacccgatgtgcgcgagctgcggcggcgcggcggtgctcggcgaggtgtcgctggaggagcagcacctgcgcatcgagaacgcgcggctcaaggacgagctcgaccgcgtctgcgcgctcgccggcaagttcctcggccggccaatctcgagcatctcctccccgggcccgccgtcgctgcaggcgtgctccggcctcgagctcggcgtcggcagcaacggcgggttcgggctcggcgcgctcggggcctcggcggcgatgcagtccatccccgacctgatgggcggctcctccggcctgacgggggggcccgtgggctccgccgccatgcgcctacccgcgggcattggcggcctcgacggcgccatgcacgccgcggcggccgacggcggcgccatcgaccgcgccgtgctcctggagctcgccctcgcggccatggacgagctcgtcaaggtggcgcagatggacgagccgctctggctccccagcctcgacggcgggttcgagacgctcaactacgacgagtaccaccgcgcgttcgccagggtggtcggccagtgccccgccggctacgtctccgaggcgacgcgcgagtccggcatcgccatcatcagcagcgtcgacctcgtcgacagcctcatggacgcggtacacacgcacgcacgcacgcacggttaactccaaaaacaacgcatttgtttaagctgtgtactgacgcaatgcaatccgcggccagccacggtggtcggagatgttcccgtgcgtggtggcgagagcgagcaccacggacatcatctccagcggcatgggcggcacgcgcagcgggtcaattcaactggtgagccatcgatctcccccctctcccctcgccgcgagctagctgttcgtccatggcgtctcgccggctcagacacgccatgccatgccatgcgcagatgcacgcggagctgcaggtgctgtcgccgctggtgccgatacgggaggtggtgttcctgcgtttctgcaagcagcacgccgagggcctctgggcggtggtcgacgtctcggtcgacgccgtcctccgccccgaccagaacggcggcggcgggtcgtcgtcgtcgtcgtacatgggctgccgcctcctccccaccggctgcatcgtgcaggacatgaacaatggctactccaaggtaattaaccaaaccaaaagcaagcaaaaacttctacacctttctcccgtcgattgtgtttgcacttgcacgcacggcgcagcaagcatgtggcggctacagtggtggcctggcccgagagagacaccgccattaagaccttgtacagctcagtattttatgctgggtgaatccaaagccgcgcgcgccgcgacgacggacgcggcgcgccaaccgatgcagcgtcgccaagtgcccccaagtcaatgcgcccccgtacgcgcgcatggtggtgatgaccgccgtggacgcgcgcgcgcgcgcgccgaggcgcgcgtaacaacaacggccggtttcgccggcgacgactcagcgactcgtcgtcactcgcagcagcagccagcaactgctgcttgcttgaccttgtactgcgagagagctaggcgtacgcctcgttagatgagctctcgattttgaaatgtttcgatgcttccgcagcccaatattctcgctgcgtcgtccgtccgtgcgtgcgtgcgtgccaccaagatccagttttttagtgtttctttatggagttcatcacagtatttttatacgacctcgagctcttggttgcactgtggtagtagtagtactatattactgtttctttggctcatcttctctgcgatgctactgtggtggagtagagcttagctagggttttttcgcagcggtcaatcctgaatttctggcgacgcatgccgacctctggatttccactatgctaacacttggtgtttgttattcatttcgactgatactaacacagtagtctgtcctcttgtgcgatggctgcttccggtgctggggttttaccatggtcattttgtttttggggttttttttgcgtgccttttgctgctagctgcaaatctgcaatgtctagttattgttactgctacgtgatgaggatgaatgcacccgtctttttcacctgcctccgccattactgccttgtcgaggctgtgacgaagctgagctgagctgagctcgccgtgatggcagtaactgattcacctgccggtagctaggctaatgtgtgtgtgtgtacgtgtgggcaggtcacgtgggtggttcacgcggagtacgacgagacggcggcgcaccagctctaccggccgctgctccgctccggccaggccctcggcgcccgccgctggctcgcctcgctccagcgacagtgccagtatctcgccatcctctgctccaactccctccccgcccgcgaccacgctggtgagctcgccgttcgtgctagtgctagctccggtggccggagttcgatcttactaatggttcttgtggttttgcagcgataacgccggtggggaggaggagcatgctgaagctggcgcagcggatgacggacaacttctgcgcgggggtgtgcgcgtcggcggcgcagaagtggcggcgcctggacgagtggcgcggcgagggtgggggcggcggcggtggcggcggcggggacggggaggacaaggtgcggatgatggcgcggcacagcgtgggcgcgccgggggagccgccgggcgtcgtgctgagcgccaccacgtcggtgcggctccccggcacgctgccgcagcgcgtgttcgactacctccgcgacgagcagcggcgcggcgactgggacatccttgccaacggcgaggccatgcaggagatggaccacatcgccaagggccagcaccacggcaatgccgtctccctcctccgtccaaatgtaagtttttttcatcttcctacacatgaaaatctctactactcctacataaaaaaaaaacctggcggtggtgatggtgattgtggtgaatctgccttctagagttgataggatcttttaaggctagataaatggggtatatatatatatatattaaaataagttgcaatgtacgtattttgttattgcaagttacaacaaaaggactatgaaaaaaagacacgaatattaggaaatgatctaatatcaaataattagaaggggtgaggtttcgaattcagatcgtctagcgtaccaccttgtggacctagccagaagaccctgggcgtttctcacaaaagaactatactagtgtacataaactagaaggttgtagtaaatttatcattaggttcttttggttgcaattctttagttcttcaaggatagcaagaaaaaatattgtacagggccctgcaaaagtgataaaccctaaatgcaaaagagggagaggcactataattaagctgaaaacttttacctaattaacatggcactgagtgagcacagcctatgcattagctgcacttggcagttgttgctaaagctttacaacatttcaattagtagtacctagtactgtactaccatgagggtggctggttgtatgcctgtatgggtaatgcatgggctgagactgatgagctagcttagtgagtgacagaagcaagaggacaattcggaaaaggataaaaataccgggttgacatttgtgagagaaggctagctgttaactttctccatgttttggaagcttgcttgcagcctagccttgctgagttgctgcccttgtcctggctcagaaagcctgtcaggctttaccccgtgtctcttttttatcttttcttttttattactttggagaggatgacatctttttcttgtttttaacttgcaactcctgatttctgactgcattgattctggcagttgctgcaagcacatactagtgctccatggttccaccaagactgctgttacaaaattgtctccaaaagtttaggatattttatatacatgcagttgttgaaactagaatgtactattatgatattatctaaaaaaagaaactagaaagtaccactctctccgtttcaaaataagtcaatttttatatataaatctagatataggctatgtctagatttgtgtacaaaagctaacagatgaattagatatgattcatataccaatttttcagctttgcattttcaacgaattttcatggtatggcaagttaaaattttccctctagattggagaccactttacaactttcatctgcaccagctcattctatctggttaatttattcctgaacaatgttcgaattcaccaatatatgttcaaacccaccaagaaattcttgccttgaattaagttttgttcacttctcatatcttgaaaaaacaaatactaatgtctctcctgcaggccacaagcgggaaccagaacaacatgctgatcctccaggagacgtgcaccgactcatcgggctccctcgtcgtctacgctccggtggacgtgcagtcgatgcacgtcgtcatgaacggcggcgactccgcctacgtctccctcctcccctccggcttcgccatcctccccgacggccacaacaatggcgcctcgccgtctccggcagaggtcggcagcggcgcctcgccgaactccgccgccggtggcggtggcggtagcaacaacaccgggtcgctggtgacggtggcgttccagatactcgtcaacaacctgccgacggcgaagctcaccgtggagtccgtcgacaccgtcagcaacctcctctcctgcaccatccagaagatcaagtcggcactgcaggccagcatcatctcaccatagataagtggacatttgacgtggattccgactcgaccatttttgagtcgaatcggatgccatctcaaatgtctaacttttgaaggttagaagactgagaggacttccgcggcgggcgatggccgaccgaaactggctgatggatgcaactcaatcgttgatcaggtagagttttcgagaggcgatatgcgagcgaggataaaaataaaattaagttatatatagtgtgtggagtatatttgcatagatgagcaaattaaatggggtgagttgcagagggatcaagtcaagaacgaaccttgcgctaggcttggctcaagctgatgtggtggttcgggtattgacttagtctctggtgaaaataaacccctagggctttgatctcctatatatatctagcagtttgcttaatttaaccattttgtgaagttttttttaattctccaaaatgggggaaatatagagaaacaatactgatcagatccccaagatcgttggtgtttgtttagtttgcataatgttggaatgagttgatatataaacatgtttattttggcatactatgtttaatcagaatgccgttgatagattaattgagaacatcatcaaaatcatatttaaattttcaattttattctatgtttgtttatgcattttttttggaatcatttttctatcatggtatcgttttaaattgtgaaggaaaaagtctatgtttttctattttagaggtttcctccttgggaggtctcccaactattaattgagaagtaaaaaaatagagctgtttcattgacaaaatacatttctcatcttaagaggtatatataaagcgagatatgcatatctcatattattggtcagaaggtttattcgtcttgatagagccacaagggtatgtacctcttgaccaacagtccaacactaaatacctctacatctaaaaaggctcgaaaacaaatacaaaagagattttacaattttactcccagttattaaattaattttgatactcacttgattttttaataatgaaattaaatcccagcctctatataataagatggacgtacacgacctttactatatatcagagtcctggtttatcacaccataaaatggtatagatgctcaacaaaacttacttgattatagggaatatcaaacacatatcgtattagtaaactttcatgtatgcttaatgaatatttccagcaaacaagtacgtatttgcaaactaaagggagtgacgataattagagaaacagtgagaatccttacttatttaggttggattgaatttctaacctcaaaattttagaaatatgttcccgtcagttacaacttactaattacagtgttaacttgaaaattttaaatgaagtaaaaaatggtaaatagaagagggtagtacaactttgtatgtacgtctggttagctagttctgtgttagagcaggtaattaattgcagcatcacttttcggccccctttgattcaaaggaaattcataggaattttagaggatttctttcctataggaatttttcctatatagccctttgaatcaaaggaatggatcttatggaatcctatgaaattcctatggattgcctaatgctatgcaaattttggaggaattctaacatgaggtaaaacctcttggaaactttccttttaagtctttatctctcctctaattcctgcgtttttcctgcggttcaatcaaacgactattcctgtgtttttcctgtgttttgcaatcatctattttacacttacattcctatcaaaaacctgcgtttttcctattcctatgttttctcattcctgcgattcaaaggggcccttcctatccaaagcatacatatatgtacgtgaaacataagttaagagacatgccgtaatgccttgttaattctctgtaacacatctgtcagtaagtcctttgttgcttgtctaactttgtagtatcaagctgattaatgtgcatcagttgtccgatatggctctttaattatgtacatcgacattaataatgtcgagctacgtgtgtatccgcagttagtgtcaacagtgtggccattgttcatgacagcaacatactgagatacccacatttagtgtgatgctactttcttggtcgatcgctcatccctatccttttatatttagataacggtaagcaaccacttttgggcttttggcctctaagcacgtcatattatattgtcaataacactaataacttcctgatacctcaggtaattagatataaaaaaagtaaattttattttggatcactttttattaccaatatttcgtttcgaatcaccatttaaccaatgtttttcagtttggacaaggtatttttacttttgtgtcactttggaacatcctcaactcttttatccatctatatccaatttttcatatgttgaagaaaacatatagctatatattagagttcattgacaagtataaaccgacgttcttaggatcgttcatatgtttgagttaagatcgttcatacgtttgagaaaagagttaagtgatcatccaaagcgaaacaaaggccagattacctaggtaaaaatattagttaaagggtgatacaaagtaaaatatcggtaataaaatgtgggtcaaagtgaaatttacttaaaaaattatgctaaaaaacatggcacctcctttaggctgctcagaaagtgctactagtatttgcttctgttttatggccctattattttcgatttatccatccaccagattatttgtctgacactacaaaatataaggagtatttgtttagttcagttcttaaaacattttgtttatcactataattgagaagataatctgcggcaatatagttcactcgagatttttaacaaatctggaccatgcaccaaagtattactacgtacaacctgcgtatcgtactatctttgctctctccaattttgaaatactctcggtataagttttcgagaggcagcagtgtgcactgcacattgcacacattgaggggcgctttgaatcacaggaatgaaaaaacggagaaataagaaaaacataggattctgacaggaatgcaagtgtaaaacaggagattacaaaacacaggaaaaacacaggaatttgaagagagatagagactcaaaaggattctttccatgaggttctacatcatgttaaatttcctccaaaacttgcatgaaaaaagacaatccataggaattttataggattctataggatccattcatttgattcaaagggccatatataggaaaaaatcctatagaaataagatcctctaaaattcctataaattaccttttaatcaaagggccctgagattggcctcgagtttggctggtagcctgatgtaaacagatgactctcctcggtgatgaaagggggtacatcagctaccacccggtctcatcttttcgtttatacttatacttatacttattaactaaattttaaatttataactttaaattaaagctgatttttggaaacttttcattaaaatttattttaccgtctttacttttaaatcactaagagcacgtattttatttgcaatatatataccgtttggagccgggtaaggataagcatccgcgtccgttaactgcattggtgtgcgggtccctctgccgccgggcgggcaataaattgcgtttgctgcccatcctgcgcaagctcagagacggctagctgatcacaaattcacaagatctctcatatccttgccttgcaaagttgcaatgcacccccaccccaacatctgctgcctcctgtctctttgcgaggacgtcctttactaatacttacatattacttttttttaaaaaaatgaaaaataaatcaggaacatactcctccgtaaaaaaaaactaacctcctagtacaacagatttgaacagttttttattttttcaacgtagggagtataaaatgcaggaatacttgcagccaggaatgaatgttatacttaggatttaaattgaaactcacacgaaagttgtgtttagatccaaagtttggatccaaactttagtccttttccatcacatcaacctgtcatacacatataacttttcagtcacattatctctaatttcaaccaaaatccaaactttaggctgaactataaacagccgaactagcgctcctctttcaacaccggtgccaagaaagcaactgtacgggctgtagacggtggaaaaggcccgtggagacggagcgcgcggcggcgctaagcttttacacggaattcgcggtggatccagcgactttcctagcgaacacggcgactgatcgaacctgccccgatcgggcgggtatggccgcagctgtaactgtgcacgtacggtacggcggccactgttgactgttgggctcccgcggaagatgctgcttctggtctgtagcgaaggcgaagtcacccggacaccggaagcgacgggacggccggccggcgacgtcgtccgtgcagccaggtagttcgttgtactagaatgaattatatttttagttaggttagattttttggggatggagggagtagctgcgccatccggtccagttttctgtagagaacttgacatatagctgtagctagtagtagcatccagccactcaatcctttgcaacgacagatcgaccgatgctatagctagtagtagcatccaaaggtttactcactccgttaaaaaaaaaccctcttaggacaacgaatctggactaagatagttcggatttattgttctagagggatggtcatatcccctcctagtttaatttttttttgaacagatggagtacggcaaatagctgtctgattggttggctaccacaacttaccaccatgtttgattactccctttgttagtatgatttaagttttttaaaatcaaactactttatactccgtatttaattaagtttataaacaaatataacaatattttcaacaagcatagcaatactttaagacaaagtcaaaagtattttataatacgaaacagagggagtagccgatatagtaaagcggcaactaactttctcgatcacttgactactaaccttctcgatcactttgaccattgatcaactcagacaggtatagaaacatacaatatttgttaataagatttagccaaaggctacattcttagagctttaatagtagtcaagtttgattaacttagacaactatctagttatagtcagagttataacaaaaatttcttttaataaatttgatcctacatgtatatatggcaaaattcttttgggccatagttagagaagcttctagttactgcaacttcttctataatcttcaggctcgagctctctaaacaatccacatttttcaaaaaaaatgtagctataaaattcaaaaaataaactagaaattagaaactaagaaatcaagttttttcagatttttaccaaccagctattcaccagcttctcataatcaatagctttccaaacagtcttgttttgctaagatgtgacagattttagggattaactttatgcaagtttgatatttccttcgtcacaaaataaacacatctaatgttggatgtgatatatcttaatactacgaatttatataagatgtgctatatactagatgtacttattttgagacggatgtagtaataacttctattgataaatggtgataaccgcgggtaacaaacatgtcggaacatctcagtcctaacaggagccaatgaccaatgctttttcaggtttatgacagtttgacgcccctgatcgaaagtcgtccgggcatccgtccatcgatctgcagccagaacaagaaaggttggccggtaaaaaggctactgacagtcatagcggcaagtgtgaatcaggaggctcggcggtggtggttatactgcagcgtttcacagttgtgtggtgcagagatcatgcatggctgtcatgagggtaaaaggagttactatatgctgctgaattttggtagtcgtgcagtgaatgttggttgaaacagccccatgattttacaccggacccccatggcacgtacttacatataaggctttactaagtcctgtgtcatggtccaacgctatgacataagcacagccggaggatagtgctgctagagttgaggagacttacgttgggaggagaagaacatcaagagagggattgaacaaatctccctcacaaaacttacctgaatagcgatatactccctccgtttcaaaatatttaacaccgttgactttttagtacgtgtttgaccattcgtcttattcaaaaaatttaagtaattatttattcttttcatatcatttgattcattgttaaatatactttcatgtacacatatagttttacatatttcataaatttttttaataagtcgaacggtcaaacatgtgctaaaaagtcaacggtgtcaaatattttgaaacggagggagtaatacatccctctacattgctggtatgtttgggctcgagctcaagctgtgtcttcgagcttttaagcacgctcagtttgagctcagctatattttaaggatatactaacctttttactgtcatcgattgtatgaatttaccactaaatagggttcaatctaatccgatctctaactctaattctgtcggccactgttcactggactgggatattaggtttggcgtcgacctcctggcctaatgctgatgacatcctgtttaaccccaagagagggagaagcagagcagcagtagtattgcatgtcagcatgtgttagctgtgcctacagagctggacaatagtaatcttcacgtggacctgttcccaaaaattgttactattacccacatgattattccttggtactaattagttaaaaagctgtttgtaataacacccccctttttttctgtaggctgaaggctgaaagctgaaacactgatatgagtgaccaagagtggatgggtcatgtgggtcgtgcgtgcggcggctgcaatggcaattattgatgatacaaatacggccttgcattggatcaacccagcacacctaactggaaaggcttaacagcaacggcaattaatcacaccataccaaacgtaacttacgtaattcgtccatacgctcttaattccattcagcacaattaattaggaataagatgtttatgtgatgtcaacatacctgtgggccaaaagaatccagctaatataggcaacataaatgatagagatgatatttccagaataataagtgcaatgtagagaccatatatcacctctctttgctctgtatcattcaagaaaaatagttagctcagttcaaaacacccatgtaagagcacaaatagcaaaacactgcataatggtttgagaaaaaaaaaaggaatatgggtttggcgcacaaaagtaatcctgtatgtttttcccataagaagtagcaacaacaaggcagacagaaagtagaggacaaaagatatacccgaaaatgatagcagaggtacaaaagctgatagaaaagcttactatcaattgaattaaatagagcgagagagacctgcttaatatgtctgttggattgtggacaacatagattgtttttatacatttcaatcttcatcagcacttaacatcataaatgaggttatgctcgattgctaaactagacctatatcctttaacccatgctgtcatcaatacatgttacaagaatagaccatttactataagcatctaatgacactatcaaacaaataaattttcagaaaaggacataaagctagataggagacacaaatcagaactaagtcccatcacacaagaaggccaaaagaaaaatgacaagcacgattatctgatatgtacagagaatgctactactagttgatattacttgaggatcatagtattattatttgaagggagagctgacaatttcaggtggcaagaggacaataagttagttcagaattcagaataattaaagtataattgggtgttaacacttaaaaactcaaactaaaaaaagtaggcagtcaatgacataaaaaaaatcctaaaacaggttatttagaaagtaaaaacatctgcaaagcagtaaaatggagcccaatgatagcagcatatttggcagataatatcagacattataaccatgatgacatcacgtaccaattagtgggttcacaatatcatgcaagttgaaattcagaggtttcaaatgatattcagaagaacaaatcccatagtcacagaaaacggggtcggtggcagcgatcctcaatccgggaacaccgtcccaggaacacgaggtcattttcgttcccatcttgtaagtagcgtaccatgtttctcgaccctgttcctcgatcccatcgacccgggaactttgatcctacagactgccaattcattacattcagcattccagtgcatattgaagagttaaagtcttttataaaagtgcatatggcagagacagtcacaactcacaaccacaacacaagacattccagcactgtgcatttgaaacagtgagcaagctgcagacctcaataaggcatgccaactgcagtgctacatgagccttcatcattctgttccaaactgaatggacttttcctgtaatatttgttttctgatttttcatcaatgtcttttgcactgtgcattggttgccctttcaatctgtaccgcgttccttcattgcagatatgaaagccgctgaggttacattcacatgtgaaaatttgttgttttgcatagaagaatcattattaatcaagggattgcagaagttccaaacttgaacaatgttttgaagaacagtcaagctgattagtcactaagtgaaatgaaatagaaactctttttgtttaatcagtcagtgctgtttacaaccatgacgctctgaataaaagtccaaatatcttattatctttggatggtaaagaacactacctgtatggttgtcgaccatacctaaagtgaaaaacacatatctaataggttagaccttgcagtcaggttaaacattctgagaactacaaaactggcagggtaaaatatgatactaaatagtaaggttcagcaatcacaaattcacaatggacagaagacataacatgtctgcaatgtatagttcaagactgattatgcatcaaatcgtagtcggatgcaatgatccttcgttaactaagtagaaggtaaagattagtgccagtctatgagtagatacgacaacaggatccaaaaggccagtcttacttttccttgaaatcaactctggaaattaattcttttggactgtatttccagatttcttagccaagactcaagacatagcaaggaaaacataaaacaattaataagattaaatattgacattaacactgacatcaaacaattcagtttagctggagtttccctgcaacacttattacacataaaagttcaattgtttctatacgatgtataagaaatgataggtagtatagtcacagaattttgagatggcaatgccaatccccaataggtagagagagagagagagagagattcactcctagtgtgagagactgagagtactcacaagactcagtaaaaattatcagaagaacgagtgctcaaaataatgaggggttttcagttcccatgcctctctctttgttccttcttcatacaacggagtgcaaaacgaagatgccatccgaccattgcagtgaagttaaatgccgacacccagagtcttcatttgacaatatcaacagttttagcacaagatatctcactagttttagcctcgggtggcaatatcttctcctcaatcagcattgctgcatccgactgttaattcaccatcagaagaaagagagcttatagatggtgtcaatacttgttctagaaggcaagcttccttagttgatgttagtaccacagtatgattctgctcctcagtcctcactcaatgtagagtgactcaactcccgagtcatggccacaatctccaccataatcaccatcagccttaatattcgctctccggtcactcgcctcaccaaggaactcctccctcaattctgctcccccacgacgaccgccaccaagctcatcccatccacgacccgtgctagtgaacatccggtccaaattcgccttctgcgggttcaattccacatgagcagctcttacattgtccgcctcgccgcataaatctcattgggctcaacgagttgacctttgtaatacgcctcccgaaggaacacagcgtgcagcttaccctggtttcccctaggaggaggatgtgctcgaggcggaggcggaggcggttgtgcgcgggggggggggcgaggaggaggagcttgcggatgcggatgatggaggccggcagcgaggaggcgatggtgtcggcctcgaggcggagcgccgtggcggcgcgcggggtgaggcggggcgtggaggacgcggtggaacgcgtgcgggtggcgcaggaggaaacggccggcgtcgaggggcgcgaggcggagctggcgccaagacgggagaagggcacggacatggcccctccgccgccgccggcgagcgcggtgggggtggccgcatagaggaggacggagtagaggacgagaaagcggcgcactccatgatgccgtcgaaggcgtggtcccgcagaagcagcagtggtggacttggatgcatatcccgccgcgactgcggcggcggcggcggccggagtgcggcgatgcggcggagcatcggggtgttaggggaggttttgcggggttggttggtgtgggccgaattggcatgagaaatctttgggttcaagtggttcgtgatgcgggccttgtagcacacaattgggctctttgaccgaaaaggctcattgcaacaaggcctataagatatttcgtcacgtttgtgcgtgtgtttagttccaaagtttttttccaaacttccaactttccatcacatcaaacctttcatacacataatttttcagttacatcgtctccaattttaaccaaattctaaactttggaccaatctaaatacagccaattatacggtacataattatatttaagatttgttcactttgttgtcaaccaaatttttgtacgacaataaactgaacatgatttcaccattacaactttaccgaactccatctatttacaaaactacaccaaatttaaattttgatagggaatcaaaccagacaacaacacatttgcatcttttatattggcaacatttggcattatcaatctttggttttaccaataaataataataataagtttctttttttggaaatgatacaagaaggtataccgttcggacataatgataacattgatgtatcacctgatatctagtaagtattgtttgatacctcatttgaacggtatgatacctccgaggtgtcgcctaataccttagtatcagcctgatactgatactggtaagtatcggctgatactaaggtattaggcgatatctcagatatatcatcccgtctgaacgggatgccgtcccgtcacattcactttttttttttttgcaacgaaatggatatgtccttagagcctggcccattgaaataaatagtgatagggtttattttggcaatgaaatggatatgccatcggagcctggcccattggctgaaatgatcacatcattcacatcgattcttagaaaatggacgttggagtgatgaacaacgcaagttcagtccggtcaaaaaaaaaaagaagaaaatattacagtagttcagtcctgtcaaagagaactatagcatagttcagctttgcgtaatccaacattgtttagctttgcgtaatgcaagctcaacaataaactaggaggttcctttggcgtgtaggaagtaagatcagattgtttaggagtaaactcaatgacaatatggagataaccaccaagtagcataatcccttttgattaggaccaaaatatactgctgctgctgctgctaattaacttggcaagccaatgattccctttcagcagcaaatgctgtggcatcgtcggtagtcggtaccaccggtagcgagaggcgacatatggggtcagtacagctgccctgcggaaaatgattttgccatcgagacaacgtgacaccacagcttctaatagccacttaacttatgtggaatcttttacaatggcgtcatgtgttttgtaaaataaggcaaagggctaagtacagagattggaattttaagcaaattgtgaaaatctgaataaccttgattcttcgatttctggcttttaatttattgtcaagactatatactccttctgcctaaaaacaaatataatactactacaaatatattagtttttttttatgaaggggggtaactatttattctttgaccttttaaaaactggtgattttgaaagaagtcttaactacagtagtaaggatatgtttggttaccggttatactttgccacaactaatgttagataagttgtgacaaccataaaatgtgatgaataaattgctagtcattaagtatggtgaaattggtaaggaagttaagctaaccaaacacatacatataggggtgaaaacagtaacggaaattaccggccgactagcgttcgttttcgactttctaccggccgagcgatatggaaatggtagtcgaccaaaacaaaaatggaaatggcaaaacatatggaaataaaaacggaaatggttttgctgttatatcgatcgtttccgtatctaccgtattcttgtggaaattaccatttcttataatatggtaattaccgtattctaaatatgtcgatatttatagagcatgtctatacttggcccacagcttacagattgactgactcttcaatcaaatctctaacttttatgcatggctaaaataaagttaatttataatttatatagtataagcttgaatttatgtatacatataacatacttatgtaaagttaaatatatgtttttatagtttaatgtttccatatttgttactggtttccgatctgcaccgacatgtttccgtccgtattattccgtttccggttttctgatatttccgatatcgttttcgtttccgagaatatggttacggaaatgattgaggctgtttttcgatcgtttccgaccgttttcatccctacatacataataaattgtggcagtgaaaagtgaggcgtggtatagtgtggctagtaaccaatcactaacgaacatacccaaaagcttgggatccgacatgtggagccctcaccagtcaccacgagttcaggaatggattgggggtctggcttggctgatgagttgctcggtcaattcatgccctttggatgcgggccaggaggccaggacgacgaaggctgaggtgaaagaaagtgagcgagccgtccctgttcgtacagttggatttgttggccacggccgtataccattggcagcatatccatccatcatgcatgcttgctaactccattttccagctagcaattcgcctgcgacacttgaatgcatgcagaaatcgcagagccatgatcgatcgccgattcaccggcgatcgatcgagacgccgagacggacggggattgaaggcacgtacacagcttgcagggcttgcagccagctgcaatgcaagcggatcaagatctggtgcagtactacgactgcaactttagcagttacagtg

SEQ ID NO: 82331 - DNA, 746 bp, Oryza sativa
tgttatatggttatatatatatatatatatatatatatatatatacatatatatatatatatatatatatatatatatataatatatctccaagcgaactcctacagtgaatttcatcttaactaaaccatataacaatatattatatatatatatctccaagcgaactcctacaatgaatttcatcttaactaaactatataacaataataagaacaataataagattaaaatagacttcacctgttgcaacgcacatgtattttttctagtcttagaaaaaatctaaaccaatgatttattgtagaacaaccaataaaatcattagtacattatagaaaaaacaatatcaatctcgttaattgaccatataagagctcgatggatgggaacacttcccataagaagatttttcttctcgttagccgttacgacgagaagatcaagtactaactttttccccatcccatattcattttaacttttgcttattccaattccttaagcatttctattacatttttatcgttttcttggtgaagctagctagggcagctacgtgtatgtatgtatacacggtgccatttgaagtgaccagacaaatatgtcttgctagctggctaaaatagttgcctggtttaatttggaatgaaaaggccacaggatatgctagctaacttaggtgataatgatatgcattgctgctatatcacaccgtacaagaaaagagagaaaaaaagatagtt

SEQ ID NO: 82332 - DNA, 6191 bp, Oryza sativa
catcggtgacaggctttagttactgtccgataaaattaagttatctcaatcgggtattagtatatagccagtcactgatgattagacgatgttattctaatgtatatatagtggctgttagcctgtatatgtagatgattttgcagtcggggttgtcgctgatgtaggctgggagaatcgagtagtgcatgtgcgtggcttgtggccatgagtctaggctatggcagcgcgtccatgatcttgctccccaacccagcggcgaaaagctactccatgaacaggacacggtcgccggtcgtgcgggttgaggcggaggagcggatgctgcacaccgtcggcggcggccggcgtgggtgcgcgcgccgcgccatggtggcgaaggcgagggccttgagccacgtggtgccgcacttgggcgggctcgcgaggacgacttcgccgcggcgctggatggcgatgatcccgggcacccacgtcctctgcacccacactttggtagcaattgaggcgcatcttggggttgctagggagcgaggagataatgctcttgtactcttccagcaggctggggttcaccgccggcacgttgccggcggcgaggcgtggttgaacgtacggcaatggcactggccccatagcagtagattggtcggtggtgctagccatggtaggtacaattggcagagcgccatagcctctccaacaccgtaatactatgtagtattactacacaatctcacattcaaccaacgaagtaaaatgcatacaacggagttgttggattacttgggatcaatataggcgtggaactctcggacccaggggcgggcctaggattttgagattgggtattcggaatgaaaaagggtaaaaaaaactgttttacaacacgaacacaatatttggtacgtatgatcaataacatggtactaccttcgtttcaggttataagactttctggcattatctatattcatataaatgttaatgaatctagacacacatatatgtctagatttattaacatatatatgaatgtgggtaatgctagaaagtcttataatatgaaacgcttattgaattagaactcgcgacatggtttttagcaatttccttgatttattgtgatatactttgtgaaaaaacatatgcagtacaatctactaaccaagtatatatcgattagcatcaatcacagcacggctaatgcacaaattaggcaaccatgcaaattgggtttgaatttgagggagccagcctgctaggctttcttgttgggcttcttttgatcaataatgtttattttctttatttttctgctatttttttggtttaagctaaaaattatgtcgacagaattttgaccttattatagccgatttttcagccgcttgatcctctgatatttgtgcaagagcaaggcaggatgtggactttagagcaagtttaatagtatagccaactaatagctacaaatcatctatagctaatgtaatagctatttcatataatagttgcttactatactattaatatctaatcctacctgtcttggagtccgtgctgcagctagctacaggtctgtagcccgctgcttttctctctcttttttttatctttttaaaatatatttatagctggtttatagcctgctattgtacatgctcttagagcaactcatgtacctcttcaaggccagcggcataggcgagcaacggacatgccacgttgacagtgtaattttacggtgtgtttgactacattaattggtagatttagtagtactacttctcagttaagaaaaaggtaaatactactccagtaaaataaagggtttgtcaatgacatgtggttcagggtggcatattacaaattttgtaaaatttgtgtggtatggttcaaattctcccaataaagaaatagtaagaaccagcacggaacaacaacctcgcccatcatgaccaagacgggtcgtccttcgctcttccgggatcacgcgttggggtcttggtagagatggcaacggggaattcactgtcgggggttacgtctgcgtccccgtccccacggtgataaaatttcaccgtccctgtcaccgtcaacaacgatggggctacattttacccatctccaatccccgtgcggtgaatttatccccgcagttatcccatccccgcttaaacaacaaatccatctccaaatcaagagtacatatctcatcaatatttttctaaataattcactcaacaactgtaggccacagtatcacaaatcaccattacaccatatcaatatatatccaaaatatttcactcaacaaatcaacaaatcataggatcattcatctttgcttcatttgggattgtagcattgtgctgacctagcttcgtggctagaggcaggcgacagcatgaagaaggctggaggcagcgtgctcatcaatggctggaggcggcgggcggcgtgacgacggttggaggcagcaagccacgcgacaacgggtcgacgactggaggtggccggcggcgtgacggcgtctggaggcggccagcgatgcgacgagggctggagacggcgcgctcgtcgatggttggaggcgaccggcggcacggcgtcggccaaaggcgtcgggaccccgcccacgcaaggggacgcggtggcgcacggcacgcgcgtctagagcagcggcagcgtcagcggcggcgctgtggagtggaggactctaatggtgtgtgctgtgtggtggagtggggattggggaatggaagggctgactagggttagaaactatatatatatatatatatatatatatatatagacacacacacacttttgttgttgggcttcaattttatggaccaaaacgattataaagtctaaaatagctccctagctacagtaaatgctggtcacctcgggggatggggacggtgaatggagcaccgtctccgcccccgccatccccgatagtgataggttctggaccattagattcaccatgggtggtagatatcaatcatccccgtcccctaatgtgtgaaatcaccgcggggaatcggtgatcgggtctccattgtcatctctagtcttggggacgacgcattcccttcctcctctcatcccctccctcacacgccgcgacgcctcctcctctttccaatgagcagccaaaccctagcaccgtgcaatcctcactccacggcgccgcgcaatcctctacgtcgcctccatgtcctccttgccggcgctggcggcagcgcgggatcacgccacgtgagagctcaagcggtgccgccgcacgtcacttcggcagcgctgggggggaaggatggggacgccggaggtgacggcgacggagcgaggcggctggtgaacatggatgcccagaagcagatcaggatgggtgattcgctaccaattgtgccgtcggtggcattcatcagggttcatccgcaggctgaggtaagaaatctgtgttctcgcggttgtttatcatgcagattggatgggaaaatgacctctttccctatggcatggatcccttcagataatcagattgctcatattgtttccctgtgtttgattcttcatacctttttttttgtttctttttgtcagcagtgaaagcaaaccaggggactatatgtgcattggagggtgaagcttggtgagatgcattcatctgtattaggacgtgcgtgttccctttgtgtttgttacagtagtttatataggatttggaataaaaaaggggacagttttatgtgcaggggtgcttttggctgcggggtgtccttgttcccaaattcgatgggcacagttgtctggaccatgtcaaaatcgccacaaccaacatcttggttgtgctacaatgcatctgcattgcgattgggcatctactggaaaagaactggtaggtcaatgaatccattaccgtgcttgtcttgcaaggatagttctctcgcgtttgcactccaggtgtttgtagtttttccttacggaagggtagtttcgattctgctccatggcttgcaggggttgatcactagaggtgtgcttcatgcttgtcagtgctgggaagaaaattcacacattcctgtcatcctgtgtctggtgaggacctcttcttcatctattacttccactgatcagtcttcaattctgggcaaactttctatgtaccaatagttcgtgtagttagctcccaaccaaagtggaatttggtttctgttctgtacaggaaaacaaggtgacaatgtgacatgtcttagtttaacttggttttggctaatttaatcttgacaacgaaatgcactgtagtaggaatcacttgagaaattcatgtatttcatatatacacatgatgaaactattttttgcagttgtgtaagatttttttttatctctgaatttatcaaagccatatttttagaactttctcaaacccatgtaatttctgaatgtgaaggtccacttattgaaatggatggattagtcaactacccacccattcccataaaactgtactaaaaaatagattaaacaatcttgactgccctgtcccaaaacaattttttccccctgaaatacagacttaaaaggattgcatcacagtactatctggagcgcttttaaatttagaggacttaggtgctgagtgccaagtgctggatgcgagtaagcttgatcatttagattatttagagaatcagcatccttactcctgcagtaactgaattctaatgtgaatttccagtgttttctttggattagctaataacataaacttttagttgaaatatatatatctttgaaatcactggtagaatatttgtttcattgtagccatctaacctttttctcaatgaattgtatcagtagttttctaacctttttctcaaacttgtacatgaatatattttttttcctggtgaaatttctgaggccaatctttctgatctatagtttggctgcctttctatcagacgccttagattaaactcatggttgaagaattcctctgagaaattcagtcacagatcttacaggctattttattggctgtaatttatgtacctttggtctccattgtatcctgatgaattgagaggctgcatccaagggtaaaatgcgattatgtgcattgtggtagtgatcatgctgcattccaggttatgttggcttgatgaattcattactatcaatgtatgtaacctcacctctatatctccttttctttttctcattttccccttaatcatgtaacgttctaacttattatttctatcaactaaatggctataaggtacggctgctgtaccttcttatgttaagaaaatcattttgagtaccttcaaaggacacacaaaataggatcaagtttatattaacaagagagttacatgtgtaggtaaatcatgtgttttattaaacagacatccgttgaaggatcattcgacaagttgacagagaaagaacataccatcctctattattaatagacaacataagttatttactatttttctgctactttactaaatgggaaattttgttttacgaaacttgtatatcttacccaacatcctattaaaaccgtcacacttcaatcaatcaatgtaaaatccaacattgttgcagctaggttgacagtcagatattagcatattactatttctgtgcatccctctacagaatctaattacatccgtgaaatctgataggccggatactattaaaggccacaagatgttccattcatgccccaacatctccctccaactctatttcctagcgaagattacccaaaggtaaatacgcagctttacaatatcagttgcaatgagttgactaattaatgattgttgaggttttgagcttttcttgctttgttgtttggttttgtgctcttttgcatcatcagtctgtgtgaatgatgcaatatggaagatgtatttcagcgacttgcttccactatcactgtagatgacgatgatgtcatgatggcaactaacattctaaacgaacttgtttagtacatccgtgaaagataacggagcaccatcttcagggtccagaccagtagttcgatttcttcaagaatcctgaatgtagttagatttctatacatatcccaccaagctctaaacatgccattgtttaaaacatattttcagggctgcaggaat

SEQ ID NO: 82333 - DNA, 32758 bp, Oryza sativa
  unsure (1)..(32758): unsure at all n locations
gaaataacaaaaataaaagttttagatcttgatgagttattcaactttgttgttgatgactttttcaattgaaatcgtttagtatttgaaaatgttgttgaatttgttatattttcaaattcaaattcaaagtgttcaaaaaaaatgttatatagaaaaatgaccaaactaaaagttgtaaatcttgataagttatacaactttgttgttgacattttttctatttgaaatcatttactacccgtaaaattattttgactcataaaataaattattatactgcatttaattattttgctatagttcaacttacaaatataaacatttcatatgaaaaatgaaaaaatagtcatcggtgacgggctttagttaatgcccgatagagattaagtatatagcccgtcactgatgagtcatctgtgacaggcctagttgctatctcaaacgggcctcaagttggtgcacgtcacggatgatggtcatctgtaacgggctacaacttgaggcccgtttaagatatgaaatgttatctcaatcgggtctaaagttggcgtccgttggttatctgtgacgggccacaactttaggctcgtttgagatatggaatgttatctcaatcgggtctaaactacggcccgtcactgataggtgtcatccgtgacgggcttaagttttatgcccatctaatttgtctgtgcgaccataactcaatcgggcactttttgacccgattgagatgacttccttatgacggcccgctatttctaggcatattagagcttgtcacagatagaaggatctctagtagtgtcggcgttcaccgtggcggccgcaactggagctccggctggcgcggcctctagcgcccgcggcatctaatttcttcaggggaatgagcccatctatctatccaagtgaaaggtgaattctgctttgatcgtagaataagccacgccatctgttgaataatgaccgttcgatgcaacacaaatttaatatgtaccgttggatatagtcatccgcagcaccgtccaatccacatctcgctataaacacctggagaaaaaagtgaggtctggacgagcacttcccgaggaaaaaaaatatgaattagctaggaaattaaaaaaacatattccctccattcacaattaatcatcctattattaaaataaaaaaaagaattgatcgtcccataacatgtggagccagcggaattcctattttctcatgtgcatgcattcaagaattcagcgaggagagattactggttggatgcaagcatatgatttgaatgcacagtaattagtgggtgattagtttgtcatttggcatgcgctgctagcgtgcatgcgtgggccatccaaccgacattacggcgttatggttttctgaaagttaactgtctctcaatttatttttttccttagtactgttgcacaaacacaatgtgaccatcaattgcgaatggagggagtactggcatccctatctgcctgttatcgccatctgccttgcacaacagaactaatagatagtcagatggcaacaagcaatagctcatcgccgagaaccgatggagccacaaagggaagcttgccgacacacgcgaaggaggttgatatcgtcggtcattgcctagatttgacatctgaagcttttgggaccgaaagatcgagatggacaacgtatgccagcggctgcacaccaaggaggaaggtaatagaaagtgcgtagtttcaatctacccgagtgtcaattcccctaggcaatagctgcagacaggcagttgaagccaagacacttgagcgacgacaaccatcaacgcgagcgagtcaacacatgagggaagcaacggcgttagcgttatggcgagagagataaaggggctctgcacatctcatattggtaggcttaatgggctggctgtgctacttaggccaaatggtcatttgcacctagggatggatattgagcctcggctcggtttattatcctaacgagctaaaaacctagctcggctcggctcgttggaaaactcgagccagctcgtttggctcgcaagcctggccattgtttcccggtgcctctgttccatctttgatggcaggctcctcctcctccatgacgcctcggacgacgattctgtggcgaacggcggcgcgcgcgcatgaagtggtgcttgctcctcgtcctcctactctatatcgcctcggacggtgattccgcggcggacagcaacacacacgcatcaggggaaggagaggaaaagggaagcgcacgctccggatgtcgtgggaagaagagcaacagcgggaggcggcgcttgcacatgcgagcgacggggccattgtgacgcacagaggtgagcagcgacacaagcgtaggacgagcaacggcggtggtggcgtggtttgtgtgtgaccgtgaccctgtttagttggtgaaatgaaaatttttgggtgtcacattggatatttgaccggatgtcgtaagtggtttttggacacgaatgaaaaaactaatttcataactcaccaggaaaccgcgagacgaatcttttgagcctaattaagccgttattagcacatgtgggttactgtagcacttataactaatcatggactaattaggttcaaaagattcgtctcgcgatttacatgcaaactgtacaattagctttttttatctatatttaatgctccatacatatgtctaaagattcgatgtgatgttttttgcgaaaagtttttggagattaaacagggcctgcgtttatgtgttctacttgcttgcctagggtttgtgatgtgcatgtgtgtgggcctactgctgggccgtagacttgctgcttggctgtggacctgtaatttggtgggagtacactacttcttaatgggagtgcagacacgtgactagctactgcagctcgtttggcttgcgagctaagaccctagctcagctcgttaacaatttcaaacgagccgagcgagctaacgagtcacgaatttttcatccagtcctatttgcaccggatcaaattacgagaagagcaaaatgaacaaaaaaaaacatgttattttacatataagactttgtaataataagtaaaattatagaaggtaataaaaaactattgttcttttgcaaataaactttttaactaattaacaatatcttttcctgacaatactttatttacagatctatttctactatgtaaaataaaattaagtttgcttataagctgaggaggacagggggaacataagaggggctcatatgacagcaggaatggtaagaaggcagttgactttggtggtgcgatgggctaaggtgtagatgtgtttattctctatgtatgtaagggcacgtttccttttcagacaaatgctggatattatgcttcatgatagcattatttataaaaaaaacacactaaactccttacaggatttacaaaagattcttcaattatataatattattaagatttcttacacactatggaccatagttcatatgcacttcagtcatatgcctgacacatgtacgcattgtacagggatgtgtttgatctattatgttcctaatgcaggtgtaagatgtacctactccgttacattcctatagagagatatatgcatgctcatttgcgtggtacaagttagctgtacaactgccacacccacatggccacatcctgacaccaaagtccctgtttggtcaaaactttatcttgtgtctagccaagccgacgtcacatgcctgtgattgaaatcattttgcaatattattttcggacatcactttgcaaaaatgatttaggacatgttcttaagtttcccaacttcacattcctttttctcatgcacaacttcactttgcacgttagtgagtttttgttgaataaatctctcacttaatgtgagcacgttttcaatatgctaaaacggtatgtttctttgtaatagatttctatatagaagtttttttaaaaaatcaaataaatctatttttaaaacttatattcgctaatgatttatatcgtctcgcgtgccataacagctagttcgaacgcatactaaatcacatttggtgatgaaatgggcatgttgtaaaatactaccagtttttgtcagttggtcactgtgtctatcggttatatataactgtgctatatcactttggcgtgtattaaaataaaagaatgcatgtctggtaatttttttacatctatatgctaacatctcattttgttatagtctgcttagaaaatatatcaccatgaatgtccactcaccacccaaacatgatatattgtgaaaatgacatttaaagtgatgtctgaaaatgatatatcacttgggatttattgaaataaaaaaatacatgactgatatttctacaaatatatcctacatcataaacctatttttctataatctagagaaaataatgtctagagaaaatattgtctgtgagataagatagcatgtggcccatcaactaatgtacccagattttgatatatacgtactttggtcaattttggtatccattaactgccaatcaacttgtctggtgcgtatatgtctttctaaccaaccaatctagtaatgctaattgtaattacaaaagtaatataatccagccataatactagtataccaccggtaaagagccaattttgagattagatagtatcacttgacatgcaaaaatcgattagatcatctaattagcaatatttactaacccaaatatataaataaatttataaaattagttttgcacagtgaatgtcggatcaagggaaaaaagctacgcaggtagtcttcccaactctcctggctagttggacctggtttagttcccaactttttctttaaacttctagctttttcattacatcaaaatttttctactcacacaaactttcaacttttccgttacatcgttccaatttcaaccaaacttgcaattttgataaaaatataagattggcatgaatgagtgacaagacaaaacaagtctgtgcttgaagtgtgaaaaaaaaaaccatctctgtactacttgtacgtgagcactatgactgtttgctagtgtaattaagaaaggaacagtcctgctaagtagaactcaaccctcctaactcttagccacttgcgcacgtatcttggtacccctcaacggtcaagatttatggttcatatgaactacttccgttcatatatgatttaccctataggaaaatgattttatactcctaggagtacatactccctctccatccaccgttcatccgcaacctgctctaggtcctctattcggctctcctaacgggtgcgtacacaataaacccgtttccatttatatgaaaaggaaataattctcgtagctgttaattatacccccataatcggaacagatgcccacatcgatcccgtttcgatcaaacaactcgatctcgttggcgttcccaggcggcgacgccgtaatcgatctcatcggcgttccgcagatgctgaagcatgagggtgatcgacctggagatgctgccacccattggtgtcactggaggagaggcgggtcggcggagtgcatgagcagggcaaacgtggcataatcgacgggtcatagtagtggagatcatccaaaacagcaggttagtatcggtgtatttctacggccagatcgacgcacgacgtctaaatttttcttgtttgcaggggcacaagagaagagaaccagtttatcgaaattgtcaaagatatatcccagaaattttgatgcctgtgattgaatatcttgatgtctatagagaaggaatatgtttacgtagttcggtccatgcatgcttttagtttcagatgttttttttttcctgtagatgctgtttttttttggtaaattatatgctgttgcctgcttttacacatgaatgtttatatgctactttgattgctatgctagtctctgtatatataactgcactgttcccggaggtgtatgtgtgctaatttatttaatttttaccgagagacatatacactacatgttccttagagagggtgtatgctgctttatttccagtaggggtatgtaatgatttttttttctccagaagaatatgctttccatacagggatatgtactgaatttttttctaacagaagtatttacttaactttgtatatatactgcatttatatggagtgataatattgagtttttctatagagaggtatatactgaactttgttagacaatactagtatatagttcattttccataaatatgctgattttttccatagaggggtatatgctgattttttttttacagaagtacatactgaactttgttagacaaaagtatatactgcattttccatagatatgctgaattttttcaatacagcggtacatactggcttttttacactgaaaggtagtacatactgaaaaaaagaacagtatatactccagagaaaaagaacagtatatactccaacaaaaaattcagtatacaaatttagaaaaaaaagtggtatatactatagatctagaacaagtggtatatactagtactctagaaagaactgcataaactaccctctttatccctgctaaccgatcgatatgtcagcggggatgtagagattaaggctttcaatctggtattacatgtatttggctagcaattaattaaccgatactttgatgcgtccaattgatatttgatatatattttaattttttcttgtagaacggccgccatttaaagtacgtgaagaaattactctacttatctgaagcagcaaaagaccaaaaagcagagagctacatagtgcaatttttataagagtgaattgcactttgggccatgttttattaccaaagttttattttggaccacctgtacttaatatttttactttggactaggtaaccttacctttgttgcacaatagactacccaaactcttttcgcttgtgatgtctagcgtctctttcgacaaaagtatgtcatgtatataggtatgaaagtttgttggcatgtcgttaacaatttgctcgaagtcatcgaagaaataaaaatgtgttttggggtggtccattgtgcaacaaaggtaaagttacctagtccaaagtaaaaagattagataaagggtggtccaaagtgaaactttggcaataaaacatggcccaaagtgaaattaactctttttataaagaaagaaaagcagaatatacttggccaagcaaaaaaaatcttcaatgagaaacgtagtagtatatactgaccaaaggagcattatactcctttaacgaaaaaatgagtatataactcattaaacttgaaatgcagtacatacagaccaaacaaagagatcttcaatgaggaatgcatatatactaactctttacattctgaaaaaaatacatactgaaaaaaagagagaacagtatatactcctaatttagaaatgtggtatatactacaaatctagaacaggtggcatatactactctagagataacggtatatacttgtagtcttaaaaaaaagtggtatgtactactaatgtacatctcaaattttgaacgtacgtgagcattcctgtgtatgcatgcaaaaaatttgaaaaaagaaaccgagcacggcccatggacatgcatccatgcgaacgcacgacgttggcaggagagaggaactacgagcttgagatatgcatcggcgtcatcatcattcatccttgcctctgctttcgtggtcaccatcgccatcgccagacgccagctcgactgactagcaggcattgttaagccactgactgactaaatatttatttcagtaatataaaatctcgactaaattgaaaccatgataaaaacaatggtccactatatagtttattattacttttcattttacaattttcccacactactctcttctatattgcttatatacgcacactatatggtctaaattaataggcctttccccttttttttcatattataagtaggcacacacaaaaagaaaaaaaaatacacgtaccatcacatactcctgcaggagtagaagtaacgtgtgtactgtactcttacccgaactactccctccgtaaaaaaaacaacctagaagaaaatgtgacagagggttatccagattcatatagaggggtcattctcctcatagattgtctttttcttggacggagggagtacaagagtgaaagtaacgtgtgtaggcggtgatgagatcgataggatacgagtagaaaggtcgtcgttccctgcaatgcagggtgagtttagttcctgaaaaaagttgaaagtttgaagaaagttgggcgtttgaaaaaaaagttagaagtttacgtgtgtagaaaagtttttatgtgatatgatgtgatggaaagttgggaataggaggaaactaaacacggccgtagatatgcaggttcaatattgatagacgtgtccagcaatgatgcggctgtgtttggaagttatcttcaaacttccaaaaattccgtcacatcaaatgtttgactcatgtatggagcattaaatatggacgaaaaaaaccaattgcacagtttacatgtaaattgcgagataaatcttttgagcctaattatgccatgatttaacaatatggtgctacagtaaatatttactaatgatgaattaattaggcttaatagatttgtctcgcagtttacaagtagaatctataatttattttgtagcggcgcactggagaaaattttggccaatcaactaaggccgagtttagttccaaactttttcttcaaactttcaatttttccatcacatcaaaactttcctacacacaaacttctaacttttcagtcacatcgtttcaatttcaatcaaacttttaattttggagtgaactaagggtgtgtttagttcacttcaaaattataagtttgattgaaattgtaacgatgtgacggaaaagttaaaagtttgtgtgtagaaaagttttggtgtgataaaaaagttaaaagtttaaaaaaaaagttgagaactaaaccatgcgtaaacactccctaaactcctactcctagcctatagcgacgcactggagcatagcgatgggacttgggagggataagatgcagaaaaacaaggcagcctacttactgatcgatggttcaaacttcacccgactcgcttgcctactggccggcttacctactgtccggccggtcagtttgctcacgctctctctggaaataatcttgatctttactattcgttccgttacagttcatggctgtgtttagttacattcagacttccaacttttctgttacatcaaatgtttggacacatcagtctaaaaaaatatttgaatatatacatggagcattaaatatggacaaaaaaaacccaattacacagtttacatgtaaattgcgagacgaatcttttgagcctaattacactataatttgacaatatggtgctacagtaaatatttgctaatgacggattaattaggcttaatagattcgtctcgtagtttacaggcggaatctgtaatttgttttgttattagtctatgtttaatactttaaatgtgtgtccgtatactttaatttttttttgaaaagtaactaaacatggcctataaatcgttttgtttttttaccaaacttaaactactctaagtttagctaagtttgtagacaaatataataatatttacaataccaaattagtttttattaaatataatatatttgtcttgcgttgaaaatgttactactttttttctacaaacttagtcaaaattgaagcaggttgattttgatcaaaatcaaaacgacttattttctaaaacagagggagtattactgtactagtactctctccgtctgaaaataaatcaacatcgtggtagaaaaatctaaacatatactccctccgtcccataatagatgacgtttttgactttttatttgtaatgtttgaccattcgttttatttgaaaaattagtgcaaatataaaaaaagataagtcatatgtaaagtacttttgataataaaacaaatgacaaacaaaataaataataattctaaatttttttaaataagacgaatgatcaaacattgacaaacaaaaactcaaaaagacaagtaatattaggacggaggaagtacatgtctaattcatcgtagtaagagatttgtttttaagtagattcgactctatgttgaggtggagtcgaatctctgacctggcacgctcaggtcaaatgacacctgagcgcactatgaaaaccctaatctcgctactcaaaccctatatggctatatcggtagacttttgctctcactactgtagacaacaaggaatcggtaggaaggccagcaggcaaatcgcgtgcttcagtttgattccacccacagttcgtgcggtactcaaattttaccctatcagctctcgcaaataatacttttcaagacccagttttttttcaacaccaaactaatttaactatctcgttttccgttaacattcaaagaaattcacttttaaagtttaaaattattaatacttaattaattataaactaatgagctttctcatttcgtgtacattaaaaatctctctctccgcgaagtgagcatagctcaactggttaggttccttgtggtggaaccagcccacccgggttcaaatcctagatttgacacgggtgctcgtatttacggctaattattctttcagtggtagacgacgtacccgtcgacagcgaggcgtctgtcagtcttcctctcctctctaaaacacggtcatctgtggtgactttatgcttttcccaatccactgccactactagaaaaacgatttttcatggcgttggtctatgattttcgctggcagaaaaatgccaaaatcgctagcaaaattgtaacgaagggtaaggggcaccgaccgccagcgaaaatggatcttcgctggcggtcacgctatactagccgccagcgaagatatgtctattttcgctggcggtcacttaggtgcaccgctatcgaagatggataattttcgctggcggttgtgttatacagaccggtagggaaaatgcaattattttttggcctacttaagcaaccgccagtgaaaatacatttttgcttgcgttcattttaagccaaccgccagcaaaaatacattttcgcttgcgttagcttaagacagctgccagcgaaaatagattttcgctggcggtagaaggaccgcttgcatagatggaccaccatctattaatatagaccacgtggcccaccaccaccaccaccagtccaccacccacccgccccctctctccagctcccctccctcccttctctcccttgcgtctatcctccctctcttctccaccaccaccgccgacgccatccatcctcaccaaccagctcctcccaccccacagtcggcagcggcggttttggcgtggcgacgacgacgcgaggcgggtgcgcggcagcgacggtaggcaggcgagcgacggtggcgggaggcggcgcggcggcggctctcgggcatgggagcggtggcgctcgggagcaggtggtggcccgcggggaggccggattcgccgccgctgggccgcggggaggcaggatccaccgtagccgggccgcggagaggcgggatccgccgccgccaggccgcggcgaggccggatccgccgccgtcggctagatttgattttttgtctttttctttttacatgttgttccagatgatgcatatgtttggatctgagtaaatcatgtttgattgtgtaaatgatgtttgatctgtgctgatgatgattttgtatttcgtgtttgaatttggaaatgagcagcgaatctagatgtggatttgaaattaatgaatcaatgggtgccttcatgggtattttcgctggcggctgggcagctgcatgcgtgttttttttccccaaatccattttcgctagcggccgatttaacacagttgacagcaaaaatctattttcgctggcagccgtcttaagctaacgcaagcgaaaatgtatttttgctggcggctggcttaaaannnnnnnnnnnnnnnnnnnnnnnnnnntggcggtcaataaccgctagcgaagatcttgatcttcactggcctttgctttgtggcggccgtaaatttcgctagcaaaaatctaaaatagccgccatgaaaaatggttttcgtagtagtgtgcacctctgcaaaccccaaccgacgcctccttccccttgctgtggcggacaaggagctccgagctgagcggcggtgcgatcgtcctcgtagaggttgccgcggacctcgtcttccttgtggagccaagacgagccgtggcgcgctcatcctcgcggagccgagccgagcggcgcgttcgtcctcacggaggtcgccgcggaccttggcttcctcacgcagccaggcagagcagcggcggggcggctagattcggccttggctcatcagatctcccctctcctcgctggctgttcaaggcaacatcagcgaactcctcggctatggaatgagctggatcaacctatatcagttgtccccttccacggatcgtcctcggccacggcctcttcttctctgtcgctttccccattgagccggcgagcttcaacagtgagagacggcatccggtcgccctcctcccctcccctggacgacgagctcggcagtgtggagcacgaggcaacgacacatccctttctctctccccctcttccttggcggtacagagcactagtgtgggtcgtatctaaaaaactgatgaggaaccgatgggatagtttggctacgcggtttttgctttgctccactggtgaaggaggtggcactgaatatattcggttccctctgcccagtcggaactcggaacgccacatgcgcaccttgtgaatggcctaacccgcattatgcctgcccaccttaattgacccggactgaagcggcagaccgcgcgcataacgcagctgcgccgcacaccatcccatccaggacgagcatcgacaagttgcgttgatcttcacctttttttctcctcttccctgagtcctctgttcgatgtgttcggcacacgtacaccgccaagaacactgctgcgctatgatacggaggcccctggcagagaaagtggccatatataacaaggcagttctagacaagcaagaagagcagaagaagttggacgaggcacttagcgcgccggaagacccgcgaactgcacagcttgagctactgccgttgctcggcaaaaacctgccagatctgaacgtaactgtgtatgatcgccgcagcgcgagaatccggaatgcctacaacgggcagcgggtggccgaagcagtgcaatcaagctccggctccgacaaatgcagcagaacaacgaaaagggtaatacacgaacgttcgtgtccggcgaatcagtcggaagggacacgtgaaacaggatgacacgtcattttcttccgttttcattttttcccttcttttacgttattctcttctgtaatccgttgtatcttttacgtgattcttccataataagtatttctgtttctttccttcgcttctgtttatttctcagattccttttttcgttatacatagtatttttttatatcttcttaacggaaattttctatacaaataatttccggggaaacttttctatatatagtgagactttatatatatgtaaactttatatatatgggctttgaatatatatacttcatatatatatatatatagattatatatatgtagactttatatatagagtttgtatatacaaactttatatacaaattatatctataattaaaaagtttagtgcataaattttactaaaaataaaaatacttagatatttttcaaaaaaagtataatccaatctgatcaatcctcataacagaaaaaggataaaaaaaggaaaagtttatcttttaccatcacgtgaaaggaaaacgagaaaccggaaaacatttttttttgcgcggctccgtttttctttttgtcgttttctgttcgctaggttcgacgctagcgcgcgtttgcgcattagacccacacccattgtatccatttacctcggctgtctatttctagtcagaaaaagtgcaccggaggtccctgaacttgtcaccgagatacgaaaacgtcctcaaaccgcaaaaccaaatatatgtggtcccttaactatagaaaactggtcacccaaggtccttcggtggttttgaccccggttttggtctacgtggcggctaagtcagtgtgggacccacctgtcagcatgccacgtcatcactcctgtcgacgtttgatgtcacaattctgctatttgcatagtatggggatcgtcggtgctaggatatatgtgagactgaggtaaaagagacggagacgaggatttttatacaggttcgggcccctgaactgtcaggtaataaccctacatcctgttggccggagccggtgttgctctttattcaccataatcacaccagtacaatatatggggtagcctatctgactgttgtcgacatggcggtctgaaggtctgactcgtagtcgacaacagggtaatcttcctcctcgaatccgtgcccggcgagatcagagatagctctttcgtctctcctgacagtatccggagacaccgtaggagactagccgtgtctatccctgaagtcgatatccggcgtcttgtcttggcgtatgtaggcttgtatattgtcccgtgtattgtggtgggtgttgattgaggtagtcgtttgtgttgtccgtgttgttcgtgttgatcgtcgattgttcgtgtcccctctcctcctagggggccttgtatttatacccatagatgtccccttgtccaagtagaaccagggaaaccaatatggatacaatccgagtagtccttgtcattttcatgtagaactctggttatctttccttatccggaactccctccatatctgaagtcagtttccgtataggacatggtatgtggtgggtcctgccgagatgtagttgactactattaggtatgtggtatccataacccggacagtatcccccgacttcaatgcaaatgaacgaattcatattctcaaccgcgcgcagaccttggagtaattgttatcgagctcatgtgaccgttctcggtgagttcagagataacgttagacttcctttgttagcctcgtgcgggcacctaaagggtttgtctaagtcaatctccgatgtcaaccaaggaagtacatagcgtacgactaagtctcccgtcttgctgtaatcgagaatttggattgaagtcaagaaattttatctcgacgggtacaccatctcttcattccgtattccttgtcaagatccagcaaccgttctcgagtgatcgagaaggcgtagagtctgcgacggagccttgtcgacatttatcgttctcgccttagtcaatcttggtgtagaaccatagagacatggagtcttcgtcaatgtcaaatagaattttcctgaaatcaatactcagaaaagaatattagatagaaatagcccccgagtgaatgctcaaagggtgacatgttataatatgtatggtaaattgaaaatgaattaaatttactgaccaatgttttgtgtatgagcgtcttctctcttaccgacttcgatcagtcagtttgtagagtcatacactctccctagcccccagccttgtcgtcggagaatcgttctcggaggataaggctcttggacccttgacctgcctttgttaaataagcgctgatcctaaccccaagccgtgtagttggaaagctcagtttccgattacacagcttggttaatacggacggcgagaactcttacacgaccagatcttacatggtcttttgtctctacaagatccgacaaggccttatcggctctgggcgtccccagccgaagttcccttaggttcctcggaggccttgtcaagacggcgtaaagggacagtaggataggtttcaacgctaggtgtcgtcatggtaagggatctctgggtaaaacacttggcgatattgtgtacctgctatcaactttgttgaaatagaggtagtaggagagtcgctacaccgctggtcgaggatcaggtagtagtcataactcgaccacttgaagtggaaatagtggaagaatcgctacaccgctggtcgagaaccagacagtagtcgtaacttgaccacttaaagtggaaatagtgggagaaacgctacatcgctggtcgaggaccaggcagtagtcgtaactcgaccacttaaagtgaaagtagtgggagaaacgctacattgctggtcgagaaaggcagtagtcgtaactcgaccacttaaagtggaaatagtgggagaaacgctacatcgctggtcgagaaccaggcagtagtcataactcgaccactagaagcaaatgtacgagagctcactacgatcaactggttgagaaccggtgagtaggtgtctctcgatcatttggagtcgtggtacaagaaccgctacgctgccggtcgaagaccagtcgtagctgttcctcaaccatctgaagttaaggtgcgagagattgctacgtactggtgcgagaaccagcgagcgagtagaattatctctcgagcaccaatggaagttgctagagttggtttattacatgtgtatctcatgtggccagcatgactcacatacccaacttatagcatatccggatatccgtttgaaatcatgtcgggtgatcaagccgacggcgttcgcgaggaattatccgttaacaaccttttctcgagtagtccagcgatggccggtgctatgagataggtcgtcggtcttcgttggcaggttgggtgcgataactccgcatttgtcgagaatgttctcaataatggagtgtactcgaccataacctactcgagtgctcaatttttcctgaaaaatattttctagaaggcaagatatatagcagataatatcgagtatgtactcaaaaaactgcatggatcttctagtattatcaggatacaacaaacagatgtaaatatcaggcattatgtaaaccgtaaacaagcatgatttatacataagagaacagagtgagcccccagcgttagaccgtagttggcctatcgtcggaagtactcgcacaacggatattgtataagaaacatgctctaggtaaacataataaattatagatctgacaatgctgtatcatctgaataggtacgataaattgcacataaaatattgcgtacctttgtagatacatgccggatgtatctacgaaattagtagatcaatttgaaaaaccaatctaccaattaccttattgcgtactcgttcaacatcatatgatctgacatcttttggtacgccgcgtatcttgaggcttgggtgatctcgatagaccaagttgtcaatgacgatgatgattccgatctcgtcggaagacatgctccggtcgggttagatctccacagccgaagtcgtcgagcagcttgttgttggagaatccatctcttaaacccatctcgtctaaatcctgaagcaccaaaatccccctacctggcgcgccactgtcgacgtttgatgtcacaattctggtatttgcatagtatggggatcgtcggtgctaggatatatgcgagactgaggtaaaagagacggagacgatgatttttatacaggttcgggcccctgaactgtcaggtaataaccctacatcctgttggccggagccggtggttctctttattcaccataatcacaccagtacaatatgtggggtagcctatctaactgttgtcgacatgacggtctgaaggtctgactcgtagtcgacaacagggtagtcttcctcctcgaatccgtgcccggcgagatcagagatagcgctttcttctctcctgacagtacccggagacaccgtaggagactagccgtgcctatccctgaagtcaatatccggcgtcttgtcttggcatatgtaggcttgtatattgtcccgtgtattgtggtgggtgttgattgaggtggtcgtttgtgttgttcgtgttgatcgtcgattgttcgtgtcccctctcctcctagggggccttgtatttatacccatagatgtccccttgtccaagtagaactaggaaaaccaatatggatacaatccgagtagtccttgtcgtttccatgtagaactctggttgtctttccttatccggaactccctccatatctgaagtcagttttcgtataggacatggtatgtggtgggtcctgccgagatgtagtcgactactattaggtatgtggtatccataaccctgacaactccctctctctctctctcccttcctctccctttctcctctctctcttcacttttctccagctggcatgggcggcgggggcggtcgcagcggcggcgctctgggaacggcagggacggtggaaggggaggaggggtcgacccagacgttctacggtcgctgccggtcacggtgtacagccgcagcacgacggcggcggcggcgaaggaggaggaggacgacggcgtcgagtgcgtggtgtgcctcgcggagctcgaggagggcgacgaggccaggttcctcccccggtgcggccacggcttccacgccgaatgcgtcgacatgtgggtcggctcccactccacctgcccgctctgtcgcctgaccgtcgtcgtgttgtcgccgcttcttcttactcccgtcccgccggcgccggccgtgatgcacgacgacgacgtacgggcacggcggcgcccacgccactcgtcgcagcgggagtcgaacacgagcgcgctcgtggacgcctgggccacgggcccacgtggcgcgagcacgacgtagtcgctgtgcgccgtgcactcgaacccgcccccgccctccgccgtggcgaactgcgtgtgcacctccggcggcatccacgccacctccgtccaagcgccgccgccgcttgctccacctccgtggccgccgccgcgcagcgtccacatgcgtccacagcggagatgttcctgacggcgaaaggggacatgaggtcatccccggccatgacggcaatgatggaggtcgggccggtggccaggccgacggtgggggagaggcgcggggtcggggtgatggggagcgcagcgaggaggcgcgtgattgggttggtgagcagtagcgtcttgtgcccctatgcatcggacatgaaggcgagcatgctggcggacgtggccgtgggtgagaacacggcggggccgctagcgacgggcgggagcgggaggcaggaccagttggagggttgaacctggccgccagcggctacctccagggacctactgctggggcggttggcgatgccgacatagagctcgtggccgcaggggaggtggccgtggaggttgcggcaggcgctgcgggtcgtaccgtcgtcctgacggctggcgagggaggagaagcggggcgcaccgtcgatgcggcgaaggaggaggaggacgctagccaccacgccgcggcaggatctggcggcaaaagaggaggcgaggaggacgccgacgaccaccatggtgacgccgacgaccatcgggagaagcggggcacgccgacaccgacgaccaccatgctcgccgctagggggccactacctccactgcctctgcctccgtcaccgccgtctactggccgccgctccccatccaccggccgttccccgcccgcctgtcgccaccgccgctccgcgcctccgctctactccgcttcgtcggctgccgcacgctcacacaccgcctccgccggccgccgctcagccccactcgccaccgcccattccttccccgcggcaaatagaagtgaaaaaaaagaagagaaaaaagaatgggaaagagagagttgacgtggcacgctgacaggtggggcccacgctgacttagccgccacgtagaccaaaaccagggtcgaaaccaccgaaggacctcgggtgaccggttttatatagttaaggaacctcgcatatctggttttacggtttgaggacgtttttttatcccgttgacaagttgagggaccttcggtgcactttttgctttctagtacaagcagacctcttcaaggcccggcccttttcttttttcatctttgttttcctttagggaaaacgtacaccgaaggtccctcaacttgtcatcgggattaaaaaacgtcctcgaaccgtaaaaccagatatacgaggtcccttacatatgtaaaaccggtcacaatagatccctcggcggttttgatcctgattttatcctacgtggctgctgaatcagcataggacccacgtggacctcacatgtcagcctcctctttctttcccctcttctctctcttcctcttctctctttctcactcttctctggctctaggcaagccgacaccggggcgaggcgggggaggaggtccggcggggcgaggcgggagagaaggttcggcggcggcgtcgacgcgggagcaagggaggggcgtcggcggcggcgagggtgaggaggccgcggccggggtcggcatcctggcgccggcgctcgccctggcgcgccagcggcggagaacggcggcctgggaaggtgtcgccgcggggccggcggtggacgtgagaaggagttgacgtggagccggcagtcggcgtcagcggcggcttggtcgattggtcgattgagcaccgccgccgcgtccatctccacctccgccgctggagaacaagttacgaaagaacttcagagtcaagttacgaaagaacaagatgagggtcttgagaagctggaagagacagtactgagcacaaaacatattgcaagattgattgacgatttagatgatcacgttgatgttacgaactcacgtcttcagcgcgtgcaaagaggcttgccattctgaataagcgcgtcaaaggtggctgctcatgcatggccctgctgctatctgtctttgctatagtgtttcttgcggttttagtcaaaaaaaaatcgtgtttcttgcattgcggtcattgcttggcttcttatcaagcacatgtaacctctgtccaactcaaatcagtttgaaatgtgcagtctttcaaagatgtggatgctcccatctcatctctgttttgtgagattgtgagaatggaatataattgcaacaaatcttcgttcagaagatgtgccaaaagaaatcttgatcattatcacaataaacggaacataatcttgctaagagattgtacaactgggaagcaaacaggtaaatactaacaacaaagagagccaggagctactcatcaaagaacaaactgcatggataatcagtgcaagaaacctacatccatttccagaccaaagccgcatttctccaaacgaactctagatgcaagccatcttctcaggcaatgagattgtaacgaactgagagccgctcattcagcgggctgcggatccaccacctcgctctcggaagaagcagcgggggcatctccctcggacggcgccgcggcggcggcggccttggcggcggcagagcgggacttgacgaagtcgaggaggcggctgctgacctccttggagtagagctgcagcgccttgatgccctcctccacggacgccgacgccgcccctgctcgccgtcctccgcaccccgtctccgccgtcctccgcgccgccctccaacctcgacggcgtgctcgccatgggcggcggccggccgcgctatcccctcgccatgggcagatgcacgcgccagctgcccagctgctccccagccgcccgcgcgccgcttttccgccgccatgccgccgccgccgcctgccgcccttctcgcggcgtcggatgagaagagaagagagagagaatgaagggagagagattgacgtggtattctgacatgtgggtctcatgctgactcagcagccacgtaggataaaatcgggatcaaaacccacctagagacctattgtgaccgattttatatagttaaaggacctcgtatatctggttttgcggttgagggacgattttgtaactggatgacaagttgagtgaccttcggtgtactttttccttccctgaatgttgtaagccgagtaccagcagtttctttacttccaatcgttttctttcccgctgttcactgtcttcccgttatcgcctcgtccttttactcgtttcacgtctccccgcctgtgccctccatcccaatcctttttccttgtcttctcctaaaccgcggcttaggttttggcgacaacttgtttttcattgcgttttcgagggggatattttgctcctctggctcttttcctgtttttggatcctctgttctgttttggttcttccgtcgcctaatctctcagcatgagaattctatcctggaatatcataggcttaggagacaaaaagaaaaaaaatctctacttctgtccactctgattgaacataggccagacatagtttgcttgcaagagaccaagcttgcatccatagacagattcacaatgccagctcttcttcctgttttcctacgagattttcattggcagcctgctctcggctcagctgggggcttgctaacagcttgggactccagagagctgccaaccactctggttcacgaaaacagcgactccatctcctgcactttccactcgagaacagaccaaaccaagttctgggtcactaatgtatacgccccccattcggaagatgaaaagctaatcttctttaatcaactttcaacgctcagaattgcaaacaaagagctatggtgctgcattgggaattttaatatctacagatacccttttgaggaaaacaacgacaacttaaacacaagaggaatggtgggtttcaactgttggataaatgaagaaggccttgtagacattgacattcccaacagaagtttcacttggtctaacaaaagaagaaatcccacactggtgaagcttgacaggattcttgtcgacacaagctggaaccaatcgttcgcaacctcatctgccagagccctagtggcgacaacttcggatcatatccctattctggccgagtgctcaaacaactcaaacacattccgatatttttcgtttggaaaatttctggctacaattaccagattttgtcagctgagtggaagaaagctgggttcaaggtacaagaccaatgagagcaatcacgaaattcaaccataaactaagaagattaagagctagggccaaggcctggaacagaagaaaacgaagcttgccaaccctgttgtcagcaaacaaatgcactcttgaatatcttgataagattgagaaatggagaagcctgacaaacctagagttttgtctgaggcaaaaggtttttaaacacattgaataaataattaaattggcacatcaaactaaaatggcaaagaacggccaggatcggattctgcactctgggagaggagaataacaatttttaccacacagtagcctcggtcagcagacagaaaaacgatttaaatttgaaaatatactgttcatttaattttttctcaggaatattcgggatgcaaacacttttgcagaaatataccgtcggtctcgcacaacgtaccgttgcgcaaaaatgacgtgggaatgacgtcgcatgtggtatcgcacggtctcgcggaatggaagagcgagactactgtgattaattatctggattagcgattaattattaggtctaagaaaccagcgacattgtacaatgggcttcatttgattagtaattaattacttaattaacaattaactaataataattagtgattaattatccggattagagattaattaattaattaatcgctaatcaggataattaatcgtaattaaatcgcaaggcaccggtattgttgtttgcttgagcgatatcgctgattacttgagcgagaccgcgcggttgctgcgtggagacgacgtcacctggcggcggcgtaggtggccggcgtggagatgtaagccttcaggcggcaacaatgtggtagccaagtaaggcagccctccacggtaggtatggctcgaggtctcgggtacgcccacccggacatgggcctcatgctcgatcttcagaaaatacgggtcagtagctatgcccagtagcccccttacgccgaggtagaatgaggttaattcattgtaacttggggtaaaaagtacacttatcttcttggaaaagagaagccgggtagcctcctgactccatgccgggatgactggggtcatcgcgaggtggagttgtcttgcacttttgcagcgaatcaagtctatagtcttccactgtgccactggatggttttgagccatggggcaagcaggtaaggtacacctggcttagccggccaagacatggccagggccgactaggtcgccggcaggttttgagcctccgggcgtagcagtaccacagacaacaaggactatcaagcccaagtgcctgaggtcttcgctcaacccctaggtggttgccagccacctgcggggccaaccgggagtaggtggccgggaggttttaagcctttgggcgtggcagtaccatcggtaacaacgaccgtcaagcccaagaacccgaggtctttgttcaaccccctaggtggttgcaagccacctgcggggccgacagaaaaaggactcctgctcagccgggtagggcgtggccagggccaagtgaggggctaggaggttacaggcctccgggcatggcagtaccaaagaaaagaaggaccgtcaagcccaagaacccgaggtcttcgatcgctcgactcctagatggccgcaaaccatttccgaagccgacagaaggggggacacctggctcagccggtaaggtctgaccagggtcggatgggtggcctggaggtcgtaagcctccgagcgcggccatacttcaggtaacgaggaccgtcaagcccaaaaacctaaagccttcgctcaacccctaggtggttgccagtcacctgcggggccgacagaaaaagggacacctaacttagccaagtagggcatggccagggccgagtgagtggccgggaggtcaccaacctccgggtgtggcaataccacaggtaatatggactgtcaagcctaagaacccgaggtcttcgctcaactcctaggtggttgccggccacctgtggagccgacggaagaaaggacacctggcttagccgggtagggcatatggccagggccgagtgggtggcggggagctcgtcacttggtcagagcgacagctcattgttttcttttccttttttaatatattgatgatcgcttcttcatttttaatatttcctgatataaaattcataaattgtgaaagaaattgtaaaagtttcagacaaattaaatgcataataagtaataacttttagggtctattcatacatgcacactctaatccataggtatttttcaagagatttgagtggatagatattttctatgtttttctctctacaatttataagaaagaaaaatttcatttggttttcctataaatacattcgtacgaaccgaatggcactcatgggaattaatccatagaaatccaaaaactttggtttttctctaaaccgaacaagtccttaatattgttttaaaaattcagtaaaacacctacaccttactcatttacggtcagcccatcctttcactaggattttataaaaatcgaatctaatcttcattgggttctattttatagcttttatatgtcccatcgatcaatgtcacctactccattacgacaggttaagaaataaatttatctaatattttaaggcaacttttatatacaaagtttttgcgcaaaatgcatgggttagtagtttgaaaagtgtgctaatagaatacgagaaaaaatctagatcttaataaaaacgaatggaccaataatacccctataagtgtacatacttaagaaataactttttttttgtcacaagtagggcatacgcataaagagcgccatccacgtttcacacgtgtataacaaaatgattgtggcccaattgaaatgcataacatacgagatagtaatcttttttcatataatttttttcgctccactaccaggctaaagctagcgtggcgcaaaatctagctaaaagtttcccgttgcaacgcacgggtatttttctagttagctaaaaaatcaaaaaaaaaagtgcctatactattccatttaaaaaagtgcaaatttcttcgcattgcaccgatgaaaactgacaaaaatggaagaaaaagaaggagaacaagctctacaccttttatatggaacccaatcatagatttgaggtcaaaaacctcccccccctaatttgtgtatgtttagaagagagagaacgccgaaaaaaatgggcttgtgtcgggttggtggctatatagcccgacgatcatcgcatgcggtcggattatcccgtgaacgggataatgcgtgcggccgacagcccggcgtcggtccacggatttttccagccggagccacttatgccccgcctggaaactaacggggctggcgtccaagaaaatcaatcctgtagtagtgcatggtcgcctctaccgctcgtcggagtttcatgctcagacctgcttcagtgccgcgcgctcaagcatgagaccgataatggggaagaggcttcgtcattgccgcggcctactgtacaagctgaaggcggcgattcaagggaggtgtacgggggcgagtaccagcgcgccgtcgagaaggcgagggagatcttcttctcggtgagctgcattcctgaaccccctcaagctcccctcatagatgttttttttgtgtgttttcatgtaataatccatgtatatggatgtttcattagttagatcaaagtgcttctacgggtttccaaaggtgtttcattttttctttgattttttctcagatctttgttgatgtttctgtagcttaaatcatttgtttcatgtgttgaactaaattgtttcatccagtgatctgatagtgtttctctattttttaagcgtttcgatgacttaaaccatttgttgcatatgttgatcaaaattattttatctagtgatttgactgtgtttcacattttttaagaactgaaacattttatctagtgatttgatcaaacattattttttcaaaattgtttcacatttttctaattagtgtcccaacatccgatattacgggactaaaaatagcccctgtgaaacaaataccaccttagtttcttgccaaacttgagtaaattttataaaactgtagatactttgcataatctatcataaaactatagatttaaaaacttatttcacaaaagtagagatttagtgtttttttaatcacaaaactacagatactttgtacaatatatatcacaaactgcatatttaagaacttgtttcacaaaattatagatttaatatcttcatttgtcacaaaactacaggtttagtgtttttattatcacaaaactataggttttagcatttgaagacactaaatatgtagttttgtgataaatgaagacattaaatgtatagtttatagttttgtgaatacactgaatttatagttttgtgaaacaagttcttaaatctatagttttgtgatagattgtataaagtacatatagttttgtgataaagggagacattaaatctctaattttgtgaaacaagctcttaaatagttttgtgataaattgtgcaaaatacatgtagttttgtgaagtttactctcataaatacatatctcaccacggcgtccgctcctcctcacggcccaacattggcggcccagacaggggaaaggggcccatgggccagatgagaatcggattccgatattgttttttttttgacaccccaatattgttttttgtttgataggattccgatattgtttacaacaaataaaaggatcctaaaaaaagcgcaacaaaaagaacggatccccctgtgaagcggctcgaaagaggacacacgactccaccgagatacccatcgagcaaaccctagccatccgaccgtgtcgccatggccatgcgcgctctgctccccaagctgaggatcccggcggccgcttcccgccggactctcccaccgtttcgctcttcatccaccgcctctcaggtgagattcaatccaattcgttccccctcctctaccgatacggactcaggttctcatgttcatgtgcgatgcgacacctcgtgattttacacctgcttctacattttttactcttccgattcaccgtttacctatgtgtgccttgcccttgcccgtgccgatgaacctttagaccctttgtttccttcaaattatctagtttctttgctactacctctctctctatatatagtactaccttatatgcgtgtctctgtgtcggaattaaatcttctttatttgccccccgagatgagcaaatcgaccctgttatttccctttgcctgtttttcttcattattatttaccaataacaagtagaagagtagcatttccttttggtccctaagggtgtgtttagttcacgtcaaaattggaagtttggttgaaattggaatgatgtgacggaaaacttggaagtttatgtgcgtaggaaatttttgatgtgatggaaaagttgagaactaaactcggcctaatcttatatagtagctagcctctgtttctcacctagtcttcttacgcgtatgatactcgcctcgctggctgttttttagctagattgatcaagccagtccttccaatttgatgttagattcacaccttacttgattaccagcgcatgtatatagtgtctttgcttccagcagttcattaattatttctggtactctggttgattttcgcttaccattgcatcgccatctgaatttttctcttccatcttatatgcaactgcaggataagcttgcagccgtcaaagaacgctctccacaactttatgacgagtacggtgcagattcatgttctattttgacatcaatttcgtccttttaacttgcccaacatacatgtttaactctaaaataaaacttgctgactaatgacttctctttatttttttcctctccctccaagcctctactggaaaaatgcttgtgaacgcgaggacaggttcgagaggaagattttgttttatcaagtcattttcaatttcatcgcattcaacacatcatcttatcttttcggctcttccagcgagcaggactaagaggagtagtgttaattaatattaattaattaatagcactttgagtaattatgtggcatctcttgtagtagcactttatttatgatatctatctgccccctctctgcatgtaacaacactttgaatgttatcagtgtgccctgaaacaaatgtagcgagcaggactaaaaggagcagtgttaattaataataggtaatgcactttgagtaattatgtggcatctcttgtagtagcactttatttatggtatctatgtgcccccactctgcatgtaacaaccctttgaatgttatcagtgtgccctgaaacaaatgtatgggaagctaacaatttttttgccatagaaattgcgctctctttaattgtttttcaatctgttcaaactactcgaggtatgtataccatgactatttggggtgctgtttggagtcgaattgagtttgtattgtttgctttagttccatgcatgtataataggttgcaacctgaaaccgttagagaagaactgaagttgtaaccgatatactataacatatatactactccctccgtttcaaaatatttgacaccgttaactttttagcacatgtttgaccgttcgtcttattcaaaaaatttgtgaaatatgtaaaactatatgtgtatatgaaagtatatttaacaatgaatcaaatgatatgaaaagaataaataattacttaaatttaaatatttttgaataagacgaatggtcaaacacatgcttaaaaaatcaacggtgttaaacattcttttttgctgataacatccacacatgacacatccaaaaaagcactaggcacttccctcccgatccttctagcgtctcctctcagacatgtggcaagcaagaaaaagattactccataaaaaataaacaatgggctattggttttcatggcaattaattggcataatttaatgggctgcactaattaagatcaattttgagacgtcaaataagtaaaataaacatgaacggttgttgtgaaaaaaaataggaatacatattacgatactgcagtatgtaacttacggactactttatttgtaacaatcaggaaaaagaccactataattacaaggaaaaaaatcttgatatcttttacacataatatggtcgcgcaaacgcgtgactgagtggctcgttaaattaaaataagaaaacttgtaatattttaaaagaaaaacaatagaacaaggtagagacagaaaaaaaaagaataaactatcatagaactgcgggaactgttattcaaactcagtgccttcacgcgagaggaaatgcaatataccagcaggctagtgctccttcattgtctgttagctctgcgcaccttttatattccggaatagaggtcagcgccagctacaatgacggcgagctcaatggttggcgctgaggtcacggcttatttttagaattagtttttgatgtaggttattcttgaaataagttttataaaagggtcaatttgtcaaaaaaaatagcttgttcgattggagttgaatagtacatattggaaatacatatacgaatgatacaaagccagaacatattgctcgaaattttttattagcaataataataataatcctagttactggaaggccttgtatcaacgacttagaacggtaaccaccatctcaatcgggaggcaacccccactcaatcgggcaaacggccgtcatgaagctatctcaatcgggcctcaattaaagcccgataactttgacccagacgaccggtcaaactatagcccatcacgaatgacctatctcaatcgggccacgactatcacccgtcacagatgactactaacctcaatcggacctagactagagcacgtcacagatgacacttatctcaatcgggcctaaactatagcccgtcacagatgaccattaactatagcccatcacagatgagtataataaaaaaaaatttattttttggctagccttaggcctttgttagccatgccatgccgtcccgcctctcccaggccagtctttttttttcaggccaagcatgcttaacattaaagttctttggaaatcggcttccgaaaaagtagttataacttgttggtatgattattctattaatcctattaagccctgggccaggatgtcacaccccaacattccccattcatatacattcattcacatacacaaccatcaatatatttaacacaaccacattcacataacatccattttgatcacatatttcacatcaattcacatatttcactagcaaaaccgagttaattggatcaaatatatatttagcaagtattatcatcaaaaggaggcaaatcagacttctaggaaaaatgaatttcgaattgaattttataatactaaataaactcatatgaaaaagctgtcaaaaacaaagttatagaactcattaagatctgtcaaaaataaagcccatcacagatgagtcatcagtgatgggccctatactaatgcccgattgagatgacctatttctatcgggcattaaataatgcccgtcaccgatgagtattttttccattttccatatgaaatgtttatattcaatttatgtggtattttttattttcaatttatgagaactttaaatttaattttaggccatttttgtgtgtcaaatgcaaaaatcacaaacaacaaaattgtataactcatcgagatctacaactattgtatcggtcctttatacaaataagttcatttgaacaattcaaattttgaattttcaaaatttgacaacttcgaacaaaaattgaggttaataaatgattttaaatggaaaagtcatcataaccaaagttgtagaactcatcgaggtgcaaaatttttattttggtcatttctccatctgactcaatttgaacaatttgaaatttgaaattcaaagtttgagaaattcaaatagaattttttgttagtgaacgacttcaacagaaaaagtcatcaacaacaaagttgtataactcatcaagatctataacttttatttttgtcatttttctatataacattttttgaacagtttgaatttgaatttgaaaatatcacaacttcaaacaacattttcaaatattaaatgatttcaactgaaaaagttatcaacaacagagtagaataactcatcaagatctaaaacttttattttggtcatttcttcatccgataaagtgatagtaacattattcacaaaattgacatatttcttatctggttttataaactataacacatatatgtaaaatttgtgaacaatgttatgaacattttatcggatgaagaaatgacaaaaataaaagttttagatcttgatgagttatacaattttgttgttgattactttttcagctgaaatcatttaatat

SEQ ID NO: 82334 - DNA, 4555 bp, Oryza sativa
tataggtaagtttggtttgctctgattttagaaaaaaaaaaggaaagagaaaatagaatagatcaaaaagccctcgagaagattgaaaaacattcggtcgaattggatagggaggatcagccccagtattgtattgacacgggactactttcctgagattgaagacagtggtaggatgtgcaagctgaatgccgaagagaggtagcttactagctaggacgtagtgccgaagagaggtagcgtactaggccggggctgaaaaggaagaaagaaatgggctttcgactcaaaaacaatattaatttttattaactttttaattataatgtatagtgatcccaatgttttaatttattactcagctcctaatagttattgtatataaaaaaatactttacccgttgcaacgcacggtattttttctagtaatttaacaaaactaatttggtaatgtaaatattactatatttgtctataaatagtagaactaagaggttaaatccttcctggcgatgcaccgtgaatagcctaaatattgaatcacaaggcagttgaataacaatctcagttccccaccaggaacaacacattattaaagattattaagaggtttagttggcaactcaaaactggatattatcagacatgaatttcattttaacagatagaatatttcgattctgcttccaaatttcattgacatgatggtagatgaaaatctagcctgaaaatttaggcacaagcatgaaggtatccagcgagtaataattgagagacataagatagtactagtaggattttaggatttgagtttacagacagacttagtggactttttatttttgttattatattattattgtcaagcaactcggttatcttttcatgattgccactagtaggaagtaaacacaaatccaccaaaaaaaagagaggggggattcgtaagaattatgctatctaagtttatttttcactcattccatatataccaatacaaataacaaaaggatagaatacctatctgatcccaatgcaactcccctatgagcatcttcgaagactggccacgcacgcacactcacccctatgagcaatcttcgaagattggatcggcaaatctttgagattgacgaagtcaccaccgtcactaaaagcacaatgtcgttaaattttggaaaattcgtttttatgggaagttgaacccataacctatggtgtcgttaaatcttggaaaattcgttcttatagagagtcgaacccataatctaaggtgctactgaggctcttgtaaccactagattacatgcgctttcgcaactattactcactttatttactcttaatacaattattccctacttttgtaaacttcgatacaattattactcaaaaataaatttatttcgaaataaatgagaggagctgatgaacccaatcaatatggaacatactccctccgttccaaaaaaaaaaagacaaaccccgcgtttccgtgtctaacgtttgaccgtccgtcttatttgaaaaaattacgaaaaaaaattaaaaagacaagtcacacataaagtattaactatgttttatcatctaacaataatgaaaatactaattataaaaaaaatttatataatacggacaatcaaacattggacacggaaatctagggtttattttttttggggggaacggagggagtaggtagtacattggaaattagaagaagcattaggagagattgatggcggtcgctggcaagataggagtagtagagtcgcgggagagaaaggagggaggcgagcgagacgagaagatgatttgatttgatctgattttggttaattttgatttcgatttgatggtacgagatacaagacgagctggtttgtccacccacgcacggcaacgccggtcggtcgtcgtgcaacggagtacgtgatcgaccagggtcggagtggcatgtgcatgcgatcggcaacaacgtcgtgcatctgcacgacgggtccgggtcggactcggacggattacttccccgtccatgtccagatttccttcgacaagttaaggcgaagctactggggcgcggttccgggagcgcttaagtcctaactaacctgttttagactctaactaattgaattagttttagataatagtgataattaagataagattttttttgaacggaatgtttgttgttttacgtcgtgcatcatttctctatctccacatgctgctagctgctgaccaccacgcgtgcatgcatgagccatgcatgggggcggcgggcgagcacctcgcaccaccttaccaagaatcgccgccgccattgctgttgccgttgccgagcatgctgctattctagaaccctgtggtctcatggccaccgatgacgccgccatcgccaccttggttcttgccgtcgtcgtgctgatgatcaccgccgctgttcgtgtcgccagccacagcgctcaccaccggcttcaagtcctcgaaggggaacaacaacatgcccaccgcgctctcttgcaacccagcactgcacgcgccgaacaccccggagccgccgcctgcacccgcgccgtgcgtgtcttgggagaaatcgagcacggtctgaccttgttgctgctgctgctgtcgtggtggcggcatgcggaactcgccgagatgtaacctcgccgctgcatactccgccaacatccctagcgactccatctgaggcagaggaatgcagtagctgatgctcctcagcaactccatcgccgagaacacgcacccacactgcccctgccaccggcgccattcaccgccgccaggttgcctccggggttgcacatgctgctgctctccaagctcgggaacgccgtgaactccagcgactgcagggcgtggccgtggtgttgcgggaatgctaggttgaggtcctgcgcgccctcgtgcatcagcttcaggttcttagccgccagccccacggggaccgagccggacaccgccgcagaggaggaggtcgacgcggccaccgatgacaccacgaggacgacgagcgctttttctcccgtgccattgccgtcgtacgcgcctccctcctcatcgtcgctgtcgtcctcgtggccgtcgccacgtctccaccaccaccccaattgccgctgcaatcgctaaccctagaaatcacacaggtggaggatttgggggagaatggttggatcggaaatgggggagccaaaatgtggggggctaaaatgcaagtatgtttccaccgtggacggccacataagcaagtcaacccagtcagaggcgctttagacctaaatgattcacttaaataagatcgcggactcgaatgacgattttcctatatcatagaactaagtgacacctcactccaactttaagtaccggccatgtactttactctttaaaaaaaagtacgaatctatcgtggtggagggggtatacaataaaccaggagcgcacggcgcgagacatctatcgtggaaaaccttgcagcgctgatgatgaggttacaactcgcactagaagggataccatcatctcaatcgggcggtaaaccccatctcaatcgggcacggcgtccgtcacaggctagaagtcacagatgtgaagagttatctcaatcgggcaaacggccatcacggatgaatctatctcaatcaggccctaattaaagcccgtcaccgatagctttgacctagacgaccagtcaaactatagcccatcacagatgacctatctcaatcgggccacaactagcgcccgtcacagatgacccttatctgtgacgggcattaactatggcccgtcacagatgagtcatctgtgacgggcattaactatggcccatcacagatgaccctcatctcaatcggacctaagttaacgcccgtcacagatgagtataatcaaaaaaaataaattttattttttggctagtctcaggcctcctaggctagtctttttttgtcctcacttgaagttcaaactttccggtcggtcaccgtgaaattgctccaagccaagtacgcttaacatcaaggttctttggagattggcttccggaaaagtagttgtaacttgttggtatgagtattctattaatcttattaagccctagaccaggatatcaaattggggttattaaatgatttcaaatggaaaagttaccaaaaccaaagttgtagaactcatcgaggtgcaaaatttttattttggtcatttctccatatgactctatttaaacaatttgaaatttgaaattcaaagtttgaaaagtttaaatagaattttagatcagtgaatgacttcaactgaaaaagtcatcaacaacaaagttgtataactcatcaagatctataacttttattttggtcatttttctatataacattttttgaaccgtttaaatttgaatttgaaaatatgaaaacttcaaataacattttcaaatactaaatgatatcaactgaaaaagtcatcaacaacaaagttgaataactcatcaagatctaaaacttttattttggtcatttcttcatac

SEQ ID NO: 82335 - DNA, 3319 bp, Oryza sativa
ccagaaagatggggtggggtaagggggggggggctccgggacatcgaagcctctctccggaggtacactttgtttattccggagctcttccccaaacacattttaacgacatattgcaggatagttagagttgtgtgaatgcacgacttcattatatactggccatgtgattgatccacgtaatgaataagaaaaaatgtttaacagcagaggttatagtcgcatgaatgtgcgactgcatagattagtatttcttgaaaccggaggtcagtgcagctctcaacagatagatatggtggaacaattttatttggtcagtgttgagtttccttgacatgcactgtgcattagtaaatgtatatgctctacacacagaaaattgtaggctttttcttgacagaattttatttgtttgtcaagtccaacccactcagcatcaccaagacattgacagtaatcaattcccaaaactaagggtctgttcactttgatgccattttcaaccttaccaaattttagtaaagttgccaaaaaaatggctacatttagtttgctgccaaattttggtaactatataagaaatcctgccaaaattttgacaagttaccaaaattctggcaactatgccaaaattttggcaataacaaaatttggtaaggtttcttttggcatcaaagtgaacagacactaagttttttggagctcctgaactgtatatctaaagtaccgaaagaactaaagtttcttgcaatctggttaggccacgtcatctaaaatatatggaccgtctgatttcccctcgagacaacgtgagtcgttcgatccttcacttggtgtaacctcttcgtgatactccgagaaacttctttttgcaaatagatccttccaggtccctacgatgaaatcgcgattcccctttatctcgtcttctcctcgtcacgctcgcgccgcatccgctcacgaggccgaatcgccctcgcgcctcatctcgtcgtcgtcgccgcctgcccactgccacctcttcccctgccatgccgtcgcctgctctgcactatcacctcttcctagtccccgccaccggcgccgcttcctcctcctcgtccctgccctccacctccagcccccagccaccgcctcttcctcctagtccccactggtactgtcgcgccgcctgcacctcctcgtcctttctccatccctagcgccacgctgccgccgcttcctcctcctgctcctctcctcgcctcccttcagaaagccagcttcaaagcgctatggcacatcccagagcaatggcagcatggacgcatgtgaggacacccatccgtcgagccgaccgtggtaaagctttcatcaaggtgctcgaggccgactccatgtgagttcacctgatctttcctcctgtttgctactccagtatttgggctgaatgtatagctctgctcctgctatgagattgatgagttgcttcacatgtccgttctcccaaatacgttgaactcggtgctgctcaaatacaactggcagtgttgatttgaattatggaaccataatggtcagttacttagttgtttgagtttaatttccagaaacatccactattatgttgtaaaataattgaagaccggacaggtgaagatgatctttcgaataagccgatagaaaaaaaaatatatgggataccttctggctttcaatgggcaaaacctaacagaagacttattcagtttggccttggtgaaatctgtaacctggaaacatattgttttgttttcatatatgatatatgcagatccaacaaatgctttggttattactcagtatagttgaattccatcactcatcagcccgttaaagaatactgttaattttctgaaactaagagcaatgccattacttaatctctattcacttatgaataggaggttttgttcttatgggaaagtaggtttcactattgattcctcaattttttgtagttttttctatgcgcgctaactcagcaagttttttatgggcctaattgttcaaagacagattcttttagactctagattgaattaaatttggatacttgacatgtacatatttttctataattcccatctaaccatagcttttgctagcagactacaaaatagaatttcctagaacctgatttgtgattataacattttgtacataacaggtcgaaatcagatgtgcatatgtaatggctcagttctgccgaccattaataaatttctgaaggttagaagtttcttgccaatctcaattaattaacatccaaaatatcaagtgtgatggctgctctaagttctaattgtttgtgtatactccaatatcgctatgaatctgaacctgtatgtggttaacattacagatttgctatgattgattctatcaataatgccttggcatttccctttacagtgtttgaaggcactcaaagttagatgccctttttgcataatgtaagttttctctggttattgaataaccatgagtggtttttgcctgactgatgattctataaaaacgagtggccactgatcaagctttctatcctggtgttatcttttgtctgacgttatgtaatttgataacatatttttttgtaacataatttgatatagaattttagtttctctaatcattgagccataaaccttttgattcattgactaatttatatgttaatgtgagaacattcttggaactatgaaaatatggcgaagtcccaagtattggaaaccaaaagcaagaggttgatcttgaccataatatttaaaccttttgttcggaacataggttcatctcgatatataattctagctaaatgtttatcaagttatgtaattttgaaagagaaatcaaatttaaagtagaatccaaaattataatacgtatatgtaggtgaatctaacatagctttgccactggctttagtggcttaagtggttttttgcctgactgatgattctataagtctctcgagttattactgcgaactactacgtactccctccatactcataaaggaagtcgtttaggacagtgacacggtctccaaaacacaactttgacttcttattactataaaaatatttattaaaaatgatatatgtatacttttatgaaagtatttttcaagacaaatctatacatataatttttatattttcaaactcaacaacttaagagtaattcatgatttatattcccaaggtttgacttaaacattctcctaaacgacttcctttatgagtatggagggagtatttgttaactgtcaagtagtagtgtctacagtggaatc

SEQ ID NO: 82336 - DNA, 2228 bp, Oryza sativa
gttaactcaaaagtatgaaaaagttactcatatgctaactgaagtattgatccaaactaaagttaccaaagcagcgaaaagccgaaaacataagaaaagcttagtggcccattggagacaaatcaatagagcacacaagaagcatgttaccatggacatgttcaataggcaccaaacatgctatatatccgtatatggtatcctcaagtactatcatcctaaaatctaggttgctatctattgttatgaataagaagctaaaaaaccagtgcaagcagaaaagcttgagtcggaccattttttagaaaagtttagtgttcatgctcttctataatagttctgtaaaaaaaatactattttttccctgacaaactcttataatctcaaattaatcagttcaaccagtattgaactcccaaattaatgagcccgactggatatcttactgaacagaacaaaaaaaaaaatgcattagatgctcaaatgcttgagatttccatcatgtcattcatcatgaaattccctcttccaatacatgcaatggcaaaagcagtgaaagaacaactatacaggacagtacctgataggatgaggaagaataattatcaactgactggaaggcggccaacgtttgaggtggaagagttgtcttattcaaataagacagtgtttcttcagtctgatcagaagttcagaatgcattactaaccattttttttcagaaaattagtttgtccaatcaagcatttagaggcctaatggctaattgacccctttcatgggactggacaaaaatctaaccaaaaagaaattatcactttaatccattttatattcctcccaatgaacatcatgcatgactccaaaggttccagcatccattccatttcaatttcagagattataaccagaatatgagatatagctttatgcaacgagaagacacagcagaatagcctaccaagacaccgggttgggtagttggcgaacatggccatggcagtgctctcactgtcgggaatgattagcgagtcgagcccctggagccctagaagctgtgtcagcttcaccacctccaccccctcacctcgatcctcctcagcgctgcacccaccggccacaaccgtataaagccatcaataacccaagcacgcagcatcaaagcaaaccataccgaccatgctcgttgtaggagacatgggcgttggacttgaggcggagcgcaggaacagacgccaacgccgatggagaccttcacagagagggatcggaggagcgtcgtgggacggacggggatgcggtgacccgtcttggtccgagcaaagcgcacggtgaggaccattggctagggcctgcagatcatcagtgaggacccgttggctgggacgcgtgatgaatcaatgaggagggctggcgcggcagatcagagcggatcccactctgtcggtggtgttgctgttggagttaatttatttctagaacataccagcctactctctaaccctctctactactcgtgaaactaaagtcaaggttgaagtccttgctctgtaaattttctagaacagtgtagtgtgtagacatgcatgatgtgattttacagtagtactagtaccagtgaagtttgacaatgtagtagtactacaagtctctagctaggtcctgaagcttcctacatgtcggtttatcaagcctataaatagaaagccagtgcatgtgtatagactgatgatggtgtgctgcccaacgtacaagcaagtgtactgttcagccctcaagcaagcaagtaaagaaaccagttaaaactagcacaagcttctctgctcctcttctctgatcccctgcttaggaaatatttagcaccaacaactggtatcagagcgcccaggttcgagtagggcgtgacggagtagcacggcgtatcggtattgtcaattgaagctacaagtatggcttcaagttcgggcgccacaatggcgcagtctatggttcctgtatttgcaggagaaaattatgatatatggagcatcaagatgcggacgctgctgctatctcaaggattgtgggatattgttgagaatggctatcaagagtattccgctggagaaactcttacggcggaacagaaaaagtctttggcagaggatcggatgtcggacgccaaggccttgttcttgatccaacaaggagttgcggaaagtctatttccgcgtattattggcgccaag

SEQ ID NO: 82337 - DNA, 2824 bp, Oryza sativa
aaaggagataagaggtaagtttcttcagctaggtttgaagtgcatgctaactgttctcctcatgcagcgatgcctgaacatttagcacgctctcttcgctgtaaagaccagtgcagcatgcatcgttgtaaagtaagcagccattgtgtcctaattacaagtttattaagttgtgatcagagcatgatccttgtttaactacactaatgccatctgaaccaagcacacaagatcacggatcatagcctctagtacagttttcctgatgtcttttctctctctcttttcttctctttcttttcattcgttttgtcaagagacaagaggattggacatgagtatgccttttgatagtgtgcattccactaaccataccaactaacactagctagctagatcattctttaagcagactggactacaaaattcagacatgatctttctgaacaatgggagataatgttttgcattcttgcagtgctactgctgacaatctttgggagcagggaagccaatggaatcagctaagatagaactgaatgctcttgaccctcttacagtacatgttaggtgttgtccccacttaatccattaatttcaatcttcacttgtttaacctttactgtttgtaccacctgtagttgctttgacaagttctatttcacagtggcttaacacatggcctgagcttggctggactctgctgattggcttgagtttgtgcctgaacacaagctttgtctgtagttacctacatttggagtactagtgtactacatatgcaggtaaaagtaaactaactcttacttacagggttcagatcaagctgtaattaacgaagtgattaaagctaggagtactagttttgcagttacagttgaactcacctagaaagcttgcaaaggtagcgggcatttcatctaaaaaagcagcaacctcaacaactttgggccagctccctgcatttgcatgccagcagtgaacaatcatggtacatgtttcagttggcagagagagaaagatgagctcttgaagactgaacctttttttggccttcactttggatactgttgagcatttgacccttttgttaatacctaaccaccatctctctggcttctgctgtttgcaattacaaccttaagatctggagtagaaagcaatgcatttgccccgaaaaggagggtggtccattttggtagattatcatgttaaatacaatctcatgtgatctcaaatgtaggagtaggattgttatctttttaacagcaggaatctgattagcagtgtcacttgcatgaggagtgactaaactacggaggagtgcaagtgcctggggtcaaaatacacatgcaacttcactcaggtgacagaaagatgaccacctgtttagctaaaatataattaaagtagggaggagaaagtgaggctgagcatcttttcctaaaaagaatcatgaaaatagtatgaaatttatttactctgtattaaaatgcagctttgaaatatgatacaaactttagtgaaataaagttcagatccataacaattcctgatgcttagctgaactgaatacaactgaataaaagaatacaactgaactattttgcgatgaaatgctactggttggatttgatggaatagcaactgaatacacagaatatatatccaagaaccaaatgtcatggtaatttcctgatgaaaattaccattgctccaggcaatagtctcctagacaaatgtttcagccatgtgttctcctggtccaaagactgaatagtgcatgtacttactgttgatgagcagagcagcagcgttggttgatacggataaatacagttgtgaactaccaatcaatcacatgatctgctgagatcaaaccctgctgatatttacctaaactgactgctttactgaagattgaaagtgtttttactgcaatgttgagtacaatacagctatgaattagtatcaatcaatcacatgatatgatgagatcaaatctttctgatagttagttagttagttagttagttacctatacctgactgcattacagcagattaattgcaaagtgtttttactgcaatgttgagtacaaaatgatcacagtttaggagcttggtcaagggaatctactactattacacgagtagctactactacagtatctcaagttttagctgtcgagtggcagtgacaattgaaggtaggggccaccatgggaggcaggggtgggtccacataacagaatggatactctacctctacctctgtgtgcctgggatgccatgtgaggagcaccaagtagtaggacgtcagtctagcatatttcttcagatcaagtgatcaaccactctgctgactgctctcaccagggatcaacatttatgggcgatttcaagtccccaaccatcgccaattcatcgccacacgtcaatgcaggtccatggaaacaaaacacactagcgagatttattgtacgtttgcatgcattatatcgctaaaaattaggagtatatacataatttcttctcttgagcatggatggatatgaactgaatgccatgttgtactagttgagttgagcttgagcaggttagctcatgaacagttcgtggtcatgaatgaggtagtatgatactataggtaaactagccaattttttttttgataaaggaagcttttattaatctcagacgattacatcaagttgatagaaccatactaagaaaactcccggcctctgcataactaggatgcacacagccaaaacacacaaacccacaaaagagtttgtaacaagagaaggaaagcagtaaaa

SEQ ID NO: 82338 - DNA, 3443 bp, Oryza sativa
agacaagactatgtcaaaattcaaattcataactagagttgatttagtttaggacggagggtgattcttcgcatgcggttgatcaactggcccccgagggaccggtttttgtaggcacggtcaattatggtccgcctgcaatctattggggtgatcgtctaggaaaaccatttgtgtagtagtgtatgcagcagtgtctgggatcatgattttgcttcgttacggattgaggtcgcgaagtgaatcggactaaacccacagactgacaacgtaaacgttttcaatttttaagtatggtatgatatgatgatagatatagatgcagggtcttcgtttttgtgctgtcactttatgtcacaggctcacagcaatagtcttctctgtaattgaagcagggcttccacatgatgttcatgcagccggccactcgaccaacttaaagcctcagtagctcagtggtataagcatcaggaggttgccgttgcacatgtgaactgtagcatttcagatttgtgcagattgttttttttagggaaattactaccagtcaattgcctagtaagttatatattaataaaccaaaatattaacttgtgcaacttgttgtcgtctttacttttagccacaattagttattctatcttctgatgacaaatgcagttatgcactcgagaaattttaaatatctacccattcttgcagactgaacaatttcaaatatgtgtaacttgggatctttccttttaaacccttctctaaataagacacattttttttcttttataccagaggtaagtaaggccctgctttcacggaaggcaaacatgtatagtgtttttttatgctgtggataccagctacatgccagaccgaaaacagagaagggctcacaccatctaccaaaaacttcagaacccttaagataagcatacttagggttctacatcctggggcaaaccccgagatactccaggctataagcaagacaccaataactgacatacaactattggaattaacttcattagcgaacaaaaggtcgagatcactgcagattgtctacagcttgatgcagcaagatttcggcatttccagcattattccaagttcatcaggattcaaaagcaccttccaatataccgagaaaatgacgcaaaaaagaaaatcacagttagagggctggaaaggagcttggttttaaatatcataccattgcgcacaattgcacaaacaaaagaagccaacaaacagcagaaaacaacatcattttaagttttaaccctattcttcctagcaccagcccccgattgcctcaatgaagtagtagtgtttagaacctcacggcggaaaatttcatccacaagcattgcaacaaatataatacaccaaacaaattgtgcaatggagcaacagaaaagcattcacggttttcagttatgtgatttttctcataattttcaagaaaataagacgatcgtgcttacaattttcaatcgttcgaaattcttgcagcatggaaagatgacggctaatccctgcatgaagaacaggtattctgttcaatgaatactgctatctccttttcttaagttttggtgagttaagtaagtatttcaggtttgtttcagacctcgccctgtttgtttctcagaaagaagcagatggtaaataaatggtaatcaattggcaagggggcacagagaggcctggggcatttagggcttgggaaccaggcttaaccctataaaattattgagatttcatcaaaataccatcaaaattgttgaatctacagaatgattagctagaagagttagctcagccctacgcttgatctattcctagcttcaccgcctgttggttggtgcttggttttttgcccaccttgcactcatgatttattttgtgcctactaaagagcaaggctaataatacagaagacttgttagctatataagattctttgcagccttctcttagcccacacatataatagttagctatttacaactaatacagggctcacttgtctctctcacagaatttgttggttcttgcgtccaatcgagatataagtttacagcccgcttctcctctctctcggtctctcctctcctctctcctccacctcagcatttagccgacttacatcctcctattatacttactctaagcattatgaagcttttgccttccttcaatatgaaacctcactatggttgttcgatgaatccaatcaagcttttttgcactgttttccttttttgtctaatttaacttcaccaattaaaacccaatatttttgttggcggcattgagcttagttcttcctttcaagaactaaatatcaatgaggactggtatctcttcaggtcagatttttagatggttcatgtttttttccaaatccagctgataattggttgtgctatgtgctgaataacacaagggttgatacaaatttgcaggaaaaaaactctagctagcaggtaattgaccaatcaccttgatgttattttcaaacctataatgtggtgtaaaatttagttttctcataaataaatcattccatcgcatatctgccttttatttgatgaaaattataacctaccattgatttcagtcaaacttttgttattgtgtacttccctttgggttttttcttttggagcaaactgttggatccagtggatcattctggtaaatggtagtcatattgtgcttttacttgcagttgcatgcttgcatttgcccttgcatatgattgcatagataattttcttttgaacactacacatttagggatttcagttttcttagttgtgacaaattataataacgaatggactgaattgtatgttttgcaagctcttttcagttctactgttggctagtacgtgttggcgcatctactaagtgaaaggttaatctcacgacgtcaggaggatgtgccacgttatacaaacgttattagccgtcgatgctaacagtgaaataatgtgtaccgttggatatagtggcaaatagtaaaaacaaagtgcatgcatcttcatgagacttctagacttccagtagaagcctctcagtccacaatgagaagcccgatctgagaaagcccaagaaagaaggtgaggggaaggagaaaactaaagaaagattgaaaaaaaaatatgatttaaattatccagacttatgtacgtataatacattgaaaaaagttctaagaagcactctataatgttgataattttcaatgaaatacaatgagaaaaggagcgagtatgagattagcatttgtgctatttcttaagtctagataaaagggtcatgcaataatagagatggccggaaagtgggctcaagttgcagggaacaagatggttattcatactccaatttttaagtcaaaattttgttggcacaaaaccaactagtgtctttgg

SEQ ID NO: 82339 - DNA, 10623 bp, Oryza sativa
ctggtgttccaaccacaacatcaacaccataattaagagctctcatttgatgactgatgggaacacctccatagacacaaagagagtccaaaggagcagattccttaaattccttctcaacttgtctagcaagttctctagtaggtgcgagaattatggctaaaggatttctaccactcctgcatgcaccaaactataccattatcacaataaattctatctgtccgataattacataaaacaaattccaggtgagaaagtgaaaccaacccattcttctcattgtgacgaagaatcctgtccatgataggaataccaaaagccaacgttttcccagttccagttcttgcacgtccaatcatatctttgccttgcattgctggatcaaggacagccctctggacagagaaagataaaacacatcactacataaaaaagcaaaaaaaagaaaaataaagtagagtgacaagagcaccaagcaaatcatattgcaaattagataaattgtagggaaaaacacattctagattgagatgacataaatgatagatctactctataaccgctgcattgccaagaatacaaatgatctgcccagattctggtggaactcaaggaccacaataacttgtaattcttttttccccttttaatattttggatctacatctctagatgaaagaacttgacctggtcagaaattcagaatcactagacctcgtttatattgcagactaaataagcacgagtatacaccaccccaaataaggtacaatacagtccatcaaattttctgttgatggtttgaagcaaagtcctattgatttatcgaatttgctgccaaaataaattagacattctttctcttgtccaaacttgcaaacagttgaacagtacgatgcaaaatacattaccagcagctcagcatcgtgtaagtacaactatacagctcctatgtgcaaaactaagaatggcaaattcctagttttcatgacaaaactgtgccactattcaactaaatctaacgattcagcagcacacgactgataactctacagttctagcacttccaaagctaacgacaccagcatctcatctaggggaaagaatttcatcagccactctactcgttcatgttgaaaacgggcctaatcaatcaaacctcagtttctactgaggaaggcggcgttatggagtctaccatgatagatccacagcaagcctgtcctctgttcatgagagatattggtggggactccatgtgttggtttttaaattcatgatcctatttaatttttgtatggaatttatatggagaaaataccatatgcttctattatggcttacaatttgggtgacaaggcgttttggtccatcagtcatctgttcttatatggcaatgttatcttggcttcatttgaaacaattaactgtgagaacgttatttaacacttagaagcgggataagtcgatcaaaatgcagcatatttgcatctaggactcttcatggatcattaacttttcaatttttaaacagttaatgtcctgtactgtgcaatgatttagtttacagcaaacagctggttgcacagcatcaatgtgaagtatccacactgtttggtactcatattgtttacttgtattaaacctttgtctcgatgcttaacttgtgttttttttttacaccacagcaaaatgtagcaaatgttctactagcttctaagtgcagttaacagaagtccaatgtgcactttggccttttggactactattcaactgtggaaaatctttctaacttgaaaatttctaggacagatttaggattttggaaccaagaaaacttattgagctgaaaaacaggttcaatctttagtgggcatctagtaccgaataagcacaagcacaggaagtgtactaaaacaagggcaccagaagaatgtccatcaaattttgagttgacggttcaaagaacatcctattgaattttttgcagggaagatttgaattcgaatttgtgccaaaatcaaactacacaatagtcattctttctcttgcccaaacttgtatacaattcaacagtgggacacggaatagagagccagcagctaagtgaatagggtatgtactactatacaacctaatgtagcaaactaagatggccctttcctcactccatcacacaactatgctgataattcaactaaactaaaagaaatcagtagcacacgacaatgaaatgtaaatatgacagaactgtagaaaaagcacaatctggaatgagatgaacatataaataggcttgttccataactgctgcattgctgagacaccaaatgtgaccagattccagtggaacacagtgtccaaatatgcaaataacttatgattcccttcttttttcttctaatattttgaatttaaaattttacatctgaagattaaagaacttggctcaggaagaacctcattctgtgattcattgtgtataacaataagcacaagtgtactctaaaaaaaaggcaccagagaatgccaatcaaatttcagttgatggttcaaagcaacatcctattcatttgaattcgaatttgctgccaaaatcaaattatacaatagacattctcttgttgaacattgcaaacaattcaacagtggtacacaaaatacagtactagcttctcagtgtataggatatctacaactatacagctgtgatgtagcacaactaagaatggcccattcatcatttccatcaggaaactatgctgctaattcaactaaactaaaagaaaatcagtagcacacgcacagttctagcgattccaaacctaaaaatgccagcatctcatctggagccaagcatttcatccgtgaatctactccttcatgccaaaaccggaccaaatcaagcaagccataataagtttccaattagcgagcagcaagccggctacctggatggggaagagcctggtgatgccccgtgcggcgagcctctccacgatccacggcgagatccccagcctcgcgacctccagcccgtcgtccccaccgacggccgcccccgcctccgggctggaccacgacgccggtgtggacctgaaccccagggggctcggcgagccatggaacgcccgccgcctcggtggctccggcgcagcagggccccggcatgggtcgagagggctagccgacggggagagcagcgcggcgagaagagatctcccccgcggcgccgccggcgaggaggaggcggcgcagagcgcacggctgagtagcgagaacatggctttttttttttttagggaaattcttatcttgggcttgggatgtgagaagtgaagcgggttagcgggtatagggatggcaaaggggccatccccgctgggtgtgttccgacagggccgcacacccgatgagcccatatgcccattggcattagcgagaacaatatgatagttcggcaagccgactgcgagggctgcagctgcggctacgcacagtgagtatggtactgtttgtaccggctacggcacaaccacaacctagcagccgaacaagtccaattgtgtttttttttgttttttttgaaaatttttgtgttgggctttaggatgtgagaagtgaagcggatacggatgataaattgtttgtgttgtttggatctgtttctattcgccgtcgagtaatttcttattgtatcaagttatgaaccgagttcctttttttagaaaaaaaaagaaccgagttcatataaaatattctattctcttaaaaattcagttttttttacgaaacaattacttcaacgttcgtgctgatacaatgttgttactaaaacttatgctagtcgattttttttctctaaacttttatgatcatttaagtgtagtcgttaaaagaatgatcatttgtgtaattaataagtaaaaaaattaaaaattttgggcactcaccctctcggtctcacaacaactatgagtttttccttttatctgtgataaatcttttacgactgaaactattaatggaactcgggttattaattaaaacgtgtgactagtcaattaacacagcttacgagtgattctattcatagccacaattactgttcacggacataaatgtactactgacattgcaaacttggacaatcaacaacaaaattggcaggtgttatattggagctagaatgagctgcaaattgcttcagcccgagattaaacagacaactaaacccagactagcatacatccaacgcccgcagctaatctttgaatccagattatacatccacatcaaacagagcatgcatgcacgcactcaggcataaattaaaccactgttcttctaatcaagtcttagagaaagaaataagcctcacatcctctcatatagatcacttggagcgtccaaagtatgggatcttcccaaccagaaaagcccagacgttctccagaatgaggttggtaaaggtgtctataaccattttcacgtcttctgcatcaattgattgaagcaccatacccaactcttgcgcgaacttgtcaatcacgaagggaattccgaacttgatcgccagtacaactgtcacaacaactccaacaaagaggcctagtccagttgtaaaaggtatactccaacgaagttgattcatcatgaccttgattttatccatgtctgcagctccggtcctaaaatttccaaatgacaaacattgattattcttaactttcattaaaaagaacacatgtatgcactaacagaaactaatgattggtacatactgtgcatactaaccacataataaaaagattaaatttcagtttagatcacttttaataactgaagtttcacaatatactagggcctaacatatatttcacataaacaccacatatagtaccattctttacactttcgataagaatttacagctatacatatcctagcgcaaaaaaaactatacataacaatagatcctaccaaacaaatagggtttcattaattagtactaactctgtctcaaacataacaatctaggatatgattaggcttatcataggactataaatttagacatgctctatgtccaaattcatagtcttgggatagatctaatcttatcttagataagattgtggaacgaaggaagtacatataaacttccacaaatcagtcaccacatgacaattgagggcacttaacttgatgaatactcagactaaaaatagtgaagtagctcgtcgcacccctaattagagtcaattctttagagtgacaggtaattaagtcattcaaaaattaaatcaacaatttaagataatcaatcaagcaatatgatatttgttgcttgccctttgtgaaccccggtccaaagtgttaaagaatgttactatatgcagtgttatgtgaaaatatgaacctataactagtccggtgtaaaattttggttagtaaagaaggcccaaaataaaatatactcttaacaaaaaagatgaacaaattgattgattttaaacagctcatacaacagagatgattagatgaatggtttctcacctcggacgagaacacaagtcgtcgagtttgccagagatgttcctggcgtagagaagaatcctttggagaagacgttcatcgcgaggtttcgtcctccgacggcgacgagcaccgggcgcgcggtcgtcggccttgtcggcgtcgccctcaacgaccaccccggcaacatccttggccttgtcgacgtcgctcgtgccatcgacgaccaccgcggcgacattcttggccttgtcctggtcgcccgcgccctcgacatcctggctgcccgcacctcccgctccggtaccgaacttgtcgacatcggtcgcgtcctggaggccggcgccgtcagccatcttggctttgtcggcgtcgtcattgatgtgcttgtaggcgatgccgttcatggcgctgctgtcgcctggtccacctccatgagaatcgagcagctctttgagaccttggtctttctggttggaggggagtgacgagatgcccctgttgcggaggaacggagaagggggcagcaacgggagcggacggacgacgagagcgcgcggtgggttgccgtggccgcgcccgcggacggtgatcttggcgtcccggcgccagcccgtctccttggcgacggcgacgtccttggagaagagcacggcgttcaccgcggccaccgctctggtgtcgtcctggatggcggcgagcgacgcggcctcccgtgtcgtcgccccctgcccctggcgcagcagctcagagcggttggtgacagacagcacggaggtgtgacgaccagccagcatcggtggcgatggtggtgcgcccgcgggccagcgacgcggcagccttggcggcggcgcggaggcggatcatgttccgtcgtcgggagcgcgcggttgtagctggttgtggtggagctagcgatcgagctaaccctagacgacgacggagcggggcatggcgaggtcggaggcggcggcgataggtggatggggggaagggatgggatcgatcaaaccctagttagactcaccatctcacaccagccgcggctcgtgctcgtgtgctccgagagtgagagagagaggaataaggacgtgtttcttttgcttttgcttttagctgttgatcccctcaggcggttgcaggagaagacggaaaccaaaccgtgcctaaacggcgttagccagctgattcgtctactcattccctccagggatgggacccaccatgcaagtccgaccgactaggcgactactggttgcattgcacctaagccgcgcgccatgcaccgatcgtatgtatactgcgttcaccactggacctcgcacgcaacgcaaacgtacggttcgaccgatccatacgaccataccctagcctggcgcacggtgcagtggtagcgagtagcgacaaccctttttaattacacttttgcccttttcttttctaccgtagtgggttacaagcgcgcgcttagcccttgtatactttctttctttcttttttatttttaagaaagcccttggtaatactagtggtacaatgttcgtgtggctgacctgatttaaagttgctggaaaggattaactaattattcccactctccctaaaattttcatgaggccggtgagagtgggcaccaagggctagctgtttagtttgatgtcacaaatatgtagtttgaatgtattttgttatatattctttgaggaggaggggtatcctttcgagtttctcaattcaataatatctacctggtgttcaagaaatcaatattgttagaggcaattttatggtctaccgatggataaatggctaattttgctacatggctatttaattcgttattgggcattataaaaatgtgctatagctagaggacacttacaaaactggtatattttgtgaggatgtcgtggctgttattttattatttatggcctaatcatatagagaaaactttcaaaaaagataagaattttgcccataagcttctaacctaacattggattgaataagtaataagatgtatgatattaatgcacttggcatgatgaccaattgagagttgcataattaatgtgcattttgaaaatatggaaggaaatcaaaattctggtttattttcaaaattctgtaaaaaattaaaaatttagaagagttacaaacacagccttaaagagctagcaattttaataaaaatgtagtctccaacagagttggtattcgactatctaaaccaaaatgtgacaattttaataaaaatgtagtctccaacagacttgccaaacggatggctaagccatccggctagccaaactcatctcctagctagcaaaacttgccaaacgtgggccccaccaccctccaaaccccctctttccccgtcccctcactcactctccctctgtgtcgccgtccttttcttttccacccctcttcgcaccagcgctccctctctgtcgcactcctctcacgtcgcagttgttgaagatccataacttcgcgccaccgctgtcaaagattgggagccaagatcactagcaagcgccaggcgccagggtcccctcctcacgttgccaccgtacgtccgctgctgatttccagtagtctccatcgcatatgctgctgatttccatctccgtcgcctcctcgccgacgcacatcctcctcctccattgcagcaagcatctaggttgggggtcgccgttgtccatcctccgtcgccagctacgtccagcaaaggagctccccatcctctgcctcctgcccccgtcgtcgtctgctacatggatccgtcgtcaagctcatcctccacgccgactaccgcccctttttccttgccaccgagttcgtcctatgcgtcgactgtcgcgccctctccgtcgaggtcatccggatcatcgagctcaccgctccgctgggccaccacgtgaatctcactcccctggttggagagagaagacaatgggcgaggggaaaaatacagagggaaggacaagagaagtaaagagagactaacatgttgggattgggataactattactccagattggagaatgtgatagaaagtttgttggactaaatacaaatatactgtagttctctaatttttactaaatagccatgctctaggctcaacttttctcgagaggcagtcagggccagccctggccctatgcagccgaggcgaccgccgggggcctatgatgataggggccaatacctaatactagtagtctagtacctcatccgatgttgagatcaattatttttattcataattaaatgtgttgcaaatgagtttgccagattcttcgatgtccgcgcctgagattctgaagtttgttatggatgcaaattgttatctaaatatttttgttgcgtatcgaattctcttaactgtacctgtgacggtagcttcagctaaaagaagtttctcaaaattgaagtttcgaagaactatctaagatcaactatgtcacaagaaaggttaaatggcttggctatgtgctcaatcgagaagaatatcttggacactattgatcttaataccattcttgataattttgcatcaagaaatgcccgaagaagtatctttttatgggaagcaatggatatgatgtggttctattcttcattaagttaatgaataatgatattaatttcaagttacaaatatattgttattttggtcgactttatttcttgataattatcagacatgttaaatttaatatatgtatgtatttgtttttattttacaagtaaaattaatgtctatatatactataaaattttatatatagcttagagggtccatcgtgatgagttcacttaggatcctcggaatcataggaccggccccggaggcggtagccatattgtgttcacgcaatggattactagaggagtaatagtagttgacagacatgactatactagagttgcctggaattcaaacagcgtaaagcaaggtactagcctctgggcatgcgggacctagctacccagcagcatctgggcacgacggcacgggtcagcttgcccattaaggaaagggaacagacaccgatgaccggactcgggctctggaaggaagcacaagtaagccagcaaacggaactaaacggcgtcaaaggggaaaagaaaaaggactccctcccttccagtacgcatagatgagatcagtgctccgatctcatctatgccttgcctaatcttcatcaatccctggtcgatcgtgggctcgtttgaaacaatattttttttctctggtttttataggaatctggtttgaaaaaaaatatattcaaatttcaaggctgcttgtaaatctaataatttcatagacttttttaggaaaggcacaacatttttcagctgaacggatgaatataatggacgatgaattatccgatttgcagtgatattagaggtatcttattcgaaaagaaacaatatttaaaggtacaaaacagtatacattaacaattataaaagtgtagagttttgttttatagtagaagttttctaataaagcttctgaaaaattaccgtttagaaacttggcaagtatactctagtgtataaatataagatcttgatattatataatgcgtaacagcgtaagagaaaaaaaaagacgtgggctttaggctcatttgactcagacctgtaggcatcgtttagcttagacgggacggctaagatgatgaaaacacgatcgataattagcacacgattaattaaatattaactattgaaaatttaaaagttgatctgtttaatttctacataaaaaagttttgtttttaaaagatacaccatttagcaatttaaaaaggaaaaaatacgaattacccccccgaactattgcggtcgtctgaattaccctcctgaaccacaaaaccggacattcttcaccccgaactatgtaaaccggacgaattacccccctcgacccaatccacagtggttttggtctacgtggcgtacgcgtggcagtacagtcagcattttatttattaaaaaaatatgggacccatgtgtcatactcctatccaactattccgggctgcaggaat

SEQ ID NO: 82340 - DNA, 8600 bp, Oryza sativa
tccctcctcattggatcgttttgtaggttgaattcgttctttatgtacataatagcacctaaataaaataattcaacaaaacaataaatatatacaagataagatgtaaaaaatcaataaacatatttaagatatatgtaaatagtacatatttattgtcaatgcaggatatggtaatgtgtggatatgatgttgcattgtgtgatttctgtaatagtggaagaatgagatgacgtgagaataataatcacaacaatcacttacatgtaaatcaaagtaggtgtgaagtatttaatcaaaattaaaggtgagcactagatagaatgcgaacttgttaaattttgacaccaagctaaaaataaataaagttgcatatgcacttccttgatagattatatacagttagtttaataatagtgtagtgcacaattttatgggtgtgccatacaataataaattgtagcatatcatcgatcttgttaaataaagatgatattttttattgtttatgtaatactccctccttccctaaatgtttgataccgttgacttttttagacatgtttgaccgttcgttttattcaaaaacttttgtgatatgtgtaaaactgtatgtatacataaaaatatatttaacaataaatcaaatgatagaaaaagaataataattacttaaattttttgaataagacgaacggtcaaacatttttaaaaaagtcaacggcgtcaacattttgggatgggggtagatatactacatggcctagacaaaaaaaaaaagccatttcctttagatgactattaaagtggggtatgatcatgcctaatcatagggcaatatttaatcatcttataaagaaattatattattggatgtagttttttggaactccacaaacgccttacatttaaactatatctttacctgcaatggctgcattgtcccatccttgtagtagattgccaatagatgccacaatagcagcgagcactgcattagccgtcgagccatccgctacaaagtcaaacaataaaagataatattttcttgaagataatatatatttacttataaagaggctattctagacttctgtacaaagttaatctgacacctctgaataattgatggaaaagagaaaagataagataagaggaggttgcatgggcttcctttgtcttgggccaaagtaagctatcgtgcagcaacagtagtagttggccggcccatttaacaagcagcagtcaacatggcagcatttagcagtggtaggttggcagctacaagtagtactccctttgtctaaaaaaaaaaaaagacacccagtactagattgattttttttttacggagggagtagttcatcaacacagtagcaggcaatgcaagctagtaccaaggcgtcgttcggattaagctggcttttttagcacgaaaaacgagccactaacacaagactaatagagtaattactgttataaatttgaaaataaatttatttgactttttgaaaaaaaaacttaccatatagatagttttattaaaaaaacataggagtatcgtttaagcatgcttagggaaaacaagatagtagccaaactaagaagctattcaaactcacctattcagaacggatctccttgtgctctgtgagcatgcttctcaaactatgaaatgatgtatttcgtgcaaagttttctatatggaagtttcttataaaaataaataaatttattttttaagtttgtaataattaatactcaattaaccatatgctaataacttgtctcattcacgtgccgctaaaagtgctagcataaagttggttcgaaaaagcttaatctagcatcgggagttagaggttaggagtaatcgttatacaatagaagcctgattattgtaacacgggtttaaactttttgccgaagataagacgaaaatgtaaagagttactccctctgtttcaggttataagacgttttaactttggttaaagtcaaactacttcaagtttaactaagtttatagataaatatagtaatatttaggatgaatagctaaagtggtcctccaagtatcagcggagttcttgatgtttcaatctatccatattagtccttcaagtttttattttagttcaaacttatccttcaacccacttagaagccacatggccaaacataaccaacaactctcttgataaatgacatttttaccccctcattcacatatataagagaaaaaaattgaatgcaatgaattttttatatagataatgcatagtaatttatgtaaaacgaaaataattatgtacttgcaagtgcatacgatagacattgcttaagtttgatgtgcacatgttgaaataatgggaagtacttctgcaatgttatttatttatcttggttttctcttttctagtgtatagttgtatataaattatgggcgaaagggacatttttttttaacagaaatattgactagaaatagccatatggcatattaagtgggcctaaggatgattttaaaccaaaacaaatacttagaggacctacgtggacaaaatgaaacctgaaggacctaattgagccttcggtgaaacttgagggattaaattagctattcactctaatatttataataccaaataagtttcattaaatcaataattgaatatattttcataataaatttgtcttgggttgaaaatgttattattattttctacaaatttagttaaacttgaagcagtttgactttgaccaaaattaaaacgtctagtatagtataagcgtggcacaacaaattgagatgggtatagaatcgtttcagggccaaggcgctagatttaaaagctaaaatttctaacattaatagtgagaaaataataaaatctagaaatattcacgttaattacagaacagggaaacatctcacacatcaattcatatgcaacattataatggatgtgtgtttgatcaaacaggcaataaatacataatttgatttcagcttgatatgtaagtgtagatacaatatgcccaaatcaaatactagtaagttctttcatgttggacaaatctaccaaggatagtataatggattgttccattctagcaataggcgaatcttacttgccatatgattaatgcaattaaataaacacaaacatacatttttgaaaattttgtgttatgcatatatatatgattcctaacggaagcattatttttgcactaaaaataattcctcttagtattttctcaacctttcgatgataaaaataaaaatacattaattgaactaacacaaatttctaaaatgaagtgtatttgtatttcctttttttaacaaatatatgtattttctgacaacactaaccgatgtggatgcttggatctatgactagtttttagtaaagaaactctcctgtttttgaagtggtgctgataagtttgatacatctacctctcaccatacctcacgcgacctacataagaatcgtaaaatctagacttgtaagtaaagttctaacctgttgttgtcgaaagttccagacttgattcggagaagacggaagaccctaagctgatcggcgaggatggagagtattgttgccgcgtgttcttccaggcacccaagtccgctgctgcataccctcgtaaataaaaacgaatcaaacacaacatgcttaccaatttcttacagaagaacaaaaataataatggtttaaacatacttacccatcctcaggccagaaaccaaacgtaacaggaatagaagaaaaagtgtagccggtttaacctaaaccacatgtgaatttcttcttatgtattccttcccttctgccgtactgtttcaaatctcaaccatttgtagtttgtatcggcgttggtgtggtatcactgcaccacacgtcaaaacgtcgctccctccaatatccagtccgtgtttatacagtaggaggtaaatagagatggagttatgtaagggggagtcggaggctatttaatcagttcgttgagttggtttaggggtggactgatttgcctttgcccttgccggcgcagtccaaccacaccctccggatcaacctcgatcgctcgtttctgagccacgactgaaaagagagagtaccgccacgcaccgcgaataacgctaacggtaaaacagcgatgaccatgcatcttctctccggccaacggctgctcctcccgatcccatgcggcgcctgctatcgctcgccgccatccccggcgatcaagccgtccccgcttggactacgcccattcaccaagtcatcgtcgtcgttgcccctgcatctgcatgcagtctcgcccgccaccgttgcaaccgacggctcctccacctccgcgcagccaggttagtaacagaatttgttgtgatcaagtttacttggatgattgaactgaattcacgtggctggctacgtgtgtagatagttgggcagagttcgcgtcgcgggtgtccggcgagtgggacggatttggcgcggagttcacggcggccggcgacgccgtcgagctaccggagaacgtggtccccgaggcctaccgcgactggggcgtgcaggtgttcgactggcaaacgcagtgccccactctcgccgacccggccgcgccgtgcgacctccactacaggctcgtccgcctgctccccactgtcggctgcgaggccgacgccgccaccgtccacacctcgcaccagcgccacgcctcctccgcctccgcgttcgcctactccgccgccgggtcgtacgtcgccgcctggcccaggggccccgcgccggtgctcgaggtggagcactgcgtcgtgcacccggacaaccgggaggtgagggtccgcctcgtgcagacagtggcgctcgccaaggaggcgcggctccgcggcgtcaaggtgttctccgagcagtggtacggcccctaccggaacggcgaccagctcggcggctgcgccctccgcgaggccgcgttcgccgccggggagaagctcgccgcctccgacgtgaccgggcagtggcagagcgacgccgcctccgccgcgaggttctccggcgagctggaccccgagacggtaagcatttctccacgcgccattgctgcacacggacagcatcaagtgcttaatcagcaatgaacaacagggcaagttcgccgggttgacgcctgatgagcccggtgagagattgagccgagacgacggcgatggaatcgtgacgctgccgaagcagctgtggagctcgttcaaggagaatggcaaggacgagttcgtgtgcgaggtagggtgggtgctgggccatggcagcgccatcacgtcgaggtgtgttctctccagagatggagatgtcaaggcaagtatttctctctctcttatctttttctttcttcctgattctcctctggtttcaggctttcaacagagtacacagccaagaaatgaaatacactgaaagcagagtttggttttgtttgcaggagatagtcgtttcgcgcgagtcgcgtgtgtcggagggaacctgatcaggatatcaaaattgtcaggttcgatgatttttatgtagaatagaattatagccatacacaaatgtcttacacgcccgggtgtatactaatcaaattggcctcccgaaaggagtatacatgagtacatatactgacgctgttgtctgcatgatctagctaaaagtaatacagcacgccgctttctgaatttatagggacactacggtatactacctccgtattttaatgtattttaatagaggacgccgttgacttttttttacatgtttgaccattgtcttatttaaaaaatttaagtaattataatttattttgttatgagttgttttatcactcatagtactttaagtgtgatttatatcttatatatttgcataaaaattttaaataagacgaatggtcaaacatgtgagaaaaagttaactgcgtcatctattaaaaaacggagtgaatagtttttctccaggttttgcaaattgcaactttggctcaaacttgacgtcgccgcctcctaatctggtttgagcacttcaccttcaccttcaccttcaccttcgcccacggttttttttggtagccgaattgtaattcgattcatccatcggaggcagctggatcttaatgtaccggttcatctgttgcttcagctgcctgacactgcagaacaaagcagagcagagttgcaacagcagagtagcgtctagttttgttcatgggccaacagaacaacgaccacagtttgtgactgtcaacgaacacaaacgtccaacaatcagaatacaaacgtccaaccagtacaagaggtggctggtagtgcaactcaatctcatatgacatggaaatgtaatattataatctttaaagatattataggaacgcaagcattgagattagagttacgcaaacatgacgactttcattgcgtaatacaggtcgttgaaagaacaaccaacaaagcgaatgcacctcttttgggttcttttttaattgctaggcggccttgcaactacatcaaccaatataccaccactatatgctcatgctattgtctccatagagactacgctacttatcaactcacacttgcttggaataaataccaactaaatgaattgacttgatctcttctcatacaagtcacagacccgaattgggtagtgaagaatgaatggacaagagaagagaacaaaatctatacattcgtgcatcaatgtacttgaggtgcgtctcttaatgctacattcaaactgctttccattgtttgccaccctagtccaacgttgctgccttgcatcatggctacaaattcggcgtagtcaatttggccgtcctgaaaaagaatgacaagaccagttcattagattcaactcgagaaagattttcagggttgacgaatcaaaatcatcgccttcttttttcttttgaaatactatccctggaaaaaaaaacatgctaatgctaagttctaaagcatgaggacccaggacaaatggatctgtagaagagactgccctcaaccgtgtacatgttatcgttctgttgttgaacaagtttggtgttagatgtgacgctgacagatgccagtaaaatcaaataaataattttacagggaatgtcattaggattaaagactacaacgcaaactaccgatgtaccagctgaccagcagagacactagaagtctaaaaaaatcctaacatgtccaagagtgtatgctttcgtttaaagcgcagagtgttatgctgaaattattctcaatacggtggttacaagtcaatagtcactaaaaaataaatcttggatattgtatagtgaaatcaacttacattgttttgatcaacctctgaaataatctcttcaaggagtgaatcctccatgttatgttctccacaagctcgttgaagcttgtcaactgtgatataaccactcccatctttgtcaaaatatgtaaaagctgccagcaggtgctcctcacgttctatcttgttaagaggtagagttgcagcaataaattcttcataatggattgttacattattgtcgttgtgtgcctgaagaagtttcagagtttaaatcaagatctcaaagaaagagagcaccatctaaccaacaatttgtggtcttgcacctacttaccgcttccattatatcaccaatctctgtatccttaaattcagcgccaaatcttcttaaaccttctctaagctcaccgaaagtgattacacctctattttttgtgtccactgccttgaacatttctcttaacccagcaatctcctcctctgaaagacgctcagctatcacctggaagcacgtaagtgtcagaaaaaagaaatggcatatggttcacagatgtagccagcagtaggacatgcaacgaaatagtgctacaggctgaattgcggcatgttaatgtgcataccacataattgaatatcgcaacctaaaaacttgttttccatattgccacaaaatcagatgatcagcctagagcagctcccaaagttgacatttaccaaaaaaataacttattttactatcatagggatccaaagaatgacaatatggcatggcatgcgaatggatatagtgaagggctgaaggccaattggggatactcgattaagatgatatgatagcaaatatcatagcagcaatatggaagcatgcaagaatatgaagcactcactctcagagccaacttctttaacttgttcattgcagagaattgtttgagccgagagataacactgggatccagagcttgatcagtggcaactccattttcacagatccaaggatgccctgacaataagatatatatatcagtcaacatatcaaaaggtttgtagctcttagataattagtgaaaactaaaaccatgcgtcaaactatgttatgaacaaaatgcagagctattcgcgatgaaacaaaagggcaactaatttatgtgaagaaataggtcaaatatacttacttagcacttcatgggccttcaaacgctccgaagggcaatgagagagcatttttcttataagatcctttgcactgtcaga

SEQ ID NO: 82341 - DNA, 644 bp, Oryza sativa
actagtggatccccctgctttgtatcagttccgttattatgggcggtcgctaaccaagtcacaacccccaccaccaccaccaccaccaccaccttgaagcagaagctgcacaccgtttagatcacgcaaaaattgaaagtttggttgaaattggaacgatgtgatgaaaaaattagaaatttatgtgtgtaaaaaagtttcgatgtaatggaaaaattaaaagtttgaaaaaaaagtttagaactaaacaaggcccaagtcgccggatctcactggagccgaatgggttcagtttcgaaggagctgacaacaatggcattacggctactccatcgaagtacgcccttgacaggcaagtacaacgttaaacattccttcattagccatccaatggcttttgtcctgctattgcaaattcgcgaccatgcgacgccccgtacggatggacatgctgattctgcccaaagttctgcgattctgcagtctcagatctactacatgttaccccttaaaaaaaagtggattaagtcttggatattcatgtcacgcttttcaaactattaaacggcacgttttctgtgaaaattttctatatgaaaattgttctaaaattttctatcagaataatccatttttcaagttcg

SEQ ID NO: 82342 - DNA, 7555 bp, Oryza sativa
  unsure (1)..(7555): unsure at all n locations
cctccaaaaattatgaaaacaaaacccaacaagacaatgaactctaaaaactattggcctaatttttttaaagttttaatgatgatgaatagtagtggtaaatcgtgtaagcaaataaaaatgtgacaaagaagtaaggggtagcgactgacgtggcttttaaaaactacaaaattattagaatcattggaatgataattttaaataaaattatttgtaaaaagtagataattttaaattgatgctagctgcgcaattgcgcgggctgtccagctagttgcttgaatttttaccatgcatatgatttttaccatccattttatccaatctaatcgtctttatcctctacgacaagtcgacaactaggtaaataaaagggcccatttatactattaaacaaatttctttatcacagtaggcgtctattcgatatatctaatttaatgatcgcccccaactttctcgtttaagaaccagcacgccatctgcgaaaagttcaacgccaggagaagaccaagaaaataggaaatcaacacgaaatcgatcgatgtgcagctccgtctaaaactaggcagtccacagaagaaagtgatgtgcagtagccactagtatctgacaagaaccccatacgcgaccctagtcgaatagcaacagatattgctgcacttttagaacacgtgatatgatagacgtgactatcattttcgcttttggctgtgtttttggatccaaacttcagtcctttttcatcacatcaacctgtcgtacacacacaacttttcagtcacatcatcttcaatttcaaccaaaatccaaactttgcactgaactaaacacagcctttattcgtaccattcactcgtaaattaaaagataatttatacaacatgtcatatataatacacaaatactaatatttctaatattttcatatttctttttaaagtttatgcgaaagttgtctcttaatttatggatggctcatcatcnctcttcacttttctttttcatcttgttacttaattcaatgtggtagttttggaggtggtatatgatgcattatagtactgtacctctcaagcaattactccctccgcttcgaaatgtttgacaccgctgactttttagtgcatgtgggaccgggcgggttgttaaacaaagtgaaggaaggataaatctctttgggctatcatccgattcattggtgaaagtatggcatgtctgcatatagatctcactctctgatagcagttggtgaataagacaagcggtagaatatatgctggaaagtcaaccgtgtcaaacatttaggaacggagggaggacttattagcttgattagtggtgtacctctcaagcaatcactgctactgctattatgctaactaactgattatataggctcgaccgggacgtgatcgcgtcacacaagaattccacagatgctaattacttcttctcgtcacactacgatatgcacgaaccacatgtcatagtttgagtacagtaactggagtaattcacaagaaaaatttacttatattcactttattcttttcgtcagaacgtgcggtagagtgaaacccacatcattggcatgagccacgtatcataaagtttgacagtaacttcacaaccgtaattaacccggtcaacaagatccatcattcatacagttggctctcttgattgtatcagattaattagctcggcctgatgatcagatccgtcctagatcaatgcaaaatagtccccgcttggaccaagcccaagttcataaagctttatactagctactccatccgtcccataatataaaagattttaagtttttacttgtaacgtttgaccactcgtcttattcaaattattttaaaattattatttatcttatttgtgacttactttattatctacaatactttaagcacaacttttcgttttttatatttgaaaaaaatttgaataagatgagtggtcaaacattgtaaataaaaactcaaaattccttatattgtgggatggagggattatatatctagcttccttccaggaaccaagaaatgttcagttctaaacgaagggctgacgaatcgtcacgaggtcaaccagtcaacagcaaatggtccttggtgtcctctttcgacctgtggtccataaccatgtgtacaattattcagaagtggtagtataccgttggcaacgtcctctagtttcacatttttcagggtgttttacttttctgaacttccgatcaacgtggagtttaattagcagtcagtcagcgcctgaagatagattgcaggctgcacgtgggggcgtagctacgtagccgcgtcagggtcaacgacactactttaatacatatacgtacgtatgtacgtacgtccagttctactatttgtctacccaagatgattggagccacacgtcggtcagttcgtcacccacacgctacagtcgaccaagctgttcagatacgcactctatatatcgtagtaaaacactaatgaatcgattgatctcgtctcaccagttaattaactttagtgtaatactatatactcctaccgtttttaatacatgacaccgttaactttcgaacacatgtttaatcatttatcttattaaaaaattttatttaaatgtataagatagtataaattacactttaagtactttaagtgataaaacaactcataacaaaataaattataattatataattttttttaatataacgattaattaaatgtgagaaaaatcaactctgtttatctattaaaaaaacgaaggtggcatgtgtcgcttttcatagcggccgtaaagaaggaaatggatacgccccgtgaagccgggcactgtcgtgtcgcagtctctctcccatccctcgtctatattggagtactccagtatattttgccggccgagcagtaaactagtactactagtaaaatagtgggcgcacaagactacagcagggaagccaagcaccaacggccgcacggcccgcaccgcgcgcaccagctagtagaaaacaccgttttcctacgtaattccgagccaaaaccacgtaacaatcgcccgcccacgtcccgtgtccccccatcccttcgccattggccggcacgcgctttgacgcagccgccgcagccgcgcgggtaacaataaaaacgcccccgtgcaccgcctgcctggcgaaaaaccggatcaacgcgagcaagcgctcacctcaccacctcaccctgcagcgacagaaagagtctgtagtagcgtacgatcgcggctagctatcgagctccagcgagaggcgtacgtgagtgcgtgcgtacgtgcgggagggaggaggaggggagatggcagggggaggaggggggagggcgttgccggagacgccgacgtgggcggtggccgtggtctgcgccgtcatcgtgctcgtctccgtcgccatggagcacggcctccacaagctcggccatgtacgtgccgttgcatccatcgtttgttaatttgttcgtttgtttttggctggctctccacaaaaccgaccttgataacaccattcctggtggcctggtgcttgattgattgatattgcagtggttccataagcgggagaagaaggccatgggcgaagcgctcgagaagatcaaagcaggtcagctttagtttcaccaacctgttcgatttcttgtcaaagcaaatttcactctctctctttttgaacaaaaggcaggagctagctttgcctcttaatcttccatttttcgtcaaaacggtaccatgtttgaagtttgaagtacaaatacttagcctcttatatcgtcaaacagtcaccggagtacataaatgaccacttagttttcctcttcaaacatagaacactcgtattctaatttctaaacataaacataaaggtcgcacttatataattccaaacaggaaaacaatagccgccgcaccagttcatcacaggaagtcaagactcatcatctacatgcttccattccagtgcccatatcctgatccctgattggctctgtccatttaccttttctctctctttttttccctgtttcttccacttgcagagttgatgctgctgggcttcatatcgctgctcctcactgtggcacaaacgcccatctccaagatatgcatcccggagtcagctgccaacatcatgctgccgtgcaaggcagggcaagatatcgtcaagggcctgaagggaaaaaaggaccatcgccggaggcttctctggtacaccggagaagaagagagccatcgccggtcactggccggcgccgccggcgaggattactgcgcgcaatcggtgagcaaaaacgctgcttaatctgttgcaacgtcacacgatgatttcgagggaaattcaagtgcgaatttaacgatgatgatttttcttcgtttttgcagggcaaggtggcgctgatgtcatcgggcggcatgcaccagctgcacatattcattttcgtgctcgcggtgttccacgtcacctactgcgtcatcaccatggctctagggcgtctcaaagtgagtggctaattaaccacctggcactctgttgtcaagcacggtttttttagtagaatttgtcagtctttgatttggattgcgatgagaaaatctattaatttgcccatgcatatgttgttccttggtgtagatgaagaaatggaagaaatgggaattagagaccaactcgttggagtatcagttcgcaaacggtaattaaagaatctaactaatactaaccttcttacctgaaacttgaaacatgacagcaaagaactgataactcgtatcatccttgcagatccttcacgattccggttcacgcatcagacatcgttcgtgaaacggcatctgggactgtcaagcacacctgggctcagatggattgtgagttcttgcacctaatcgatctctacctgcctaatctttgcagctacctggttattgttcgtatccaacattttttttaaagaaaaaaaactaccatgtttgttgttaggtggcgttcttcaggcagttcttcgggtctgtcaccaaggtggactacctgaccatgcggcaaggcttcatcaatgtactactactaattaacctgacccattcgccattgttgcaatggaccaagcttttgggagtgtgcactaattaactaatgtatctttaattctttgcaggcgcatttgtcgcagaatagcaagttcgacttccacaaatacatcaagaggtcattagaggacgatttcaaagttgtcgttggcatcaggtgaatccctctctccagtacttctctcttttttttttttaagaaagaaagacaagtattcagtcttgtgttcgtccttcgatcttgacacatttggcctgtttttgcagcctcccattgtggtttgtcgcgatccttgtgctcttccttgatatccaaggtaatcttttgtcctatcctgttcgttcttttgtttgctctgaataattggtcttgtaatcaccatgttttttatctgtgtgtggtgcagggttcggcacgcttatctggatctcttttgttccactcgtcgtaagtgcgaattatatatatttcttgacttcttgtgcaaatgaatagtcaacagaatcatgattttatcctacaaggtatgcaaaacatttgacaaaaaaaatgcatgccgttgtctttagatcctcatgttggttgggacaaagctggagatggttatcatggagatggcacaggagatacaggacagggcaactgtgatcaagggagcaccggtcgttgaaccaagcaacaagtacttctggtttaaccggcctgattgggtcttgttcttcatacacttgatactgttccagaacgcatttcagatggcacatttcgtgtggactctggtatgctacttgctaattggcatcaaccttcaaaagccagtgttatgcactcactaatgagccactaatgattgacatggtttggttatttttgtctgacaggcaacccctggcctgaagaaatgcttccatgaaaacatgggcttgagtatcatgaaagttgtagtggggatattcattcagttcctatgcagctacagcaccttccctctctacgcactcgtcacacaggtgaaaccatttagacaaaaatcacttgtaaatgctcttggaggtctcaattccaacgtcctcaacctttccgtgtgtttgcagatgggatcaaacatgaagaagaccatcttcgaggagcagacgatgaaggccctgatgaactggaggaagacggcgagggagaagaagaagctccgggacgccgacgagttcctagcacagatgagcggcgacacgacgccgagccgcggctcgtcgccggtgcacctgctgcacaagcaaagggtgaggtcggaagatccgccgagcgcaccggcatcgccggggttcgccggagaggccagggacatgtacccggtgcccgtggcgccggtggtgcggccgcatgggtttaaccggatggacccggataagaggagggcggcgtcctcgtcggccatccaagttgacatcgccgattctgatttctccttcagtgtacaacggtgatggccgaaaggtttctctgtacttaagttgtatagcagcaaatataggagtacaatgtatagttggtacactacatatagagattagaaaagtacagtcgatttttttaagaaacaataaaagcataactttgtataacatattctttcggaagaaagatgcggcagcattggggaacatccaaataatctccatcctctttcgtcttactataaaactacatggaaaattcttgttaattcaaaataaaaatgatagtaatagttagctgcaaagggttcgagctgaaggagtcaacaaagtagaagctggacgatcctatcgtaagccatcactgcttatattcaatatatgaaagctaaatgacataaatctggatttagctgcaaaaggttccagatgaacgagtcaacaacgtagaacttggatgatcctatcgtaagccatcactccttatattcaatatgaaagctctctggtcccaaaaaaagaatacttgtacactatcgggaaaaatcactgatggccaggaaaaagcaagggcacttgtcatccataggctagctagtcagctttggcacgacctcttctcttatgagtaactactagggccagtgatattgccattccaatcaaatgcccagcgactgagccataagtaacagagattggccattcctacgaaaaatcatgacagaacattagcaagtggcagaatggaggtgcaggcaacgatagaagcaatgtgtaaggctcagcaagggaattatcagccttgtgcactacatagtccactgaaagcaggatgcacgacgagaacacaagattatttcagataaaagagatgataataatgagtagtcccaaaagcaacagacaacagaagtacagaatatgaggcaagctacagaaactcatgtcagctccaaaaagt

SEQ ID NO: 82343 - DNA, 2813 bp, Oryza sativa
gttcttttaaatggccgatataactgtagaacttcaaacaaattactataatccatgtaaacccaactaaattagttaatgaggtagcggttagtgaacatgcatgaacatttccatttataattctgacttcccaagcctaggcagatgacagcagacagtaaagattcacagtggtatttttacctgccaaggtctttcccagtcgagaggcataggccaagcaccaagccatgctcctattacagctccatgagcaggtgcagatatcatgtagtccactgaatcagttgatccgcaataactgatgcaaaagcacacaacaaaccacaatgtcaggcagttgctggacagtaaatttagaaggaagatatccattaaatgaacccctagcattctattttcatttaagagtaagcgatgtacatggaatgagagagcacagcctgccaattcactttggatgctccaaatacgcatgctgcaggaacaaactgcaaaatcatggatttagcttgatatgacttgatatgtaacaattatataaatataaaggcacagtattggcacaagaaaaaaagtaatagttgtccggttgccaatattgttaatctcagatgtggtatttttacatacttgctgctccaaaaatggcactcacatttagtaccacctgccagtgacagcatttccaggaatgctactttttggagtggtgaaaatctaactgaatctaactggcagtgacacataagtaaatcaggggaaatggcacttactgtgaacaaggacatgagaagtgaccaataagttgttgctgcccagtacctacagatatgcaaccccgtgaaaggaccattgatatgtattatccatgaaagaaatatcctggtgcattctggtaaaatcagatgaaaaatatgtaggaagcagtatatatgacagtactagacatctatttagcattgacataaaggttaacaacaaccattgacgtccttgttgatctatactcacttgattccaatgggtgcaccaagaacaattgctccaaatgcatttaggaacgcacctatcagaaaacattgtgtacaataagggaaaaaaaaggtaagtaggtcctaaataattcaatagttcaactattattgtgtcacaagaatgaactaagccatgagtactgaacaatatatcctgtgtccagctattttggtcgtagtaacgaagctaagttaactcacgaaactagaagctaatatgaatgttaaaacacagaagagagagaactaaccaatggggaggccaagcaatcctcgcgcagctgccttaagaaactgaaattatagaacccaattatcctatcattgaacataacattggcatagaaatcagaagaagcaattgaccgaacaggtcacaagtgcacgccataccgagcagcgcttgggatttcgacggagcaaactgaacactgcgatgacaagaggcgcttcgaagacctagaaaaagtcttacttcgaatcagaagacatgagggaacaggggagcacaagatacgtcggacaatgtgacgaggtgaggggacggatgcataccacgaggaggcggagggcgtaggcgggattggagacgagcatgccgcggccagacaattgatgggctgccacgatcccagcgaagcacagagcatggaccgctactgcgcttgaggcgctgacctgcgtggcctcgtcgcccatgacaggggcaccgtgggggagtcaataggtggcagtggagccaacacctgccaagtcgggaggtcaattcccaggttgcggttcagcgacctctcgcagtggcatgatcctactttggaagttcacattacatacaaaaattttttaacaccacaaatcccatatacaacgacaaattagctaaaaagatgatacaaatatagcaaataatttaacaagcaagttcagaatgtgcaaaaaatcttacatataaatagaagattacaatggcactaccttgctctaagcttgctcttagccatgaaagtatttattactccctatgtaactaataccaatcctaagataacaacaacgatctattcacatccagtcattcacaaatcccaaattggctgcctaccggtggcggatctaacattggacatgggggttcagttgaatacccaaactacaaacaaaatgttattagtatgatatttaaggcaaatttctagaacagaagctagggttaactcaaattcgagaaatagtgcgtgggtagagagatgggaaagagcatgcgcgtaacggatgcggcggaagcaacagaacaaacgacggcgaccctacttgctcgcacgatggatggggatcgccgcaggcgcaggcggcggtggcggaggatgtgctcaccaggatggatgcggcggaagcaacaggacgagcgacggcgaccctgctcgctcgcgggatggatgggggtcggcggcggcggaggaagcagcaggacgagctacggcgactctgctcgctcgcgggatggatggggatcgatggcggcggcgaaggcggaggcggcggtgggcaaactgacgaggaggggatggatacgtaatcgtattacgaaggagtagtaatttcgcccatcactcacggtgtgttcggaaaatgggaaacgagggaatgggattggaattgggattaggaaatgaacgaagggttatgattaaatgaaagagagaataaacggttaggatttaaaaatgtctcttggtgggtaggaaatcattttcctttctgatttgccaaaca

SEQ ID NO: 82344 - DNA, 12823 bp, Oryza sativa
ttgctcattctgatactgtattttacatccggtttgccagtaactagtaattagtgacactagttctgtttgtatgtttataaaccaacgaccgtgtagtatttaacttttagtggttcgctttcttaaaaaaatggccagtaaattgcacaaagcaccatattacaactaaataaaacatcaaatcaagattttgggaaagacttcttgatctccattgctaggtcactaataccaatgccatcaaatcacaggtctaccaaacaattgtcagctgtcaaggcagcactctgtaaatgagaatagaaacaggggaaatcatagaataaagcaaataaatgcacacaactgattggagatgcatcaaatgagaggactttattctcaaataagagatgtataaacaaccaggtcacgttctttaaaaaggataccccattgatatcaacccagaggccagaggtcaatttcaaataaactttagctcatgagagaaaggacaaagtaaaattgaaaaaaaaaaggttggctaacaacaaagctttatgtataagtagacatgaatacaactaatgctggtcatacaaggtaaagtgtgccagcatagctaagaagggggaaggcaaaagcatggggaaacataatttctgtataaattttaatcaaagaagagcttttacttgtcctaaatgaaataaagaaaagtaccctgttaagggacagagagaagtcaaaacgttagagatcactgagtgactgagagcaactatcagcttaaaacagaaaaaaaacctgaaatgctccattgctacaaggctccaggctaaacagcaggaattctgactatgtgtttcccaagtctacatagttttcccgtgaacttcagcaccaccaagagggatttgcatcctctgacatgcagtagttaagtcagagacgtgcagtacccctctatatcaactgcccgttttaatccaatgatccttatttggtcttcgttctccccttttcttcctgccttcttcgcagttcgcacatactcctaagtcattacatgcctacggccacaaaatccacgatgctgtggtatggcgctgtggtcatcgagtacccatgaaacaaagcagagcttgtggaagtgttgttcaggttggggtcacctgtggctgcggagtggcgggtgagctctgtggtggccagaaacatggcattggtggtgtcctgctccggtgggctgaggcagataatttgctctggaaagcgaaaggggctatagaacatgtgaaaaataatttcaacctcgatttgagaaaattagccttgaggtggcaaattttagagttgatctttggagcggtcagaaacggttcagcccaattttgtggccgtccaacggcacgcgccgccacacggacactacgaagaaaagggaggctaacttaaggagctccgcttggtattggccaaagcaatcactaatgaaacaaattcgcttctcagcagcattctcctcattaacatcaagcattttggtcgttgacgtgctcagacgagaggtcctagtggatgggaacagcgtgtccttaacaatgcaaccttgcaagcagtggagaagaactggctaataagcaggagccatcggatggttttggacagcggatagatgggtactaccacgtcttcgacttgactactgcgtgtcagaggatccgaatcccaccaccaagagcacagctagtggaaattcaaagtgcataccagtgcaggatatcaggcaagtgttgggatcgaaacattcagcaagttggtgacaacaaaactaaattcagatctccaaataaattgggttactgatgcaggattcaggcatgtattgttctcccacgaattagtgttggacttatatctcccaatcataaccagctagtgaaaaccagtagtgttaggattcataaccaactagtgaaaaccctagctaacattgtagcaccggtataagaaattcagtaggttgaactgatggcgccgctaaaacagccgaaatggaaactcaagtttcaatacctctacagcctaaaggttcatcagtagtgctcgtcgaattccgaagggtaaaatttgcgttgaaatcgcaatcacgaagccaatcacagcaatcgagccaaatctagaggggccaaaatgacaaggcggggcgggggatcacctgaatagagcagatcgaagcggagcggggatcaggagagcttggcggtggaagggatgagggggacgccaatggtggcggcgcccttggacttggcctcctgcgcctcgcggatcttctgcatctggatcatccgctccatgacgagctcgtactggcacttctcgtaggcgtggcgctcgggctcgcacttccaggggaggtagtactcggcgacgcggcacttgttgagggggatgaggaggtgggcgcactggtcgcggtagggcagtgggaggcgcgcctccgacatctccgcctgggtcgcgatctgcggcttcgaggtgcccagctgcacgccggccgccgccgccgcctccatctcgcgctcttcctttctctctcctctccggcgaggcggtcgatggttggtggtgcggtgtgtggatgcgggtggttggatcggtcgctttgggctcgggttcgggctccagctagaccaagaagtttctcgcttccccaatgccccaagtaaacttccgtaaaaaataaaaaaaatggccccaagtaaactgggattaaaagttgaacgtagtcataagtcatagtaacacatagctgatgtttgagatagatttagaataaaatcagcgcagagaaagttatcagagtataattaattaagttttaattgttccaaacataaaaaaattattatttaatattttaaagtaatgcttatataaaaagccctattcttttctgattaagatttaaattttatatgggttttcgataacgggtttctcgaactgctaaacggtgtgtttttcttttaaaaaaacttctaagatctttagatttgttttacatagacggaacaacgaaataacatacggcaatagataacgatggtgcttgtggtgaagcgacaagggtgccatggcacccaccctagctagatctgcagcgaggagtcgagctgcgatggtccgatgagagatggtggcggcgagttagaggagaagcagatgatgcttgcaggcgagaggcaacaacagcgaggactagtggtgacgaatgaggatgaggttaacatgattgcgacgggactagagttagcatcacaatcgaggattattgacgtgggtggcgacaacgtaggtagcggtgagtcctacatgaagtagagaaggtcaaccctacccaggcctcagcgggtcccacatatcatcattgctaagatgtggttggggtgtggtttactggaagagaagtatcaaaataactctagatatctggatagactaaaatctccatggttattttgaaactcagaccataatactagaggttttgtgatatttactttaattttttttagaaaaacattggcaatcaaaaacttgtttcttaataaaattttgccggcctcaaccttaatctttatccgttttatgcccaactagagtactacaatatgttagctgtgttgtggtgggcttagccagactcattttggtaccaagccatacaaatccatgctttagccaggtatgtcataaatgataataacaagttagcttttcttatatatatatatgtgtgtgtgtgtgtgtgtgtgtgacttataagctaatggattttaaagttctaactttaaatgtagagtcatattttttttaccttatataagcttaaaaaaaagcttctgacttagcttttggcttaatagcacaagagtagcttacgactttaaaaaggcgaaacgaaaaaaccgcttgtttaatagcataagattttttgcacataaattagtttataatcctaaacaaagaggattgaaagtttggatatttagctacgttgagctacggattgaatgggctacattttatttgggtcacttttgtgttacatcatggatgccctgataagagcactaccctcagagcacttctgtcgtgtatcgataaatctgctaacaacaaaatgcagtactagtacgcacgattttttttagaaatgagggagtcaaaatatacttatttaaagctaaggacggtgggttgatcatgccttcgacacgacacggtccgagtttattgggccgtgccagggccatagtgcagcccatgagcgggcacggcctgtcacagtgagtttgttggtccgtgacggcccgactgccctcagaccaggcaggcagccccttcggccatttatagtgtagattctgattgtctcctccaaggctccaatgcgaatgctcgtgtaagttctgaatgtttctcctccaatgcaaatgcagaactgtccaggctctgaatgctaacggcgagtgatatcgggtattgcagttgcctagcagactgtcaccaagcaaccacatgtccacatttacgggtgacatggaaaatttgtcagcaatttgacaaataactaatatttgtgattcattcttctcatttttttaagtatctctaattgaaagcacatacaatttatagttggatattcgttgataatttttccactctgtatttggtgatgtgtactcgcgtatgccatttgctgtcttctttcttaaatggaaggatttgtccgttcttcacttcttcgtgctgcctcattgtttcccttctgaaaaataaaagaccgaaacaacaaagaacggaccaaaactatataaaaaaatggatcagaattctggcttggaatcctcctcgaagaggggtcacttgtgcgcactgtataatcatagtcgatcatctggggaaaggatcgtcacttccattcaaacaaacaattggacgagcaaaaactgtacagaaaaaaaaattacaaaaccacaaaaagtaaagttaaatattgcattctgtatggatcagatttctggcttgaatcctccgaaaagggattacatttgcgcacagtataatcgtagtcgatcatctggggaaaggatcttcacttccattcaaacaaacaaacaaacaaaaaagggtcgcgcaaaaaaacactgcaaaacaaaaatacaaagctgaaattgtgttgagaatagcagatggatcagatttctggcttgaatcctctgaagagggattacatttgcgcacagtataatcatagtcgatcagctggggaaaggatcctcacttccatcaagattatataatatctcaaccaaaacaacaggcgaaaatcagaacaccgcggatgaataactcagaaacagatctagtggatgaactcccagagaaacgaaaccaaatcagatgcaaatcaaatgtagcggtttgatcagaactactggcttagaagccttctccgaagagaagagcttgcaaaaatcgcacagtacaatcatagtcgataatttggggaaaggatcatcacttcaaaactgcatcagatttgcaaccgcgtaaaaccaatctgaaaaccaaacgcaacagatctatctagaaagaagagagaacagaaaagaaactcaaattaagattgaacaaacgcgagaagcgaaaaccacatattaccggtgcggcggaagggaacgatgagtgggtttcggaagaacaggatgccgcttatatagggttgacgggtcggcggcgaggaaaccctagctcgtattagcatcagattgtggtaacaggccgacgtgtaaccaaattgggccggtaaaatatgggcctaatctatagttttggcccaaactctatacaccttgtccttttctattactttcttttttgtctactgggaatcagggatgaatagcagaagaacacaaatgtcgtttttgtttattactaaataaaattcagaaaacatgagtaaaaatttaagttgtggtaacaaagagatcgttcccttcttgcagtcaagagaatggagatacataggacagaaaaaagagaaggattttatggagtgaattgtgaacagattctacatatccctaccggagctgtgtaggtacagtgttgctgtgttagtatcacacattcacaccgcacacaattaataacagattaaaagtttaaagctagatttacccaatatttttcagggaaaggccgaacgaactaaattaagactgattaatgatcatctcgtgatatgggccgtattctcccactgggctcaccacaacaaaaagttctggcccatctcattctcaatccttccccccaacgataaaaccgagaaaactatgctaactgcatctaggttgaattcagatcctctgcatttagaggtatatatatacaaaggatataaatagacatgtgctttagaaaaaacttccaaccacaccatcatattttaacgtttcatattatatcactatagtaatgtgctaaaatacatgagaggctactagggtaggcaacaaaatcagtcaccgttgttccaagacttttgccacaatgccatgtagtagttactgtaatagactcctattccctccgtaaaaaaaaaaaaaacctaagagagatatgacctcttcgagtacaacgaatctggacaacattatctagattcattatactaggcctcctaagttagttttttttttggacggagggaaaactcaacctaagagggatatccctcctatgataacgaatttagataaatggtagttgtattagaaggggtcggttgagtttatttgggatggaggagccctatcgtggatttagatcggatgcaatcgatagtgtcaccgcaacttatgcagtccaccgctatccgttagattcaaaaccgaggatcaagatgcatccagtaccgtagatcactactatgacaagatttgtgaagtacttgtatatcgataccggagctatcgacctgatccgttcaattattttttttaaaaaaagggatggttgttattgtgtacagtagcttaacttatggttgctattttaaactgcagatgatatgcatccacctgggttacatttacggggattgctaactaggacagcttcgcacatgtatacagtactagtacacaaaaaacacatgtaccgtagatatatgtactcgcagcaacgaccagaccagagcgatggtgccgaggagccattttcggctgaactttgtacgggcgtgacacggacctgtactgtacgatgtaaagtgtgtcttctgggcttgtacgacgacgcagtttgttccaaacggcagctacgtacccaaaccaaaccagactgacgaaaagtcttgctccacttgaccgttgaccgccgcaggaagcgcgcgttgcatgtgcaagtgcaacggcgcccaaagtatgaacaccacgagcgtgaccgtcgatcgtatgaacagcgtcgacgatagctcgatccattggtcaagcgtcggtcagcagattttttttcttcttcttcttctttttttttttcatatgaatgtcactagcaaatctcgcgcacaacagggggtgccacgtcactcaaacaatattacaaataataccactaccttctacctagcaggtctattatatataactctatatacaaactcttctaaatggtcaataccgtttggcaaggtagtcagggcctagaatattgcccccctcaaatcctaattaattaagtactgtactcaattagaaaaaaaaatctcatgtagaacaagaggtcggtttattgcctgagtactaattttgcatttttaaacattactatgcgatatattcctatgtagtatggtaaaatcataatgtattgaagttgtatatataattgagtgaaaacatgctttgtttatatgaattacgagattaccctgcacaactttacgcgaagctcgataattgaagcatatttagacatgatatataactctaagttctatttccacaaatacagctgtaaaatgtttatatcaaccgttctacaccattataatctggacccattctgatctaacggtttaatttttttttactttctttaattaatgtgagaatatatgacctctagagtaaatctattgccctgttttcgagctatctttatatatataatctactcactacccccgaatttcaaactccttgtaattctgcgtacaccccaattactactttccaaaggtaatatgaaattaagggaataaaagtattttctaattgtagggtcgtatttgaatttcgtcccaagacctcaatttttttagagacagccatgccgtatagtagtcaggtctcttaggagaatattcactggtaagaatttttgtatatgtagtcatatacttaaaaaaatactacgaatattaggaaatggtctcgtagagctagccgaaaaatctctggacatttctctatggagttgtatactttaaatacctaaaaatgaataagtgagtaatgaagtctatacctattaatgtcctatattccctaaaaaaatgtcatatattaattgttctctcgtacctttcgtctacactggtggagaaatgctatttactcccggtttagaaccctttgtagtctcagttttccaactgggactacgaatccgggactaaagatcgctatctttagtcccggttcaaataaccggatctttagtcccggttggtaacaccaaccgggagtaaagaggatgaatctttagtaagaggggaagcgacagtttctcgagatcttttttttattttattgttgatttgctaatggctagtgttaatccctgtattttctcccgaatcgaatgggatgcacatccccaaatcaacatcctaaatattaagttacttatagacacagatcaaatacatcataaatcctacacacagatcaaatacatcacaaatcctaaaaaactatacacaaattaaatacatcacagattatacaagattatacatctcagatccatgcgatgcaatgaatcacaaaatataaaaaattatacatccagtgaaacacaaattatataaaaaaaagaaaagcaaacgaaccagcgctcggccgcccgcctgcccaccgccgccggcctcctgcccgccgccgcctccccccacgcggctgcgccgccgccggccggctgatggaagagggagtagaggggtggaggaggaagggcggctgatgggagggaggagaagaggaaggggaggagggggaggaagagaggggatgttccaatcttatctaaatatatgtctgggacttaaccgattagaagtgtgagagaaatatttactcccggttgataactccaaccgggactaaagatcgatctttactcccagttagtattaccaacagggactaaagtggtaatctttagtcccgattggtagtatcaaccggcactaaagatcctcggtcccctgacatacatctaacaggggatgaactgggactaaaaatcatctttagtcccggttggtgttagatcaattttttttaaccgggaataaaaatcgttttttgtcccggtttttaatagaaccgggattattgtggaatttggtcgaccgaccaaatattgtttctccacctgtgctacttagactacactttaatacttcatacgcgcgacacaggaagagggaaacagaaggaaagactgcgagcggagtctttagtcgttgaataatcgtgcttaatttcttgcgcaaactgaacatatattttagccaaagagtgatgagagtttgatgcgtcgtccaccctccaatctatcacgcttaactataaactgctcgctttcgcaacctgtcgatcactggatggatctgtgtccaacttgaacgtaattaggttaactgtgcgtatccaatatgaatatagatagtactactattgtgcaaagccacataatgccggcacacgcacacatatgacagttattagacattgacgaaaattgacttacctaaactacctacgcgacacagcaatattatacagaatcagttgcccagttgtatgtattgcctaagcttaattgggaggggagagatagagtgaataatcagcacgctgacgaactctccatgaggtcttattatggtaccagtcatcaacccgaacgatggacgggtttttatggactgatactatatgtatttgaattttaatattatattaaacatgttggttatcttcaaaatcaaaattataatgcttatattaaaagcaatctatattggctacaactgattaacaattaattttaagttttaaaattaaactaataaaatactcacttcatcctaaaatatagagattttggttggataagacatatctaaataatagaattgagagttcaagctggtacgattaaatatgactttttgattttctatattgaagtcaatgatattttcagttcatgatttatttaagatcaggtaatttattctaagttaacatgaaagctcactttaaagtgttcaattactacaagtataggtacatcgatcctagagaatttcctcacactgatactgaaccacaaaagttagcacaaatagctttccaggaaataggaaaagaaaggcaaaagaaaacacaatgattcaatgaagtcgcaactcgcaagtcaagaagacaatcacacctacccagcaagcaacaggtagctgtaagtgcacgaaaaacaccagcaactgcaagtgattttacaagaaaatagccgaggatttgcgggtcgctgcactatcaacaatggtcctaactaaagcttctcaaccttttacacgaaaaggagtcacagattttgcacgaaagagtgcagatctgggccactgggaagcgaaaaccgcagataatttcggccaaattcctgtccttgtttttgaattggtttccgaaatgaccgaccgtccgggacagcgacatggcgatcgacttggaccggagactgaagattgatgcagggccctgtgcgtgtaaattgtctgagcatcagatgactgaaggctctacagctgaagttagtaataatcttgactagaatcgagttcgtctagtctttaaaattttagagcagtttggaacaacgcggacaatgtttaaatttgggtcggtgcaggcaaatcgacaaaaacatgcagggtcggtttcgttttcttttggtctgtcaacttgaatcaaaatctagagcgaagtgctcaggtcaagtgaagggcatctacacttggggcgcaacaaaagctttgtttagagaactccagaagtcctctagaggaatctctaaagctttttgtttccttttcttgcacagggcatctctgtacctttaaaaatcattcaggcattcagcacatggagcagtggaggtagtacacacctacattatatatatttatattgtaattatatatttatattgtaacttgtgcgccgtgctgttgtgacattatcgtactgtgctaagcaagcaacaacagtatatgccacgcttttgcaatttcagcatgtggaacgggccagcacacacctactcctttcgctttaaaatatacttcatttaaaatatttaaaatttatatcacaatacatgtatttatgcgacattgattttaatgcatgtaaatctatacattttcaaacaatgagatacttagaaaaacaataatggtcaaaaattgcacttaaaggacaaatgaaataaaaagaactccatatatttattacatacaaaagtagttgtagggcttgtttgatttagtggtagtgccaaaacttagtcatattttgaaactaacaatattttggtagggtagcattttaagtgagtggatttgaattgataccaattgaaagccaaatctcatgttatggtcaagaaagttatagaattatgccaaattaaccatgggcattaccattcaattggctctaaaccaaacaattacattcactatataaactaccaaaaaattggtatggtaatattttggaatcaatccaaaatgacccgtacttacaaacagttgacattgacaacttggaaaattgtaagttacgttctgcaatttcgctagctgttgcttcagaagcatggttagatatatcggttggcaacggctgcagccgccaatttgcaaactgcggcggcaggacatatgctgagctctaaagcactcaagcagcaagctattgaatggacatggctgtcaaaaacacattgtttaaggaagacgactcggtttggggcttagcattggactactacttgaactggcgattcatgcgagtatgcaactatagcttgaaaatttagttcaccttagtcaacgatacgatggttgcatgttgcatacttgcataatgcatagggagaaattgcctgcggattacagacttaattaacaaggtgctctggaactctgaatccatgggccatctccggtagtataattctcccatcggaagaagctgtgacatccgttgacaattgcaaggcaattccttatttgtcactaaaaatttacacgaatatttatttatcgctaatgtttcgttgacatgtatcaatattacaatcttcatctggttgacattttcgtaagctttgctgcattgtggtggcatgaaatgatcggaaggatcgtcgggtttgcacgctatatatgtcg

SEQ ID NO: 82345 - DNA, 7385 bp, Oryza sativa
aatttaatcgtccgtcttatttaattttttttttgaaaaaaataataaaaaaacataaatcatgtagtataaagtattatttatgttttatcatcaaataataataaaaatactaatcataacaaaaattcaaataagacggatgattaaagttggataaaaaaacttatggctgtgcttaaaataggacggagagagtagaaactagtgtaaggctttgtttgggagagtttaagctgcttgcatgcttctgagaattttgaaaatttgggtttcgcgagtttgagcttctacggttagtttattttataaattctatagctacagatactgaggatgtggactgaaaattctgggaaaattggcttttgctaaaagctcccgtaaacgtatgctaagtctctacaattccaagtctctcactaacattactaattcaatatgataattaatcattatttctctcacattatgtcttgagctacgcctagtagaaactactccgtactacaagatcggtttctttatcattcctcatttaatagttagattgtcacattatattattttaaatagaattgtctaaatacaatagaactttatttttctaaaaaaaacttgtagtgggtttatagctttacaaaattctgggtggcgcttgtggatggttgatgactctaaaagacgctatcatactggagtatctcctatgtatgcggcgctggtgttacaaattctcccctcgttgctgttgacaaggagataatgacattggattcttcctgttggcaataattacaatgccaaattgccaacatctcatctcaagtactcaaccggcgttcgtcctttgacatgggaacagcggtcgactacaatacgtgccaccctcgacgacggccgcggcggggacggtgacccgttgcaatcagagaaggacgcggcagctgcctgcggcgagggaggcaagcggcagcggagggtaggacaagacgcgtgcagcagcagcagcaagcaggcagcgagatgtgcgattgtgcatgcatgcatgcgtgcaattttgagtagtctgttgtagttgtagcgtttagccatggcccaggcaggggaatgatgatgacaaggagaaaacacgcaccacaacatattattccattccaagggcccggccatccagtcaggctagccagctacagtaactcatcccgacgtttaccctacatcctccatcctacaataacctctcatttatcctaaaataagtttattttttaaataattattttattagaacatgaaaataaagaataaatacatttggggtagattattttataaaaattaattgtattaggatttgataaaatgtaagtattctagtctctttttttgtgtgtgtttgtatatgtgagatgcgtaaaaaaataaatttattttaggatagagggatagggggagtattactctttctgtccttgataagttcattcttattagagctcctaactgatatttaaatcagtatggaagaaacatagtactaaatatctatcatcctcgtgtagaaaagaaatattgttggagagataggtaagaagtattaaaatgataaaattcttcgatgacaaagggatgatactatataaggagataaaacttactactctgggataaatattaaaaatgagtttattttgaaacggcggaaatagacattttgggaggagatagacggaaaagcaattttgaggggagacagaatcatcatgctcgtgggggcagcgcgggaaacaaaccggagtgtgcagtagtatccccccctcctcactggccccgtgcaatgatgccagccagccctctgcgctgcatctgcatgcatgcccacattgcaactactctctgcatctcatctcatctccggttgttgaatctactgttgattgggctgagatgacaaatgtacagtttgtctcacggagaccacttcgctagccttgtcattatcaagcgacacactagtatatttcaggatgtaattaacccatctctcttatgattgtttcttctcttcttgccggaatttccacagcaaaggccaagggccaatgacccaattaatgtccaaacaaatgatgcatccttggtaaaggcttttgtggactatccaaattttgctgcaatatccagccctgatactttcctagctagcaccatgcattgtcacgggtttgtcacagtgggcagcgtcttctccgtcgatgtttttcaagggtcggccaaaggggtgcgtcgtgaacgcctttgccggccgagcttgcagctgctgctggtccagactccatagagacagagagaaagagaaatcaaattatgtgctcatccaccgcatgcgccggtcaatcccagctctatttgcaaacacctccgggcatgcagatgcccccaccgctgcactcactcaactctcccctttttccccggccgtccgtacacccatccagatcctctacagcctacacgatgctacacatatataccacagacatatatatactgcacgtatacaatctactactattaacatatccatgaggatgcacgaaactgtctactcctactaggagggtatgaagttagctaacaatcggtttcgcgaaacttgactagctacatagaccgacttaagaaacacaaactgctcggtttttttctaatcaagttaaaaataatcaaactaaattttaacaaaaatttaatccgattttacgggagcaaacagttttaaaatggttttaagaaaaacgacaaaccgttgacccccagatttcaactcgggaatggtgtggtgacccgttgctctactagtagtagggagtacttgaagtgatatggcaaagctatagacagttgacaactaagatatatctcctccgtcctaaaataaatcaatctagtatcttatatgtaatacgggtgtctagatttatcgtattaaaatagcatatcatatcactagtccagtggtatataaattggcatgcattggcattgggtgaggatgcgtaaaggatcaaaagccccgggttgaagggggcatgatgagccgtatgatccgcttggtttcccctgcatgcaatgatggcggcgctgaggctgagcctgaggctgagctgagctcctcctctcacccacagtagctggctgcctcctgtatctcagtatctgtacatgttccctggccgcctcctccgtcttgcactagctgctactgtgcccgcgtgtgtatgcgcgctcctttggaacacatcactgcataaggacatgcccactttactcaaatacgcaacactctttgtcctgtttagtttgaaaagccggagtacaattcaattgttgagatcgatcggatcgagtagtattaattcgagggtggatatcatgccacgttattatagagtatgagaattgttggtactgggatatacgcgagattaagataaagagacgagagacaggttttatacaggttccgaccccttaactgacagataaccttatttctgttggccgaagccggtattgtttttatatttcagtatcacataagcataatattttagatgacctaatctactttctatcggcttgacgtcatggagctctcgcacgtagtagatggctagcgtagtcttcttcctagaatatgaactcaacaagattggagatgtctctaagctagatccctttatggcttctacattgggtttggctgggtctatattggcttgtattctgacttggcgtgttgcctctctgacttggcatgtcccctcctcataaggcgtattgtattgatacccttggatgcccccttcaagtataactagggagacaagtatatattaatatgaagtaatccttgtagtgcccgagtagaactatgttttttctttcttattcagcggtccagattattagctagattctgaaaatctgattatatattcacaaaatgaaattgaagctagaagttgataacctaattttttttcgatcagattctcacgggatggctatctatcaattgtttcccagaatctcgagttacctcaaataaccttaaaatctgaagtaagaatctaaaatgcttgagaaaaaaatagagattgttagctgaagaaccgtaagtagctgtagctaatgaaaatcatccttaaatttaggttctcgaaaattatagtatgtttatatctatgccaatacgtacgttgtaatatgtttaggatctcttcacatcaatttttttttcgattttctctctttctacaccattgatttgggctagaactagaacttttttccggctccgataagcgttccatgacaataatggctacctcaaaaagctatacttcgtaacaatgatatggacatgattttccagccaataaggatttcatatttcacttgattggtatggcaatttttttacatggccagtccgtcactacttaagtagatgggtgggtatatttggtatagttctagttttcagaacacatataaactcttgttttatatgacccatagttttacgaatgaccctgcgtgcttaggacatccacaacatggatgaaaagtggatagtaaggtcactcactatttatttttatcattgtggaggtaggtagtagaggaggtagtaactataacaaacaatagcactactacctagtaataggaataaaaaacattgaactctctcctctgtctcttttctacccaaccattgttttacatgttgtgagcggtacaaacaactataacctagtagtttattgatcccaccttattattcacttaataaatatatattgaggatgtccttaattattgtgacatatatatggtgccctattaggtagcttgatggaagatttttcaaaggctatcatgcttccattcctgatgccttatggctgatctgtttatgattgttcctttgtcgactgcatgcatgtatgattcatctgttggtaccagtcaataaattcattttgaagctttctagcgagctcgattcatcaccgatattaccgatccatccatcgatcgatctccttggattggatcagcaggcatgcatgcagcacctgccatctctgattctctgcacccgggattattaattaacctcgcctttaagtacgggagatcccggtcagaacgctgaaagagataagaatatatcgtgatcactatgctgcatgactgcatcgtacggcccatgcagtcgttagatttggttagttgcgtcttaattcgaggtaatgatcgatcgtctgatcctacctgatctccatcatgttcctgttgatataagttgcatgcaaaggaaaaaaatttcaaacaaaaacttttaagaaaaattcgcactttatttgatagtagcttgtactccgtctgtctccgaaagatcactagcctttttgttttcccgagatgaaaaagggaaagaaaaatctacgattagcttttcttgcaatagattggcaactttttgaatccaaattcaaagcccaatccttgaagccacgcactgcacagcgtcctacagacacctttattttggtagggtctgaagaattcttcagagagtacagtatatagtccatgcatgcagggagagctagctaggaatttttcacatcccattcaacacaactcatatctcgtacacgtatgggacgtccggtgacaagattgagcctttattccttttttcccaggattggacacatgctttcctatttatgcacatgctatctgatttctcctggcaaatatactgaaaaagaacagctacaagctcctttgaaatgtaaaattgaaaagatgtaggactagaaaaaaacactggatttcatcgtaaatgcaagtgcaaaacatagaaaaaaaatataataattaccgtttgattattccgcatgaaaaatcactataggattgactattacatggaaaatttagaagaaaggacataattcaattaatcaattgtttcaaacaattaaaacacaaacaactaaaaagatgacatattactccctccagcccaaattataaggcttatatttttacacgatttttaattatatactttgaccgttaatttattctattttatgttccaaatgaatacgaaattagcatcatacgaaagtactttaaaatataaatctagtgatataatatgtataatacttagcgtagatatgtttgctatgattattaatcaaaagttatcgactttaattttcctaaaaataagaacgtcttataatttgggacggagggagtactatagtgcaatacctattagacataagcataaaaattccgtacatcctaatctaaccattttatggtagtaaccgatgatatcaaatatttaaaaacggatggaagtattggttattaactattaagccactattcaaaactgaattactctcaagtggttaaattagtaattctcaagtgagaggggaactgacccatgataggaagaaaacaaggctggctggggtgagggtgagggatcagaaatattcagaatggtggtgcaatgaaatgaaatgaattcaaggtgctcgtgcctacaggtagcaaaagcaggcaggaaggcaggcagaggggggagagaagccaggtgcatacagtacatatgtcagtggcaatacaggcggaaaacttggcatgctttgctccccggtgtcttcatctcggctcgggtcaacagccctgctccaatctcattattatcccctcctacggggaggcatatgccctgaccgcatctgaacaccttctttgtctccaaccttttgtctcttcctgctcttctctcccctctccccaccattgcccctgcaacctcctctacacctcattcaatttaacactagcttctctctctctatagctctacaagttgatgagaagctgcagcgttatataagccgggctagctagctgtctgtttgcaggtcactcgtgtgtgtgtacaacaactatatacacagttatacattcgtgtgtgaagtgatatatatatgtgcgaagtgactggttagcttaattagctgcctggatgatgatgacgatgatgagcatatagctggttttgtttgtttgtttgatcgatcgctgcaagtcgatcttgacattgtgctgttgatcgaacgatcgatcgagaggttgtgagagatgaccatggtgagggcggcaatggtgggcggcggcagggagaggaacggcggcgtcaggcagtacaaccgatccaaggtgccgcggctacgctggacgcctgacctgcaccactg

SEQ ID NO: 82346 - DNA, 5022 bp, Oryza sativa
  unsure (1)..(5022): unsure at all n locations
gcaaggtactttgctttgaatgatcttggaatgtttatatatgtattataaacattacgtacatacttttatacacgtacattcttttgtttttttcttttaactttgctttgcaatgtgttggctttgactagctacttctataggtatttttgcctgccaggaatggttcaggcagagctctgcttttttcaacaaacaaaagtttgaagtaaaaaggatatattccccgagacgtgtctatcttgttggtcctgaactgcagagtctccaaatatagctactacagtactctacattcctcactgctaaaactgtgaagaatatacagaccccagttagtcacaattcttattaaccaccgatgcatacataatgcaggaagatgcattttcttgtcgatgctactagtcttgaaggttgttaatcacaggctagtcagagtagtgttaaggtcttaagcaccttatttcgccattaaagaagaactgttgggcacacttgcttgtatgcagatgcatgtgtgcatggatggcacacttctcaaaatataacaattctttgaaattttttatactaattctttgggctatacagtgttagttcctttatcctaatgctgcatgcagctgctactagtaactccagtactccatgagaggaggaaagctaaggaaagaaaaacctaaggccctgtttagatgggactaaaacttttaagtccctatcacatcggatgtttgaaaattaattataaatattaaacgtagactattaataaaactcatccataatcttggactaatttgcgagacgaatctaatgagcctaattaatccatgattagcctatgtgatgctacagtaaacattctctaattatagattaattaggtttaaaaaatttgtctcgtgaattagcttttatttatgtaattagttttgtaagtagtctatatttaatactctaaattagtgtctaaaaacatggactaaagttaagtccctgatctaaacaccacctaaaaccattcttcttttgccaatcttgtgatcagggatacaggtgcaacaggtggatcaggagcacacatatggaggtggtgtggaagtttggactgatatgcagcagtgtgatcatgatgagtgtgatgtcccttgctgcagctgccactccccaaagcctagaaaggagccactgcttcacctccaactgaaaaggtcattgccctttatttggagcaatcagtttatgctctgtcaatctatgagccatcagtcacatcatgagcaattcttatcacgaataatgtcaacagtttaaaaccatcattttgcattcactttaccctctaattcaaatattcaattagattgtgtttagttcctaaaattagggagaagtttgaggaaagttgatagtttggaaaaaaaagttaggagtttatgtgagtagaaaaattttagatgtgatgtgatgtgatgtgatggaaagttaagtttggggaaagtttggtgtgaattaaactatcacatcgaatgtttgaacacttgcatgaagtattaaatataggctaaaaatataactaattacacagattgcgactaatttacgagatgaatcttttaagcctagttgctccatgatttaacaatgtggtgctacagtaaacatttgctaatgacaagttatttaggcttaataaattcgtctcgcggtttactgacggattctataattagtttttttaccagtgcccaaataccccatgcgagaccctatataatacccgatgtgatacgccaaaactttacacccctagatgtaaacaccccctaaatatctaactatatacgttgttagaagttgattttttataggatgcaacatcttgaggcatcccatcaatatttctagataagtgaaaaacttgaaaaaaaaaaggctactagtaataagcaaagggatgtcttacttgtatccatttgtgtagccacaaattcttgtattattttagaatggacatagtaatacttacttgatgtggggcctgttcagatttatgtcattttaactcatatcattatttgataaaattgacaactgtgtgacaaaatttagtttgttataaaatatttgtcatgcctagataattgactacattatattagcctatcctactaaatcttggtaattaatgtttctaacttgttgaaattttggcaatgataaattttggaaagattgaaaatgactataaagtgaacaaagccgtgatgtttgcatggctataacaagcaattcgtattatatccacgggtatgttttgagaagaatatagtggtactagttcttttattagaatgttttgacaaactttgttctgttataggagcatttatagttgtggaccccattagtacaatttaaaataactagaaaccttaaaacacaatgattatttagatggagcttaaaattcatagatacagctgatgaaaatatgagaagggcttagttttttagcttatagattctagtgcattttgtagatcttgtagctattggttactcagaatctgagtatctatactgtttggaaagatataggtttttataagacaaattacaactgtcagaagcctctcaaacagggcctaacgtattattgttttattgaacgagcttcttatattcttcttttcctttggtgaattttacataactaaaatgcactaggtattatagaacttcttgacaccctagaatatgtccaccaatctaatttaaagcatcaagattttctttttgagaattatgtcgtcagatttgttatttgaagtacttccacatatactactatatcccaatacaaattaagttgcagaaagtaatggacaaagtggcatctcaaacaccatagaaagttaaaaacatctcgaacacacaaagtcagtcacactgaaactagatctgcatgcatagttagccccatttgtcactagtgcgacactagttttgcacgctggcacgctgcacacacgcatgcatgtttcccatttctattccctttttcctctatctctctctctctcctgcagcagtggcatgaatattgacgaaccaggcacgcgcgcacgcattgccgcgcccaatgtacgcagctgcagggacgacgccgcagcatctgcgacggagacgcgacgacgacgtggtgggaggccggaggaggtagacgacgacgcgaacgcgagcacgagccccagaattagccagctgcagctgctgcgtctcagaggccatggaatacgtgagagcgacatgtcaccgtcgacgagcctgcagtgctactatgtacgcagccagaggacgacgacgatgccgccgggcgctgctgctgcagcagccggcggcgatggcggatcacagtgctacgccgcacctcggtacagctcttcctccaagctgaaattcttggggttcgtggtgacatcggggcctcctcctcctcgtcttcctcctcctgctgcctgctgctgcggcagcgatgacaacatcccttttcaggtactccggcctcctcatatcctactcccagtaatagtactagtagtagtctttctcggctatccatggatgtgattcactagtgatcgatcagagattcagagggacaaatcgtatggatggatggattggatcatcaatccactactctgtctcagtctgtccaaacacagtagctagcccgttcccctgcaaattaaagtgtttgtgtgcgtcgacgttcgtgcagtgcatacatgcagccatgcacaaacccatggtgaattggtgatgcatggtagtgcctttttcttttctttttttttcatgtctagtctctgcagctttgcgacacataaaacattcacagtagcttgcttccctccaatcactccaaaaagtcacaaaagctcgaagtgaacagccggatagtccctacctttccctttttgtcgtaaggaaaaaaaaatcaacagtaaaagttcactttaaccgctgattaattaccacgtggcgctgttcatgcaggtcggcacgtttgccccacaccgcgtcgcgccgccaacggcgagctgcggcggcggcgcgccgcgnngnnnnncnnnnnnnnncnccncnncnnnnnnctccnncccncnnnccncccccccccccccccccccccccccccccccccccncccccccccccccccccccccccccnccccccccccccccctcccccccccccccccccccccccccccccccccccccccccccccccccccccccccccccccccccccccccccccccccccccccccccccccccccccccccccccccccccccccccccccccccccccccccccccccccccccccccccccccccccncccccccnccccccccccccccccccccccccccccccccccccccccccccccccccccccccccccccccccccccccccccccccccccccccccccgcccgccccccgccccccccccccccccccccgccccccccccccccccccccccccccccccccccccccccccgccccccgcccccccccccccccccgccggcccgggcgcgcgcccggcgcgccccggccccgccgccgccgggcgcnccgcccgcggccccgccccaagncgccccgccgcccgngngnnggcgagnnggnccnncgnngcnagcnnnnactcnnaatcccttatatttatggatggagggagtaggagtattaacctaaagattacatattgatgccgataacctactcattttacttccgatgtatcatggtatgagacatacattggtagttatggtggctaaatgataaaattatatgtcaatataaaaaggtaaaattattctaggttatatatgaaggaaatactggactgacaggccacatgcacagtagcacaattaccacacttgtcaagaagggggatccactagt

SEQ ID NO: 82347 - DNA, 15356 bp, Oryza sativa
  unsure (1)..(15356): unsure at all n locations
gcgagcaacaacggcgtggcgccggacggcgagcacgacgacggctgctcgctctcgctctcgctggcgttggacacgggatgcgccggcgccggcggcagcctggtctcgtcgacgacgtcgtcgtcgtcgggaagccggatcagcctcgacttgtcgctctccacgcttgactcgtagagcgtgcgtgcgtgcgtggcagcgtgagatgtttgggcctttgtgggctttgtgggccgttttgtcgcctgattttgatgtagttttaggcccaacaaggcagctcatatatgggcctcttattcaggcagctcatatagtttttctcttgggccgcgagctgctttcacatatgggcctcttattcagattagctattcaccaatcctggagaaagcacgaatctcgatgccccgaatttctgcacctcatgcggttatacgtacagagatcaggcagaaatttccccgcaaaaaaaaaaaaagagatcaggcagaaataacacaccttaactttcttcaatggaagcaaccaaggcaccaagcaacagcttagcctttttgaagtggcaaattcaagcttcagtaccgtaggtctgtggctagcttttatgagcccaaatttagtgggcatgttcttctccattctcttcatgtgtactgtaaatacaggggaaatttgtaccaggttcaaggttgtacgtttctcttctgttgaaatggagtagtagcatgcatgaattgtcagcttctacacggacatatgtcacagtgcttcacgcggattgaacagtaaagtgcagacaaaatcaaactaagctcattggtgcacatgggcaacaaatgcagtataaagcctaacccaagttacctttttgtagtaggagtatatctgagaaaaagtcatgcagttggtacttttacggcgtctacaactacaagccagttcaggaatacatgtagttgatctgaactttagacagaattgcaacaatcggtgtcaccaccagataaagtaatctgaattcagatcgactagcttgcttcccgaacatgttgagcaatatttgctcttcgtcagaggcactaaaagcccacagtttagtcgtacaacattggctcaacaagggaaaacgaaggttcaaaacttagaacttcacacggcgggcggctagtggcggagctcctaatttcattcttaccctgaaagtaatctagctcccagataggaaaaagcaaaaaacaagtggaagtaaatgcgacggaaatttgggggggatttggttccgtttgacggtttcggaagccccggtccatgttttggttggagcaatttgatcaccgcgccacgctgttccggatgaccgaccgaaccagtggaaggaattccaccgtgacagactcgatcgatcgggcgcgattttttttccgggaaatccaagccatccatgcctacaaatacgcgcgaaacggccattgggtcgcgcacgctggagccgccgcgagccattccccccgcgaacacgttaaaacccttttccggtggccggtgtaacgcgcgcatacgtctgatctcgcatggccacggcggatgaggtcggcggcggcggcggcggtggtggcgccggagttggagcgggcgatcaggtgaggagggcgaagacggcggcgctgttcctggcggccgtcgcgctcccgtgcctcgtgctgtaccgcgccgccgtgtcgccggcggggctgttcctccggccggccgccctgccggcgccgccgcgcggcgacgtcgacccggtggtgagttgttcgcccgccttcttcctctaggatgatcaaggtgtgtatacgtaaacgatgaacacgtctgtcagtcacgtacggctgaactgaaggctgtttttgttggcaaaaattatttttctttaatcagcttgtgattcatgttcatgatcaccagaaaatgcaggaacacctctttgcatctcattgattttttttttgggtgcaaaaatggtggacggttaaaattcctcattgttagcagtagtaaatagttaaatactccactgtagaggaagaatagtaaaactgatgagagcgatggtgaattcgggagatccaccaatttgagataagatcagtgccttcgcaaattgcaaattgttttttttcgcgaacgcttttatttccgcgaacgcgcaaattgttttcaaatggtaaggctttagtctaaactgtaaattatgttgacaatgtgagtgctgttaacctcctcatttggcttctttctagaaacactattattcaattgcaacgtgccagaaatttgctcccaggttagtatgtaattcaaccctgtgatgcatgcacccgagaattcactcccagaaatgaaattttactcgtcctgtagcaggcctacagcgtttgattggccacggcacttaaaaacttttttttgacagtcgacatccatgccaaaatgccagattactggcatggttggcattcttagaaagcaacatgaaaaactgtctgccaatcaaattaacagactagtacatctcttctattggcaaaggcatcttttgaaatagaggattttttaaagagaatttcacgggaattggactgattcatgtgaaaatccggcaaacttcattcatttcaaactagtcgtaaaaaacacaggaatggtagttacatttgaacatctatttttttttcttaaaaaaacctgccacaatagtaacagcacactattcatctgaaatttttttatttatatttctcttaaactaaggcagcgttcgagagggtgagagagtgagtttgtttgtttcgttttctgcgcgcacgtttcccaaactactaaacagttatgggtgagggcaagggcaccaaggctttgcgctcagcctcgagcgccgtcatccgagcctgcagagaggcgttagcctctgacgcccgccgctcttgggcggcagctgcgtcgaggatgccgcgcgcgtcctggatcctcctctccaggtcctcggcatgagcctcatattggaggcagatgtcgcccagcgcctcgtccaggacgctcgaggcgatcagtgccgcctgccgctcctcctccgtatcccgcatgagggagtccaggacctcctcgcgcgcctggatttcggctagttgggcttggcgcattttgcgctccaccctcaccatgtcatccacggcgcgtcgctcctcttcgacccgcgcgcggtccgcggcgagctaggcccactctgcatccaggcctaatttttctataatcaacatgttctcttttttgcgttttttgtaaaaattttctataggaaaattgctttaaaaaatcatattaatccatttttgaaatttaaaatagttaatactcaattaatcataagctaatagctcatctcgttttgcgtatcttcccaatctcctcaatccccttctcctcaaacacaccttaagttgagtttagatttaagatttgtgagagtgtatttcatatctacgcatatctctagtagttttttcataaatttacaaaatttttagatatgattttcatgagttttcacatttagcttgttttcaccaaatatgtcttctttttatacaccatatttccggcaggtaacagttaatcaatgtgacatatatgaggttgtgcttgtgcacgcagaacagtgaggacgcgaggctggaacgcgtcctgagggcggcggcgatggcgaacggcacggtgatcctgacgacgctgaactcggcgtgggcggagcccgggtcggtggtggacgtcttcctcgagagcttccggatcggcgacgaaacgaggtggctcctcgaccacctcgtcatggtctccctcgacctcacggcgcaccgccgctgcctgcagatccaccgccactgcttcgccctcaccaccgacgatggcttcgacttctccggcgagaagaacttcatgaccgacggctacctcaagatgatgtggcgacgcatcgatttcctcggccacgttcttgccaagggctacagcttcatcttcacggtaaaaagagaagaaaaacaataaaacttaattttaaaattgattttaaggttttcatgtagtttatttttatatggttatgaacatagatataaaagttttatctatatattatattttttatcacttataagttgtgttccttatgatccatagtaagcaattgtaagcgaaacaatggcttttctaatcaaatcttttgctcaaagaacatactattctttttgttcaaagtctgaactttgtgaaggtttgtttcgtcaggacacggacatcgtgtggttcaggaacccgctgccgcacctgcaccacgacggcgacttccagatcgcctgcgaccacttcaccggcgacccggacgacctcagcaacagccccaacggcgggttcgcgtacgtgcgctcgacctcggcgacggcggcgttctaccggtactggtacgcggcgagggagaggcacccgggtctccacgaccaggacgtgctcaacctcatcaagcgcgacgcctacgtcgcccgcctcggcgtcaggatcaggttcctcagcaccgacctcttcgccggcctctgcgagcacggccggaatctgagcacggtgtgcaccatgcacgccaactgctgcgtcggcctccgccggaaggtcgacgacctcgggctcatgctccaggactggaggaggttcatggcgacgcccgggagtgaccggcattctgtcactggagtgtgcctnggnnttgccggtgnttgnttttccgngnngnngctgttcgcgctttgtgatttgattagttgcatgttttgttctgattagttctcttgttcttgtgatgatntgtcttntgcagtatgaagaaactggggcggtaggagattggaaagattaattgtttaattgcaatgtgttagtttagagccaacacttgctgttgtctgtaccatagatgagatgctgactggaacaaatgaacatgcaggtaattgtcgttgacaatactactcttcttgattagtgctttctaagttgggaagtgacagtacaaatttagtcaaggtatacagcttaattaactgtagaaaaccctcttttttaatacattttttccacgctctgtagttctttcgcatctaatccccgatctgaacaattgaccaaataatgtgttactgatagctttgagataacttcaagctcatagatacattttgtagcggcatttctctgaaacatgaattttacaacggcatacgcccaaatttccaacgaaaaacagtgtccatttcgttgtcctgaatccactgcaatggcattcgagctcatggagctcgcacggccgcattgtcatgacatacctgtagacagaattagtgaaatggatatgaattcagacctggagcagaatgaccgaaatgttgagagtttggtgcaataacagaaaagtttctcctaccgctgctgatgctgatgccatggacgattaaacccataatataaactctgcaaacttccacagaacagcctagcagcaggaatggaagaggcaagcacaggagagagaggcaaaagtgaagtccagcttcaaactgaatctcctgctcctctgcatgccccttccactgctgctgctacagccaaaaaaccagacctaacataacacctacctatcccaaaccaaattttgctgtggctgctgctgatgcatccattggtgaagggtggcatatttgtaccccggccatggtgcactggtagtagtacaagttagctgcagtacatatgggggggagatcgttaggggcggcttgtacttcaggcttgcaaatatcatcagtgtactatggctttcagctgtactcttgtactgcagaagcgttggagcaaacgctctaacggcgacgggtaagccacagatccgttgaggaggtcgtgtcgtgtgcgccacaggcttcactttcagtgaccccgtcgccgttgtcttaatgcaggaagaggttccttttcttctcacttcgcttgtgtgattgagttgctactagtactacctatcagtgattaatcatccaatccataattttgacaagggtccagtctgtcatgtgacgtaggatcgatttatatcgcatcagatctccaacaagttgaacgccacgacatgtatgctgtactagtatcgtctgatgtactccatgccaatatgtgaagtactactccgcaattttgaaaaaaaaattgtcgcgaatgatagtacagattaaaatgttaaatactctcgttttttaatacataccattgttcgtcttattagaatatttttacgaaatgcataaaatataaatcatgtttaaagtactttcaataaaaaaaactcacaacaaaataaataataattaatttattttttaaaaattaagataatatatgttcaaaagtcaatgctgtcatgtatttataaaagtgggtttagtaagatacaataaatgtgagcattacagaaaactctcccatcatcccatccgtccatgtggtaaccggtggactatggaactatagaaaagcatcgggctgtgcgcagcgcgtccctctatgcgattgagccagagcaggttcgcacttacggcaccgagggtctatttgaggagcttaaaattctgagaaataactaattggttgtaaactttcgagaatctgaaaaaaaaagttgggttttttttctaccttatggcttctaatttatggcctgttcactttaataacaaaaaaaaacattaccaaattttggcattgccaaaattttggtatagttgtcaaatttttggcaggattttttacatagttatcaaattttgacagcaaattaaatgtagcctttttttttgacaactttaccaaaatttagtaatgttgaaaatgtcatcaaagtgaacaggcccttaaattacacaactataactttgtagaataaaaaattaaactgataagagaatatctgattttggctgacataagcttccccagcagagaccaagtctgatggtaaaagcggtgcctctccgtgccgcctgtggaagctgtatgcgtgatgcggacaacaaaacaaccacttcattcgtcctaaaatataatagcttatgatcggataagatacatcgtaatactataagtctagatagagatatgtctagatttatagtattgtgatatgtagtatctaataataggtttttatattttgaaacggaattagtaagatccgagacgcgcgcaaatagaccttccgtggatagacgtgacgtacagcatccttgtattgcttgatttgctacacgtgctatttttttcgccgggccggtctatgacagtttgagatgatatgggctgccgaaattcgaaacctcatgacttcagacttcagaattcggacaaaacagacgcatgtggcacaaacacacagacagaagaaagtaaaacaagactcgaaaagaaaaaaatcctgaagtctgtaccaaagttcagtattacacctcacagaaaatggcccgtgtctgcagctgtgtttcttcttcgacagtcatgcgttcctctgtcgaaggggaacaacgtacgggcagccaatccgagcacagtatatatagtatagcagttctgcccggggacagtcaatgtgtgtgcttcgttacattataggagtatatatttctgcacctacgcgagcccgtacttggacagtggtcttagttttcgtacactttgcactcgtcggtctccgggttgtccttgcagaagtcctccagtgggtcgccgctgccctgcaccgccgcgccgggccacttgctcgccaccagatgcgccagatcgaccacgcgttggctgcacaaaaccgcacacgaatacacgatcgatcagacgccgagcaatgcaattgcaacgcacgcagtaacatgtgttgtttgtttgcattgctgattgctctcacctgtagccccactcgttgtcgtaccaggcgaccaccttgaccatgtcgtcgcccatgaccatggtgagcgaggcgtcgatggtggaggagacgtcggagcagcggaagtcgacggacaccagcggcacgtcgcagacgtcgaggatgccgctgagtggccccgccgcggccttgcggaacgcggcgttcacgtcgtcggcggtgatgccggtcttcacggtgttgatcaccaggtccaccacggacacgttcggggtcggcacgcgcagcgcgatgccgttgagcttccccttcagctgcgggagcaccagcgccacggccttcgcggcgccggtgctcgtcggcacgatgttcagcgccgccgcccgggccctcctcaggtcacggtgcgacgcgtccagcaacctctgtgttagtcaatcatcaaacacagcacacgcagaatgtatcagcctctgcacgtacgaaatgctgcagcgatcatcgatcaatcaatttactcgttttgatcagaaaaccgaccgacctggtcgccggtgtaggagtgagttgtggtcatggttccctttacgattcctgcacatgcgtcacaacacagtcaggaaacacatgttgccatacgtattgtgcttcaggttaaggcgagcgattaaagttcttaccgaactcttcgtccaagatcttgacgaacggagcgaggcagttggttgtgcaggaagcattgctgcaacacaagaaacagagttcttatgcatgttgcagagtttgatatgcatatatattgaagtggtggtgtttgcttttgcttacctgataatgttggccacttcgtgggagtagtctccctcgttgacaccgaggacgtaggtagggatgtcagcacccttcgccggagcagtgatgatgaccttcttcgcgccggcctggatgtgcttcccggcgccggggccgtcgacgaacactccggtacccttcatgacacacacagcaatgcagcattgtcagttctgttccctgcagattgagttcacagtcaattgtcgatttgtgtacctcgatgacaatgtcgatgccgagctcagcccatggcagcttgagggggtccctgttggagacgaccttgatcagcttgccgtcgacgctgatggtctggtcgtcgacgatcttgacgtcggccttgaaggtgccgagcatcgagtcgtacttgagaaggtgtgatgcctgaaataattaacacacgcagagaacaaaattatatcggaatcagtcattgattagtctgtgcttgattacgttcaggacaagcttttctgaaggatgagtacttgtacttacgttcctgacgcctccgctgtcgttgacgacgacgacctcgagcggggagttctcgcgttcgtgccagcaccggaggaagttgcggccaatgcggccgaagccgttgatggcaaccttgagcttcgcctcagccggcgccctcacggcgttctctccggtagcctgccacaggttgaacaattcattcaggacttgcgcttacagtcagaatacacgtctgtacaatacatgatattgtggttggcgaggcatccaaaaacgataacttgaccaacttgtcattatagtcttgagtgcatgatactggaacatttatctacctagtactgtaatacacgcacggaatattagtaactaggataatgtcctatgcaatttttgaccgtttgaagttgtggtttgtcccaatatagctcatgtcttattttctatttcatctattccaaaatataagatattttcgattcagattcatgtactagagattgatggagtaagtataaaaactcattggttgtgtccaacataagagactagagatgtaaatcatgtgtgatctaccagcaaagataaagtttcatccatctagtgaagaagcacgcaacatgtcgctgttatttcacaaaaacggctattaataaggtgattattttgtcttatctacacacgctgtgagcgtttgcgtttatactacattttttgttttttaaaaagaacccaactattgaatttccagaagtttgtaacatataatagcagtataaatacttttgctaaaaaaaaaacaagtaacgaaaactctgtatttatttatgtacaacgattactactgttttccatagccaaaagggaccatcttacgttactcatcaggttaaactgtagtcatactaacgtgcgtggtaaattctacagtttgttatctgaaatactgaattgtgcacaggtaaaaggaaaaacagaaagctacagatcaatttgttagctaagctaagcacaggcacgtaccctggcgacgagctgcgagccaaggacatcggagaaggacgcctccctcgcggcgtggctgatggagcacgatcccggcctcagtccggagaagtcggcgaagtccaccctctgcaaccgcacatttcatcagatcacccgtagcttcacacgcaaagccggataataccacaagatcacgcacgcgcgcacctgcttggacgccgccttgctgtgcagccgggcggtggccggaatgcgggacgccgcgagcgctgcgtgtgtggccatggctcgtcgctgccgcctgtatgcttcttccttccttagctcgctcggctggatggatcgaggcggccggatgcgcgcgtatatgtacttggcgcggagggcgcggcgatcaccgctggggctttgtggcgtggagaccggggataaggcgattgcacgcgcgcgcagccacccgttgcgcggaaggcgatatccgtgtgtgtgactctggtggcctcgtaggtgaaacacaaatatctctctgcagtgcgcgcccgcgcgcgctcccgtcgttgtctccgctgctttgtttctcgtcgccgtgtgcctgcgcgcttgctgtcaccgtgtcagcctgtagtttaaactggtgagacgtgagagcctggctgcgtggggctcattttttttttcgccatttctgtttggattaggatactgacatactgttattctttttgtgtgctctgtgtggttcatggttttatggccatcggtgtagcttgtatgcatatatcttttctttgataaaagaagatcactggacaggcaaaatggggtgtaccttatatgggcatttcaacagaaaaatggaagccaccaaaactgaacatgagataaatttgtccctgccaaaattgagcagtgccatttataattccaaaattttcaaaaaatttaagaagggagaaggtttgagtcagcggtcaaaccgaactaccaaagccacatcgaatgggctcaaagcccaaacactggctagcccaccacttaacacggcccacggcactgaacctatcaaaacctctcttctctctctccaccgccgccgccggtctgcgccgtctcactcacgctcagggccgccgcgacgccgtgtccctctccgccgccgccgccgccgccgccgctagcctgcgacgcccgacctcgccgacatgttgcagagcaagaccttcgtgaagaagacgagggcaggccgcgtccagaaggtaactactcggcagcagcatcaccctgcgcgcggcgaaggtgcccccaaaccctagctaacccggagttcccccattcccgcaggtggtcagggagcactacctccgcgacgacatctcctgcggcgccgcctcctgctccacctgtggcgcggtcgagcacccgctctccgccgacgcggccgccatcctcgtcgtcgacaccaacgtcgtgctccaccaggttggcctttcccctcctgttgcctgtagggagtagagctagggattccggaggctgatgttctgagagcttgctgcagatcgatttgctggagaatccagcgattgacgatgttgtcctactatcggttgtgttggatgaggtgaagaataaaaacctcgcagtgttcaacaggatcaaggccctgtgttctaacaaggcaaggaggttcttcgtgttcaccaatgagcaccacaggtgtgcattcgataccttaggatttgctcgatggctattatgatttgttatgtgaatccagtatacagttgctcagttcttatctgaaccaaaacatgtttaaatttatggttaacagaatggggtagagaaaccacctaggttgttaaagaagtatattttagttgctagtactagggagaagatttatctaaaagctctaccctgcatctgatgttccacaacatttcctttttaacagactcagatttatgttgggctaatttgattttgggatttcctaaatccctcttcaaatgtttcttctccaaacagcatatctttggtgtgcatgacagtcggacctcaattttagcactatctgcctgattatatttgcaaaagtctctctatgcatgcactgttgcacatctacactctgcaattttttttaaaatattcttgtcagcaagcttgtatagaccaacagaatttgcaaatttctcgtgataaattatctcttgcaagtacatgtccgtccttatgtttgcgaatttctttaaacacgaagaaaatgagtgcacttccagttccttatgtggtcttcttggtttaaaattacaccattctcttccaaaaaaaacagggatacatatgtcaaagagatggttggagagagcccgaatgatcgcaacgatagaggtactgtaccaaataattctgttagcttgctttatctcatattttgcactactcgaagtacttttgtgtattcttttctcttgattggtcattcatattcagctattcgtgtggctactcgttggtaccaaagtcatcttggtgagaatgtgaaagttttgctgatcacaaatgatagagataacaaacggaaagctattgaagaaggcattaatgctgagacaggtgaaattatggatgttacaaaaatgttagctggatcttttcaaatattggacacattattttttctggtaatcacaacacaatatttctggttccagtggaatcatatgtacgatctcttgcacagcctggtttgctcgatttagtggttgtttcaactagtggagatgtcacaatggaagatgtagaagatcttagaccgtccaaaaagaaagtaatttacagtgaggtacagtaaatttaaactgttgacttgtgcttgttttattggcgttggccatctagtatcaaatacgaatatgtaatttcttgctatcattgcagcacaaacctatgtcagaaattacagctggcctgcggtgtggaatttatcatcaagggaagctccgagttaatcgttacaatccatttgaagcttacgttggaagtgagagcattggtgatgagattgttattcatggccgttcaaacatgaatagggcttttgatggagacatagttgctgttgagctcttgccacaagatcaatggcatgaatcgaagtcatttattgcagacgacgatggtacgttcttcagattccagcacatgatttttcccttacattgatggatgtttctgttctttcagaagatgatgaagaagacgtccatttggctccaaatagtgctgatgatgctccacggaaagccaatcccacacaatcaacagctgcatcatcagctgattctgtctctagtcgcccagttggacgtgttgttggtataatcaagcgaaattggaattcgtaagtcttttataagatagggatatgtttttgtaattacaatatatactcctgatttggaaataacctgaagagatgcatagtttatgaatcttgtttgtatacatattagacggatgcaaattttttgggctcaaggttttattcacccattatgaagttatgatctatacgtttcaacaaaaaaatgtccaaaattttgtatgtgtgaactgctaaaccgtccaaaatttcaacaactaaattgtccaaagctgtccaaaccataacttgcgtgcatttttatatttcaacgtgttaatagtacctaatagttttaaaaatatttcctccctgctatttcatgcatgcgttgtttatccatttttcaccggttagaatatggattgttttctgtgcttagattgtcatctaccaaaactattcagtctataattgcaatttaccttaactgttttatgtgcttcacattcatacaatgcctgcaaacggcaggtattgtgggtccttggagccaatgcccatgcctgctggtagtggaggcgttgctcatgctctatttgtgtctaaagatcgacgaatcccaaagattcgaattcaaactagacagcttggcaatcttctggacaaaaggattattgttgcagttgattcatgggatgtcttgtctcgatacccatcaggacattatgtacggactataggagatattggtgacaaagatactgaaacagaggcaagtcttacaattttacagctgcatttcacactttgtgttgcaacatttacttttactatgtaggagcatgcactgatgctaatgtgctaagtgatatttgtgcgtggaacaggttgtcttaatagagaatgatatcaacacaagacctttctctacacaagtccttgcttgtttgccaccattgccatggacattatcacctgaagatcttgctaatcctaatagacaagatttacgccatgtgagagtctttagtgtggatccgcctggtaaataaatcactgtcatgcattctatttatatttctgtagttggattgaattcttatggttcaactgctgtttaggttgtagggatattgatgatgcgctacattgcacgccactcccaaatgggaattttgaagttggagttcgtatcctttactgatttattttttatttgcagaattcaaaattggaatgctaatttaatcttaagggcacttacactttgagatggttctcaacctgtccactttcttctagtttattgctttattttggcttcatttcatcagattgtcagtatgcactgttccatccacctagattgagtatcacataagtttggatctgtagttacagatggaagtagcaaatatgcaaagcatgcaattttgttaaatgtatgtatcatatatatctacacaggcactaatcagaagaagtgtaactctatgctggttgttcgtattaattctatctggtctgtgcttagagcaattaaactcctcgaggaatttaacacatcaaggacataaagtttaagttagttacttttcattattaaaggtcattcaa

SEQ ID NO: 82348 - DNA, 1441 bp, Oryza sativa
  unsure (1)..(1441): unsure at all n locations
taaaatgcgacatatacctggtttgaaaacacggatagaccaaaatctattgcctttattgacagatcatcatctttatccaaaaggaggaaattttctggcttaagatcacggtgcatcaccccgagcgaatggcacatagccacaatgctgacaattattcttataagctctgcagccttccgctcgctgtaatgccccttctcctgaatcctgtcaaagagctccccaccagcgcagagctccatcacaatgtgcaccgcttgcccatcctcatagacatccttgattgcaacaacattcttgtggcccgacaaatggtgcattatctgaatctcacggcgcacatcttctacatcctccttggtgatgagcttgcgctttgggatggtcttgcaagcatactcacaccctgtattgatctcggtacagaggtaagttgtgccaaactggccctgaccaagcttccgaccaatgatataatgctcccttaggtccgctgtcttccgcccaaggacattgatagatgtaggatccaacccccgcctgagaatactagcagcagtaggcttgaagttgttcacctcaggccaagtatcatcgaacttcttcaagtccaagtagctatccccctgaacgtacccaacggcatgctcccttgggaacagattgtggtaatcactcccaagagtcccgttctggcactgattccccattccaagaactncttatgcaaaccaattccaaagttcctagcctcaaaacaattgtatccttcccaggatgcagatttccacttatatagccgcaccgctacgcgcaaacccgtccaattggaagagttcctcgctaaggcagcccttgcttggcttcctgggcgtgaggaaatccccaacctgacatttttcacaacaaagacttgatcagcaacccatacttgttactacacggcaagggaaaacagcggaaagttttaaacttagccaaggtgaggaagtggaaacctctgggatggcaagaaattccttccaagggcggctcctttggtcgtccaccggaaggaggaaatctccggcctgaggggcttccaccaccagacttgaccaccaaaaccacacaaactttttgctctccactacacgaaatctactagaacccgccctaaaatacgagatttcccagcttcttctcgagccaggcgagcaacaaacaccgaaaccctcagaactggaagagttcctcccaaaggcagctcctccaaaaagcttcctccggcaggaaatccccaatctgagggtttctaatgctaagatccaagctccgcagccaggaacaagcaaatccagccacaaatcgatcccagacaaaaagccgaaacacgcgagaaacgcctangcggtcacccacaagccaaatctatgccaaaaaacacgaaatctgc

SEQ ID NO: 82349 - DNA, 12202 bp, Oryza sativa
  unsure (1)..(12202): unsure at all n locations
cgcgccttttatagcacggggacgcctctggttaggtgcgactcggacagtttttttgcggctgggcccccggattcctggagtattacacaccgacagaaaaccacccctggtttcttggttggtggtgtctcgcagcagaagcggtttggggattgagagacgatggatttattcagtcaaaaacgatttgcattggcttggcttctagctggagctgctgtttatatatactccctacgttccaaaatataaacatttttagacttcggctagtctccaaaatactactttgagtaataatatctataaaagtaaaatattttaaataaaaatagttgcatattataatagtttgtttaatgataaatctaataacattaattttatatgattaatcttttttatatttttgctattaatagttaaagttaaaaatatttgatttgtcactatgctaaaaatacttatattttgggacggatgggtacatatactccgagtccgatccaaattcagttcagactaattcactgacagctacagatactagttttgtaatactactagtaaatgatttcggtttgtttatcctgtacaaatcgaagttagactgtctttcctcggcaggggattagttgggttaattttaggtgttgtctgattggtcagagttcagctggttgtgtaatgtgtatgaaattctgtggaacgttttgaaatataaatttcgtaaacatggggagagccaagagctgcaagcatattctcttctgcaaattcgaatatggtacttccagaaaaaaggataaagttcagaaaatttggtaaaagaatcattagctttgaagataatgttccccatttatactaaaaaaatattaatatgtactggaattacagatgtcgtcgaccagaatatcgagtaaggttgcgacgcaattatcatatctcttcaggattagattctaattagcactaaccctaaggtgtaacatggaaacatatcctctcagcttcccagcaatgcaaatacagtagcaaggccttacctaataagaccaagaaacaaaagggaaatggagccccattggaagccagcccagacacagacagggacgccctaccattgcagggggcacacatgtcatgctgaatttctcatgaggctaggtttctgaagaaaccgctgttgcgtcttcagaaatcaacctgcctgctgcggggtcggtgccgttctgtgcttagaaacttggagtgccttcgcctaaaacgcaataagaaaaggcagaaagcctttgacctgaagccttctcagccacatgaaaattagcaacagtttaatctgctttcttgcgatgggtttattatttggccggtgtcgtgtgcttcaaacagggttaagtggtgagtcagagccacatggtttgattgcataggacacatccccatggaaaattaggtggggctggttatctgtagaagacactgaatttcaggttagagcaaagatcagatactactagaagtctgaaggtttttcaggttcagataagaatggattttgtttctgatgaaattcagagggtctaagcggcaggccatgacccatatgagtcgcaaagagctactcctttagaagcaggagaatgtaacgtgagcttataataagattgattactccttgccacttttgaaggttctcagtggaagcttttgctcttgtggctagtgctgtatgattgcatgggcgacaatcgtatctacaatgacgcaaatgtttatcttctgctacggaatggagattaactcccagcataaatgagtagtgaattattgcaccgaaataattagagacgcttttctttggttgattacaaccatcgcaatttcaactatgccactctgacaacaacacagctcgattatgacactgtcactaccatatatccaggtggaggaaacgagcagagtaggaggaagtgttcagataatagatcatgcaggacttggtaatgatacaattagtatatgatcaatcatcgcaaggaggagttaatactgtcacattcgatcattacattattggcctcttgccgatgaccttttaaatctgaattttgaannnnnnnnnnnnnnnnnnnnnnnnnnnnnnngcatcgacccaatccaattccagacctatcgcagcatgtgtgcatcggttgatgaaagccaaaagcaaccatactaatcaagcactgacagtgcaatgcctgctcaataattttaggataatactacatactgttaccactttactaccaattgctcgagaagttgaaatgcttttactgcgtggcacgatcgagaaaacgagaggttcggtcagctcgtcgccgtttgcaaggttctgctcgatcgatctgtcggttctgacgaacagtgtcgatctccccagccatgcttactgactaaataatgcagcgagttaattactcgtctcggtcagtaactcaaattatgcagtgaattatatgtagccgtcgtggtcagagcgatcagatcagcagttgctgtgttgctagccttgccaagctagcaatcaccatctgttgaaaaggaaggagcaattgacaagtcgctcttgaagccacagtgaccgcgagctcaaaagccttgagaagccagcgtttcaaactctctccgattacgtaatttctgaaataaccacgagtatattgggtgcagaattcagatgataggtgaaagtggatatcaggagcaaacaattggtccaacaaaaaagtgcaatgcgtgatcgatgttgaaagcttggaactttgaaagacgtatacgtaggtgatgacttgttggcggcaaatacaaatagtaccttggaaatttaggatctagacggttaattatgcatgcgttgaaattggaaaggtatgcctggaacttaaagttagttttatccacagagatgcttccctcactatgtctcatatgatattacttattccattgatctagaatcttttatccgtggaagaaatatcaaccgttattcgcttgaaagctgaaacacctggaatctcctcctttgttttttgttacgaaaggaaccaagctagaagccttttcacttttcagtatatagataactacgcccggatagttattcgcgatgaataaaataaataaatgataggcaactaaactccatttccatccttataccattatgatgagttcgtttcttcatggtctcaacctccactccatcattttccacacacacatataaaactactatacgatgtgttcttttttaaaaaaaattgctttaaaaattatattattattttagctaatacttcatgtgttttatattataagtcgctttgactttttctaagtcaagcttcttaaaagtttaaacaagtttatatgaaaaatatagcaacacttataacaccaaattaatttacatataacattgaggtttctttattttgtgttggaaatattgctaaacttttttataaacttggtcaaacctaaagacgcttgacttagaaaaaataaaacgacttatataagaaacggacgtagtaattaattaataatgtactaatttatctctgcgtgaaaaattatttcccaacccacactaaaaacatagccttaatggagatctcctctgatgatgagtaggggcaagaaaaaacacggccttgacgaagatctcttctctgatgataaacatggggagacaagctagcctaaagtagctagggctcgagcccctaaattcctattatatcatctcaaaatttagtagaaattttgaatatatatgacacatgagcaactttagctctattttaaagatttttttctagtccaaagtgaaaagatcacgtacaggatggtacaaagtgaaactttggcaataaaacatggcccaaagtacaattcactaaaaaaatgatattgatggaaggggtatacactccctccatccagatcccttttttttctttacctttttatcaagattgaagttagacaattacaattgtgactgtcaatataactattaaaatatttatgttgaaatcaccaaaacacgacatatggattaattaatatttaaaagtattttagtaaaagtaaatatttacttgtttttatatatctctattactttaaaaagagagtcgacctccttcacctccgcataaaaatctatttccttccatgaaaaccgcccaccttgaaaaactgatttctaataaaatcatgagataattcaagaaatgccattgacaagcgtacaagtcccagaaatgtcattgacaagtctgagttccaagaaataccatcgttcaaacgattttgtcctaaaaataccatcgttgttagggttccgtccattttgcaccgttaaatacactattcatcctatagaacttaacggcgggaatggacggaaccttaacggcgatggcatatttggaacaaagtcgtttgtacgatggcttttcttagaatttacatttgtcggtggcatttttaggatttagacgtttgtcaatggtatttcttggattatctttaaaatcattataaaaaatcgaacaacccagtgaaccaaattcctcctgctaaactcaacaaaagaaccgttgcaacacacgaacctataactaactataatagaaaaaatacggttaaaaatatattttacagatcgtgctattattcaaaatgttaatcgggactatgtaaccgatggaagtacgcagtagaagtagtagcttgaatggtgttagcattaacaggtcatgggacaccatcacgccacagtacatggagtagcagccaacggcccatcactagtctgaaaactcgccgacaaagcgaggtcgcgaggaagcaaacaaatagtaagaggaagcggatagccctatccggttggctggcccggtttcctgtgggacgtaactaggattttgctcttgggtgtgtgggcgacgccgttccacggccaccgccgcctcacgggtcgctttccgatcccgcgcggagggggcagcacagcagccgctgtcgggtccgggcacatccggcaccgcgcggtggacggccgaaatcgggtgaagcgtccgtgttccaagatcacccttttgtactgcatcgcgatcccctccccggccatggaaaatatcgtccctccctgatccccgtctgcttctgcgtgcgatctcgcggttgtataaacaccgttggtattcgtcagcctgatgagtgtacgtacgttgttcaattcgtgtgtgccgttgatctctacgggagattcgatttgacctcgacggcaaggaagggaagaacgggaggagaaaaggagattttgacggttgacgtagccgacgttttacacgaaaattgctgagacaaaccgagggcggattcagccacagaggacattacccacgaacagtgtggcgatgtaatgttactcgagtcgtcagtcgtcaccgctcacttcaccagctgaacaagaacacgcacgggcgcacggctatggttggggcccgcgagtttttaatgagaattttcgcggcggcattatccatccacgttggcgccagcacacacagagcatataccatatgccttattatattctccccctaagcctaaaagtacacatattttgtacaattaattgcctcctgtacacaatttgacagaaggtgccatgcgtgacgccacgaatttatttatttatttatttcgttacgacataaaactagcttgttggtctgaaaaagaaactgaacaaatcatgtttagctgtttgtctcttcgctcacggctagtttggggatcctgaatctcacggtagtctatagaaaatgtattggcatgttatttggtatctttgtctgacaaggaaggctttgagtttgattcccaccggtcacgggtaatctttgtgtatatacaactatgatattaaagtctcgttctttacttcaataaaagttagatcaagattaaaattttcgtgacacgctttttaaactgctaaatgatatgtttcgtaaaaaactatctatatgaaagttgctctaaaatattatattaatctattttttaagtttgtattaattaaaactcaatcaaccatacgttaataccatctcgttttgcataaaaaacttaatcttcatcattatcttcagaagaaaagaacaccacataagataaactgcccaactatgaatattctaagggctactatgaaatgaagaattcctacaagaattttagagaaattcaatcgtgtgaaaaaaaaaatccatatgatcatttggatcaaaagaatagctaaactcatatgaaatttatatggattggcttaaaatataggaatttcggagaaattctaatatgagcttcaaacttttggagaagaaaaaaatccttcgtgtctatctctctcctgattctttttttccccgctacaaccaaatggtcattaacgtggctttcctacatttttttcaatatcttctacatccgtttcaggttataagatgactaccttaagtttgaccaagtttacagaaaaaggtattgatattttcaacataagttaaatttattatgaaaatatattctattattgatttgatgaaactaatttagtattataaatattagtctataaacttaggctttgtttagttctcaacttttttcttcaaactttcaacttttccgtcacatcaaactttactacatatataaactttcaacctttccgtcacatcgttccaatttcttcaaacttccaattttagcgtgaaactaaacacacccttaatcgaacttggaacagtttactaatattaaagttaaaatactttataacctgaaacagagggagtatgatttaaggttttatagcaactcaatctttgcttttctatttatgtgttatgagaatcatacgttctaaaaaagaccgtgaaaatacaaacatactctagtttgtgcgcgcgcgtgtgtttccgaggtccacgtgtagaatttgtgtctcatctctaatatataggattactgatatacctaactgcaaatttgtttaggtgaaagggtgacgtttactaatattaattaaaacaaagctactacaatccaaaatgacaggttcatgggtacaattgggacatgagattttttgcgtgctagaaagattttgttgttggaagaaaataaacatgtgggatattatatgatctcttcgcattacaaggtgagatattaggtgttgatttagtggttgataaaaaatgtagtcatggataaggttattaaaattataatggatgatccttttatgtattcaaaggtacacaaattgtcaaaaaattggcacataaacaattgccactagttattgttaacttgtcatggtcttcctagtgcctttaccaacacctacttaaaaaatataagagcagaaatcttcaacttcgcttatggtagaaaacaaaaatccagcatgtattgggcagctgggagagtgcacgtgcgtcatatatagatacagcacatgatattggacgatggtgatggctcgagtatctctttcatctgatcaaaggaagtacgtggttgttcgtggcacacatgaacgtttacatactttgatggatgtgattttgaccgttgtttcttaagcaatacaaaagtgaataatatctactactccaacattcataactgtgaatatattttatgtaattaactataactattgttgataaaccgataggtatttgtgagcggagaccgagtattacggtaaattaatgtctattctttgagagctgagagtactggctctgtacatgaaaaagttacttaacctaactccacgtgtacaagaaaatgacgtctccatcgaaaaggaaatggaaactgatagtgctcattggtcatggagcacgccgcgcgaagcgcgatgcatcatcacacgaagaagagacgacgcaccacgaggaaaacgcggccggccgagagcgacttcgcggccccatcgcgcgaccgcgaccacggcgtcatatatagcgggccgtccccgccgtttgtacccggaataagttcactttaggtccctaacttgacagcgagttcaattttcatcctttaacgggtccctcaactatcaaaaccagcagatcccatgacagttttgacggtggtttcagatgacgtggcacctacgtggctaatttgactcggtatttcgtctgacgtggcattgacgtgatgaatgaagcaaaaattaataattttaaaaaaataatatgtggatccgcatgtcagttaaataataaaattaaaaaataatgggacccacatgtcaattggttcaaggatgaaaatcgaactcgctggcaagttaagagacctaaagtgaatttattactctgtatccgggctaggccctgtttggaaggcctcagttccggcccattccccgcgaatgggccggagaaggcattatgggcctgaaagcccgctagatctcgaggcgtcagcaacaacagtcagcagttcagcacgctgccgccgcgagggttggcgacgccgcgggcggcgcgcgaagcaaatggagcgcgattttggcggataaatttgggcgcgcggaggcgggaggagcgggaaccaaatcgcggagccgcttccaacctcaggtctcaccccaaactcgccgccgccgccgccgccgccatggagaggaagcaggcggagtacagcaacctcgtaagcttctccttcttttgattctcgaatcacctcgatttgggttctgggctgagcaatggcgattgggggatggcaggacgagaggtacgcgatccagggggagaagtaccaggggcagcagtacagccacatctacttcacgcgactccaccacatgcgcaacctcctccacgccctcgtcccctcctggaagccgcaccttcctggtccgacccctcgctttttcctaaatcgttagggtttctctgctttgtttttggagcttgaactgtttttgggagttgattgcgatgtagcatgatgggtttagttagggtttatgtgctggcatgtggattctctggttcgctctacaaaattctgggggcgaaatttcaggcccattgagctcatattagggttttagaagcaatttggcacatcggctacgatctttgctccatccatagtgtgaatgtatgaccatcaactgagtttttttagggggtgttatgagcttgtcctgtgctagtttgtctatgcttgctgaaaatagtattcacaaaatactgatttggcatcttctatttaccaatagatttttattggttggtgaatgtaactgaactaaaaaaaacatttttcttactaaatgctttgtccagcagttaattcgcaatgaagctagtaatcaatcgtaagatcttttgctggcattatttagtcagtatgaatgtttgatcttatgaaatgtgcctccttattaccaagattgaacattggatccatttgccgcgtgtctatcttagttcatggaaatggatcgtgtaagagacacttgcttttatgcatccacagagcgtttaaacttcaaatcacgcctcttgctgttctgcagttactactgtgttgggacttgaagaaggaaaggattgcataatcgttggaactttatataagcacatgaaattaaagccttccattcttgatgaatattctaaggaggtaatttagcatgtcttgtcttcttatccttattaacttggatggcctctgaatgaactattgtgctacagaggtctgctattcctcttgttaaaccacacaatttcatgcatcctgatgatcatctcattctggaagatgaaagtgggagagttacacttgcaggagccatacctccagcagcatatgttactggtatgtctgatatttttcactgaaaagttaagtttgcaaattctagactagtttctttatgattgtagcatttgtcgaacaattttatccaatatatcatgttgcttggaatactcacccaccaattgtccacaggagttgtaatagctttacatgggaaagaaacaagtgctggcaactttcttgttgaagatattcttgaggctgggattcctcctcaaattacgttacctagcataagtaaattttttcctatcctggcttgctcattctccattttccccatttgcctacacaagttttgatggttagatctcttacattggcatttacctctgttacagacgaggacaaatatgtggtatttgtgtcgggattaagtattgggagtgaaaaattcaatcctctgcaattccaacttcttatagaccatatcacagggcatttgggtgatgagaatgtatgcgcctttttattttatttttcccaaaatgaaggttttcaagtgaagatatgcactaaatttagatgatctctttgcaatttaattaggagcaatccatagcatccaacatagtacgtgttgtggtggctgggaattcggtacatatttctccaagattcttcaatggtcaggtaatgtcactgcatattacatgtttttggtgaaactccatagctttagtttattgcactagtggtgaacactgatatttcaggcagtagcatcgaaagatcaatccaggatagctgaaccaatcaaagaattggatataatgctcactcaggtttcaaccgtttactcccccctcaaatattatcaacgcaattaattattcaggtttatgatgtcagtatgaatgtaatccatttcttctgcagcttgtggcatcattgcctgtggacatgatgcctggatctaatgacccagcaaatttttctttgcctcaacaggtgggctattgacatggaaaaataatgactaatttgcactagtaacattcaagcatgtttttatgcatgcatgactaacttatgtcttgctttttttttggcagcctttgcatagatgcctttttgctggagcagccacttataacactttttcatcgtgctcgaatccacatcaattcgagcttgatagtgtccggtgggtgttggtgtttttttaactttcctcaattaaagcagctgtggagtttgaagtatggaagttctgcatgtaggtttattggaacatctggacagaacatagatgacctctacaagtactctgatgccaaagacaagctggaattcgtggaaagaacactgcggtggcgtcatcttgctccaactgctccaaacagtctaggtaactcttcaggcatttcagccccattgtgctatgctgtgattgcttggtaaaaaacctgtattatatcatccaactgtttgtaattcaatttcattattgatttagtgaccatttttatagcaaagctagaacccttctcatgtaaatatctgtttcacccaggatgttatccatacacagacaaggatccttttctcgttgaaagctgtccccatgtttacttcgtcgggaatcaagataaatatgaaactcaattattgcaaggtactgcttcatgtaaggttcctatgttgttttagcgcccaactaaacatatttgtcatcatgcagggctagaaaaacaaaaagtgaggctgatctgcattccaagattttgtgatagtggagttgctgtcatggtaaatacctctagttgtatgctgactattggtaaagctgcgctgttttatctttgcaatctagaaagttataaggaggccaagtcatcaagtggggattagctccttttacacatcgtaaaaagttcacgaatgatgaaccagtaaaacaatttcatacacttctttgtggaagatttaaaaaaccatgacaaaccagaagtctctttgaagatggacacttttcctttggtcttctgtcttagtatagtacatagccttgatttatgtatgcgtatgcaaacatttttctttgccctttttttgtattctaacacttaacattgttttttatatgcattattgcatacacagataaattgctgacaaacacaagtatatattttaatgcagctcaatttgaggaacttggagtgcagcacgttgagtttctcaa

SEQ ID NO: 82350 - DNA, 1260 bp, Oryza sativa
agataattaggtaagcaatggatcaacaaaactaaagcacaaacaacaactgcagttcctatgctacacacagtagtgacagagcatataaaaggtttcagcctatgagcttatggaaggatatgttactgggagactgggagtaactgggttgttctactgaattaaagtagctcttcatatgcagagtccacgcattgcattcaaaactttaaggcgtcatttcagtcattgagtataaacaggtagttccttatttcatattgaaactcgaagatgctcaccaacggagtaaaggcggagagaagaagacaacagttaactttatgctaaattcaaacagatgtttggttcatagaactagcatccacgatccttgcacaatgtccttcgtgctgtcataaccagccctgtgcatccgaaaggaatccaattgtcaatatgactgataaactgataaatgtgtgctatataaaaaagaaaaatcggatggagtttctagacagagtgccatcagggaaggaacaaaacagaaccaaattgtgccagaggaaacagaataaaacagcatcgcatttactgactcaggttgaggtgaaaacaaaggatgcacagagtaaacaccacatgagccacatgccattctgatagggaaaaaaccgctgtccccaaacttaaccatctgacacatccaatgtctatgccatcaaaggttatagtgatgcattcaaatgggagaggaacctcccaagagcacttatcatcaaaggcatgaagactaaatagttgcagcatctaagatgccggtctatactatgatgactgaactgtagagagtatggatctaccaatatgccagaaactaacagcctaaaggtacagaatgatttcatcacctaatggacagttgaaaagattgcaaatgccaacacgatttatgtcagtgtgtcatgattcataactctgaagataaagtagtactccatacacaataagtgcaaggaatcattttgcagttactattagcagaagaaacgaagcagccaaagtatattatctgtacttatgtacttctgtcattattatgtcctttgtttcttgttgtcacagaggaactatcaaagagaacttgcactgcaatactcctactactagatacttcaaacaaatgatttgcagtggacagttccttaaatatcacatccaatatgttttcaacaaaacatggatgagaaaaggacttaatgtttaagaggtgca

SEQ ID NO: 82351 - DNA, 697 bp, Oryza sativa
ttcctgcagccctttgtttttggttttatgtgccgtggtattaaaaattgaataattactttcaatacaaacaaagataaaataggtgagccatggaatgcattcagcaaaagatcctacctcactcatcgcatctgctacacagcactttattagatcttcgtataaatcagctgaacgttgtatctccggggcatcagcccaatactccagtattaaaagagcgtactcgcagcacctaatacggtagatcgtaagcctcaaggcttcagcacattatatacatggaagcaggaagataaccacacacaaacatatacctagcacggagaactgcacttcggtcattctttgctgtgtcagctatgcgaggaagaattcgtgaaatcttgcagttccgtagaatctgcaatatacctcatgtcagcaacaagagactgaatgatagcaacaaaatatatattaaaaaataactcacggtttttatgcatgtatcggctgattcagctatgacaagcactgttatgacaacaagcttaaaaagcatctgaaaaattcacaaatatgttagttttattgaaacaatataaggaagaaaagaaaatttgtttgtatataccggaataaatagttcagcacatggctcaaaatcaccaaagagttctttggatagtacattgagtagatggcatgcctg

SEQ ID NO: 82352 - DNA, 1650 bp, Oryza sativa
tcctgcagccctttatgatggtttttccactgcaggttgtggtgcctctattggtcagtgatgatgaaaagacactggttgtgtgtatcaactccttgacaaaggtgtctcgtacctgcagtttttccctgtttactgtttgagcgtttcccatttaagtttgaatggcacataataacaatataacatataaacttcatggtgccatggttctttagtgaataagttcatatcatatgttctttatatatctgatcttttgtaaatagcatcaattgataatataattactctctgctgagttgtcctatcagttattttgctccaccaaacctaacgtattacacatcctttggttagatttcctgatctcttgtgcaagtgcttttttctcagttccatgtatatattatgatttttttgggggggtactctggtaagtggtcagattgcaacatatctgaattgctttagcgttcaatgttacaatttagtgggttgtagtcttgtagatgcccctttcttgaattcttcaacctgttgtttgagtatatacgccattctactactttgtgcggaagaatgcagcccaataaactaatcgtgtgttcgtaaatgtatgccctgcataggacacatgaatcatatgtatttgaataaaacaattggattggcacacctctagcatctaggcattgtgtctccgactgattaaaaaccggtaaaccaaatataattttagcaagtgttgttgactgctggttctgtttggataatcttgcagcttgttggacggctttccgaggaggaattgatgaatcagttgcccacatttttgccagcactgtttgatgcttttagtaaccaaagccctgatgttcgaaaggtaggtactaatacagtaatactgtagctcttgtcatggtagatttcttctgtttctcatagtgcttttttatttcactgaaattttggtgctatgaggattttataaggtaggatttgtggaatggttgtccatggcttaagttctggttggactaaattctaataacattcaggcagtgagtggaatatgagctggagaggataggctggtggaatggaattgtaacagtttacatagagaagcatgctatacattagggatgccgcttacaaatgcctatttcctatagttcctgaattaaagccaccctgcccatctctgatactaggtccattagcttctgatgcagtctaggtatcacttgctcttgcccactgaaatattttcacgataatctttttacctgccctggttatttggaacattcagtgttttacgagcttaggacatggaggatgaagattagtttgaagctggtactggatgagattgtcttttttccatagtttgtcatccccatgcagtactactcatttcgatgtgccggtgttgaagttagttaagtcggcagcttcctttgttacgttgctttcttttcttttctctttttgtgtgtgtctggtacaatatccacatacatctctgtgtaaccctgatttctggcatgccctagaatggttaagcctctaaatgtctcaacctgctatagttcttgcattttcaccatgaatcaattcgtgatgcatcatcccggttcatat

SEQ ID NO: 82353 - DNA, 4499 bp, Oryza sativa
ttttgtaccacttagtgcttacactgtacaaagaaaaaggatagtgtaggttcatggagagacctagtgtctgccccattttcatttgctgtatgatttccgttggaattgctaggtgtgaattctcagttgtcagcctcgttcttggttttgccttgcttatggaggtcccaatctagcccaaaacttggtttttgttctggggtttctggtatgtttcggaccagcaacgcgaacatcatgttagctctgaactcatacaaagttcacaccttcaccagcgcagtggattttgttgaaatttttacggcgtcaaattgtctctaattagttgggttcccttgccagtaattcaccactccagtctccaggagcagcaaagctccagtgtcctagccagtgatgaggtttaatggttaggataatgccggttcttcgcaaggagcgggagcaggttgtccgtctgctgctgagtctgtcgtacagtgggtttgtttagagcagtttaaagattctaagaactgattgatagtcaacttcgattatggactatggactatcaagtctggccgccagtatggggcaggcgacaaaggactatggactatgaagtcgattgctaaggttaagctcccatcggatggcctaatcaaacaaagaaaaagctaaattttaaattttcaaacttaattttgagatattttcaacgtagttcctttttagcattggatttaagtcaccaagaatatatatatatatatataatttacctacaaatttatttttattccctagggaaaaaagccaaacgatgaggccttaacattcctatgatgttcttacatttttttttcatatattcctgtagttttccatttctgcatttcaaaatagccctcgatatttttgtcgaggttacaatcatgccgtcctagtctcctagatcaggcgatccagcataatattcctacttgatcagttgattgggtgcgccacattaattgatttgattagccagattagtcagtaaaattccatcacgcgaaaatcatctttactctttagaaccgcactggctgcaggaacccaaagcttttgaaaaaaaaagggatttgggttggtgggtgtctgactgactgaccgagcaacaccgtgtgcagagaggatcagttagaattaaacgtactagtattaatttaattgaatctccggtctcggaatctggacggcatgcaagtataccagcctaacataccaggtccggctgaggaaattctaggtttctaaagtcgccacaacggcgtctcaccgtcaccgcccggtgccctcctcgagacttcgaccgattgaggaatttctaaccggcgcattatctattcggagtagaaagtttggaccgagaaagaacgtacgccgcttcaacgacgcatgcagtgaccaaactatcttcaccgcccgatccgactctcccccgcttttatatacgcgtgctggctagatgcatgcgtggtacgaggaaaacgtactacgtgagccatttcggtgtccgagcgcgtgagctcgatcgtcaagctatagctccggcgaacgtacggcgatcgatcgatggcggcgtcatcgtccctggctttcacggcgcgccgaggcgacccggagctcgtcgcgccggccgggccgacgccgcgcgggctccggcggctctccgacatcgacgaccagcgcagcttccggttctaccgctccatcatctacttctaccggtccggcggcggcgacccggccagggtcatccgcggcgcgcttgcggcggcgctcgtgcactactacccgatcgccgggaggatccgggagcttcccggcgggaagctcgtggtggactgcaccggcgagggggtctcgttcgtcgaggccgacgccgacgtctcgctggaggagttcggtgactcgctgtgcccgccgatcccttgcgccggcgagctcctgaccctgccggagagcaactccgccgtcgtcaccgaccgaccactactctatgtgcaggtacacacgtcgtcataaaacttgaataaaattttgcaacttttgctccatttgtacgtgacgtatacgtgctcatgatgccatgcatgcaggtgacgaggctgaggtgtggcggattcgtgttcggcacccagatctgccacaacctcgtcgacgcggcggggatcacgcagttctggcaggccgtcggcgagctcgcgcagggcgcggcggcgcccagcgtccggccggtgtgggcgagggagctcctcgacgcgcgccacccgccgcgcccggcgtacgaccaccccgagtacgagccggcgtccgacgaggccagcgacaagctccgtccgggcgacgagctcgtgcaccgcaggttcctcttcggccccgacgacgtcgccgcgctgcgcggccagctccccgcgcgcctcgggccccggtgctcgcgcttccttctcctctccgcgttcacctggcgctgccgcaccgccgcgctcgggtacgcgcccggcgacgaggtgcggttcatgttcgtcgtgaacggccgcggccgcggccacggcgggaggccgctgcccgaggggttctacgggaacgcgctcacgttcggcgtggcgcgtacgacggccggcgagctctgctcgggcccgctgtcccgcgccgtggagctgatcgctgccgcgagggcgcggaccatggccgacggctacgcgcagtctgcggccgacgcggtggtgctccgcgggcggcggcggttcacgacggcgcggacgtacctggtgaccgacctgacgaagtcgccgctgcacgaggtggacctcgggtgggggcggccgctgttcggcgggccggccacgacgacgctggccacgttccacatgcccgcccgcggcggcgggatcgccgtgccgatgtgcctgccgccgcgcgccatggagaggttcgcgggcgccgtgcgtgcggggctcgcggcgggcgttccccgtgcggcggaggaggccgccgctctgtcgaagatgtagacttgggcttggatttcattcaagtggcctcttattgggcttctacagcgccaattgttggcccaaaaaaatccaataaatcaattttagaaactgggttctgtatttcggaagctataataatttgatccgaattcaaataatattggatcaaatttaaacagatcttgctaattgttgaacgaaatttttcagcgggggaatcccgaagagttaggccggatgcactgaacccagaaaccagaaaatgtcaaggcccaaagtttttccaagagctgttactttattatcagtttattatcactccctgacgaactgcagttgctgtcctctctcgatctctccaattcctacggataatcaactgtccaaagattcaagtccgtaaccatgtttttcctgcaacttggttcttgcgaatgcacaaggataattagtctgctcccagaactcacatagcaccagatttgagattgtatatcattatgtaattgaacaacagttgtacaatggttctgtttccagaactcaaatcagcacatcacttggcgtggccacgagcctcctctgacgttagagggacatgtctctctaatgtgtaggcttatgaggatggccccacctgctagagacttggatactgggctctcacactctatgaagttgcttgggtaaaccgaagtaccgaaaatatggatggattttaggttttcagcaagcagaggcacaggcgcacagcctagcaaacctggttgtagggctgggcaaaaagctcgaagctcgtggctcggatcggctcgtttcaggctcggctcggatcgactcgagcttggagtcttaatgagccgagccgagccagctgttttgctcgttaagcaaacgagccgagcccgagccagctcgcgagttttcggtaggctcgttaaactcgcatagctcaaaaattagacatgcagcccaacccaataaggaagcccaagttcccagcccaacagctcaagtacccagtaaaaaggaaaaaccctagctttgaccttcctcagtcagccgagggcccgaggcgcctctcttgcgcatgctgtcgcaggctgccgccgtggccttctcttgcgccgccgcagcactgcctcgcgcccttgcccttctccttgcaccaccggcccgccacaggccgcaacgttgccgctgccctgcccaccgactcctcctcccgcagccgcagcgccatgccgacgacgccgatgacgccgctcctcccaccgcagccgccaggccacgccgaccacgccccttctcccgtagccgccgcagggccttcatggatagggagcgccgattggcaagcatggagtccaagaaccgcagcaaggggaagaaatcatcagaagcttgtctaggcggcagccacctcgcctctgttcagaagccaccaagacaaagacctaaatcaaa

SEQ ID NO: 82354 - DNA, 8646 bp, Oryza sativa
  unsure (1)..(8646): unsure at all n locations
agtctccttctcgtatgcatagatttagagaggtatgtaaacaaattgcattgcctattggaaaaggtttgtgttttgatgtgccaacaaggtggagttcaacctataagatgctttgtgcttgtgagttttacaaggatgcttttgttcaatatgcctatgtggatgctaaataccaatggcaacctttgcttgctgattggttagtcttttccaaaattcatccaatattgaaggcacttgctgaagtaactactgtattttctggatctacataccccacagcaaatgttttttatccaagcattgtgaatgtgaagagggcattgcttgctgcatctaagtctactaatagggacaaggttttgaagaatatggttgaagctattttggaaaagtttgataaatattggaaagagaagaacaaccttatgatcattgccactacccttgatcctaggtttaagataaggtatgtgagttggtgttttgttcaaatgtatggtgaggaagctggtcaagttgaggaaagaagttgatgaactctttgccacggctgaaacgacgcatcgccttgagaaggctgcaagaaacaggggaagggatgaaacatccacctcaaccattgacacaagtaactcattagcttcagttaaatcttcaagtgagttctagatatttttgcaatctagctctgcaaatgtatctaagtcagaatggctaatctatctagatgaaccaaatcatcctttaacggacaaggatttcactttgtttgattggtagaggttgaatactcacaggttccctgttgtgtcaaggttggcaaagagattcttgactgttccagcgtctagtgtatcatctgaaacaacttttagtgctggtggaagagtgcttgatgattaccgaagttccttgcgcccatcaatggttcaagcactaatatgtgcttctagttggatacgtggttctcaagataacaagacacctccaatggctgtggtatgatctctcatatcaaccacttgcatttttctttaccagtttataattgcattatatcttaagttgaacttgcaattttctttttaggcggaagatgataaggatgatgttgctagcaactagatgatttccagagagtgttgttgctagcaactaggatagtagaggtaagacattttgtaagatttctgtcttctgatgatttgttcaaatgtatggtgtggtgaggtccaagggtgtttatgtttgtaaaaatatgtatacaagtatgtagacttgaagacaagaatactcatgtaagattatctaattttgtagggactgctagatgcttggatggctgtcaagacattttttgaggctgataagatcttttaggtggctttgaagacaaaatagttgcaacttcaaagggcttttgcttttcttaacagcgatgctattatggatcaatggatattatttatcgattatgcttatgcatgattggatctaggatatgtggatcaatgaatataacagactaatactagaacttgctattatgctatttgctaagtacttgctgctactatgctatttgctgagtatgttatctgtgagagtgtgactgtgaatctgtgatgctattttaattaatattcatagagttctctgaattctaacaatctgtgaatctatgagactgtgatcttattctgtagttttgttttcttattacgtgactgtgatgcactcatgcacacgcacagatggactgatggtggaagcctggttcattgagttaacgagctaatcaagctcaacgagccagctcgccgagtcagcgtttgagctcgttagtcttaacgatccaaaccgagctagctcgttaaggtaacgaggcaaagcgagctgagccgagccgagtggctcgatatccacccctacctggttgtactactagcaagcagagtggatgcgggcggcatgcggctgctacagagccaagccagcgcctccccctgcctccctcgctgttgcatttgccgccacaaatcaagtggcagttagaaaagctaaaatggatgaaaaaaacagagaaaaagaaatcctaccctccatagcgagcagtggtggtctgcactctgcaggcaggcaggcacccaggcctgcagctcgatggcgccgccgccgccgtcgccgccgcgatctctcacctccgtctccctccggactcctctgagccctctcctcttcctacggccagcttcttgcaatccatcggcggtctccggctcctgcagcagcggagcatgccgcggcgtgcgctgctcggcggcgaacaagccttctccttccaccgctccgggcaccgaggtaaggtagccggctagccgccccccatattcttgtttctgtgttgatcggagctcgatggctggggtgctctgggctcgtcgtcgtcggtcgatcgtcatggcttgcttcgtttcttgcagctcgacctccatggcaaagataaggagtgaggtgctgtccccgttccgctccgtgcggatgttcttctacctcgcgttcatggccagcgccgggctcggggccctcatcgcgctcacgcagctcatcccggcgctgtccagcccggcgagggcggccgccgcgggggagacgctcaagggcctgggcatcgacgtcgcggcggtctccgtcttcgcgttcctctactggcgcgagagcaaggccaaggacgcgcaggtggcgaagctcacgcgggaggagaacctgtccaggctcaggatccgcgccggcgagggccgcccgcccgtcccgctcggcgagctgaggggcaccgcgcggctcgtcatcgtcgccggccccgcggcgttcgtcaccgagtcgttccgccggagcaagccgttcttgaaggacctcatggagcgcggcgtgcttgtcgtgcccttctcgacggacggcaacgcgccggacctgcagttcgacgaggccgacgaggaggaggaggaggcggcggcggcggctgggaagatgaagcggaggctctggcagctcactccggtttacacttctgaatgggccaagtacgcgcaaagccgggatcccatgaatttagctgcttaaatttcttcttcatgtcaatcgaaattcaaatgcaaattagtatctcattttcaaatcgattgctgcttcttgcagatggctagatgagcagaagaagctagccaacgtgtcacctgattcccccgtgtgagtatcaaaaactactctgaatttgtctgaaaatataactgaagtttctgcagctgctgaactgaaaccgcatcactcttgcaggtatctctcgctccggctggacggccgcgtccgtggcagcggcgtcgggtacccgccgtggcaagcgttcgtggcgcagctgccgccggtgaaggggatgtggtccggcctccttgatgggatggacgggagggtgctttgaatatttgactgatacagaccgtgaaaacattagttgattggagaaaaaaaaggacggccgggttcgatctatagcttatactagaacaagaacaggaagagtttgatgattgctttaacttctgtggggttgattttgcttcctgcatcccagcgacatcgcccaagtgaatgtgatatgccatgtgcccatgtacatgttgttttgcagcctacgtgacttgattattaacgagaatcctgtgtcaaagatcgctttttccgtggtaggcttctccattttattttatttttgaatatatatacgaaccgtgacaaatctgatggaacactggaccatgggggtaatgatactgtagtcgcctggtctttttatcaggcgctaaatgcaaacaatcagacagcttaaacaacctgaggttgttcagccagcccagaatacaaaaagcccatggaccgtgagcccgtgaaaccatggcccacccatcagtcacgtcacgtcgggacgtgtgcgcactaccccgagaagcgcgcggccgtaagccacaaccacaaccccacaccgcctcttggctgctcgcgccctgacacttcccaaaaccccaaaccgcccatatctctctcctcttctccgctcctcgcttcccccaaaaccctcgcggtggcggtgggccgccggtctcattccgccggcgtccacggaggcggccggagccaggcgctccgcgggccggggagccaccggaaggctggaaccctagcggcggcgggtctcctccccctccccgcgcgccgggcggcgccatggccattcagcggctgctcgcgagctcgctcgtggccgccacgccgcggtggcttcccgtcgccgccgactcgtttctccggcgccgccaccgccctcgctgctccccgctccgnnnntgtgagcttccttcgcaccccccgggcatttgctgccttttgctgctgctgctgtataggcggtttgttggttttggtaatggcattgtatagtaggcgttgtcacgttcgtggcccagaatacacatccgaatggtagggattttggagtccggcgcggcggtggggtatatttttggaatctcgaaactttgtgggtactacatactaatagattgatcatgcatttagataaatctatttctaatccgtgagaactgagcttgattactgtatctatgatcgttaacagcctgaactctgaatgaaatgaatataggactcatttggtttgtttgagaaatttgataatatgccatctaatccgtgtgcctttgataatataccatccaatccgcatgtcttgctaccggggctgcatttttttttgattccgtgccactttcgctggaggagggcatgaggcaatggtccttggtggcggcagtggtggcgcgggcagcagcgaggcgatgcagtggcagcgcgggtagcagcagcagccgaggatgccgttgtcggccagcaggcaactgggcaaggtgaaggagacgttgatggggacgcgtggagctgcggacgcagctggcgggcaggcggcgggaccaggtgaaggagacgccgatgggggcacgtccccagcagcagtagccgtggacgtcgtcggcgggcaggaaatgggatgaggcaaaggagacatcggtggggacgcgcaaggctgttgcattggctacgtgggcagcagccgcgaatggataccgccggcggcgggtcaaggcggaggagacgccggggatgcgcgaggctgctgccgctgaccaccgccaccatcaagggccattgcctcctgctctcctccggcgaaagtggcacgaaatcgaaaaattcacagccctggtggcattttatcaaaggcatgcggattgggtggtaaattatcaaaggcgtgcggattagatggcatattaccaaatttcttggttttttggaggtttgagatgccctaccaaatcattggtagtccgtagtccaaaacgtaccttttggtagagttggatataggacttgtattggttttggcaagtattggcatcaatccaaatatctacaaagtactattaaagttgccaattatttggtagggcaaatttttgcatcaaccaaaacaacccatactcaactactattactatgtactaggttactactatgatctagggacacactggaggatggccatgtccacgctccgatcatagcttcctaggctttcaaattgaaattttgtcatccttgtagagacagacacagaagtgcagtacaacattatctcacatcctcacatataccaatttcagtctccctcatgatatgctgtaccatgcgaagccacttcagggttaagtaaacggtattgaaaaggttagggggtagaatccctggtttgagagtttgggggggttaaatagtcaacctgcaatagtttggggggttatgtagacttattccatgtttccatattaaagtaaactaaaaaatcaagttcaaatgcactactgtaatttagaacaaccaatgggaggtcattcagtgatgcaattggtagtgctgtagtgcactgcacgcgtgcatcattatttggggatgaaaccagtgaacacgtaacgttgatgccctatacagctatactaaaagtccagttctggcaagatccattttactatactaaaccagtgaacacgtaacgttggtgccctatatgagttggatcagctcctatttcctactgcacaatgttgatagacacacaaaaatattaaagaaattatttatagattgttgtaccttgaacctgatctcaatttcactttttagaagtggcatgcttggcttgatttttgttctatattatttggcctgtttaaacttcttggtaatctgggtacatccacacttcaggctatttaacaggaggtcctggtctaaaccaaggaaagtctcacgaagcatttccattgtgtctaggaagatgaacaaacaaggagatctctgtaatgaaggcatgctgccacatattctgtggtggaaagaggtgcttgcaaaagttggcatatatgtattttttttctctccaatgtattgacagggaatcactaatgcttcagctttgttattgctgttattctgtttaatgttctcagaaaatggagaggtgcaggaaaccatcatcaatgcaattgactcagagacttgtgtattcaaatattttaggattggatccaactttaagaaatggaaggtgaatcagatgctcatgcttaatataattatgcaatgatcattctttcacattttctttaagaaatagaaggctagcatgacgttgtactatttttaagttactgtgaattacttcagtttttcatattctaaagtgaaatatgtatgtgttcattactccatttgtttgcttagttctattaatcttacaatttgtatgttcctattctttgcttaatcattggagaattttatggcaatcacggcttcatgtatgtcttgaaaaagaatttctaccagagcaatctgactagtttggagaaagtttattgtaattttgtatcatatataatcaattcctttcttccatggttatttttctttcattttattaaatatttcttgcttgagccatttttgtgttggtcaaatcaggcacatttcttggtatttactttcttttcattaacacaaatgttgatatgaatctttgcagcttgaaggatggaagcctgaacacggaaatgttgcaattcaaatcgaagtttcctcgtgaagttctactttgcagagtaatgctattctattcttttattttgttcacatgcttgatcgtcttttttgcgaaaatctggagaaatgccaagaatttcttagctgggaatttttagttatcaaaacctataatgtcatagatgtttctttctgaacatctatgacatgtgatggtgtgttttatgtgcctctgggaaatctttactatgccataacttacgtgcactgctgtccttgtttccaaaacaatttactttttgtttcactacatacccctccatacccatttccatctgtcaatctggattcgctttcagcattttgctaaatataatactcagaattaatgtatctctccagcgttcttctggttttcctcttacattcaagctggaaaaaaaatccaaatacatagacctataacggaataacctttctccattcaggtgggagatttctacgaggctgttgggtttgatgcatgtatccttgtggagcatgcaggcttaaatccttttggaggcttgcgttctgatagtattccaaaagctggatgtccagtcatggtaaactgttacataactatgctgatgctctgaaattaggattgctttaagaactatcatagtgatctgcctagttaattatcaaatttttgcatcattatgtaatttgttttttgaaaaagtggagaacgaggagcttgaacttcttctgtgaaacagatcttgttgcgttcctttgttatgcttttgaagagtcagcgtatcagtaccatactgtgcggcacttactgctgccttttatctacatataagtttcagtctaaccacaataacattttgtaagttgcctgccttttttttgcaattacacattgtggatatggaagacttatttattttgttagttacttacatcacacctgtctagcatttcgtatgctcatgatccatcaatatagttcaagctttattcaccaatatggtttgaactaggagacatgctaggaattgaagttagcatgcttcatatcttattgttctgttggcaatagtatgaaaagagcattcagaacttgtggcaaacattgatttaatatggtttatactttataactaataatgcacatctttttacattatgttgataatattctatgacatcagagcacatttccttacagaatttgcggcagacattggatgatttgactcgatgtggttactctgtggtaagatgttaactcagttgcttgtaacatatccattaggatcatttgtgcaagggataattgcatctgtacccccattttgaaagccaattgttgttttacccccactttttagggtttgcagttttgccccc

SEQ ID NO: 82355 - DNA, 934 bp, Oryza sativa
tcggcgattcaactcccatcaagcaaaatacatttgaatgctcgccgccgaattttctgatcaaccctaagactaggatctttcaaatattctatcaaagggattctccagttttcttctaactcttgggcacaaatatccgaatttacaactaattcggcctctaaatcaattgtctcatgccccccagcttcatgtctgggatcggtaatgccggtcaaaccgccggtcatccgcagttagaccggttataatgcgtcggtcagaccgcccccaatatggaacttcgccaatttatcccaaagatttaaaatcaaacaccggcttttctaatataaaaaatactcctttcttcacattttagccagatgcttggtgtatcaaataactggacaaaaattccttctttctggatatatgaaaaattataacacccaactaatatgtctagatgaataccaattcaagtggcttttgaaacaataatcaaggtatcaaaacacttagccacttgaagtatgatcaataatgaatcaccaaagtcataagcctcacacacatgaattccaataaactacaaatgtaagtaatcggcttgagcatgtatgcaaaatattaacaatgccaatgatcctaaagaagacaactctagaacaaatcatcacattggccattgacattagccaaattactaataagcaaaactttcttggtgcaataattatgaaatctatatcttatatggtgatccataaaaacacacatgatttggcttttaataaatatcaaagactcactagccaaatcatacttcaaataatttatatgccaacttgacaattccaccacttagaactggcatttgcaacatgcatgtataatatcaatttaatgagcaaacacatgtgctagatagcaagcaatgttctaacat

SEQ ID NO: 82356 - DNA, 3737 bp, Oryza sativa
ctgctgctgctgctgttgtgcttgctgctgcatctgctgcaacacctgatggtactgttgttgtatctgttgcatcatcattgtcatcatctgagtctgattgtccaacacctgagcaattgttgggttctcgggcggtggagatgaactgttgctagatgcatcgctagcacgtgctctactgatctgctcttcgctgccactggcgttgtgggattcacgggaaccattccttgtcttcaccatctggagggggataggtagaaataagagaaaagggagaaaaacagatggcttagaaactaatctttcttataaatttaagtgcaattatcttaatcttgattaaaacactgaaaaggaagcaaacaactcctaattaaggcagtcataccactcacacgtgatatcgaccgccgactaacccacaagcaacaaacctaaacacggaaactagcaagaaaacaaactaagaagacgatgaatctaagggcggcgactctgaagatcggagcggcgcttgtgatcagagaacaagtctaacatctaagatggacaagggataggaactaacgcatgctcaaatccaaattaaacaaagcaacaaatgactcaaataaataaccaagcatcatgatttttttatgcataaaatttttttcatgaaaccacacaaaagatacttatgcaactgactaaaccataaattaatgcataaaatagatgcatagttataatgatacgcttgaagctgccccatcgaacctagacacgacttagtgcatatcacccgataaattcccgactgactgtcgaataaactccaaataaattttttctaaaaccctagactgagctaattttaaagatccgatctgaatgaacgaataagattttttccgcaaaccaaagaggcaaaaccccaaattttcccgaaacaaatccaagtgaaaaaggcatatgcagatgaaaaggggttcagaggtctcttaggtttccagttggcttgtcctacggtcaacctggctctgataccaacttgtcacgcccagaaattcccgaatagaattccagaatttctaagcttaatgtgcattaaacctctgtccaggaccagccagggtacacaaacgacaattgttgacatatagatccacgtcttacaaaaatataaaagattacaaatgcagcggaaaaaggtaaaacgagctagacttggaatcttgacttctgcagcgggtgattccactccacaggcaatccttgacggcagcgacgaaaccaacctctctgagatagctccaactgggaagaactccagctctagtgtgggggaaaagggagcaagactgagtactacccactgtactcagcaagtcataccggaagaggaggtatgatgcaggatataaccaaaggaggctaagggttcatttgcaataaagcagcaaaaccaccctcgccgacccaactccatcatgcccaccctcgccaacggtgcctaggaaagggtcgagctatacttcagatcaaacagtaacccactcccgcttgtggtaagcacgataagtctcccagggtttcccgtgaaccggtccttaattgccatgggtgcgaccagcaaaaccatgcacccacgacccaccattcagtgtattttaattaactaacatcattgtggtaacaccaatccaaagctatgctaatagtcaaagtctatgtaataatgtgatccccatttgtgtactagttgaactaagcatggctaagcatttcctaaaccaacatctaaacattttgatacccaagttatcaatggcataaggtaaataatatatggctgagtagtaggacccatcccacatgacattgtaaaagaatgtaacatttaatagaaatgcgggatatttgtaattgggtacaatatgatcaattgtaatgcatgactttcattgctctcgcattgatgagaccacagcaacgtcttcgagaaaccgcggatcgacgaaacggccaaaatctacgcgacaaacaaagcacataagaaaaacatgctataagactgctgaaacaggaaacaaaaccatttttaatggattctagggatttttatgaatttactgagacttgaatggacttaaacggaggtcggatgaattagatataggggtgaaatcgggtcgggttcggtcggatctcactcttcccatatcctaacccacattttataatcggaatcggcttggatacggatagtatcgaatacggatacaagcacggataatatcgggcacaaatatgagacgaatacgtacctagacggatacgaccactatcggttatggatatcttttcggatatcacgtcaaagcaacgatcatctatactatatagacaatagctatatattcaaccatccccatatatccataatgtgactatattattagggtttaagatatacgagcaatacgacaaggaacaatcgatttttaactggaaaaattgaaagtttggttgaaattgaaacgatgcgatggaaaagttagaagtttgtgtatgtagtaaagttttatacgatagaaaaattggaagtttaaagaaaaagtttggaactaaactcggcctgacttgtgatgagctgctgacttcctattcctgaagagatgaggatcggctggcagcaaaggcatgtagcggcggtggccacggctcaacggatgcagcaggtggcggtgcgacgggtgctgcagcaccggtggcgctcgtagtctcggcgtcattgcttagtgggattagtgaacactgaacagtaattagtatttttagttgttgggttgttaagcatggtttactggttgatggtggttattgtactagtaggccttttggccactagtgctttattgggctaggcatgttatccgggtattatccggatatttaaccgggtaatacccgtatttttaccggataatccgtatccgtcggataccgtcctcccgaacccgatctcatatccgatagaaaatacccgtattcgaacccgctacccgtagaaacttccgggtacccgaattttttacccgaaattgtcccgaaataatacggccgggcgggcgggcgggaaatacccgccccgttttcacccctaattagatatgatttttagaagattctctgtgtttttactaataaagaaaagtccttaatcaattttactgcgcaatattacccagggctgacgtcagcgaagggggggagggggcggcgccgacaggcgggccccgcacgtcagcggcttgagggagagagggagggagtgccggcatgcgggccccacgagcagtggctcaaagggaaggggggtgtgcggctggcggctcagcacggctcaagctggccagccatggggcggcggcggcggcgcgcggccaccggtggcggctggcggtcggtgaggcagcggcgactggcgcgaaggcgggaagggagagaaaacgaggcggagggagtcctcacccgagggggcggcggcgaccggcgtggaaaacgagggtagcggcgacgaccggcgatgccgaggcgcggacgggcggcggcggcaccctaggagagagcagagagggattaggagaggaggcgacgaccacggtggcttaaaacgccggcagaaaatggaaacaatggcgagctcaccggcaaacgtggggaacggagctccggcgtcgttcggc

SEQ ID NO: 82357 - DNA, 3946 bp, Oryza sativa
ttggtcacatattgttattgcatagtagatgctcatatttggtccaaatgctcatcacacaagctgaaatcacaaaataggggcaaaatcgcacagctgaaataaaataaaatggggcaaaaatgcaataaccaccaagggtataaatgtccttttttctaccactaacactgttaaaaccggctgttaaaagtgggggtacatggctgattcagattcaaaaagtgggggtaaaactgcaaaccctaaaaagtgggggtaaaacagcaattggcttcgaaagtgggggcatggatgcaattgcccctttgtgcaatgtaattttcagtgttcttgacaaaagaaccacaattctgcatgtaaggaacatgtgccccaaccttgtaccggtcaagctgcataagcggctgattttcccataagtgctacaaggtggggtgatcccatggaatctgatatcactttttagaaccttggtagttgtagaaatacaacttcaactataaggtctaaagtcactgttccagtaagccataagttcaatgatctacatgaaatgtcagtgcttatttggagccgtaatgagtactttggtttgtaatttttatcctctcatcaagccttagagtaaaaagttaattaactgtttacaggacagttcaaggatgttattacttttttatttatgttatttaccagtgtcctcatgctgaacaattgattgggcctgacataagtctctggagagaggtgtatcaagatgagatcttatacatgagatcaccacatgatttcacaccaagaaattttgaaaccaactttttttgcgttagtgctggagtgatcatagaactaaacagttgtggattttgctcagtttattctgtagagatgcaatgctcacatttcacaacctgttcaattatgagcagtacttgaccatgcttttatcaaccgtgacatatttgatcattaatttcccaccaatttggcatctctggttacatttaattggtcatcttcttgaagctgaccctttgtgcatattgttattttttactactgcttgcagtgcatagttgaagaaattcaaggcccaacccaagctcgtgctaggaaaggccgatttatttctgggtaattgtgtgactatttatcgtggaagtttaacttataattttattatttattagtgatgggtgatcttttgacaaaatatagtggtactcatagtatttatcgtccttaagcctgtttcaatgttactggaggtgcatctagatcttaatagtaggaagttctataatgctttttacattttaagttttacaattacttatgtccgtaaccatgtacctctgtttctgttacagccatgcacatcctggtagtccttatgtatttggtcttgctgaagtagaccatgatgttgagttccctgatccaatgcctgtagttggtgggttatacttctagatttctactccataaatcaagttaaatatctctgtgttatctcttccatcgtaactatgctgcttgttagctagttatatgtttgctccataaaatttcatatgtaactttgtaggattaatttcatgttgagagtgtgctagtaaatcaaaatcgagcgtggaaattgattggtaatggtatagtccattaggttatatggaatgttattttcttttattgaacaatacttttatgaactgtttatatctttcattgaaaaatgtcataattactactcatgaatcttgacaaagattttatagcatatttttcccccaaaatttaatgagtacaagtaataaatcatggtgtatagacctatgagtgttgttcaaggcgcaaagaactttttttgtgtttgaggcattatgttatgcttttttgtaagttttaaaatgtatttcatttctgttcgtgctttatttctattccctgtttatatgatggtttcattaggccaccatgtactgattccagcactgacattttcatacaccatgaaatttatattgatagggatttcacgatctgcaaaaggctattgcctgatttctgtgctagagacaatgaaaacatattcagctgaggagggcttaacagaggaagcagttgttactaagcttcgcatatgccgttatcatcatctataccttcatagttctttgaggaacaattcttcaggtttgggtttatatttcagagcaattgttttctcatttatttattgtgtttgatctggaatcaaggatacagtaattatggaactaggagatataaagttccaaattatgctcttaacatgattttctgttcattttggatcgtaccattaaaattgtccaaatttgaaggtgttacactggtatcgtgtttcatgcatttgtacttgaacaacaattttaaagctcgtggtgctcactcctttctctacatttactgatgcattagtttttttatatgaatgctgcatcactcatatgtacgatggaagaaacttgagattgaaatttttgtggagtaatatgattcgtgccattaagataatatgcatatgacgaatgtagttgtagctatctatggtttgaatgcacctatttatttatgatccttcctgtcaaatttcttatggtttaggcacatcacgctggggagaatttggcgaaggtgggctattgtggggagagtgcagtggaaaatcttttgagtggtttgatggtaatcctattgaagaactgttatgcaaggtctgtagaatatatcttggtgtaatggataattatcatgattttttgtgcatatggtccatgtgttgagattaaatatgaacttttgctgattttcctagatttttatgtgccacacttctatattcttctcagtgagccttgaatattgtttcttactttcttatatccccccccccccaaaaaaaaaaatcaaggtaagggaaatatatgggcttgaagagaagactgttttccgtaatgtcagtgtctcattggaagggaggcctcaacccttgtatcttggaacagctactcaaattggtatgagttagcttccttggtagtgttgatcttttaaaagagacttctaaagtggtgacatctcatttattaattaatgtgctataggggtgataccaactgagggaatacccagtttgctaaaaattgttctccctccaaactttggtggccttccatcattgtaagtattgttatttgttggattaagtgcccctatttggtggccttccataaaaatcgtagcaagatctttatattccattgcttatatgtgtttgccttggctcttgagagttaccttttcttatgatatgtaggtatattagagatcttcttcttaaccctccatcttttgatgttgcatcatcagttcaaggtatattttttcactgtgagattcagtgtttgtaatttgctgagttggaacttgagttcactgcgtgtaagatagtatctatttgatttttaattaagcgcatacagttatgattaatattaactttggaaatggacaaaaatggaatgcctaatttcatctgaatttcaatccttggaactttgcatgctttccttttccgatcacatcactacatcatgatggtttaattgctatgactaaaaatgtatttccatcattgtggagaactgcagatactgtcatagcctcataggtcttttcgaggaaaaaaaaaagcctcataggtcataattgcattaacaaaccatcccttaggtggaacataggccccgtttggcacaactctagctcccaactccaacttacctggagcgggagctgtgccaaacggtccacattcacctttttttggagtggagttggcagagctactcctagaaaatgaactacgggggtggagctgggtttttgctactccaca

SEQ ID NO: 82358 - DNA, 2874 bp, Oryza sativa
ctgttgggggacgaggacgagcggcgcggcggcggggccagcaggtggcggcggcccatcttcttccccatcctccgacgacggccacaaccggttgtggcggcgtctgcgttggcagcatacgggggcagcaggccgcggcgcatcggcggcggcaggcgatggcggcggctgcgggcggtgttgcggtggccgcgacgggcggcacgcggcggcggcgtcggcaggcgactcgcgtgcgggggcgtcggcaggaggcagcctgggcgacggcggcggcctgtgcggcggcgcttgctcagcggcttgggaggcggcggagatgcgtgggcttcccggcggcggtggctcgtgggctgaccggctgcggcggcaacgtcaaggcgacgcctagaaggtgttcgatgaaatggcgacaaaggatgtagaaatgtggagctgagtaatctagccaaacacttttttacctacctcagctcctagaggagctagctctcactggagttggagtttggagttgggagttgggagttggagttaggagctctaccaaatggggccatagttgtgatatttttagatatcacaactttagtctcctttctgatatgctctgcaaggttgaaatgattatatccttttttgagcaactatcatctttcagcttatcctgtgtattcttagtgatgctctataccccctctgattccaaatgatagtggttttagttttctcaactctttcctaaatgtaagtcattttggaatggcgcctcgccatctcttttaccatgtttgcacttgccctcttacaaagaaatgactcatccttttccaatattgtataaatgatgggcaatagactgatagagttgtttgagctatttctttaattctcgtgcagaaatctgaaacaaatatattttggattttgttaagaaaaacttatatttggaatcagagggagatatttgatactacgctgcattaatttcattttttctgttcagatttcattttttgccttttgttctagttccccagaaaattgagtaatgttgcaccatgtgatatcataacagctgttataatttgaactcttgaactgtttcagaggcttgcaggcttatgggtagcataacttgctcgattcctgaatttacatgcataccggcagcaaaggttgctttttctttctccttagagatattgcaacaccatcagttatactagattgtgtgctttgttgcatgttcatgctggataaatgaatttaacgtttcatacccagtagttatataccacagcccagagtagtgcagtgtccttagtcatgtgtaacttgtgtgatgtgtacagatgtttgtggttactcaatatacagtaagctggttttgtaaataattctgaggaatttagccaagtaagatgcatcatatgacaatactgtttggagatacaaaaaaaaaaggtcttttcaaatgttcaatgtttattcttcttggctattttcttgagcagcctattgcgcatactagaaaataggcactgctactaactggccacacaatatgttcatgggccattttatagtgagtaaaatgataattgggatatcaaaaaaggaagtattgtagattcctttttgttgtagtactttcaattttattatatctttagggaaacctttttggtctcctgttagttttgatcaatttagttatcatatcatgattatagtgcatactgttttgtcctttttctcatcctatattatttttcaaatgttgattttgcagcttgtgaaattactcgagtcaaaagaggttaatcacatcgaattttgtagaataaagaatgtcctcgatgaggtgttgttcatgggtagcaatgctgagctttctgctatcctgaataaattgcttgatcctgccgccatagttactgggttcaaagttgaagccgatatactagtaagttgaagccaattttgatagtctttcccttcactatgttattgatccggagcatcttattttgccttttttgtaggtgaatgaatgtagctttatttcacaacgtatagctgaagtaatctctttaggtggtgaaagtgaccaggcaataacttcatctgaatatattccgaaagagttcttcaatgatatggagtcatcttggaagggacgtgtaaaaagggtgcatgctgaagaggagttctcaaatgttgatatagctgctgaggcactgtcaacagcggtatgttttgagcaattggtttctgtgtttatcgaatttattgtgaattgaccagaattatcagtatttgaacaaactaaaatgctatgttgtggtcactaatgtaaaaatgtgcgaatcttcaacaataaatcaatacctgtggctgcagtcttcaaacaaggatatgaatactgtggatatttgcaggaggctgaactgcaccttccgcatttgcatttcctttgatatgatttgtcatgagtcgactaagacattaagatttttttttcaggtcattgaagattttctgccaattatttcaagagtaaaatctgtgatgtcctcaaatggaagttcgaagggagaaatcagttatgcaaaagagcatgaatctgtttggtttaaagggaggcgattcacaccaaatgtgtgggccaacactcctggtgaactacagataaagcaattgaagcctgcaattgactcaaaaggtagaaaggtcggagaagaatggttcaccactatcaaagttgagaatgctttaaccaggtattcaatatactgatgatgataaccacttggtctggcaacctcacttaataatcaaattggcagtcttacccgatttatctgt

SEQ ID NO: 82359 - DNA, 2322 bp, Oryza sativa
cgagcgcggtaaagaacacgggagagcgcggcaagagcggaaagagggagagaaggctcggtggagtgatttatagggcatgggaggggagaacgtggctgggagaacccccgattttcccagcgacgtgggaaggagacagagggagggcaggggattcaaaatgaatctcgcccatttcatgcgcttacgtggggcgggagacgcgggggagagggcggcgacgcgggcacgacgcggagtggggcgcgggagagacgggaaaggcggtggcgtgggcggttgccggcgtgggcgcgggtggctggaggttggggacgacccgacaggtggggcccatctatcggcgtcccgaaaggaggaggagggggcgcgggccggcccaagaaggagtggggcgtgcgcgggcgacggggtggactgggctgatggcccaagaatagggaaaaaggaggaaaagaaaaagaaaaagaagaaaggatttttcctgggattctttattgcggttaatgaattttaattggttaaaattacttatagggctctgaaaattccgctaaaaatcctgttaatatattgcgacacgtggaacccaagaaaaatcacataatgccaattccaattattaaatgcatttattaattagggaattaactctaggttaaattaaacaaatttcttcgaatgatttatttaacaaatttttaaagcaagaaaaaggggatacttcagggcgtgacacgcaccacctgacagggagcgatttgtcacatccaaaaattcagtcaattcctagattattttgtgtattaaatttctttctatgcatcaagtcaagatatacaaaaaataacaaattgatatgcaaatacaaacgtaaatagtgcagaaatgctttttaaacccttgaaagaaaatgacggtgtgacatgactggagtcccatcctagacgtcctctacactcagcaccgctgggccacctccgtcgagctctctccacaggccccatcaccatccacctgcaccatcgggtggctgcacgtctccactctcgtgtcctctggcatcttctccgttgggatctgcacctccatatggatccaccttcggctcctccaaatccacgttgtccatgcccctgtcactacaggggtcctatgcgctgcccgccgaccaagttagcgcggccctctccacccggctagccacgttgtccgtcgggacccccggtctgtcccacattgttttctcttctcctgtactggtaaggagagagagggatgggagatggttggtggttgactggttgtgcctccgtggtctatgctctcagccttgttcctcgcttgctgcgatcttgtgcgtagctgccaagtgaggagggagataacagatgggtgtggactgtggatatattctgcctgttctttaacctcatcatggcgactttgcgtcggagggctgtggtgtgtaataggttttccttatcatttgaaggggttatcgcaccccatggtaagatggtaaccgttgaaaaccgtgtaaatttcatcgacaaacatttgaatacaaaaatttagcgttttcgtggtttggtcgcggttaccatatggtttgatgcggtcaccacacggtttgacgtagtaaccgtgagttgtgtagctgaccaaaacaatgcttaaaaaattttaaaaacatttaaatgtgtgtagaaattatggataattagaagaatatataggatacttgttgtaatgccctgtaaataattagattttttttttgagaagggtacaactcaggacgcacactaacacacactgcactcacacacgtgcgcgtccctaacacacgctaggaatgagattggaggcactaggcctcagtgcacgggaaacgtgcagtcccactaaacacgcacgtgtgtgaagtcagtcttagggaaacggggaaaaacccctggtgagacacgcgagttgcgatcccagggatcgagcccgcgcgggctgctcgctcacctggcgacgctagccaaccgagcaacgctcggttctctgcaaataattagatagaaaaagagaatgaagagagaaaagggaaaaagagcaaagctagctagcagcccagcacatgcagcccagtagctagtcggcccaataacaaaaaccagcccaagcatgcaagcagaagaggagagagagagagcgcagcgctacagtaccatcgcggtactgtagtaagaataatcccacctcgccaattcaacctgagggagaccagcttaaataggaaggtcactagcaactctatttttggaattt

SEQ ID NO: 82360 - DNA, 8997 bp, Oryza sativa
ttgttcttcacaaaattgacgggggatggcatattatgaccaatggtacccaaccaattggtattggcgggaccttgaatcttgactggtatatgatgttactgattgggtgcatttctgagagggtattcactatctccatgtcagccacctattaaaaaaaagtcaaaagttcagaaattttcataggagtgttcgacttgtttgtgcccagcaactaaatcccacttcggtgaagcggttgaaccccacaatcggtgctagtgatttcctccctgtacaagtggaaaattccatcctaaaatacagttagttctttttctgttttgtttagttatatgcatataaggatgcctccgttgggctcaagagctctagtcgtacatgaaactgagatcttatcgaatttaagtgcatgttatggaagctgatttatttagagggagggacttctgactttgtcatccaggatttggaaatgtaatgctttggataaacatgagttagtggctaaacaggagtgtcacattgttctaactccacactcttaaaggcatagctctaaaggtggagagtgctccttcagctttttgtaatgggtgcctttcttttttgccccctctcttgctgatagtagattcagtcacacatcatgagtttttgaagttcgttttgttggtgagggcttaagtacaaggttggtgattaacttgctgtatctacagttctacagaattttctttcttttattagaaacacagatataggttgttcattaaatgtcaatgaactaatagtgaaaatcaaggcagatatagttagatgaagtgtgcacactgcaaaagagatgcacagattttagaagtatataggtttttcaggaaaaaaaacaatttacaagtatatattccctgggaactggaactggatctttgtacatcttcttgttatataatataggtctataattgttctgttaagtaaaatactctggatagtattgggtttgtaagtggaatgagaatttctctagagaaggaatatagttagaattgacatgatgagggaagaacaacctcagtgtgaagtccagcaaatgagcacttggcacagtttttactttcattgtcctttctccactaagcatgctgcgctgtccaatttaaaatgctaccatgcagattctgggttctttgcaattgatttctctggagaagtacctgcagacatcagcaacctcgtcaaggtataaagtagctttccccctcgtcttgtttgtactcactactaaccatggaagatgaatggcttgaacatgcacatggttcttgagagcagcaggaggaggaggatgaagagcaatggctaagctccagttcaagaagctcttcaactccatggtgcctttccggcctcctaggtggtcggctgaggtacgcaccaaaccggcaagtcacaaaacggcaatggtgaaactccagcaggagtccacccttttcttttctgcatttccatccttccagttgtatcaggtggtggcgaaataatcagaaatatctgtgtgatccttaatatcaggtggtggcaaaattattgatacctaattgctgagtcaatgcttgttttatgtgtactctggaaattgccctactactaataaatggctgctttttatctagaaagatgctatgttgtctcatttgattgtctttgtgccagttagcagttggtcatatccttgctttgagacaaagttgcttctgctggggggatggagagtacacctcatttcatttctgccttatgccattgcaagtatgttgatcctgtaaagatctgccataagaaatcgatttgcatgttatgttggtgactatccagttttttctattgatatacgtttccaccgaggcagaaatttccaggtaaaaaactatgatttgaaatatgccaataagatttttaaaactgaaaagaggaggaaaaaattcaaagaagttttcccttttgctgctgcctgctggctgagtccagcatttcttctgaacaagcccggaatgatttactgaaggaagatgaattgttgcaacgcaaaagagtactactactttgcagtggtgcctgaagcagaactaacttacagttacatgtgtttcactgactcctaagtccttgaacatgaaaccttaagactcagacgtggaaacttcttgcagtgtactctatgaaaaggcagctatggtttcgatatgaatatgtgatgatattcttcagatggtacatcagttattaagctctcatatgtacatgaactaccgggaggaaagaattaaaacctcatcatcttattaacgattaatctgcttctacctgatctactcactgcaggattttcctgtgtttatgtgcacctctaacatgaaccatgttaccactcatcttttttttttcgcctgtgccttgtgtgtcaactgtcaagagattttgagaaatcaacttctcatagtctccacgatcctctccctgcctggagcagcgaggcgtacagcagctcgttccaggaatccggcacgccgggcaggcaccagtggctgcagtcctgcttcgccaccgccgccatccgctcctcctccgtctcgtaccgcacccggtacaccgacgggtgggcgtccttgcggtagtccgtcatggcgctgatgttgaggtagatcaccggcgtcgtcatccgccccagcacctgctccaggatcctcatcttctccgggtactcggcgaggtgcgtccggttgaagatcggctccgtctccctgtggcatctccctcctgagttccactgccctcccctggaaggtgaagatggatcatcagatgagatggaggagaagaagaatacgccgtgtgatgattagagttcaaaattccggaacaaaatttggacaaaatattaccaaattcaccaaaaaaacatgaaaaactttaaatattttggctgaaataatatcatatcggggtctgatacaactgaattttctaaaatttcggtatatcgacaccctctgatacaaacactgaaaacgaaagattgaaccctggtgatgatcggatggtgcgacggagatgtgtgattcgatctcttacctgaaatgtgtgagggagtatcctctgaacaccacctgagttcttgtggagtcgatgttcttgtcgacccatctagcccaggtggtcagagctctcttgtatgcgtccatcacctcgaggctggggtgcacgtagttaccttcttggtagtaattcagcctgtggagacaagaacaacgtttgatcaatggtttggcaggagagggtgaaatgacagattttgtgtaaagtttcatgtggaagttcagtttggagaacggtgtgatataccctcttgatgttttccagtgcgtccaccagtggccggtgttgaagacgacgatgtcggcagtccggtacgccggagtcgtttcatcgagttcatccaatctcaacttagcgtccaccacggcgccgcctttggtctcgttgatcatctccttgactagaaatattgatcttatgaaatccacggagcaattgtaatcctacaagtgcagtgaaattagccatgagatacaaatgttgacaaaattcagagctagtgttgttcagtgagccagcctagctgtgtaccctgaatctgaaggagtagtatcccctggtcttgaactggttcctccctgacgcttcatacatcctcctcttgtccctgacaccatgccgcagaatgcacaccagagactcccacatgttgcggttcagtgagtcgccgacgaatatgatcctctgccctctcagcctctccagaaaatcaatcgggttcagcctgatgaagcagaagagaattaagcttcgatcacaaatgcactcgaaatgatcttgaaatttttataattccgaagcgaattcagaaaggtgtcgcgtgcatattacagtgtacgtgacggaacaagatcctctaacgttacgcaacgtaacgtcagaaagacatggtcgctgacatgtgggtcccactgacctccggttctcttggagttactgggaagttcacaggagctgaggttgttgggctcacctggggatgtcgcagccgtgcggctgccacctccacctgaggaagccggtgtcggcgcggccgttcttgtggcagttgaagtcgtcgtcgatgtgggggcacgagcccggcgggtagaacgggtaggcgccgccgccctcgtcgtcatcgcgcacccagcggccactgaacacgtcgcacttggcgaaggagaccaggccactctgcacgccggacgtccagacgacgcggttgtcgccgacggtgctggtgttgatgatcgtcgcggcgggcaatggcatggcggcgccgtcgtcgcggcgatcgggagcttcttggcgcgccgccgccgccgcgaggaggacggtgtcctttcgccgcctcgggtgctggtgatgctgctgctgcttgtgcctgatgcctctccgatggctgtggtgggtgtcagccttcctctccggcggcgtcgatggcgtggctgcggctgctgctgcggctcgcggcgtcgccgtcgagttcagtggtggggccggggcgtcggtggagttgccgggagcggcgacgatggcgtggtgggtggagttcttctcctcgtcccttctctgccatcgcggcattggtgttgcggtttcctctcgctgctgtcgtgatcgcgtgccattcccgacgcgttgatccccgtcgacgtcaccgacggtggcgttcccggcgcccgaccggagatcagaaacccgcggtttggccgtttgctccgccgccggcgccggcaaccccgagccctcggcgccgctctgcgttctacgcgcggtgttacgcagatcagcgccgccgccggcaggaggaatgggcgggtgaggcgggagagacctcctcggcagcgccgccgccgacgtcgagttcgacgacagccacgacaggagtgacgacgacgacgcccccgtcggggaagggaacgaggcggcgtccgcggtggggccgctggcgacggagacgtagaagaaggccaccacgagcgcgacggagaagcatgccagcacggccttgctactcgtcatcacatggccgccgccgcaaccaccaccgccgccgtgcttaccgccgccgcgcttgtaaccgttgagcgacgacgacgacgaggacggggagaggaggccgtggaggtgcacgtgcagcgacccgctgctcccgccgcctccgccgcccgcgcctgatccgccgcctcggtccagcatcgacagccacgccttcctccacgcgccggccattcaatagctactagtactagctagtcagcgtgatcggtgtgtccggctagccgcgcgccgccgccgcaacttgctggggagtgaagcgagcgaggagtcgaggtgtgtgcgcgactcttgcagcagttggtgataactgtagtggagtggagtggatcggatcagccagagatcgaagtgcaaccgcttttactggttcttggccagtgcccagtgcagttagggtcgtcgagctccctctccccgcgcttcgcctccggactttttccaaacaccttgcatgcaacacgatctcgtcgatctcgtcctcgacccttcagaatagactaggaggcccgtttataaatctaacccagccaccgagcatctcggcccaatcatctattgctcctacatggaggcctaacacagaactgggccgagtcatgggccgcaccctcgttatcttagggttagttacccatgaaatcctgaccgtttaatctctcgtatctgcatcctgaccgtcaaacaagattacacggagtactaattaacccaccttctataaaagctcgcccccatctccctccgcctcagcaagcgccgctccggttaataatagcaaaatcccctcccacccccgccttctctctggaagcttcctcctgctcttcgccatggccggcggcgggaacctgttcgggagggtgctcagctacgtcgtcaacgagttcatcgtcgaggggctcgccaacaagtatgatcccccaatctcatccctctcctcccccctccccctatcttcagatccgtctgtacatgtatgcgaattcgtttttgattcgattgatgtgctgcgatcggtaggctttcgagagaatcaagttcccgacggagtcgtcatctcgttatcgtgaagtgatatatgttcttaaattattttttctcacaacttttcgaatggatgtcatggaacaaacgagattatgcgttcttggaatctgtaggagacggactaggatttggagtcccaaaaccagcacttgaccgagtcttttgttgatttgtgtccaatcctcggtactctagtgttgatttgtgtccaatcctcgtactcgggttcatgtcgtgtccgatcctcgtactctaggtcaaccaacttttatctccgccgcctccacctcccccggtgtagcagaattctcttccctgtgccatggcctgtggtcctggtggcaacctgttcggaagggtgctcggctacgtcctcaacgagatcctcgtccaggtgctcgccaacaagtaataatcccccatcccatcctttatccccccaactccttatctttagatctgtttgtcacatgcgaattcgttatttgtttcatgacatgtgattgctacgcttcgtcatctggtctgtgggagaatcaagttcccgatggactcgttcccttgaagccacattgtctcgttgtatcagcccttatcttgcgcccttgtagggtttcccgtgaagttgggcgcagtatggctcttacatacatgttactgtcaccatgttttccagtaatatgcgtaatgtctgattagtgtatggaatttttgttagttgtgcctgtggcagtgatgagccctaacagacctgtaatgattcttgtgtatatgatcgcttgattcaaagaacatctaagggactgagttgtcatatatgcacaagactggtgttgtctagtctagtaaattgctactgtatagtacattgttattctgtctagtacattgttactctttctagggatgagatgtgatcgttacgcttcgtcatctggtctgtggggaatcatgttcccgacggactcgttcccttgaagctatattgtctcgttgtatcatgggcctgtcccttatcttgctccctcggaggatttcctgttaagtagggcgcagcatggctcttacatacatgttactgtcaccatgttttgccatgcgtattatgcataatgtttggtaactagtatggaatttttgttggttgttcccatggcggtcttgagccctaacagacctgaaataattattgcggatatgattgcttaattcagagcacatctaagggactgagttgccataggcatatggacaaaactggtgttgtctagtacgttgtcattctgtctagcagagtagttgtttgtgttagtgatcgttaccgcttctcgaggttcatgcttaagagctggttgtggttcttgagctttggaaagtgaagcaaaatactttgtggttcctctcgctatccggggcagaattctctttgatgttactggacgtcgaggaactacattagtttgcttgaaacatgtagtcatctcggtgttgatttgttaattgtgtcatgcaatgttttaatgtagtttttgtgttatcatctggtctttgggaaagattaatgtcctgatattcccagtagacttgttccttggaagctacttcctctgtttcacaatgtaagactttctagcattgcccacattcatttagatgttaatgaatctagacatatgtatgtgtttagattcattaacatctaaatgtatatggataatgctagaaagtcttacattgtgaaacggagggagtactatcatgttgtattatcatacataggcttcccttttcttgcgcccctggaaatattatcatacataggcttcccttttcttgcgcccctggagatttcccatgggacatggtacttcatggcttttttactttcatgccatcttaccatgttcatttgacggtgattagccctaacagacctgtaatgattcttgcggatacgatcgcttgatcaaagaacatctaagggactgagtaatagtatgctttgtatttccatctttggtcattggttttaatggatgatctttatttattcgaagcttgtgaattactgcatggcaacagtgatgagtccttacagacctgtaatgattcttgcgggaatgatcgcttgattcaaagaacatctaagggactgagttatcatgaagcttgtcaaacacattttgtattatgtgcttgtccattagataatctttgctcccatctcttctcttgatttgtctttcatcctttgcttgttaatgctgaagtaaaaaggcttaatttaacacttcttatttcaatcctgctgagcatttctgtgtactttcaattgtttcctattgtacttgtcttgtttctgttggttcttacagtgggacatctcaatttttgcagccgtaccttccagagatttgctgtgaggaccaacaagtctcttgagaatctatcgtccaaaggtagtttgcttagcctctgcagtgattatagtatatactggtcatgatagggttaatctatgtgttatgacctcgtgatattctggtgaattgttgcggaacattacaataatgttaccgatttgtgcttttcagctaaagaagtgagggaggagctatcggagcaatggaggaattctcgtggcaatgatgatgtaagtggttcgcatagagctttatactgtttcatattccatcaagtgctgtatctgatcaaattctgttttgcaggggctgcaggaat

SEQ ID NO: 82361 - DNA, 8260 bp, Oryza sativa
ttcaggtatagaatcaaccagtccaactcctcgggtataaaatcaaccagtcctactccttgttccttatcctctcaagtcctactcattgttcctttccttaccttgtttctttacttatcctctcaagtcctactccttgttacttatcctctcaatctaagtgtttactcttagactccttgttccttatcctctcaatctaagtgtttacccttagaaaacccaagtggtatagaatcaaccagtcttatcctcttatatccttgcaagttttagatagtatcatatcttgcactactccttgttccttgtgtttgtgaaattctcttcacgtatagaatcaaccagtccttatcctctcatatccttgcaagttttagttaaactagacattttggcgcgctttgcgcgccctatcaggaagctaataacaaaacaaaaaaagaaaagtttttcatgaaaggtaaacaatatttttaaacggtaattagtgtttacatgcattgtatagagcgaaaattgccaaccatattggctagctgtagtacacatgtaacatagtaagataccatatgttgccaaaatcagtacacttgtcaagattagacaaaaccatatggcgcgacaaaatatgccacaaaaatatagcggccgattagatggcatagcatagtagcatgttcaatatatagagcaaggcatagtggctgattgcgtttttctttaacaccatttaaaaagattggaccgctcccactgcatatagtgcacccttgagttgattctgtagagctgaatgaagatagtcaattgcttaccatatatatgaataacatgcttcatactatggacgacactaaatattgcactcattatcacataaccacaatcagtacagttgttcaaaatcacaagcagagtataacatgaagcactgttatcttttaaagattatcattgataacaatcataaattcataacactgtatcgctaatacaaataacattatattgcagtataaataaaatgaccaaaatagtttcaaagcatatactattcatacataaacagcccagtttatgcttgcaagacaactttttgggtgatcagctatgtttcaaacatcacagcaaatagcttctccagcaaagttcagcaaattgatatagccatatatagactgacaattcattgcattatctatactcataaagaacctgctgtgtacaactatatatatgtggtatataaagtgcatgtccaataatatacgatgcccaccaccagtctcgcccctgttggtctcctaattgccgcatcttcaccctgctttgccaccggtcatgagaaccaatccaagcaaaagtgtaacataatggcgattacttacccaaatccaatatagttgcaacaataaaactaatgcaaaattgcaaagtcggtcatagttgggttataaaaattaggccttaagctaaaatgccaatgaatagcaaaacacaaaacagcaaggtcttgagaaatctaatgatataattttgttttgaacaaaaggttttcctccctatgcatcactccttttctttctgaaattaaactacattgctactatcctctaatcatcagctagcacgaaattgcttatattgccctttaaagcttatattgcaatgaatgaatctgattcagaaaaatgtcgctcatccccagattagctacaaatctgactgcaccacaacttaatacctgtccatagagggtggcaaacaatattagttttgcctggatcggtagttaaaaaaaaaattgtatccctgaacagaacctccctaatttgcatcctatagaaagaaatcatcacagtttaccttaggtatttgcttgtgacaaatttcatctttttcccagcaggtcatatcacctaaaccctttgaagctaatgaaccaatcatcattgccaaaaggaaactaaggtcagtgcatcaacgacaaaaagaataaaaagctgtgcagtcattcatgcaatccttaacatgaatggcaaggcaccaaaaaaaaaaatctacagcactcattcatgcaatccataacacgaatggcaaggaagaaaagccacagctacaatttagtttcaagagaagatgttaaccgcaatttgtataccatacaaatctatgattaacatctagcaaaaaaaaatgctatccctatttgcagctctggaagagacatacaaggtcagacaatgggagtctctatcacttgacagtaaattgtaaaaagccactaaatttgatttctacataatttcaactcgtgcaaccttcgtgtatatattttacaaaaacgcgaaatcaaagttggggataaagtagccggaagacacaggaataaggggatcatttcaaaaattttgcctaggcaagatatgccctatttgcaagatggaacgcctgttgatatggttttcaatcccttaggagtaccctcccgaatgaatgtgggacaaatatttgaaagctcgcagttacctctgggtgtgtacacagaattgcaagaaatatagcaagccagtcaattgatcgtccagcagccaccaccttttcccatactaatttgagccagaggtgctaagttttctgcattgcagagcatgtcttgcaccaacgggtctccaatctacatgcactaagaaagaaggaacccatgatgacgatggcaacggactactaagaatgaaggaacccatggtggagatggcaatggactgcttggtgatggatctgctgttctgcaacaaattgatccatcctaaccatgctgaaacctagtgttatcagcagaagaatcattgcagggggtaaaacatttttgatcagattgattgctccattgcaggcacaaaccataaggccggaaagggaagaaagtatacatgtcttttttttcactaaataccagcagagtggcgtcacagcagaaagtggatgaaagcaaagatccactcgctagatgcagtgctctcagaatgccatcaagaacgaacaagttccaggcagatccactcgctagatccattgctcttgaggatggcaacaagaacaatcaggtggctgggacttgagggtttactttggagaattacctctgcacatctgtccggaccgcccaatttcctcagccgggatcaaccacctcgccgtcaacctcaagctctgatctcgcaaatggggtgttgcgctgcgaccagattagtggcatcccatcgatttccaacctcatgccaccgcacctgctttcggccgccgccgccgccgccgtttccccaggctccttctccctttccccgacgagcttgccagatccagcgagaggcatcggtgcgcgggcagttgcggcacggcgaggctcgggccgcgagccatcatagcaggggagggagggggaggaggaagcggcagggagagcaagggaggacggcatgggaggaggaagccgatgggggatgttcattttttcaaaagagcccctttctgtttgatatttcgagcgcggttcttttttggggtttttctcttcttcttacaaagttttcctgaatgtgaagggcctagaagtaagaatgaaaacgtaggatcgtattgtattgagacctaaaacaaattacaaataacttgaagggtctttttgcaaaatctccacccttatcatcctgccgttcaatcaagctgatcggacggcgcgcgggcgcaagagggaggccgcctccaagagggcgggggcgacgtggatagcgccgcgtgcgaacacgcctctgcaaaacgctctcagctcggcacggcaactccaggcaagttttaatataaccgataatctaagtgtttacccttagaaaattcaagtgtctctgtaggtaacctatctgatcattcaattataaattcctaccgctgtcatcatccaccaaataggctcaaattctgtagttctattgaactgaacatgaatctattcattatgatttagcgagaatcctgttaggcgcgtacgcgccggcaaacctaagtcgcgctcgtggctaagattttttttacccgagaagcctaattaacgtaactaactaatccgattagatttgataatgatgatagttaaggtaatattttcctttttactttttactaatagattgaaaagaaaacagtacgtgaagttaaattttgaaaacttccaacccatatttgaaattttcaaattgaaatttaaattctttgaactaaaattttgtaaacttttaacttttcatttcaaatttgaaaaactttcaactcaatttgagacatttatcccagatttaaaaacaaaaattgaaaactttcaacctagatttgaaaactttgaactcataatttgaaaactttcaactctagatttgaaactttgaactcaaaagttgaaatccttcaactattgatttgaaaactttcaactcaaaaattgaaaactttcaacccgaatttaaaaactttcaactcaaaaattgaaaactttcagctcaattttgagtctttcaatccaaatttgaaaacttttaactcaaaaattgaaaactttcaacatagatatgaaaactttcaaataaaaatttgaaaaccttcaactctagattcgaaactttctttatattgaaaaactttgaagtcaagatttgaaaacttttaatttaaaaattttgaaaaacacgtgtgctaaaaataaaaaaaatgaaaaagaaaacgtaaaaaaaagaaataacgcgaacagatggaggcgcacacgaagaagaaaaaaagaaaagcgaaaaagatggaaaagaaaaagagaaacgggaaaagaatagcgaaaaaaagaaaatgtgagggggagcgccaggccgccgcgcgcgccagttctgttactggcgcgcgcgcgccaattagcagcacccatgatttagtgtacatccttcaacatttcagtgccaatcacacaatacttaagttttctttccaaactacacccatatttctgttttccatgtctggttggccaaccattctggcaggagaccaaaataaaccacaatatatcatttatgtttcaaaaaggaaaaaagaagacagggacacaaatccttttgttgacaactttttgtgacaagtcgacaaacatgatcacagcacctaaacgtcttgcggtgatatagaatcgccaaccacctcgatctagccaaacggccaaatcaagatgggttgtagaaaaacagctaaaccggctagcggaaccgatttagagatcaaaatcagcctctaggctaatttagaatgatatgaggataactaccagtctcgtgggcaaaacggaaggtttttaggacaaacctacaaggaggtgtcgcattctcgcagcggcggcggacgatttacggcgcaaattgacaaagatggactaaaactagggtaaagtagaaaacatggctaaaagttaagatagaagaaaaaacaattcaagtagattgtgtgttcgggggttacaattaaaccaagtagattgtgtgttcgggggttacaattaaaccagccttgtcccttaaataggggttggtcttgccttctactggccctcctctacatccaattcgggatagaaaccaaaggaaacacgaaacatgccttcccaagcaaggaaacccgagacccaacgaaaataggctcgggcacgaactctgacggtctgaccagccgcatacttgcggtcagaccggagtttaggccgcggtcagaccgctcacatacctgcggtctgaccagccctatgaaggaaacctggcactttccaaactttggcaattttccctattttgtccataggtgctaaattttggtgtaaacacatgctcccctgcctttttggtgaacattgtgaacctaaaagcatagaacatgttatctcagggtgataatccaattactggctccgtgaatccccaagcatcttgcaaatgcgagagaagtatttcttcaagtatttcccaatgattgctctctaaaaatgctgtccttgaagtgtctccatctctttcgaggtcttcaaacgcttgtcactgacgtcttcaaaattgccccccatcaaggtcttgtaatcttcgactgacaagtcatcttgcttgaaacaccgaagagagccaagatttacctcaactggcaaaacggccttttgttcagaagccaactcaaaaggagtgactttagtagcaccatgtttagatatcctatgagcccataatgcttccaaaagcacttcatgccacttcctttgatgtttttcaatcttctttttgactaattttaacaatgttttattactcaactcggcttatccattagcctgagtatagtaaggagaagaactcaacaacttaaaatcataaaattcggcaaaacttctcacctttttggacttaaaagaggcttattgatcaaagtttaaaagaataccgaatctatgaacaatatgcttcaaaataaagtcaattaccttcgtgtaagtaatattcttgaatggcacggcttaggcccacttagtgaagtaatccgttacaactagcacgaaccaatgcccttttgatgacgaatgataaatttgaccaatgaaatcaaaagcccaatctcggaatggccatggtttgataataggattcaatacggcggcgggcgccaattgaacattgccgaaccgttaacaatcttcacatcctctatagtacatggaacaatcatcaatcatcttcggccaatgaaacccattctcctaagcaagcaatttatcttatgggtgttggtatttcttaatgacattactagaaatataattcccagcaatggcacagaaatactcctggtatattatggttacagagttcatccgcaagcgcacggatataccattgtagcatttcacccgagagtattccaaaggtatcatatttattttatcccgtgggaagaagatgtagagagaacttgactaataatttatatatcacttgtgataatcatattctaaacaggggttaagataaaccaagggtagagtgacacacaagcattggctactcattctcataatatattatctaagctaagtggaaagaaaagagaaagataatctattcctatacttctaatatacatagtatacatacattctagttaactgatatactagctaataccctgtatccgatgccctcctggtacttcgagaagccacccctgactgccgagtttcttacgacagcccgtcatgaccatataaccgaggctaaatacggaggagtaccctccccaaggaattaacttaggactatatacacgtgcggaggaatacccgtactgagctgtcaccatcagcgacccacctctcatccgtagcatataaccccaaataatgatatcccataatctagacaccacgtctaaactaccagatactactctaatatcatcgtcatgacatagagaaattgcatatgcaaacattatacccgcaccaaagcatctcccagataagctagcagtatattccgtataacatgaacataatgtaaagtaggcattcatatactcggaaagtatttcaataccataaatgtataaagaagagtattctaaataaagtacaaagcttacaaaagaggaacagaaagctactagagccatacccgaactcttccgaagacttccggactcccgatttctactttattcctattccaccagcttgatactaaactaaacttgagagaatatgagagagctcttgcttgaggtgtgtgagtgaagtgagaaggtgaagtccttatatagaggtagttatgacagttgtggaaggggaattgtccgaagtgccctccgaccgtcattgggatgcaatcctggacgtccacgccgaaccctgcatccaacggtgctaggatgggttcggcccaaccaccaggttttgccgaaccatgggctgggccatcccggcccatcttcggctggcggcctcctctattgcttcactttgtagacttgtgaattttggcccaattcatcgtgtcaattctgagttcttggcccattcatgcataagtctgattctcgacatcgtctgattgatttatcgtttgagttgatgtcaattctcctccactttatggttattctctgcaaaaggttagtgaaccaaacacta

SEQ ID NO: 82362 - DNA, 14882 bp, Oryza sativa
ggcaaaattcaaattatcaaacaagcttacataatacagtaatttacagacagaagtgtgatcggtcaaaattcaaaaagctaaggaagatccacactaaggcaattttgtgatgtaaagattgttgttaaagcgtcaatataatctacaaaatggagtacttcaaatataatcaacaggaaacatctttgaggaccatacaaatatatagttttgcgacgggaaagctggcatcacacaaatatatgtgaatgacaagctatggaacagacatgattctaccaaaagctcatgtctttaaataaatcagcacaactttgaggagctacctggaaacaagtccacatagtgatacttgaactgagtgcaatggcactttcactcttaaagattgcctaggttctccggttgccacacacggaggagtcgatcataaaatgaacaggtagcaacaactgaaaaattcttgttctgttctgcaccttcatttatctgccaatccgcaccatatgctaaggactcatgcttgcaatatgtttccactactgcagcatccccagtacctactttaacaatggcaaacccattgtgcatgcatgcagccaagacaacatctgcaataagaggatgatatttaatcctccatacaccaccccctaaatttagggacttcacattaacgggtttcaccattgatcttatgtcccaaactctgagaaattcatcatagcttccagtaagtagcatgttcccctctagtggattctgagcaatgcaacagacacccatattatgcgactttttgttctgaaacacagcatttgatgggttctgtcgcaagtcccagcagctgaaggagcagtcgtctgatccgctgtataacaagtgtggatttgcacgatcaaaatagcaagtccacacttcatactgatgagcagtccactgttctgatacctccaagcggtcctccctcatggaaaccacagacagggaaccatccgataatccaacggaaagtgccttggcagtttggttccagtccacaaacaagcacatcgaagaagaaatgtctccagaacagacatccctgagaacagcacctgcataattcggtcacataaagcacttgaattcagcctcaacatataagaaatacatggtggactacaaatatgacaaatactgaggtgtttacaaatagctacacaagctcccctgcttccagtacagaatcaactagactatcgtggcaatttaactaaaaaatcaagaccaaatttgatccagaaatgcaagaatacgaattgacttagaacatcattcagcagcatattgccttattctcaaaagaagatgacagacacggatcacctccagaagggcagaatattgcatagttgaagcaacttcttgttaatccagattaaccactgggaacacatccactcaatccatgagagtaagaaacccatttcaccaaccccccccccaaaaaaaaaaaaaagcataacccctgaacccctaaatacttctgcaagcatcaggcaacattcacatggatgatagaacgctttcagaatcctaagaacttgaatttgcctttggcatcagtagcagtgcatcactatgttcagtaaataattcatggaagcttagtaagtggatagtgatccaattttgacacagcagacaacttatttgattctatggtaatgcaaatgcaggaacaaacagcacctttgtccgatccgtcctcctgctccaggcgccagagcgcgaggcggccgtgggcgtcggcctgcgcgagcagaggcgccacggggctccacttcatgtcgaacaccccggcggtctccaccgtgtggagcagccggagcctccggggcgcgtcctcctcgccggcgtcgacggcgaagagcgacacgctgcccgcgcggtcctgccgctccccgccctgctcctgcagcgtgtaggtggcggcggcaacgacctggcggaaggggccgtgcaggcataactccaccgattcagttttgccgccgaagtagcacgaccccaaatccatcgccctggaaaaaccctcgcgttccgcacgacgcggttcgcggcggcggcggcggcggcgagagtcgagagcgctttcacttccgcggcgaggcggcggcggcgggggcaaaatagtcaaacacttagtccataccggtcactatatacctatcctgactggggacgtggcggacacccatggccaccctagccgccgcgatttcggcgggccccgcggcgcccgcccccgccgctcgccgccgccgccgccgcgggttcgccgccgtgagctgcggctcgtcctccgcggccgacgagcggcaggccctcttcagccgcatcgcccccgtctacgaccatgtccgttacctcccactcctcctccccttctcgcaaaattttgaattccactggagatatgtatactaccagcagcatcgtactgacgacgggcgcagtgccgtgttccttgtagctgaacgacgtgctcagcctcggacagcaccggacatggaagcgcatctgcgtgtcttggtccaggtacgccactagtggcagcatgcatatactcttgttctgcaattggttgatggaaaaggttgaattattgtggtcagggcaaggagaggggatcgtgttcttgatctctgctgcgggagtggggatttggcattccttctgtctcagaaggttggcttggatggacaggttggtgttggatttgcttggctgctttagatttcagaaagaaaaaaaaatcgacttgaatgttctagcccaagctctcatattttacaggtgatggctgttgatttctcaagtcagcagctgcaaacggctgctagccgtcaggatcaacgctggaagccttgctacaagaacatcaagtgagcatcctcaatgtgagagtttgtagattaagaacaacctgtgatatgtagttttgtgattgctgttaatgaagtggacaggtcgtgcgcgtggctgacagatgcgtgctttggacctctatggttgcaggtggatcgaaggcgatgcacttgatttgcctttcacagactgctacttcgatgctgttacggttggttatgggttacgcaatgtggttgacaaacccaaagcaatgcgggagatatttagggtcctaaaaccaggtctagtgcagattccaaagtttttttctggttgatcatgcttatacagttcagcagaaattttcatgattgggtttcgctggactgcaggatcaagagcatctattctagattttaacaagagctcatcacttttcacaacgtcattgcaggtaaaatatcagaccatctatagtacacgcaagtttggcttgtgtttgagatcaaagagaaagataacttcctgattattgcactatgacaatgtaacaacatcacggtctcacggatggatcatgcgttgacttccagtgtcaatgactttgggttggtcctataattccctaaccaaattgatgttttcccttggacagagttggatgatcgataacgttgtggttcctttagctagtggctatggactcactgaagaatacaagtacctgaaaagttcaatattacactatctaacaggtttgcatttatatttcctttgtgagaaaattcccttgaagaacaagatggtcacatgttttaccactttttaagcaatactcgagtaaaacaaaaaaaaattataactttagaaaaacaaaaaagtaatgacacaacttacatttgtcattctgatagtagcagtacttcaacacacttctcaattaatcctgatggagtacagtaggaatcccttttttttcgctcacaaggccacgcatctaaagattcaattcatttttatatgagaagctgcattcttatattccaaacagtccattggtcaatgccctttcatcagcgaccaaagttatctctcatgtatttaccttaatttatttgtgctggtttacgtccattgtagaaaaggagctggaggagttagctaaagaagctggcttttctgcagccaagcattatgaacttggtggaggtctcatgggagacttagttgcaactcgctgagtagaatggttgtgaagaacctgatctgtacaacttacctgaattttgtagctgcttcattccttttccctctacatcatctgatagttatgttccgctgatccaacagggatcatgcatcaaaaactcaaaactttcgtgatgtatatttcctttcttctttaataaaaaaggacaattgtaaccacctgaaaaaatcaataacctgcaattcatgatagtgcaggagcggttcgatcaaaatcagacgattgagatgaaatccggtaccgtgcataccagcgacctggcaacatttgagctatctgactggaaatcagccagttcaatcaacgatccggttatcggaggcatgaaagcaggtgagaatctcaagccctcaacccaaaggatctccatagtgtgcattgccctgatttcagaatcctctgtctgatgattaatcggtccctattggcgacagaccagatgtgcactcgtatttatgggcagagtttttaatcactcgtcagactctttacccacttcgctgcacaacgggacaagtattctgtagggtcgttataactgagctcaacgaaccagccaccaaaatgttcgcaatataaattctagcaacgaagttttactgagctattacaaacaaattctccacctgataaccgaggagaaaacacatgccttaaacccccactatccaataagtacccttgcaacattaacaaaacacaacccactgtaggctcttaattcacccattacttacttactttcacccctaaaccagattcaccatcactttcacctaaaccagaaaaatcaaagaaggtagagagaaaacttcaaaacttgaaccagcactattaagcacatacagccagccacacattgtaatgtagtagtaaatatgatgtactctctgggcaaagtagtagtgtcctgtgaatgcctgatgagatcgatcaattcctcctctcgtccatggcgaggatggtgctgaggttcatggggctgatgtggtcggtggagccgtgcatgatctgcgcgacgatgagccggttcgcccgctccgtcgggtggaacgcgtcccagtacgcgtacacgtcccggttcgcgcacacgttggacgccggcgtgcacagcccgataccgttgtacggcccctgcccgcagcacgccaccttcgccgtcacaaaccctgcaaacccccacaaacacatcaaaatcatctacatggatcttccgtctgtctcagaaaaaaaccaacttctaaaaacgacttctgttcagattcatctctgaatttttgttcttggttggtaattggttaccgtagtcctgggggttgaacatgaagtcgaagctgatcttgttggtgttggcggcgatgaagacgtggccgccgagctcggagttgagctcggcgagcatgcgctccagctgcgggttgaagaggtcggcggcgcgcgtcaggtcggtggcgcactcgccgtcgatgctgtgcatggccagctccgccggcacgcacccgatcatcccggtgcccgtcacgatcacccgacgcggacccagatcgtgcagcctctgcatgcaccaccatatacacggacgcagtcatgtcatttttcctttcaagacgaaggacacaaatacaatttacatgtacacgaagctgcgagcactgcacgtctgcacgagtggcaactggcactgtcgttgcatgtggcatgagtaaattttggcacgatggcctcgcgggtacacgagtgagtaaatgcgatgacacaacaagccccctctacgatgactgcatcctgcttgtttttttttacagcgttaattgtcctacttggcatattcattgcctctgcagagtgaaggtgtggtaggtgacacagcatgcatacatccacccgaacggcgacgaggaggaacagtcggtcagacagagtactgtcaccgactcaccgtacggtaaaacttgggtgctagatgtactgctacctcctacctcttgaaattatttggtgggaagccgatctagtagtagtaaatgtttaggcctattggcattgaaccccatagatcatagtaataagctattcataaatcatacagtaactcaagagtgtgaaggaatgtgtagatctgaagcagagagatctgatacagtgacttgcccattttcatttactggcttactgctccttgtaatgaaaatcttgtacttctgataatgcaaggcgtgaagcctttttcgcattacactgtacttatattgcttgtcagacatgttaattgtttgttgcagttcgagctcttaatttaatgatgctaaagttagcataatgtcctaactggaagtatttttacaggtattttaaatagtcgctacaatcaatctataccgttcatattttctaatctaacgatcatatatatttacgatgtgccttaactactagtagaacagtaaatcataaattaacggttgatgatgatacaggtattggtatacggagtacattactactaccagaccacccatacttctattttcttcctttgcagtggacaggaggatgaagatgggggcttactgacactgactgcaaatagtgtgagatgaactgcataatgtattcggcttattgttttcaacaggaactttctcaggttgatacagaaaaaattacaggtcatgtcattgacaacatattacccaaaagagactccacaccaggatatgttcactctgcaggctgcagcctgcactttctatctattgtttgcagtgccaacagttaacatgcagcattgttttctactactgcttttatgcaagtgagttatgctcatctgcttcgatcggctgagtctctactgaaatgctaatcgtaaatttgccaaattctacctttggtgataacacggaagttaattgaggctacttattattctctagagcaagaagaaacttggaatcgatgagatgagactaaccgtgaggatcttcctgtactcggagatgaggtaggggacgtaatcctggatggcgaactgtcgggacctgacggagaatggcaccaggtagtagttgttgacgaagtcgttgccgccgagcgtgatgagcacgagcgactgctgcaccacctgcctcgccgcgtcctcgccgacgaacgccgccagattccgctggtagttctcgaagttgtccagctgctgaccgatcctaattatgttcacctgcacccacagcaaaacacaacgttaatgcgcatttgttcgtgacgaaaatggtggcggatgcgcgcgcgggggggcttacgaactggatgccggtgtcgttgaggatgccgacgccggcggaggcgaagttggcgccgacgagaaggttctcgcctcggaggtccgggctcaggtacggcagagcaggctgggacccgaggtactcgcctgagcccaaaaaaaaaatgcagcgtgtcaagaacagttgtaactaactttgtgcattgcattgtgtttctttttacaagtgacagtgatggataaggtgctaactgatgatgtccgggatgttgagcccgtttgagaatctccccgtgggcatgtgcgtcgggaagtcgatcccgtacggcggcgcgtccgcgcgcgccgtcgtcatgaggtagttgttgttgccgttgtccacgagcgagtccccgaacacgaagaacgccctcggcgccgccgccgccggcgtcgcggcggccacgagcagcgccgccaccgccgccatgaggaatccaaccaaagaagaagcgcccatcgcgcgcgtacgtcggcgagactcgcgacagcagctgagagtatacacttggggctagctgactggcagttggacagtgggcgacacgacggtggatgtatggacggcgcgagggtggcggcgttcacgttctcgcttgcgatctctcttatagagggaggccgcattcgcgttcgcaattcgcatcgatgtctcgcgccacgccaccttaagacgcgcagttaaggcgtgagcagtgagttagcggggcgcgggacacggaaagcaattgcgcgcgaggaccaccacaccacacacccctcttctctctcgcgcgcgcgcgcctgaccaagcacgcaagctagttgtttttgctgctgcacgccgcagatgcagggtggttggatgctaaatgcggcgcttcgcgttgcgtccccgcgtacgcatctcgccctcggaggccacttggctggcccggccctgccctgccctgccttgctgtgcctcggatcatgtgcatgcacgagaaagagatggagatcgatcgaaggggaaagaacgctgcgagctcgctgttgctacctaccaccagaattgcattgctccccagacttgaaagctagtgaacccggcagtacaggaactgaatcctcttccggccgggatgcattgtgcgtgtatagtcatcgtcaattattcagttcgttccagatggagcaggggggcatgcgcagctgtgcgtcttaatttgtttctcattgaattcgcctttttggtggtgtctccataggaggagaagatgtgtttttgcaatcacgagtgagagcgacgcgtgttaggatggagattagtgtcatctggattaattggtatatatcgatcgatgatcgatcatttatggttggtctcacgattaatgcggtcgatcctctgctgttcctgaaagtagaacagtgtgggacatggagcgcggacatcttaatgaagaatccaataagagaaaatccgtagctgaaactaagttaactaactcccgctcaattcaaatcgggtacgagaagcagcacagtgacaagatttaaacctcaaaatcggtcgtcttcctttaatttgggatgcgtgataaacaacagtaatctgattctgctactcaaggcaagctaatttgattttccaacaaacgtactaattcagagtttcagactcagcgcgctagctcctctttccgctttctagacagagttttgaagcgagctctctcacggacaaaagtcgcaaccatgcatggattctacaccgaagatttcaatacgccatattgtttttcatcctcttgggctatctcagtcctcctaactagtaactactcgtacctgcaactcgtgagaggttggcgagttaataatgtaattaaatcccctgaacatatactgcacttaccttccatcagaaaaacattgacatgtcataattcagctgacagctgggatagatagatgtacatatatcatatatgtatggtccataccgaagggagtttaccacttacctagctagccatttcatttgccttgcggccatgcccttaccacacttaattaccagttaccagtaacgaaacaaattgactctgacaggtacatgtatacgcattccatgtaaattcagagtgacaattgtgatgtatagatgtatacgtattccatgtaaattcagagcgacagttgcgatgtatagtgcacatggccgtatatacagtatacacacggagcatcatatgtatcgcggccgtatactgcgtcgtaccgtacgtatagacggccagctttcatttattgtacttgatccagtacgtattgcgcatgcatgcatgcatgcatgcgcgtagcagaggggacgccacgccatgtgagattcattaagcggtggggtagaaatcatcgatcaatcaatgtgtgccaccacccatagctaataccgcctactagtcgcacgctcgtacggcgagtgagataaaatctcgaggcgtaattgcgcagcgctgtaaaaagatattcgccggccggcgattcgtcctatgtactccatcttctgcaaatcgtacaggctttgcagcgaagtactcctacttactgatctgccagatcgggctgtaagaacgcattttggggtagagcctcctctattcttaactttccatcacatcatattacataaaaaaaacttttctacacacataaacttttttttttttttacaaactcccaactttcttcaaacttccaacttttttagaaactaaacacacccagagtattactccatgatctaccaattgtgatgtaatcgagttgtatttctcgacttcaaacttcaaacttctttgttttctgttaacacgcttattaaactgttatatgatattttttataaaaattatatataagttatttaaaaaattcaaataaactcatttttaagtttataattattaatacttaattaattaattatgtgtaaatgagatttcttgttttgcatgcacaaaaaatctatctcaaaacatagagatcgaacgctcaccagcagctatcaaactcgcgtcgtatgtatatataggagcgtattcagtggcatgcatgttccagttccggttctctctgtgtacgtaggtgtgttctgaaatttcatattcagcgttgtatatatgtactactcgatcgagcttcatcgagctgtgcgagttcaggaaagaagcagttcaggaatttaggcacagctcgtcgatcgagctgtgcgagttccaccaggaaagccatacacaccgatacatgcatgcacctatcaagcagcttcacatctagaccatgcagttaattgtacagtactcaccatgagtactacagtaaaattgtggagaggagggggacaaggtaaaacccgatcggtcgttggctgattggctctctgctgttctagctaccatctgtaactgtaaaggctaaagcgagcatttactcgtaacagctggctcccgtggactgatacacatgtacttggtctgcagatcggctggcgaatggcgatccatctgcaagctactgacgtacaattactctcccatctcgcgaacgccgaacggccggccatcaagggtgtgtttagatcacgctaaaattaaaagtttggttaaaattgacacgatacgatggaaaagttaaaagtttatgtgagtagatcgagcagccgcagaagttcctgctgacactcctcgcgatcgaccggctggtctctctcgagtctcgacaattcacacgacagggcaatgcaggtcgacgaggccggcttagcggccgtgaaaactgaaattactcacagatcgatcgatctcgccgcggccggccgtacggagcggcgcccgaagattccaatctcttccggccgtcccggtggtctcgctgtgccagagtacctgctgtaacaacagtgagttcataaatcataacgcgctgtaacacaaacagtgagatcagttcgtattaactgctcgatcatatcgtgttctctcgatccagatcggtccagctccgctcctcattggatcgatcgagcgactggctgctaggctcttcatggtacgcatatacatatatgcatgtgccgtttgatccgaagcactgcaggcacgcacttgtgttttaactatctcttcttctcgatcgggaccagctttaaaacgacgctgcagtgctttaactgtgtgcagttaactgtgtagatgtgttctacatgatgatgtcgcgttccgttttctgaactgaacctcctgagtcctgagcaaacactcgacgggaagatccagacttgcagagctcgacgaacgatcgacgacgacgcatgcgtgcgtctggttaggtgaccgttcggctgtgggccgtgacgggacacgcacgcgctatctgggctgagccttcggcgtgtacggacatgccgggtagcttatgggccgtcccggtatggtccatttctgtccattaataggcttgccagatgatttcatggcgggccgaacggaggccgcctgtctcgccaaaaacggcccagatgagcgccggtcagcatcgcagccatatgacatcgagacatacttcgtggaacaaaccttttgtggaataaaccaacctattacgagatgtgataggagatataaaaggacgtgacattagatatcacattccgtattagatttatttgttttgagacaagagaatatgagatatagatataggagggatgggcccacataatttttaaatttattcgataactagctgccacgtgaacaaccatgtcgactaaaatcactctcaaagcagtttcttgtgagtggtgatatacccaattttacagctgagtggtatgaatcatattcaaccaatataggagggagtcaaaatgctttctccagtccattagtatgcgagaaagtctattttgacttgctcgtctcgtgcttctgattaaatcgcgttcatcaaccacaaaaatggataaagcgcatccctatttttcaaaatccggttcaaattgaatcctccaatgatctgagaacctgttttcgctgacgtgataggttgatcatgattgactcgctgagtcagcaagtagaacctatctgtcgacgacttctcctcgtctcatcttcttcatcgcctctctctctctctctctcgctactacctcaagggtggcatcttgaggagggcagtcgtgctaagcctcgtcgtcccgtacattctcgggatcaagtcatacatcatgctttcacgccccgcggtggtcgagcctggctaagcccgacgaccagcagcagcagacccttctttgtccccgtcaagtgatggccacggaaatgacggaagaaccccacttactccctctgtcccacaataaacgcagccgtgggtttcagtgtccaactttgaccatccatcttatttaaaataattttatgattattatttttgtgttttattggatgataaaatatgaatagtactttataagggactgaacttttaaaattttttaaataagacgacggtcaaacgttgagcatgaaaacttatgggtgcacttaatgggacgaagggagtacctctgttgtgagtgtcgtctccttgcgtggggaatcctcggcggcagcgagcctgggatgtggccgccgcttcttccccatgacgcgcggtgcgacacgtacaaccgcgttgtcgccaacacatggttttggttctgccccttctgcagctccctgtccggctatcgacgctccgcacgtcgcttgatgggacccgagatgcgcgaggaggtcttacagcaggcaatccgacagatcactgagttggtcctcctccacggcggccccgtcactgtctctaccgccttcgtcgatgcgggtgcgtgggtcccataatacatatatgatatgcctttctgtggccacaagaggagggtagggctccagctcttcaccaccgtcgctctccctgcatgcctctgctgctgctattggaacgttggatggaggaagaagattagatgagaaggaaccgcttcccaaaccaccaaaagagtcaatttacaccggtttgcaagatgagaaagacgttataactggttttacggttgagccaagggattcgaacaagacgtgaaggaggaaaaacagacttattccttaatatgcgtgctacatgactacgtgacggggcaattggaggccgaaaacgaacacgaggcagccagctcaggctcggcatgtctcgccaaaacgacccacgttaacctttaggccgaatttcgtggtgattgaaattgagacacaacttcgtgcctccgtgaaattggactattaaatagcctttaagcccaacaatggccattaaaatcagaggtccatttattcgtgggccacaacaaggcccaaatcgctgctaaatagctgctgatgggccgttccaatttggtcaattgatcgatttgagttgagtccaccgagagctaacaatgtttacgtcacattagctttcttcggtaatcttaatccaacatcttcagtactagtaccaatcgacttcttatgattgggttcatgctgttcagtgttcactacttgtcgatcgactcagcccgggctttcatttgtagccaactagccatgaaaatgtgctggtctcaaacctttttactactactccataagtatgagatgaggtaaatgattggagttgaagaccaggcctagaaagagcgtgcgagaacggacgatcgccttcagaattctgatgctgcccgtcctctgagatctgccacccgctgcactcccgcatctgtctgtctctccacacgacacccccgtttgagctctggagctcttaccctgacagtttcctatgattttttttattataaagaaagccattactgtctactactccgagttgaacctttgcaaaaacagatcacgcctcgtctctttcctactcagcagtactcaaccttttccttgtgaatcatcagagaaaacgctgcggccatagctgcagtgctgcacctgcgtgcactggtccatccatgcatggcggctgaacactgaagtccagccagcgacgccgatgctgagagagtgagagcatgtgtgcctctccaggctagtccagactggtgtgacctcgtggggtaaaagcaagcagatggtcagtaataaaaggagagatcaagattggatggatcatgggtctcgcggatggcgtgcgacagcacgagtgccccactgttttttttgcaaaagcgagccgataaaaaatgatggcttcagtacgtaatcattgtcagttaaaccatcgagagccaacctgtacctgcgatcccttgaagcatcggtaagctaccttaat

SEQ ID NO: 82363 - DNA, 1507 bp, Oryza sativa
tcattcatatttttattcccactagagccataggttgatcggttatgattagcttgctacatacgctgcttgtcattacatcaagcgttgtcaagttttgtgaccctagtgaaatgtgtttcatactttcatggtcaagatcacatacattccgcatgcatgcacatatgcttgacttctacactggaagttagcatttctcatttgtcattcatttcatctatcaaataaatactccatgttatttatgcctcttcctccaaagttctttcaaaaaaaaagaaagaaagagagaggcatggctatgcaaaaggaaaagaaaaaaaatgctcaaacaagtatggagcatgatggtgaaaaaaaaagaaaaaaaagataaacatgcactctcccaaatttcaaaagagaaaataaatgaaggaggaggtatacaaaaggagttatttttatttttcctttttccaccgacaaattcaccatacacatacacatgcacattcttgaccagaaagtatgtcttgtatttccgtggatccattatttgactttgcaatatatgtgatgcaagtaatgctctactcttttccataccctgagctccacataagccttattagatggtaggaaaagaaaaggcgcaatcatatgcctttgtgaggaatcatacaccatgagtgatcgagagaatcaattgagtagctaagcaaagttatagttttgtgttacttgaaaaaaaaatccaagttgttcttcatgaaaagttagggtgacttgagtcaagattgttccatttctcaattgctcaggatcgcatggtagacactacaaagacccacaagtacaggtatgactttgaataatttgtttgcatgattgttagtaaggaagtcataactcttttgtagagtccatagccttcactcgggacgagcaaaggttaagtgtgggggtgttgttgacggttcttaaattataatatctgactgacaatacctgcatataatgaaataaaacatggtattcaacttagtggtaggtgttattactaatcatttccattagtgttggtgaaatatgtgtatgcatgtaatttgaggagaaaacacaagggaaattgacgcagtcaaacccaatgaggggtcagtcgaaccaccaattcggctgaaccacctctaccatgaatcgtcctctgttttatacaaagcgcaggtttgcacaatttttcctttggacatccattttatcttgagatcaatttgattatcaattctaaaatgtcgaagataattgaacccaagctagggatggtacaattagagttcatggtctccctgaaaataacaaaatgaacctccgcgcattcaggacgcatttacacagattggagggcccatatgtcaaccaaaaccacttagaatcgggccaaaacattgtgcaagatgttggcggcccaataagctatctaccggccaaatgagaggccgggaggtcggatttttggttcggc

SEQ ID NO: 82364 - DNA, 2422 bp, Oryza sativa
ctgcagcccccttgaagcatcggtaagctaccttaattcagattaggacaatgcagtgtaaatgtgtaattaactgaattttcaatactgtttttagtagcttactgaactgagaccgctgactttgcatcagtgcaacacaaaatttatttagtactggatgtttcagactttcaggtttggatacgtggaattaatttcagggtctcccatttgtttcggcctttctgggaagcgaagtgatcgaaatgaatgcagcgtgcgtgtcctactgcttagcttagagatcaggataagattagctgggatgtaacatctcgccgtagctgttgcttgccagtactgtaggcgggctcgtctgctgaaatagctgcatttttcgacctgatttggtgatacgtagtacgtgcttccagctcctgttgaattcaaccaagaattcgcgttaggtgattggtagtaatagtagtactttggtgacggattaaaccaaaccagggattggcgacgaggcaacatcatcacggcaatacgaaacgattttggcactgtttgattgcgacactctgtcatgtcttgtactcttgtatgcttaagaacggccagttcggacagtagtaccagtactcctgtatcgacgctttagccataacaaaactacactttcaaataggggacacaaattttgtccgctgctcaaattatggccaaaattcgtatctgccgcggatatttgaggcaagctcgtagcggggcccactgctcatggagtccagttcacacctcaaaaggctttgcaaccaagaggggcctaaaagcgagaggttacgaaaaaccaggggtgtaaatgcacaaaagccacctaaagcccccccaaccaccctggcattcgtgtctcgctgcgcttacactccccttctccttcctccagatccggccactcccctcccctccccctcctcgactcgcctcgccgctcgcctccgggctcgaaaccctaggtttggtcgctcggggtgtagtgggtgggggcgggggggaaatggaggcggcgctggaggcggcgcgcgccaaggacacgaaggagcggctggccggggtggagcggctgcacgaggcgctggacgcggcggcgcggcagcgcgggctgacggcgggggaggtgacggcgctggtggacacctgcatggatctgatacgggacgccaacttccgggtcgcgcagggcggcctgcaggcgctctccgccgccgccgtcgtcgccggggaccactttaagatccacctgaacgcgctcgtcccggccgccgtcgagcgcctcggggacggcaagcagcccgtccgcgaggccgcccggcagctcctcatcaccctcatggaggtccgctcctgttgcttgcaatctcattggttgtttttttttcgttctgtttgggagctggatggagctgcaaatacgagttagtgttagataaggagcaggcttggcatcttgtgggcttgtttttgagtagttcgattcgtttattggggatgttgagctgcacagccgaacttaaatgagaaaactaaaattgtccggcacattacaataaattgataggccctaataccaaaattgatcaaaacactaaatatgattttcagggagcacttgtttaccgggtttgatgttaaaatgtgggatacaagtgaactttgaaacttcttccatgcatgtagtggcttgacctttattcggagcagatgatttaactttcaaatactcatattcaaagatatttcttttgcccttttgtgctgatatatatatattttttggtgttatagtgtaaatatatgatagcttttctcttttacttgtcaatgttgatttatatatactaaacgtgctatcatttttagacctttttttttttttacttttctacattcatcctatgatttgaaaggaccaatccaaacatgtttgtcttattatcagggttttggattattggcagctaaccttttaatctatctgtatctcaggtttcttcgccgacaatcatagttgaaagagctggaagttatgcatggactcacaagagttggagggtccgggaagagtttgtacgtacagtggcaaccgcggttgggctttttgcttcaaccgagctcccattgcaacgagttcttctttcacctgtaagtctaggcttcatttagtaatttctcctgtggagagctcctactttatttctttaatagatgggcttgctaagattttctggctttccaggtcttgcaattgatgaatgattcaaatcaaagtgttcgagatgctgctatctattgcattgaggtcagctgacgtcaaactaaatgattcagctaatgcttttcatatttttctacttatctagctctcaggggctgcagg

SEQ ID NO: 82365 - DNA, 10248 bp, Oryza sativa
ataggtgaattcactacggggaaacggtgaacagccccattgccatctctactccccctcaaaaggagcacgaatctgcacggcccacacagccagccgctgccgcctgtcgccgccaccaccacaccaccgcctcgttgctgccgtcaccaacccaccaccagaaaaaaaaaccatcgcgcctcgtcttttcctccatttcgtgcgtgagcgtgaccttggttgccgcgtacaccaccaccgcctcgcacttttccgccatttgtccgactccacccgcggcttatccctccttttttttttctttttcccttgctctcctccgctgtttgcttccccgcctcgtcttctcggttttttccgtgcggtcgaagcatcggttccttataccatacctttgcccccgttcttgattcggttcttgccaacagctttgtaacttctcgggcgcctcattggagtttctttgtgagattcgcaagggggagaggaggagtcctttggtcaagcccctgtttctccatttctggttctctgtccgtgcagatttgctgaggaagtagttcttgggttcatcagggagcgagaggtgcgggatttgaaggggaagccgcggggcggccgggcctgggcgccggggcccatggggaagccggcggcagccaagaagccgccggcgagcgcggcggtcgacggcgacgaggaggtgttcctggagctgtcgcgggagctcaaggaggagggcggcaggctgttcaaccggagggactacgagggcgccgccttcaagtacgacaaggcggtccagctcctccccagcggcggccatgccgacgcggcggcacacctccggacctgcgtcgcgcagtgctacatgcggatggcccccgccgagcaccaccgcgccatccacgagtgcaacctcgcgctggaggcggcgcccaggtacagcagggcgctgctgcggcgggccgcctgcttccaggcgctggaccggccggacctggcttgggaggacgtccggaccgtgcttgcctgggagccggctaaccgcgccgcgcgggagatctccgacaaggtcagggcggcattggaggagaagggcgttcttgtcttggagaaggaacccgtgccgccgccgccggagcacaaggctgttagtgcgaagggacaggggaagttgaagaaatctcataaacagtgtgattctgctattgaggggcaggagctgattcatgtcgaagattatgagcaaagtgagaaaacagagctgaagattaatggtcaggagaatggagaaaatcgtgccgggaaggagcaatttgattgtaatgtacctgtcaagcaagaaattcgaaccgaccagccggaagcaaatggagtaggaaaacatcaatatcatatggacgataaggaaaacaagggtttagataaggaaggaaagaatggcaaaccagggaagcacagtgcaggaaagaaaattaggcgtgctgacgccaagaagcaaaagcattccgctatggagccagtgcatcatgctgaggaaaatcgtcatgagcgttacacggagaccagtgtccatgtcaaggaagcaatgaaggatctgaagctggtctttggggaggacattagatgtgctcaaatgccagctaactgcaatctgtcacaattgagagacatagttcaaaacaagtttccatcgttgaaagcgttgcttattaaatataaggacaaggaaggtgacttggtgacgatcacttcatcggatgagcttagatgggcctacagcttggcagatctggaagggccaattcgactgtacattgtagcggttgatcctgcacaagagctaggtgtggatgtggtcaggagacgctcttcatttgcctcattagagaaagcttattatagcatgtcggagaatgggagcagtaggcatgatgatgatcacaactgctctattgatgactggatgatacaatttgctcggctattcaagaaccatcttggttttgattccgactcgtatttggatctccacgaccttggcatgagattgtactatgaagctatggaagacactgttgcaagtgaagaagcacaggaaatatttcaagttgcagagctaaaattccaggaaatggcagcattggctctgttcaactggggcaatgttcacatggcttctgcgagaaaaaggcctcccttgtcagacgatgcttcaatggaatgtatacttgagcaggttaaggttgcttatgaatgggcttgtgcggaatatgccaaagcgggcgcgaagtatggagaagctgtgaaaacaaaaccagatttttttgaaggtcttattgcacttgggcagcagcagtttgagcaggccaagctctgttggtattatgctcttgcatgtaagatagacatgggaactgaggttttgggattatttaaccatgcagaggataatatggaaaagggaatggggatgtgggagggaatggaaaatacacgcttgagggggctctcaaaaccaagtaaggagaagatcatatttgagaagatgggcatagatgggtacatgaaggatatgtcttccgatgaagcatttgaacaggcttctagtatccgatcgcatgtaaatattttgtggggcaccattctttatgaacgttctgtagtggaatttatcttgggacttcctagttgggaggagtctctaacggttgctatagaaaaatttaagactggaggtgcttctcccgcagacatcaatgtgatggtaaaaaaccattctgctaatgaaactactcaagaaggttagaataactttcctgcagcattttgtttgcaatttctcagtttgctttatattgtttatttgcccaatttttttgttctattttgcaacttcgaaaagcaagatgcaatttttttaacacttagagccctctattaggacaaggtcgttctcctatatagataaagaaatatggtatgccgtatgcttaataaatgttgatgtaccagtatttagctgctaactagtagccgctgtgataagcttcagatttcgtgtgaactgtgtatagaacattgtgttttttgtgtgtgccgatcctaagaacatagttttgataccaagttcttacaagatttacctcttttatatttaggactgagttttaaggttgaagaaatagttcaagcatggaatgaaatgtatgatgcaaagaagtggagaaatggagtgccatctttccgacttgagccaatattccgacgtagagctccaaagttgcatcatatgctggagcatatacactatgcttgaccctctaatatatataagaggctctggtttgtcatcatggagaagttatttcatgattttatcaggtaatgtcttgccttgcaaatattatcggcattgacaggctgcaaacagagcttcaccaaggccaattataccagaaaatttatgatgatgtccctctttttagataattggtcctggtttgaagtaatttagtatcttagactacttttcatgtcaaggtgaaaactaaaaatattagcttagaacaagtaagcgggaaaaaatgtctatccttatgtacctggaaattgacttgttatcagttggtgtccaggatttttacttcaacctgtacttttatccttgtgaattggttaaaacttactttgatagaataatagaaaataaatgtctaataatttgttaaatgaggaatgcaagtgccaaagtatgatatattaaagcactcatgttctacaactactacatcttgtgtgtgtgtgtgtctcccttctctcagaaagcacagtccgtttacacaacattacagcttcacctaatacaccatctgtgaaatacaaatgcagggcactagggtatcaagggatcttatactcagttgtttttatctgttactcctacagctgttgaactaaaggagctaacggtagtcagccacccctcaggtgttgattgaatgtactgaaactagattgttgtcatattttgtcgaatttcaatcatcagactattagtgacaaagtaaatccttagctgtgaagtcatggatatttgcatccagtaacatgacctaatggaggaatactttagaaaaggtccaacatatgcattaaaattccaacataacttgcatacagtgacaactaggaaaaactcctccagattacacctctaccaggtgctctttttcttcatatcaggagaaaaaaaacatgaacaaagaagaatttggaatattatttgcactgttatataatatattttctgcatgatatggcattataaatgattttgttttttttcgaggaaacgattgcaattttttgaagatgtaaaaaaccaatttatacataactattttttaggtctctaatttttctttttattaggaatacaaatttaacctgattggtttgaaggaccactagcttatattgtacaatattgcactcaatgtaatctcatccgctttaattgcttttgctcctgatctacactgtgagatagcattaacttgtctaatttctatgcagttcttctacatagtaatataatttgtattgaaatacagttgtaatttctggagaatgattatgcttgtcactaaacatttaattgaatattttgcggaactgtaacattaggaaatatagccctctgtcattaggagaaatacagtgaccaacaaatgatacaggcagtagtcatttttgtttccttactgctattgtttactgtctctgcttacatatctccatgtgcaataccagtattttatccccttggatcctattttatttttctgaccttctctctaatggttgcaggtttgtttattctgggagctgtactgcacttactcgtcccgccaaaagaaaaaaatataagaaaaagaggaaaagaaaaggaaatattctcttcaacttcaagctacagattggttgagagtagtgtgtaggggtttcctcaactgaaaagacaaaaagaaagtgctaacaatgtggcttgcgtttgctgttatatttggtgcttcacgcaaccttctgcttgatgctatatttcctttcaagagatactgtggatattttgatgttgcacttcctcatatttcagtcatggaagtgcttcaagttgttaggtcatcataggaaatttctgaggatacactaattgtatttcacttgtgtagaagatcaccccagctgtgttttacacttttactccaggtcacacatgaagaaagctgaatacagttcgtgtaacatgtagctgaagtagcaggcacagaatgcttgtagtctaattgtgtgaaacagatgcttttattgaagaagttatcagatactagtgattgttggtcattcagtttgttgcctactcgggatcggctttcatgaaatgaggtttgaagaatacttcgttcataaaacctcgaggggtttttggatttctcatttttcacaattgtttttcttctcagggaacggatttctcattgttcgcaattctttttctccgtaggaacctaatgggtgtcaggatattttgtaaaaaaactcatcatttaatatttgggttaattagattcatgccattataaatttgctagttttataaaatgccattactatttacctatttggatctatgccattacaatctcatacctattcaaaataggttaattggattcatgctattggaaattttatggttttgaaatataccattattatttacttatttggagtcacgccattgtaatttggagtagaaatttacgaaatgccactacataccccttccatgcacttaaatatatttttggaccaaattgcccatcgtcttcttcctccatcccacttctctctctgttgggttacacgtaggctacgatagcataaatcaaaatttttctaccgcgtaaaccaggaaccatgcaagtattagatcatagatcgttatcactcgacgctaggggtgggcaaaataagaccgaaccgaagaaccgaaccgaaaagaccgagaccgagaccaaaaagaccgagaccgagaaattcgggtagtaattcggtctcagcatgtcaaagaccaaaatttgttcaggtaattcggttattgggctcggttaaccgaattaaccgagaaaaccgaattgtggcccaatagatccaggaggcccaataagcctaatacaccactgaaccctagaggccaccctcatccatccaggctgcatccccatcccatccctatcgcgccgcactaccaccgctgcctccatcgcgtcgcgccgccgcctccacatcgccggcaccgtctccgccctccacctccactccacctcgccggtcgcaccgggctgccggccgctggatccatcgcgccgcgccaccacctccgccctccgccctccatatcgccggcgccgtctccgcctccacgcctcctcgccggtcacgcgggccgccggccgccgggtccatcgtgccgcgctgccacctccgccctccgcctccacgccgtctcgccggtagcgtgggccgccggccgccagatccatcgggccgcaccgccacctccgcccttcgcctccacatcgccggcgtcgtctccgccctctgcctccacgctgcctcgccggtcgcgcgggccaccggccaccagatccattgcaccgtgccgccacctccgccctccgcctccacatctcaccggcgtcgtctccgcactccgcctcggctcctccaaattcggtctgaccgagaccgagacaaaaaaaccgagaccgaattcatcggtcctgatttttttgggacgaaatttggtcctgacttttcaaaaaccgaagactgagaccgaaattttcgggtagaccgaacgcccacccctactcaacgcgctgtgcagcggaagtaagtgctaagtagccgaaggaacgtcggggacataggacgcatcggtatagaggaagtagtcgatcgcagcaactcgacattctcctcctcgtgtgttctcctcaccgtgctctcacaccgatcagtaccgcaaaccagcggcacctctaccagtatccacacgtacagggatgaaacgccacgcgcagacatgctagcgtctgcgtgcggcaagggttttgctcgggggaggggagtggcagttagggtttctcacgtgatgcaataccaccgccggtcacacccctcacgaatatataggagatagatagtcgggtcatcgctggatccaatgctaggtctagcaccaaatacagagatagataggaggaaggggaacgaagagagaaggggatggaggaagatggggtcaatttggtccgaaaacaaacaaatttcagtgcatggaaggagtaagcagtggcacatctcacatattagttagtaaagggatgaaaacggagcggatagattccaacccctccggacaaaaacggatacggatacctttcggatcggataattctcggatagtttggatacggatatgaatacgtatactttctcctggatacgaatatgcatatggtatcggggtttccgtcaaatacagataataattcggatatccgatgaacaatgctattaggatatccgtataagccatgagacatactacatttctttctaactctataaccttcaatatacctttatagattttaatagtagtttatctcataacactagtccatactattaatattatttaaaattttaaaaatatttataaattatacttcattttatataaaatgagctaattatatatgttgatatttgtttctattagaagttgaattggttttcgtgttccgagaaaaaattgtttctgtattcgtgtccgatcatattcgattcttattcgtatgtgagataatccgtatttgtttccgtattcgagctatccgtattcgttttcgtatccggtaaaaaaatatgaaaacaaatatggtatgagtattatttgtccgtatccgctccgtttttattcctaaattgtaatggcatgaatctaaatagaaaaatagtagtggcatatttcaaaactgtaaaaaatataatggcatagatccaattaaccctttgttaaatggttggcatgaataaagtggtagatgtccgtgtaaaattccattatttaaaggaaagatgtctgaagttctgctctatttccttaacacttgaaactggacagtatttcaacaccaatccacagtaacagtatttggctgtgtcttataataaagattccattgtctaaaaaatccagagtgtcagccggaatcgtagcttcttgttacgtaggcaatttagattcaacacttccaagaatagtctttcatctgtaggctgtagccttttttcttctcttgtattttgatattttgtttcttttgctcccttcatcgaaaatagaaggtgttctcgtattgttctgttcttccaaaaaagaacctagtgcaaaaatgaacgagtaagattgtgattgatgtttctcaaaaaaaaaaaaagattctgagttttttttccagaataacatcaatcaatagagaggacaagcatacattgtaattctgaagcacaagtaaagtttgaaaaccagtttatctgtgtacaaaaggatacctggtgtaaaggctatacgatatgcgaacataagctcacttatttcttcgtcagagcaattctgtgaaaagaaatcctcctcgtcgccatccacccacaaatgtaagtttcttcgaagtctaagcatatctcggcacagtacgtttagttctttgctgcaattatagagttccatgtccttgagcgaagctgggagaccccctaccggcagggaagtaatatgtccacagttgccaacatgtagtctctgcagggatgcaagggatccaagttctgcaggcagtgaccggagttgctcaaggttttccagatcaagaaatctcaagcaggtgagaaatgacagtcctttgacatggttgtctgtcaaaaactccacatgaccatctggatcgtgacgatcctcttcaatggataatatcttgagagaagttaactggctgcatatgggcacacaaaggacatcaatgttatcaacgttgagcttttcaagtggtagtgagaaattcttctcctcgatattaacttcagctgctgctgatatccatctcgttatgaacccaggagacgcttcaactttcaagatctcaagagaaacaagggatttcaaaccttcccatgatgtcagtgccgggcagtctttgatgcatagtttctgcaatgatgtgcatgatttcagttccagagatgctagatttgtgttattctctatgctcagtgttttcagggtgtggagtgatgcgctgagcgaaggcagcaatgcacagtttcgaattttcaaatccctcagtgctgagcatgacggcaaaccttcaattgactgtaacaaacggcaatctataacacacaacttttctagcgcggtacaagaactcaggtcgagacatgccaacttcgggcatccagacacatctaaatccgcgatggaagagacatctgagaactgcagagtgctgtcttggataccagtcatgcagagtttatccaaagatgatggagatatatgagatgctcctcctgaaagcgctctagatagcagagtagggcaattttctataacaattttcttaagagatacaaatcttcctaggcctttcttgctcgtaaagtgcataattgaatttgcatcagatggagctgttgtgaaagagatttgcaaactttccagactcgtgaagcatctgggaggaatgtgccatgagccttctgacattgtgttctgttcatctgtaaacaaccctacaggtaaggatgttaccccttggcaattagttaacttgaaactcttaagtaaatgaaggttcacgaggagttgtgatagttgtatcaatgtaatgttgcatccactcaactcaagttcctcaactgacggaggcagaaatagctcaaagttggtagaaaatatttctgggcacttgatcactctaaactttttcaatgatgtcaactgttcgaagccttcccagaattgacgttggaatatcactgattgatagtcccggatttcaagttcccgcagatccttgagtttctctaatgtgaacaatctttcct

SEQ ID NO: 82366 - DNA, 5286 bp, Oryza sativa
aaattacacatatagatatagtcttaaaaataactaattacacatattgcgactaatttgcgagacaaatcttttaagtctaattgcttcatgatttgacaatataatgctacattaaacatttactaatgatagattaattaagcttaataaattcgtcacgcgatttactgacggattctgcaattagtttttttattagtgtccaaacaccaaatgtgacactatatataatatctgatgtgacacatcaaaactttacaccgctatatggctgtatctaaacaccccctcaattgatcatgatatctttgaaaacctagcctcatatgagtagtaccattatgacattatttttgcatgagcaggcagcctggcacgcctggaaatggctcatgagtcatgactaacctgtgtgtcatgctgctacacacgaaagctgccggttcagggttacatagattgccggtttgcggacgctctctcggctcgtcagaaatgtcaggcatctcacctgtggagtctgcctcgcaagttcagctttacgtaaatctacaaacagtgagccacgtcacatgtgcctcagtccctcagtgacccggcctagtgtaattagtgaaacctatattacctaaaagactttagacagcttgatcatcctaaacttttcttttgacattttaaatactactccctgcttaggagaagctcgtccaactatccaagcactcgctagtgcttaggttcaaattttactcggagaaatatggacaattgtaggcaaacgcaagtactaggaaaggaatatctctttcacgggaggacgagacgttaaatcgtcggtattcgtggtgcagaggtaccagaatctgtcatcgtcgtacatccgccggaacgatggacgtttcttggcaagttaacccggggcggtgagaaattccttctgatcgtatctccccaaacaccaacacgccccctccccgtgccgcgcaccgacagcgtccacgcgtggaaaagaacaagagaagacgagcagcgcagcggcgaggcgacggagaggcacgtgacgagacaccgcgaggagtatagtaccccctgcaccagcagcccacaggcaggcaggcatgcggccgcagcgcatgcaggcagcgtggtcgatctgcccaacctgtcgcggtgtcgctcggctcgccgggccggcgtccgcttccgcgtccgcgtcatcagcctcagcgcgcgtaaaaaaacaccagaattcgccgtgcgcccgtgtgctcgtgcagctgtggtggtgtgccgcgcgggttggctaccggcgagggagctgggacctgggaggcggggggtggatggggatctcgatgagcggggagtacgtacggctccggcctaactcgcccgtttgctcgcagccacacttgggcgtacgacgtccgcgggaccgcgcgaccgctgcctgcatggctggctgttctcatgctgtgcagtgcacgctgtacagtgctaaccgcgggcgggcacagaccccagacaggcgcgcagtggcgtcccgatcgaatatcgatcgcccgagcccccacacctcccgtgaacgcaccacaccaaagctgaggccagaggccagagccgagggtaggacgaaaaccaaacaaacgcccgttgaggcccgtctgatcaacggtgtaatcgcttgcaatgtgtcaaaactcgaaagggagggtgcaacgagcgaagagttactgtaactgccggtccagagaaagcagtccgatggatcaatctgttcgcggtcaacgtgctttacgtcacgcctgtacgaacagttggtgcgttacgacttgactacggattaccgagatgcttgttttccaaagctccaataaataacggccgtgttattacgtgggacttttgaaattgaatctcggtttgccttccctgtcacaaaacagagaaacttcggttctcctccgtaaagaaaaccacgcgtacaagcgtacaacaaatgaataaatctctgcacatttacacggtactcctactccgtactactactacgactggaaggtagcagtgccacggattagccgaagaaagaaggaacacacatggcgtgttgtgcagccgccgctgcttcccgttcttttcagttcagttaattactcccccacttctcatcatcccatgtccactttctttcttttttttctctcttgcacgcacgcacgcacgcaacccacgcgcggagtggcggtggatggatggaacgcgtgactgcgtgagaaggtcaagagcaaacaagaacacgcacagtttcacgaaggcgggtcggggttaaatcatcccaccaacaccaaccaaaccaaccaaccaacctccccacaccgccgccgtcgcgtagcgcccgcccacccccgcgctcgccgccggcgggcgaacgctcgccatccgcccgcatcgccataggtgcgcgcctcccgattcccatccttttttctctctcccaccattcccggaattaatgcacggatgatggatgagttgcgtgcctcctatccgatgtttttcgtttttcttgccttctccgttagatcttcctcttttcatttcttctcgtttcagctccgctccgcaaaaccctgatgatggttgtcctcgaccacccattgcgtgcggcatttgatccgggcgattttttctttccttttttttttctttaggcgaggtggtgtgtgttcgtggaaatcccggtggccgtgcgggaggggcgcgcgtgaagatctgagctcgggtttatgtgatatccctcggaccgaaattcccatcgatgatggcgtaaaggcggcgccttttctctgcagttcctcccctcccgtccctttccgctcccgcgcccgagaatttattgctcgcaatgctgccctctctgatgatgagcagagcaaaggatgcagagcctttacactttaaatgcttggtcggtttggctgcaagatgccatattgccatctcatgcgtaccaccgccatccgtccgtcactgagctcctgcttgcgtagtgacgagcgttctggtttcgctcagctcgtctcgatttcacacggattggaattcggccgcattccgcgtggaaagcttcgagttcttggtgcttcttgttctccgctgcgaaaaccgcagctttagtaagagctcatcagatttcctcttttattttttttattttttctgtcttttgctttcggtttcagggatcgtttggggttcagggcgtacgttacgtctcgttcttctcattcctttctacgttgtcgttatacttctcctcctctccccctgctaatctgccatcaggaatacctggcgtcctcttcttttcattctaccgatgttctgatgaaaactgcaagattccctttgaggtccagcccgtacgatctcgttgctctggatagttttctattatatgtttcttattttgttcttttgaattctgaattcttgaaactagatgagcttgaagttaacagctcgaattttgatttccatggagtagaaagccgtgcttctttggccttctctctcctgccagctgtggagctgtgcacttgttttgttcatgatagctgaactatctgactgaggaaagtgcagcctttaaaagcctttgttactgcaaagattccttttgatggtaatcatggatttgtaatcctctccatccaattggaatagtgcatctgcttttatgtttacctcctgttggctgctactataccacattctactttttcatcttgcctggtgttgctcagtccccatcgtatcttttcgtcggacgtgccattctccttttcttttggttttaaatagaacagggccatgaactgtactctccttgcatcaaattgggcctactaatgcctgcaaaaatccagcctttgcatgtgtgtgttgatgttttcctggaaggacagcatcttgctacagtgtacagtaaattagtaagctcgtctgaccttatatggcccatacccacagtttcaaatttaagggttcaatactgagggctttgcaagagagcattatatgctttgctgcactaggttgttcgctcgccagtttcttaccagctacctgtaattctattgtgatttaattggctacatcagcttttggatcacgggtacaaggttggttttgtaatgttccatactcgctgttccatttgaatgaatttcttgtcataactgtcttttcaggattcatcaatgttgttatcctctgaggcttcctttgtaataagaaggcagtgatcaatttgtttgacctgagtaccgggatgaccagcaaaaatgtgctaactgatagaactcacagagatggtacaaaaatttcttccactttttctttgaagtgctgcttaagcaagtgatctgcaactcctgattttgctttttttcgccgggtcggcaactcctgattttgctttcataatgcatatgaatttatactttagagttacttgtgatagacgggctagatggcattggcattgtttgaataatgattcatttgcataatgttagatggtggtctccctttagacaatgtcatgtttgattgtttgtagatgatgacacatttgtcttttctttctggatgttttcctcttcttggattcgaaaataattcaaaagagctcttgctatttttgttgcaagacactgaccttaaaaatcaaactgactgtgttctttatttgttagtttgtattgatagacataagtgttttctgcctaatgttaattgttcagcttgcatctttcaggctctcgagttcataaaagccggcaagatgtcaatagaactgttgatcccaaaataggttgtgtagaggacaaattagtgagtatcatgtcatttgccctattctagcatatgtaatttcaatttatcgtaggtgtcagattgtccttctaaatatatatctggacagcacttacacaattttgtaaatttcagaaagtatgtcttcatttttttttctaatatagtattcattgcagcaggtagtagctagtactaggaattcttcaagcaacaaatcaaccatatctccaatgaacagattagtagcaatggagatgtccaaaggagtggaatcaaagaggaagccacctagtgtcgttgccagactaatggggcttgatgatgatctacctgctaaagaaccagcattacaatcttctagaagaaatttgcggagaagtcattcacttgata

SEQ ID NO: 82367 - DNA, 854 bp, Oryza sativa
caaagcccacaaaattgccgcaatgcccatataaatttgtcttttaagtctaggttcaaaaccattcaaccaatttccaaacatatgagccatgctacggggttggctaattccgaaagtaaagaaacatgcactccaaatgtaccttgccatgagacagtcaaagaaaagatggtgcatcgactctttagagttacaaaagcagcaacttagactacctctccatcttctcttagctaggttatcctttgttagaataaccccttctttaagataccacaagaatattttaatttcagtggaattctgagcttccaaatcaaagtctttctaggtatcactccattatacataagcaccttgtacatggagttaaccataaagagctcatccttgtttgctttccaaataaattgatccttttgatcagacatagtgacattcactgctttggaaactaaattataccaatcttgcaaatttcttccagttattgctcttctaaaggccaccttcaacggagttcttcccaaaacctctgccactactgcattcttattcctaaccaaattatacagattagggtattctttctcaagaggttgacttcctatccaacaatcctcccaaaatcgtacttgtttgccatcacacgttttaaaataaccaagtgattgaaaggattctttagctgtcataagactagcccaaaaatgagaatctcctggatgtttttgtacttgcataatggttttttttttgccagatacttcctcctaagcatattttgccacagtccatcctcattgattagtttaaataaccatgtacttaacatacacctattttggatt

SEQ ID NO: 82368 - DNA, 557 bp, Oryza sativa
agagctgtagctagctatagcattctctctctaggatatagagagagaatacaagggaatgagaaggagaaggagaagagagggagtgtagaagaagggggaaggaggcaggagtccctttccccgctccgcttggctttttgcctaccctcctcttcctctacacctcatactcctagctctctacctctctagctagctagctataggtagctagctagtcctcctgctacctaggggggcgacgccgccggacggggaggaggccatggcgttccacggtcacctcccgcacgagatgaccatgcaggcgctcggcgcggacgacgcggcggtggcggcggcggcggcggcgggtggggtcggggcaggcggggcgccggcgtggatgaggtacaacgacgggagcttcctgcacctgcagaccacgtcggactcgtcggcgtcgccgtctggcgctgcggctgcggcggcggctgcggcggcggcggcggcggccggggtgcagcagtggatgggtggaggcggcggcggcgaggacgcggtggcggccgcga

SEQ ID NO: 82369 - DNA, 571 bp, Oryza sativa
atatatatatatatatatatatatatatatatatttcctttatatgataattgtcggtgatatgggcccgggggtatcaggtttagagggaggaggctgccccccgatgccacgtggccctccccggagaggagtcagacccgaggtggcgtggcggccactccttcccaaagactagtcggaggaggctgccccccgatgcacgtggccctcccccgagggggggagtcaggctcgaggtagggcggcggctactccttcccagagactggatggaggaggctgtcccccgatgccacgtggccctcccccgagggggagagtcaggcccgaggtagggtggcggccactccttcccagagactgtatggaggaggctgccccccgatgccacgtggccctcccccgaggggagtcaggcccgaggtggggcggcggccactccctggccgagactagagggagaaggctgctccaggcgtcacgtggccctccccctgagaggggatcgggcccgaggtcgggcggcggccgccccctctcgtgactaggggtcgggctcccccgaccc

SEQ ID NO: 82370 - DNA, 14981 bp, Oryza sativa
ttacactcacggaggcacaatgacaataggcccaccggccactcattctgtcatccaccgccactcatgttttcaaccagctagatgttacttacacctcaatttggccactatgttctgcaaactttgatggttcgtttaatttacctcttggcccttaatcttaacataaatcgtctaagttgaaaacaaagatcgtctagccatttctctgtgactaccagcggaagacatgacaagagagcaaaaatgtaggttagacaaggacctgcagagatattggggacagaacgtgctgagagctttctcctgtcagttcatcacttgtgatgcatgcactgaactctttaattagaagctaataatgtcagcaaggttgggtcttaattctaaaaataaaagaaaatcagaggaaaaaaaataacgtcagtacaaggtacaagttcaaagaactgcatgtgctccagtattaattattcctttgtatgattcattaagattgtacgacagagggaggacaccatcgttgtattgcacaggaggaagtggagactggaaagtaggagagccatgcatatatggcaatttggaaaccctggagctcagctcgcagcctcaccgtgtgacctcatgatgcttatcatactggtcatgtatacttaattaagctccaattattacgaaactgatctaatgcatgcaacccttatcccccaccctaataaacatattaaagcctgagattagcagccttaagaaatactgctgcaacagccacatgagtccaaagaggtgacaaaaaaaaaactaactccaattccataaagtgagataccatttcggcatttcccaatatggcaagctgcaaatctttgtagagaagaggcgtataaaatactcaccagcgagcgaatcgagctgcgtctccaccctgctgaagaactccgcggcttccaggatcggccgctccagctcctccctgtacctcgtcagcatgctgcagtacgcgtcctgtgatgacaagatcagatcccatgtcgatcgatcagaagaacagtggatatatatgtgtgtgtgtctgtctatatatatgcacgcatgcgagcaaaggagttgatgatctatatatgttgataccatgaactgatcgagctgatccgggtcgtcatcacgctgtggctcgtgccggcgacgagggtggccgtcggcttcgtccagctgctgcgccgccggcacagccgtgagcttggtcagtacatccggcggcgccccgacctgataaaaaaaccaacaaaatcaacttggtcagtacatccggcacggccgtgagcttggtcagcacatggcgtgttgtcgtctgtatctgcatgggtttaaatatatgcatctgctagcttagctactacacctttttgcagcctaagtaggcggctaggagagccgagtactgtggatgcgacatgatctcggccttgaccgccgcctccgcgcctgccggcgagacctgtccctgcacagctgctgctgctgcttcgccgccaccgccgccgtggtgatgcccatcatgcccatgctgccgcgccgacgactccgggccggcgagcagctggtacagcaacgggggcggcgagatgtggtccgggttctccggcgagatcagctccggcaaccgagctgtggtgctgctgctgccacctcctgcgagactggcgaagctctccatggccgacaggacaggtgaggtgaagaagaggcgatagatagtagttatggcaaacaaaccctagcaaagaaaaggaggagatgatctcctgaaatgaggtggtggtggttgagatggatggatgcagggaatgtgaagaggagaggaagctagaaagaagatgaatatgatggtactcctcctagtatacgtatggcccatcttagctttgttctaacgtcaaaatcagagcgagaaattaatgaagaggttaggctattcagtgtttgcaagcagcagcagcagcagcaacagtgaaactactgcaaaacacatgagaaaggagggaataattatactcctgggctaaagcgtagacagagcaatgacggcgaataaaaacagacggggggaaaaaggatctggacaacgtaacagcggcaggcgcagctgatacacatggcacatgcacctctcgtgtgggatgtttcctctcttctcttctcattcgaatactgttcgttttcagacagaaaacagagatattcatatgctggccagtattacgccgcagctcctttcgtctccaggtcgatcggcatgaagcagcagcagtactaagtactactacctccgtcccaaaataagtgcagttgtggatatccgtgcccaacgtttgaccgttcgtcttatttgaaaattttgtgaaaaatttaaaaatatttagtcacacataaagtactatttatgttttatcatctaatagtaataaaaatactaataaaaaaatttcaaataagacgaacggttaatacaaaactgcacttattttgggatggagggagggagttcgtatagcagcgtttgcagtacaaggcgtctcatgaacagcaacaggacagtggacgggacgtacgagagagctacagtctacagcagttgtgtgttagttccatgcgttgagcggtcgaggtccttaacttcttttcactaagatggaaagattctgggaaaagtaatgtgatggaactgtgcatcgatgtggccactctatattctatatagctagagatatctcctaacctcagatatcatatcagaaattcatctgtttagtactacctagtacatcgtcgttgtgctaatagcatcagatatatcagaagtacagtatacttacagtcatcgagacctcgagtagttagctccgatccttcctacgagctccggactgtgtgtgcgaagatcccgtgttttaagctcgtcctgtcaaatccacgtcgaaggatgcacaagtatacggatagttagtttccgctaattaggcagccacagacactccgccaggcatagcgcgcggcacagcacgtgggcgtgtttagagctataataactgcccatcttccagactctagagtaaacggaaacagtagcacaaacaggaaaatcttattaaaaaatagtgtaaatatgaacaatataagtcatgttttaaagttttttttaagttatagaacaaatcgcaataaaataaatgatatttattttgtgaataatacaaataaccagaaattataccaaaaatcaatgacatcgtttattaaaaaaagggagtattttgaaggttacaaaatgtaattttaccatacctctaagggggctgcaatacaacggaatcccgttgggacgggatgataccagttaggtatcaggtcctgatacctctgaggtatcatgtcctgatacctaacctttatcagacgatacttccgaggtatcaggtgatacctataagatatcaggcgattcctatcatgtatcatgtgatacttgcgaagtatcaggtgaaacctgtcaggtatcaggcgattcctaccatgtattaggtgatacttgcaaggtatcaggagccaggcactaaaagcgtcgtcgtcggtgatcccactgtccacgtattgtgccggagcttgtcgccggcggcggcatcctccacgatccacgccggagatcgtcgccggtgatcccaccgtccacgtctcgtgccagagcttgtcgccggcagcggcatcctccacggtccacgccggagatcgtcgccggcgcagccacatcctccgccatccacgttccacgtcggagctcgtcgccggtggccgcgtcctcctccgccacgccccacgccgggctcatcgttagcggccgcgtcctccaccatccatgcctcatgccggagctcgtcgccgaggccgcgtcctccaccgtccacatccccacatcatcatcaagcgttcgcatcggcgcggtcacaggcggtagcgacgagcaggcaatgaccgcgaccatgaagctatcatcagcagcagtgacgcacgcggaaaagacatggctcaaggagatagtgcaggaggaggcgataccgtcccacgcgctcgggacggtatatcccgtggtatagcatttcaacacctctaaacaccttaataaaggataaaaatgagtattgcatcaatgaatataaaggaatgtgtttatttaatttcagacttttgaaattgcattatacacgctattaattactacattcataaatatgacttttaaaataagatttttttggttaaactttcaaaacgttcaccatcaataacattttcaaataatccatttatataaagatagcaaaaaaaaggctacaccatgttttctctataggtagaaactttcacattaatcgaagaaaaagggtaaggcattacagtctatctaaattataatagcgtagattaattgatatagttgtatagaaaatatgattgtatttattaatacacttttattctatgtcaaaattattttcataaaaagaatgatggttaaagtttgacctaatcttagactaaatcaaatgagcggataggtagtgaatatactaattaaatagaaatacaatggacgcagacgcacgtctatttctaataaacctttatcctgggaacccatttctgatggaaattaaacgccacaggccacatgcatcatcgaacgtcgctattttgcatagccgccacagtcatcggataggtgatttaatcaccgagttgttttttgttgaaaagctgctcacataacgtctgtgcaggtggccttgtaaaatcaaatcagcgtacaagtattacctgagatatcttttggatattattggtagtagaatgtaattaatcaaagaatcttatctttaaaagtaaagatgggacaggaagacttgtcaccaatcatatcattttgagtacccatagactcagggtggatggatgcatggatgctcagttggctcactattttgctagtacacatctgtacatgcacggtgcaagttatatactcctatgctttacagtaagcttctaatttttaaatccaagagacattgctgagtacttgaacttacctcactgtttgcatacataaatattgcacctatctgttttgttctgcatgtagctagtttcttctgtattaaccaataaatactattttaccatgaagaaaacggtagaagaatcacaagaagaaaggaagcaacaactggaagagattgaaattttaaagaagtcaccaaaggagacaaatggccttcgtcgtttaattggcctcaatactccctcttttggtcagcctcagtaaggtttgtctatcctctaaatgtccccatgctgattcatgttaagatgactagttttgtggttggtgtgatctggacatgtgactttgttttggttagtgaatgtaaacgactatttggacatgtgacgtcattttggtcactagcgatggctggatttggtcgatgatgatatgcgcaatgtactgatgttgtatcgatgtaattgaacctgttttggtcaatgaacttgtgatgtttgtgttggctaatgaatctgtgcttatattagaacatgtgactgaatttggtcgttaattgggctataagatttgagatttcctggatgttagttgggttgtgtattggatgataattgggctaaaaattggctgataaggtggctgaatacgtgattgtataatgcttgggcctatgtgggcctttcgaattttctgggcccactcattagttgattccaatgcaaatgcatataaatacaagtgggatgaaaatattgtgtaatttgatgcgttttagatgggccaggcctaaatctaatcgggcttgtaactaggcatgacccataaacatgtggaaaaagtatacttcgactccctcaactatgacccgagtatgattcatgacctccaaccacaaaaccgggcatatcgactcctccaaccatcaaaaccagtgcaaactatgcccctgggtggttttggaggcggtttaggctgacgtggcgaccacgtggtggtgttgaccggtcttcgtccagcgtgtcgtcgacgtgtcgcttatctggcacaagagtaaacaaaaaaaacaaaaaattatgggaccgacatgtcattcacacaaaaaaaaaatagtgggccccacatgtcatcttttccacatgtgagctcccggccgtccgcatgctaggggaagagcttgccgtccgcgcgacggtggtggagctcccggccgtccgcacgccgggggaggagctcgtcagcgtccgcgcgcgggggaggagcaaccagccatccgcgcgccgggggaggagctcgccggcgtacgcgcgcgggaaggtgcaatcggccgtccgcacgccgggggaggagctcgccggtgtccacgcgcgggggaggagctctcggccctccgcgcgccaagggaggagctcgccggcgtccgcgtgcggggaggagctcccagcctttcgggtgccacgggaggagctcgctggcatccgcgcacgggggaggagctccggcctttcgcacgacgagggaggagctcgccggcgtccgcgcaacgggggaggagctcgccggcgtccgtgcttgagcaaggagctcccggccgtccgcgcacatggggaagagctcgccgccgtcttgccggtgcccgtcggcatctcgagcaacatgtggcagcgcgcgtcgagggcacgcttcagctcacccatgtaccgccgccgccgccgctgccgctccctaccgccacccccaccgccgcccgctgccactgccgcggccgctccccaccgaagagaaaggccaggggagagagagagaaggagagagagagaggaggggatgaaggaggaagaagggaaggagaaggaggatgacatgtaggtcccacaatactttatttgtgtgaatgacatatgggtcccacatatttctttttatttttttattctaatgccatgtaagagccacgtaggataaagactcggtcaagagcgccacgtaggcgccacgtcatccaaaaccacccaaggtattgtttgtaccggttttgatagttggaggagtcgatatacccgattttgtggttggaggacatgaatcatactcgggcgatagttgagggagtcaaagtatactttttcctaaacatgttgatcattgtatgggccttggcaggccacaagaaattgtgacgaaataaattgacaaaaaaactctgccatatcagctccacgtcatcgtgtgctaaaattttatgacgttttctatccgacatggcatctgtacactcatcaaagtttagtgagttataacgatttctgagctcaataatgacaaaaatgggcgtcatagactcaatgacgatagaaggatcgtcactagattagtgaaaaaaaaaacaagttttcatcataaaacttcattagagacgcatgataggtgacgaatgaattttcgtcacgcaagcatcacaaatttcaaatcatgacgtaaatttcagtttgtgacgtaagtgaaacgtcacctatcataagatttcttgtaaggtcatacacagtgcagatataagaagtggtcgagtgcctccagcttgtcatatcggtgcgatgatgctaggttggctaagtttgtgcaagcccttcggattcctcatgccctctgaagggtgcgggtgcccctacagaccgagcaaaggccaataccacgagccacgttgaccttggatgtaggagagagtagagaggggagagcgtgggatgttgccactaacaagctaaagcgcatctagcaagctagagcgcacctaccacgccatcccccaattcatgtcggctcgaagctcacgtcatggccgaatttgatagccactagctatagccaccctagagccgtggtcatcgatttgagaaggagagaaaatggatggccacgggaactagcgaggaaggactccccatggcataggaatccgcaagggcattcggcttcctcctcatcactgagcttgttcacacccttgttcactcggccaatgcaaggccagatagggagcatgcgactagaggtgaagaagagagcaatgttgacaagaaggggaggggagataggagccgatggagggtagggagtgacgaaggcaatgggaggagccgtcggtaaatggggatttcatggagtggctggggatgggtctagacaatatctacgagattaggtcaagggagctattttataatagtttctagttttaagggtgtttagtgtaaattttagtcgtaatcacacaaaatttgactaaaatagaaaatatgagaggttgacatgcaaaattgaaaacatgacttaattcagcaactttttcactataggagagaatgtgtagcctcaactttgagatccttattggagtggcttgtattatgaatggcctaataaagctagagtgagggatcagctacttatacgtattttgtctcatatgtgctattttatgtggcttcgtatattattagttcactcaaccatttaacatatatacataggagtaaaatatagatattatggtgagtagttatattaactggactggcccaataaggttacttagtagtacatccgttctaaaatgtagctttctagcacaggaccttgtcccaaaataaagtcatttctcaacctaccttctcctctcaaccaatcataaccattttctttcatctactactctgtcctaacaaaaaaagacaaactctagctccaacctggacacgcatgtgtgctaggattagacttttttggggacggagggggcactttctattcttaaccaatcacacactttctcaaatcattctcacatattttcttaatacccgtgccaacctaaaaaaatacttaaattttggcatgaaggaagtagtagatttatttaagatattaatgccagaactacttcctccatctttaaatgtaagcactttttagattgacacgagtattaagaaagtaggtgaaaataattgaaagaaatgtgtgattgattgagaggagaaagtagataaaatagaatgattgtgattggttgaaaggagaaggtatgtgaagaaatagttttatcttgggacaaagtattgtgctagaaatagttacattttaggatggaggtagtagcaaaatttcaataaagcagggatcagtgcaggagtagaaacgtatagtggtaactaaccagtgaggccccatgtatgcaagccagaagcttggagcggccacgggccacgtgcaagaacgtggccagtacattgtgcagcctccatcgacctggtgcttgtgtagttgtgtgcagcggcagcagcagcagcttccgcatgcatccggccatcctacttcctgctgacaagagaacatggaagcaataagtcagtgttccaactctggtaaatacaaatgcttcggccgtacactggcggtcagattaaacatgtaaggagcagaaactgggccttgcattgctgccattcatccacagccagaatatcagcccaacacaaactggtagtgcttccaaacatattgcgttgtatggagtagtcaggattcagcccagttaaaccatctggagcccatttatgcctttcaggagtgctgtccaggagtggacaccatctggagcccatttatgcctttcaggaatgctgtccaggagtggacttatctttctcatgttacagttttattccatataggatgagcccgttttcctatactagatgatatagcttttcaagatcctctcaaaaaaagatagcctctcaagaaaagattgacagctaaatgacaaacaaagcctaatcacacccaccattccaagttactttcagagaggtccttcagaatgtgaaatggttaatatataattacgtgtcaaagctcctgacccgtctgatcaatcttttgctcggatgtcactttctcgtgtccagacctccagatgacttcacttacaaacctgcagtcatatatagaaacaactttttacttccttagtcctcacacatgaatgatactaataccataagtaaatacagcaagaattcaaaccaacgaacaaaaggcgttgcagtttcaatgttaaactcaacagctggaagctcacagatttgtcaaaatacagtatatatcattcaaacggtcacttcaccggattattgcaataaatcagtaaacaagctattgaataggaaaggcataaatcagaggtagggattagtacaggatggcatggtacattaacctcgaatgctttccaaattcctaacaatataatgtacaacagttcaaaaacagaagaagcgtttgaccagatgacaaaggaaaaaacataaaaacaggatcaaacacctcccatcttataactcgagcaaggtggccacctggtgatctattgatatgtcaaattctttatcaattgaaatcatttatccatagagcaataccaagttattttccaaacatccaaatatggcttacaatgtaatatggcacaatgatgtaaattagctttggacctttatttatgatatataatcaatcagtaggaccaatttggtcttccacgtttcattaacatgaattatttttctaaaactaaagtataaataaatcatacaagagccacggtccaaactggaccaactaaaagatcagcatgaacaatgtaaagattgagtagaacagaacaagaataccaatacaacacaaattaacagaaaatctaccctgatgcaagccagcctacatcatccattacaccatagcattgacagtgactgaaggagtaaagggagcaaggaaggccaaatgccagatgccaatgactcgtttattcggtgagtatatttcaaagcacttggaaatcaagcaacttatttaattgacttactatccacaagtagctcaatcgagacacaaaaattatgttgaatatgatagtatgctcgctgggttggtatgcataaatggatggcaatcacacatcaaatggctactccaaaagatagcagaaaaatcccactccccttgaaaaaatagcacaaaggttttgcgacacaacagagcaaattatgaacagaacttctgcagcaggattaggatccagctagagaagaggtaatgtgaagaccaatcatgccacctgattgttgtacctgatattggaaacagggatatttttagaaaatgcaagcactgtacttgttgctagctagtctgtgctatgtaagttactatgcttctaccaaatattctaccaaactgatcaaagaaggatgggcagttgggcactacctttctttaagaaatgatgcttttatacgatgaaatgcatgcattttatttacaatgcatagttagatgggtgttctgagaatgttatttcactatttcagcatgtaatcttgcaaaacttatttcttctctcccataatggaaattaaaaatacattacattttgcaaaacaaaagattatatagtgtacatgggttgcacttccaagttatgatttttacactttattgaactggccactgtctggttgtctgcaatacagtatatatgtgtgcaagagtagtacacagcatgaaccaaaggaattggatcagacatgaaaacttgaagcatacggtgcacaaagaccaggtccaaggaagaggccagcaataagctgctgccttgctgatggccgcatgatggagattctaatccaagggaaacaacaattagaaagaaagcaacccagatcacaccaccacaaattaaaccgtattttattaccatcacacgcagcccccttttcccgtggcaataatacaatcctctattcctctctcatgtctgccttttgagcacataaacacaccaccctcgccatcatcatgcctaaccaagtttaggccctaatcaacgctttgctctgcacacctcgcaagagatcagagcccctgaaagctagaagaggagatagaggataacccacacgccatggggagagcgccgtgctgcgacaaggcgagcgtgaagaaggggccatggtcaccggaggaggacgcgaagctcaaatcctacatcgagcagaacggcaccggcggcaactggatcgccctgccccagaagatcggtatgtgttggcaattctcatgagtcatgagtcgatgtggtggttgtggcagcagcagcagcgatagtggtagaagaaagctaatcaagtgcatgtgtgtctttgttggtttgggtttgtacatgtaggtttgaaaaggtgcggcaagagctgccgcctccggtggctgaactacctccggccgaacatcaagcacggcgggttctcggaggaggaagacaggatcatcctcagcctctacatcagcataggaagcaggtatacttgctaattcagctgggcacacacaagtctagtcactcctatgatcaactcaactgtagaattagctgcgaaaccggtaggcaggcaggcaggttgcacatggggcatgagagtgtagtacaatctatgatctgacatgaccatatatgcatggcacaggtggtcgataatagcagcgcagctgccggggcggacggacaatgacatcaagaactattggaacacgaggctcaagaagaagctctttggcaagcagtcgcgcaaggatcagaggcagcagcagcacctggcgcgccaggcggcagcagctgccagcgacttgcagatcaaacaagaagcgagcaggggtgcaaacgaagccgatggcttggctgccggtgccaattacacttggcatcaccaccacgccatggccgtgcctgtgcacccgatgtcggcaccaatggtggtggaaggaggccgtgtgggagacgatgtcgatgagtcgatccggaagcttctgttcaagctcggagggaacccattcgcggcctcgccggcaccgccatgcatacctccaccaccaatgtacgaggaagccccaagcttcgtgccaccattggcgcacggcgtgccgctcaacgaaggcggcatgcagtgctccagcgtgctgccggcgctggagctggacgagaacttccacttcaaccatgtcaagctggacgggctcgagtgcctcttcgggatgggagatcaccaaaacatgagatggaatgaggtgagcccgttggtttgccctaataacgctgtggcgtccagctcccaagggatgcagcagtactgcctagttgaagaaccagctgacctcgggatgcagtagcaatttggttgtgtttccgtgtacatgcatgattgtgtggtgtaaatctgtagcattcatggggaaattaatggggaaagatgagatcaaacttctttgaactaagagcaataaggtcgagctctcaccactcctagatgagagataggtgcatgcctgattttccaggtgtcttcatgtgagtctagtctttaaatggtattttcctctactctcttactgccctacagaaacattttacattagactgtacgtgttgcatttatctgtcgcttaatttggtgtgttttggcgtatttaatttgtatcaagtgacaagtactgacctaaacttaagacttagggctatagctagaaatttgttttatgttcctaataccgtaccatagggcattatatcccctttttttaaagatcatgctatacgtacacacacttatctttaaaaaaaattctctaatgtttgcttaaatttggcccaaaaaaacagtatacatcatgcgatattaagaaatatactaagacaagcatatctacagaatccgcaatattaacatatcatgcccttttgtatgcaaaggtaagagagaagaatcagtttactcaagtattactcaagtgtctacagccataatttattattcgatattccaaggcactgggcatttatgtgccagaagatatgtcattactggcacatgagattaagatttagtttgtgcaaaaacttcctcatgtgcagtgtcaaatatatttatggtgactaatccgttcaagtttgaaattttggagtctgaaatgatacgggaccttcatttctcttgatgtcatatgcaattatcaaaacgtttatttgacttagcttgtttgatttctcattccgtacattagccaagtaagtgaagcgttggtataatcattagttgacatttgtcttcaacaactagttgtcgtactggggaaagaacagacctctacccaggtaataatcaaactatatttatatctattactaagctagcatgccccttcctacgaccaaggaaaatgtcagcccagctaactgttctagaaaaatgaaaactcaactgacctctcccatcattgacaccacacattgttccagcaagatgtcgtcattgccttttccattcggatgcttgcataaaatgaagtaaagagcatgctttttaggagttcctcataaatatgtaaaagaaatacataacagaatgtaaaaaaaaaaggatagaatactcttatgttgtgggtgataacagccatagcgtttaaacaacaaacacgttacatggatatggttcatttacatgagttgccaatttcgaatatcaccatttctagctgttttgttataggagggtctgaatctacgagaaattagatagatcaatacaatttgatgtctttgatagatatgttttgctaatttaagaaatcacgtggatcaattaaatcaacataacttattttcatcggcaccaataatcagccgaatcagaaaggtcaagtttacatatgttgctttgtttggtaaaagaagttcacagtt

SEQ ID NO: 82371 - DNA, 9014 bp, Oryza sativa
ggagggggctcgccgggagggggcctcgccggcgctgttgaccttttccggccagccggcgaggcgggcggcggcgcggtggggcagtggcggtggtggtggcggcggatcgcacgtgggacaggaggaggagggtggcggcgtgatctggaaccgggggaggaggagaaggagttagggttaaggggctacacgaatcttaaagcatatctaatggtccaaaattcgaatgataggaggtgggattttctgtcacatgatatatagacagccaaaaaaaaaatctttggaatccttacttgcgcctcatcattaccagcttagcatcattttcctcggattagcttgccattctggctcaagcttcttgtccgcgttggctttttgtggcaatagccgcatcatatcgtcgtcctggtggcccaagctctcttctccgtaccacttgtaatatgagtctactttctcgatcctataaaaataaatattgtacaagatatgatatattctagtactataaatttaaataagctattcagattcatatagtactagtatatgccatatcacgtatatattatttttgtttttatagaacggggagagtatataggtagtttaattactgaacttcccaacctagtggtaggcatgagacgtcactagtcagatcatttaggccacaacagaagtttcatgtttcttcttgtcatgttttctggatatgctaaatagttccaagagcgtaaaaaagaaaagaaagagtaaaataattaaatagtgttgtctgatatcattgtagtggacacaacagttatggctttgctagtctcgcctaatttcagtaccctacggccctaccacaaccctcctaaactagcacgaaccactgtctcctacttcaaaacattctgaaccaaagtccagcttctagatttttcacttttgatctttttaaaattttattttacaaatagatccatcataacttattatgagaatggatcatttttatggcatcaacatcattagcgtcatggtccaatataacggcgcaatgacagtgatgccatcccctagcttccttgcaaaacctatgggtatgtttccgaagcttaagattttgagaagctgtgggttggtagtcagcttctaagaatttagaaaagctaagttccccttcccgtggatggtcggggcatggtggaccccaccgagacctacaacgtctgcctcttcaaggtttcaaaaggagtgtcgagatctactgaatctacatcttccaggtgtcaataagagtatcaagatcaacaagatctatatcttcaaggtgttaggaagagtgtcgagacttacaagatcatcttcaaggtgctaaagcagacactgacggataccggtgtcttgtctaaagctatgcccaccatgaactccttcttcatcaacatcttcgagaagctcatccaaaacaacaataaaatctatctttggcaatatgagcgcgctcgagtgggcaggggttatagttattgagaccggactagtaattgagccgacaaggctcttggttcgatggttcactggttcaaccggttgaaccattggtccaacctagttcaataggtattaaatatattactcattccttgacatcacgaggtgcatgatagcctggtggttcgtgatcagcttcctctctcacatgtgatcttgtgttcgaatcccatcctagtctcgttttcccctacctgctcccctgcatgcatgtcttctcgcgcatagctgccacaaggctggttcaactacagttttccctggttttatagcagtttttcctcaaaacaggacgctccaatcggttcgattgcatatccagtcttttaactagaccggactggtataggctctggttttggtttttacaggtccaaccgtcggtatggttcggtcttaataactatggcgggggtgccctgaggattcgaggtgacccaagcacggtggctagtcgaacacaagttttcaatcccttggggacctgagcactgattaattagtgccctaaaggtttaaggagagcagatcggatccggtgattacttttaaccaccactttacgtttattatagggtggttcaaacttaatgtacaactcatccacaacttgtacgtggccgcacatgcagccccttgcatgcccacatcacgttggagaacacgagacgtgcgatgtggctcatcttcagcaacattccctaggggtcacctctattggatacagtggctaataggtaggctcggggacagttttaatgaagacttttacctcccatctctacttgtcattcggtatatgtggctatcacatctggccgactagcttggaggtacaacaataatactaaacatatcaaattcagaagagtagacctcactcctacatgcatgcaatggcattgtggactccccttcacgtataaggagaattcatgccaccgagaaaaggttcacactttcatctaagctaggttagctgaacattcagtgagcaagcaacctctccttctcacttagaactttctacatcactttgtagttcacctcaccatccatgcatagtccatcacacaggagtaaagtgctacgcatccgtgtgggccgaatttgtatatccgattgtgttcactctattcgcgtaattaaaacccgaacttagaattggcagcccggccgaactcacaaagagggagtacttagctttctcactagaggagttccgtactccgacaaacgccaatatcatttgcgccatcatgttggaccacaaaatcaatgatgttggcgccacgaaaagagaccattgctagaataagtttttaagtgtctatttgtaaattaagttttcaaaaagatctaaattaaaatataaaaaatccagagcccagcttagccctaaccatgcctggtctggcccagcctggctctcctagcgcagcccaaaccgatcagctgactcactaatccaattccaaataccacacgaatgtactccactccattgatcactcatcaatcatcaatcactgtaatgcactatccatccattaattttcctcccttgattcacgtcgaccgaccgagacggagtcatgtcacacggtcctaatttctttcgccgtgtggaaggcattggatggatctccccagccacggggcaagcgaggggaaaaagggctccgagcccacaaaggacgagccgtctatgccatgccatcatcatggcaagatcacaaacttcacgggggatatatgtaatgtaggactaataataatattgcaacaattgtgtttctgcctttttcgctgtgatcattacacgggtccagccttttagggataacaatagttacctataacacttggagggttgaaaatctagtgtgtccttatatactttatgtgtatacatcttggtaggatatttggattttttttcaagccttgttcagttagtctctccaagagagagggaattgagggaattaattctacatcttaataagtgcgaaataaattaccttaaccctcgaaaaaaatcaccttcagatcccctcaaccttagcgatcaattatcccagctgagcacatacaaagtggacattcttatggtgcgggtgtttgggttttccatgtaattaaaaagaaaggccacgtgtctgcttgatataaagatcgcacgatgggtacgtatgggctcgatggtgtgttcaagggttgatgccatgccaaaccaacaatattgttgaataatagaggattagatattgaacacattatattgatccttgggagcctgtgcatataggagtacaacacttagttctcaagtaagcatagagatatactcccttcgttttaaaatgtttgacaccgttgattttttagcacatgtttgaccgttcgtcttatttaaaattttttgtgaaatatgtaaaattatatgcctacataaaaatatatttaacaatgaatcaaatgataggaaaagaattaataactacttaaattttttgaataagacgaacggttaaacatgtgctaaaaagtcaacggcgtcaaacatttcgaaacggaggtagtagatatataggagatacaccacgacgtgtgaatctcatatgtatccatgttttatgcagtcatacaccacgatgtgtgaatctcatatgcatccaacgttttatgcatctatagtgtatcacgttgtccctttttctggataaggaatgattcaaagtttatgatattcgaggtcacacacaagttaatttaataacatcaaaaagtttaaaaattgtttcaaaaacttttctaaaattgctgataaaaaatattatgagacattgtcccgttaaaaagcttggaaagcgtgatccgaatagtccatctttgccaaacgggtagacggtatcatcgctttgaaaacgtggtgagggaggccctacagagtctcgagtcttctaaactctaacacgagatgtttacagtcgattgcatttcagtttgacttttgaacctcttgtgtctgcacagaaattgaacccgacaagtgtcctgctagatagtttcagccttgatggaagccacatgctatatataaaccaaacaagctaggttagcgatcaaataaccatgtccaagctgggccaaatagttgctaatcctctgtaccgacagaacatgcccccgacacaacaacagttcttggatagagaaaagaagtttctcgtccatcaatgctaaaacagtgaacagtctgacatgaaaaaacatcaaaagatgttgcccaggtaggtcaattctgtgagaagctaatcattagcatcatagtctcaacggttatccaagatgaaagctgacaggtcaagaattttgcacagcactgtaatatatttacttcgatgaatcagagacccgtcgtacacattttgggccagaaacacagcagatgtcagttaatactagatggcatatatacagttgacattggagggagaagaataagtgtaggtacacaaaattgcctctgtggttttttatggcagacttggaggggaaagtgatggtttggtcacttttagctctccgcaatcactgatataaacagtttttagcgggcgatcccacaacgctcgagcagtttgagctctttcatcaccaatcaactgggcaaaatcattgaagaagcggatcctttcagctggtttataggtaggaatagttgcaatgctggttataacattcattcctgcacaataaattaaataaacattacgaaaagattagactaatttagtcgggggactgttaatgcataacaactattttcctaaaattagcatatatttactgggcaatctagtaagtatcatagccaaattgcttcaattgcatgcatgttaagaatggcaggatcatatggtctacggtagtctacaatgtagtaaaaggagaaaagatatggactgcctcaggcagagtttctgcagcactactacagttaacagatacaatttacggaataaatttcaatacagataaactccagaagtaaattaatttatactgaactgataatctgatattcacaagttttaaccatattcaatatgttcataagacaatgtgatctctaaattatttcataagatgtcggtgccatagtacatctttcactgtacatatgcattccaaacagatgaacctaatatctattatccacatgtgataaatctgccacttggagaaaaaaagaagcagcatcaaactatcggccttaaatgtgcatccacatcaccattctcaaccacatatcagtggagtatggcaatgctacccaacaatacatggtcccaaacactttaatgaaagcactattgagaacataatcgttcaccacatgatttgactttttgtattttatacttttttctcatttgctcaagaaaaatgaggctaataaaaagatagtaatggctacctttacatattcacaaaaaaaatgtcatacagtctttctgttttatgtaattaatatatacttccatggctatacggagagtatgctttgttaagaaaaagggggttcttcatgaaagaaagataagtggtagctgattttttttttcatacactgacttaatcagaaatagattaaaaaccactcggtcctctttttttttgggcaaggaaatcaagacagttctctattatgctagaagtatccacttgatttatactattaacacattagctcttctgtaaaaaatttcaaccttgaattgaatggactgccaatcgtgcagaaataatctgataaaaacacaagttgcaagaccaaatagttaaaaaaaggaattgcggagaaaacagttttttttttttttgacgatgaaaacagcaggagagactgctactgcgatatattaaaactatataatagttacaaattacatatgtacaaattatcatgtaaaatctttcgaattagccgctttctgttaatctgaatcaacaatatcatcattaatcatacagtggcaatactagtttccattaagacaacagaaagcaactcgtacaaaattgaagcttcatgtcaattccactggaatatatccaattaatacacttgtttaactcagtgcttgaaagtctgttttagtcgcctatgtgtgcatgtgaatgcagaacttgacaatcaaagttgcttatagaagaagaaaaatggatgcttaagaaaaaactgttggtaataatcaaatactgaaactgagactaagtagctagttcagttcaaatgagtaacactattacacttcaagtggcaatgggtcctaatgacaagcattagtgtgcctcaagtgtcatgtgaatataagttatatagttgtatgtgcgcatgcatttgttgcgtctgcccatgcatgtgcatgagagcatgccgcatgggcatgcagatgcagaacgtgggcatgtgcttttttggggatagaagggccgtgcttttaagttcttgatgcataaaacttaaatatgaactgctttgtagttaactactgccctggttgttgttgtaaagtttattaaattacaaatcaaactgtcaaagcagacatgtcagtcttaaattagctagaagtagattctcttttggggtgacatgttcagtggcagtataaatctcattgatgagttgcttggtttagttcaatctacttctgataaccaccagagatctaataaatcagaacagggaaaaacaatgaagtatgcaccaaatttgactatatgaggatgatacactctctggtgttgtttattgacaatgtggcacattgttagaacaaaccatggcaggaattgatgatgagttatactgtggtgaagtgcagagaagaaaaaaaaaagaattaatcttagtgtgataaccatccttggtgttgagacaacaaaaaggaagaaataaaatgacaatttctttacaagcttatattacttgcagaaattggtaataataaaacatctaactttatgttctgcatggatgaagtcctagccagaatacggacacaactgtttgttattttgttaatactcatgcaaagctgcaaaatttgcattttttttcttctctgttatgtactaatgttgattacttcaatgaaaacatgtttaccttagcaagtgtatataactataccaaaaggagaatggaagatgtcatataattatacttgacaaaaaatgaaacggtttgaaatacattttatttttctctgtttgaaccaaagaaaatagatttatgcatgaatttaatcatgccaaccttgcattagtagattacgcacaggtcaaatcccaacttgttcgagggaaagacattgaaattcttgcaagacagaatttaacacaaagtgtgcaagaaccatttagtaaaagttcagaaaatgaaagcaactaaccttccaatacagttccaaagacaatgttctgtccatcaagctctgggcagggccctggtccagtggtaaccaagaattcaacattgtgataattaggattgagcttgatgtcatcatcgtcatcgttctgtccaaggcacaatgagagggtgccaggccttgcatgctttagttcaaatgctttagggtcaatagtctcagcattcctcacaagtccggtgggaggttggacctcgcccctgtcacgccgaggaccttggcggccagcaacgaagaactggccctgaaggagcttgtggacaagtgttccccggtatgcagcagaagtgcaagcagctttgaagttggcagtagtgagggggaggagtcgaccatacaaaccaaaaattacacgaccaagaggttcagaatcaggacatgtagcaagctcagctcctaaagtgcggtcagagcgaaagtagctagggcagacactgaagtccatgaagatccgatctgtgatggtggtatcaatggcagaggtggatggaatgtttgcgtcatctaaggcaggggatgatgaagcgtatagaagagaagggaggacagggaggaagatgagagaccgtctagaaattctagaggattcaataggtttatgagtattatcatggtttgttttcgagggaagaaaaaaagcatggtggttgttggggtggtggtggaggctgctcagggaaacagggtaagccatggaagaagtggccctggtatttgatgaaggcaacaccatactgttgctaactgaattcttcagttcttgtccttctgacgaaacagcagtagaaaatcactaatatccttccctgcaaatgtaatagttggcttttgagatataacattactgaaattctaaaacctactgttagcctcttcgttgtagggtcacaattatcacttgtgaataatggcaaatagctgacagcccaaacaattacaattttaaaatgg

SEQ ID NO: 82372 - DNA, 13014 bp, Oryza sativa
ctgcagcccctaaagatcgatttttagtcccggttattttacccgggactaaagatagcgatctttagtcctggattcgtagtcccggttatccggttggataaccgggactaaagtgggattacgaactgggagtacaaagggtttctccataagtgaacactaggttgatcgcgagagagagagagagtagtgacataagaaatagggtagagcaaaacgagatgtgaggaggaggaggaggaggaggggaggggggatttaagggttgttcagtttgctactattttcttccacaccaaactttggtattaccaatttttagcaagatagcaatctaaacacatcccaaatactctaccgcaccttaccataccaaattttggtgatcttttagaaacttctccacacaacactatacaatagtagttggcatggtaacaaaccaaacaacacccgcacacttctaccctatcaaattttagcattatcaaactttgccgaattttgatcttaccaaaatttggaagtgttaatttcggcaacaaagtgaacaaaccttagtgcctacaactgtcgaaaatgaggggaaggcgttgcatgtgaaatacttctttcttttttctttgcgattacacggcgggtacgcacgcacaccactatacacgttacaccacactcacacactcacgaatacgtcccctaacacatgcttgaagagacgaaaactagcgatatatatttgatctcactaaattcttgttgaaaacccacttgcgtatgcataatatttatgagcgctatgattcgaactctggtggttgtcccaccacaccactgatgcttctcttgtatgtgtgaatactttgacacactagtagacgcttgtatagtgtacgtagtattggtaggttagcctaatatgagaagttgtgttgatgagattagagaacatataaagacacgtattagaaactagaaagtaacatatccaaactaaggttcgcctcgttgttttattgagctagtttggcttagcttgttaagcttacactggtggagaaaccatctttggtcggtcggccgaaatccacaatagtcccaattccacaaaaaaccgggactaaaaatgatctttagtcccggttggtggctacagtgggcatatttgatctttagtcctggttggtaacaccaaccgggactaaagatcatctttagtcccggttctagacctgtcagaccttgtcaggccccctgggatctttactcccggttggtgttatcaaccgggactaaagatctagaagatatttagtcccggttggtattaccaaccgggactaaagttcaacgcttactatataaggcttgttcgctatcctctcctccacaaccacctcgcacttatcctctcagatctcgatctccctctcctccctctcagatcgatctccctctcctcctccccctccgcttcctccccttcctcctgccatccccggccctctcctccccgtcctcccttcccatccgctcagatcgatctccctctcctcctcccctcctcctctcagatcgatctctctcctcctcctcctccgcctcctccccttcccaacccatccccggccctctcctccccctcctcccttcccacccagcaggcgtccggctgggccgcgcacgggcccagtggcgagcggcggcaggcggcagccactgctggcatctttttttttttacaatttgtgattcactaagatgtataattttatgatttgtggcatgacctgagatgtataatctgtgatgtatttggtttgtgtgtaatttttttaagatttgtgatgtatttgatttgtgtgtataagtaacttaagatttgtaatgtgaatgttttgggatgttactttgatttgaggtttgatttgggatatgtatcccacttgatttgggagaaaatacagggattaaactctagctaaaaaacaatgaaaaaaaaagagacctaatgggactgccgctaccctctctttagtcccggttggtgttaccaaccgggactaaaaatggatctttagccccggttatttcaatcgggactaaagatgggcatctttagttccagattcatagacccggttgaaaaaccgggactaaagggggattaccaaccgagagtataaatggtttctctaccagtgttattagcgagaagtctagctaggcttgactcgcgagctggctcgttaagctcattaacatttattccaccagtgtaattttaagtttatcattttatcatatatgtgtggaaacgaagaatccactaaatagtaaatacatatatatagttggatataattaaataattaattaaacaccagttgtgaagcgctgggtatatgaagatacggtgatgtctagtactcagagattaaaggggtactagataagagagatgggataaaatcgctcccatacatcgtggtgttcttttccggatggttttagccaaagaccaggttgaggcttgactcttgtgaagagagaaatgtttgggcccatatgttagctcctattgtggcaaagcagagagatattttttttattttattttaatatacatgtaactgaacatggtaccaatgctaatctatacacccttcgtaaaaaaacttaaatcttggctatgaacataaacacgtcatttgattacttttttatgatgggatacattataacttctttcatctggtactgacatagatccatatttaatacgtgtgtatgtgatctgcacactattgatgctctaacatgctaaacaagcaactcgaaagctagctcgttaagcttacaaactataagactaatttgacttggcttattaaaactagagtctattcgagccgagctcgctacacaagccaatttaaactactactccctccgtcccaaaatataaaaagttttgaatggatgagacgtattttaatactacgaatttagatagactatgtatttaattaaaactccttatattttttggattataggacgaagggggtacgagcttagagctcttcttctcgcccctggtggtaaaccgaccaccacgggatcgacgtctcgctacgctgtggcgctgcgtgcgccagcgccggtgcaaagcgtgccataccgtacctgatcgcaaccagtgaggcctgcaggctggcagcaactgcaaagcctggggcgttgcggacggagcgcagggtttcgtggaaaaccgaggcacccatccctgtcagtgtctgtcgggcagccagctccagggaataatggtcgcagctttggtactctatggctatgcaccatccactgcaccgcatccgccaaatgccgcccgggaccagctgcagctagacagctagtgctgatgtatatacgcctgttgcaatgtacgattactacgagaggaattagggagtattagtgtactactgtgtgatcctcttgttttattgtaggttgcacttctgcttagatatggcacggttgggttgggcgtttttcattcctggctagcttggtcccgttgtggggaaccaatataacttgtcttctttccctcgactcgatcggatggcttttaagctatggcaagctagatgtgtcgtagattagttcgaaattttgataaattaaccattttcaaaaacttattttgaaactagatcttgtaaaaaaaactttaataaaaactgaaccatgacctcagcacgaatcttagttcctatacttcagcgccagtggcgcagctagaggggttgccatagggtgccaacacccccctatccaaacactaccaccactacacccccatgtttttactctatattaaggttagctaagataagtatttatctagtttattttgtgtagcttgaaagtattatcagtttagttagttagcaagtctaaaaatattagcaagaaacatgatctacaaagttaatttgtgatttctcatctttttcaagtaaaatagatgatacttatttgtgagattattcaatagtttacattaaaagaatttagcaataaagactagttttaaacttctaatgatattattaaagagctaaaattcaagtttttcttaaaggactagtttacacattgcttgttattgacggtgactatttgacctcctttgctatcaatattagttattcggtatcatggtttatcttcacccccacacctcccccgccccgccccatgtgctcacatgacacctgagctgatcccctcgtaaacatggtaggtgcttagcaccaaccgctttgacgttcacaaggcttgttggtgctgaaactggggacttagcattgcgtgcgaccaaccttcttcttcctctcctctccttctgtgtctatgtgcgacaacgccccccccccccctctccttttccccagatctcctcaaatccaccccaaattgaagggatttcagggatttgttgggagattgatttgcaaagtaaactccttccaagacccatctttctccatgtattttggttgttttggttgaaatctaaattggggaatcaatgtgggttgggatgaagtgtggtagttccgtattgatgttgctcaggatgattcatgttgatttttgtgtgggaatgggtagggttacaacttataattatgaaatttgattttgtgtgtgtgtgtgtatgtgcgatgtaatttatagtagtttgaatgtgttaagttgtatttcaatgttggaattatcagtagttgattcatgtatattttttttacttttgaaaacattaggactactagtcatccacccatgcgttgcacgggctattgttattggtacaataaatactaaaattgtaatcatatgttaaagtcattggttatttatgaaattattaagcttaatgtttctaatttagttttctgaaagcaaattgataaaacagtaaacttatagttcgagatcgatggtacattttttattaattaattttgaattttaaaattattaaattttataaaaactaaaactaaataacccttggtaatccaattcaatgttttatataactatggtcattagatatgtacgggttgcatatagatatttttatatgccaagagagcaggtcttttacaattatatattatttgttacaaatataatcgttgtagacaataagactaaattattaatttgtaggaactgttgttctaaataatataatttgaacacatgcaaaatttgtatcagtaactaccgaaatgtagacctacctcaatgataaaaagatgaatctttgtaaatatgatttcatacagtctgtagatatgaatctcttcatctataaattaatgccaaaaaaaagattatggtgaaaactattcaaatttttaaatactttatttagtagttcaatagtaaactaaaaaggtacaattctgaactaacgatcaaatttttcgtgttctgaaaaccaacttttgcaacaatcaatatagaacgttcaaaaaatgctatacatcattccaacttcatgcacctatctttatttagatgcattattagaggttgtgtaattcaccttaattcaatgtctaatttaagtgttgaaggataaagactaatacaaacgatagttattctaaacggatggctaaaatatagtttgtttgaacccatagtagaaaattaaataaataaagaaaaagttattgctacatttcaattgcctgaaattagaggagagagtcaatgccacaggacaaaatgagagtgtgccccaagtgcaagaacaaagaggagaagatatacacacacacatatattacgatggggtaatataggtagctataaaaactatcctaacctaatcaaaatttaaaaacaaaaaacactcagtgcactataaaaagattcggtatagtaaattggcctccacgttccaatttaattttgatttgcatggatcgatctatctttgtgatgttagcgtatttgtgcataatattagtttgtaaacatagcatggattttcccccaaaaaagcacagactaagctaatattgggttggatcaaaccttggttaagttgatcctagctttatacatatcaagagcgaggcaatataatcagcacggctcatggatacagatagaattagtaatacttaatacatgaacatacatgacttactaccaaggtttggatctgattgatggcatgaactatgacgatcgagcctctacaactgctggcgcgcggctacatggacgtcaactgcccggatgaatcgatcatgcgtctttccatgtaggccgcttcttccttgcatttaggctttagctccctattgatgcccatctgttgcatatacccatgctgatggatgcccaactgtcgcatgcatgcctgactgatcgatttccatcgataaattcctgcatcgtgaaacagatctaatcgtgttccccagtgctataactgccaatatcatcttttctctcgcacaatctctctcttatctcctcctccgtgaaggggtggaaaatagattgatttgaaggtagcccacaaagttacacacacggattggtttttgcaatctactgtgactataatatcaattacttaatcaacggttagatttttttggttaacatgggagctcgtagaaagtgtccaattagtataggtatagatatatgtgagatagggtttgttgcaagtaaattaggcatccaattcagagttgtaataggcacgatgtctaaaatgttttgaactactacgctcttacgtttgttagttttccgattgatgtgacatttattagtttacctcctatatgtattattttgaaatgctctatttttatttattggttacatattgtagatggatagattggtacaccttcattttggtggttgtgtggtagagaaaagaaccgatggaagccattttgagatgatgattgttaggcagctagtgctcggtgccaaacccacatatatgaggtaatttttcgtatgaaggacgaattgggtaggatttataagtcagttggtatacaagaaatatatgatgttggagccgatcccatgtcgtataagtatgtgttggacttgaacagagagatggaatgaaaaacctatgtggatatagtgttgggtcacaattcaactcgtttgaggtgttttcttggaagaaggagtgcagggaatccacaaatgaattcttagaccttaatcgaagtatgtgtgtacaatcccccagtattgtcatgaaccgaagaacgatgtgtttgtggcggatcagaaggaagaggagtttaaggagaagccaaggtatgctcgaaaggaagaagtgattgaggaagacgtcatggtaggggaggaagtaccagttgaggaggatgtggaggtataggagaatttgtcagatggtggatgataatcatgtagagaatgagatgggaggtgaacttgatgataggcagatggcttctaactcgaatggtgatcgtcctgtgggcaagctgttggaggaagagaggaaggtgtttgaggaaattgtaggttgcaattctgaaatctctcaattcgaggatcttggcaatgcgggatgggtagttactgacaaggatctagaatactgataaaccctaagcaccactcaagacaatcactgttgttggcctgatctttcgatgagttgatgataactacgatttgggagaaatgttgacgacccgactacaaccgtacaagacattgcgttgcgccttagtgatcgatacacctctccatgggttgttgatcttgcctgtgcaaatcaaccctattcctacaagcaaatcaaagaaataagcaagaacaagataaaagcaatctgatattgcaaataggaattgaatacaaatgataagttgggattccgaagaacaagtagacgggcggtctagccgacatgcgcgctgcaagcaaataacaatggctaaactttaatctaataaaacccgagaaaaccctgaaggggtacctagctatttatagaggtgagaggacgaccaagggtgccctagggtcgtgctccaccagattggggcggcatccaagacaacccacttgggctagggtccaagacaaagttacatgcccataggcccactattggtgatgcagcaccttgtttctttgattgcggataactgagatggagtttggtaatgaggctcgatctgttggaaacaggactccgagatctttccatcaagtactcacaggctgaaaacggaggtcgtacgcatattttgcggccgtttgaagtcagcaatgcaataggtggccgaatcgaattctagcacttggaggacttgaccttgatgacttcttattgatccatgatgtgagcaatggtcgtatcaatggtagccatagtcacatcaacaatggacccattaatgaaatttgggaggaatcgaggaaaggtttggaatttcgatctctagaagacttgaaactatggctgcagagctactctatccgtgtgcaccgccattccttgtgaagaactccaatgcatctattaagtacatggtggcttgcctcgatccaggctgcaaatgggaggtttcttcaagaaagagtagagctgataggtagaggataactggtgtatgtgaagatcacaagtgttgtagttctgaggcattgggcaacacttgtagctaacattaagggtaacagcttactgttgacggtccttaaataacaaatctgaccgataattcctgcataaaatgaaatgaaataccaaacttagtagcagtgtttattactcatttccacaagcattggtgaatatttgtatgcaggtgattattgactattcgtagctgtaagactacgcaaagagccatctgcatgggagccaacctcaactccatagtgaatggtgttgagctagtacacctcagcaccaaatgagctggcgctgaggttaccagctcaactccattccccttagtgtcgagatgttgaatctcggcactagctaattttgcgctgagatgtgggcaccgagcgcgccacccaacacaataccaatgttttggtggctggttgctacccagtcctcaacaccaaatagaatggtgttgagccctggatagtagccccctactttttttccttaaatcctcaggagggtagcacattacgggttttacaatgcaagtgttgacggttcttaaatgccaaatatgcctatcaatttctgcataaaagaaataaaagaaaacaccaaacctagtggtagggtttattactgaccattttccacaagtattggtgaaatatttgtatgcaggtaattttgaatgaaaaacacacctgccatgtgaagaaatacagctccagccactcagacatgagcataaggattggagagcccacaaatagagaaaaccgacttaatcgagctaatccaccatgcaaccacacaagggcccaccaagcagccactcaagcgaaggagcagctgagaggtgggaccaggagttcggctgaccaagggggtcggccgaaccgaccttggccccctctcatcctggccctccacgtggtagcttttcattggatgctaatgatggttgtgggtgaaactgacctacataaccatcataactgcctataaaagagtgtttcatcatcactctcaagacacacatctcaggtggagatctctaaagttcattcaaagctactttctagtagagtattggaaaatagggagagggtgaggggaagttctggaggagtgccagagttgtcggcactctctcctctcttgtacctcggcatacgcttattttatacaagtgagtatttaagatttctcttggttatttaattttcttgtttaagtaagaaatattctcatcattgcatattcatcgcttagtatttaaattaagtgctctagtactaagactctagatgaagaaggatgttcttgcgcgaggctagagtagtaattgataacgtggacatggtatctaggttagaggtttcctttgtgttgttgcgtgctccacgtgttgtagaggtaggcggcaggtggtgacaaacatgtccgtcctttataatcttccatgtttgtgtatgtcatagagctgtaggccacatcacttggcagactagtggaaagccgatacccgaagcaattgatagatttttatcctaacatatttcgagaatcttaacccacatgaatcatctctgtcctaagcattccattggttgtccttggacgaacccatttcttagattctacacacatgttccttgtgatttgatacccttcgaatactctaaggagaaatgctacaacggtatacgtgcgcttgcggatttatctgtgatcgtaacaaatatcaatagaaagcaagacatgtactaatgtcttatatatagatagaatatttcgagttggaagcacataaattagttttgataaatcaaaaaaacaaaaggattgaatagttttgacatatcctcaattttgttcaactacaaatgtttcaacgatcacatgcagcttaggggaattaaatacatcctactaggtgcaacgggggtacttgcccttcctagcggcctctggtccggcttccttgcatgcttctccctagcaacctttctctccctttcagccgcaaggtcctccttctccttctgttctttctccttgacccacttcttttttctattttgaatctatgcattcctaaaccagtagtgaaagtcttcttcccaccaaagctcccccctgcgaagatcctcgacatctttcaggtgggtctccttatcgatccacaccacaaagtcacatagaggaggtggtggcttcggtacctgcatagcagacaacacactatgaattcattctacaaattgcatgcataacaagagaaatcatcaggaagaaaagaatttacctctatcggctttttcgacttttctttctttccctttggctttggcttctctagggtgtatgtgtagttgcagctcaaatacctttggtgaaatgtcatctgactgtcacttattgcaaattgccattcatcgctacaccaacacattagacgaggaatacttgatgaaggttatcaacgagggctataccccaccaaatccatcctagcaaacaaagcatagacaaattaaaaaaatatcaaacacctacaaaatactacagcatcactacatgaactcacaagtattataaccacccccaacaaatcattcctaaaaaacaatcaggtcaagtaggtcaaaacaattgtctcctaatatccactatcctaaccgtactaatatccacaaatgaatcaaacaaaccaagccaactaggtattaaacaaatcccactaaaaaatcacaaacaatggacgataaaactcaaaccctaaccatgaactcgaatttattaaggcatgagagggtaacacaagctcacaagatccaacaacagatttgagatagtgagaggggaagaagtaaacttaccttcgaaattgcctgggctcctcgaaaaccctagtttagttaggcaaaactagactgagatgtggatggcacggggaggaggatacaaagtcccctagctcagcaccaacgggactagcactgaggttgggagcttagcaccaagacaattggtgatgaggtcttgccacgtcagcgaggggatctgctttggcatcacatgggcagaggaggtcaacaccgacatggactagcgctgacccgtatgacctcaacgccaagacgtttggtgctaatgccacggtccattttttgttaaagttttttttttttgtacggtctagttttggaatagttttaataaagggtcaatttgtcaaaattttcggtagattagaactacttgggttaagaaaagttaatattgaaaacacaaattcccttcagaaggaaaaaagaacatcaaacgataattggggatcgatataggtaataggggtaagtttcacgagatccaacaactgttagtgcatatatatttgcaatttcctacatttgttctacaaaattttcaaattaaaactccaatttctcgctatttccttcgctatcccacttttctcccatctgcatgtttatcttgtgcctaaaaaaacctcatccgcgccaatggactctcctaccattagggagtagctgaccatctctccctctctcttgccggcttcttttttttttattttattttcaaaactcatgcattttgtttataaagcagtctaaaaatatatgctgtatatccttaggtacaacaacattacatctgattaaatgaagcaacaccatggctatggctgatctaatcaccatccaaaaaagagtactttggaagcaatctagaaggtgaagctctcaattggaagcagaccgcagggactaatgcaattgattggggccaacagcaatgccacaaagccaaggtgattgcgaccaaggtcctcttcttggaacatgcaactcgttgagggttcaatcggcgacccctactgcctcaaacttggcacttgttaaggatgattactgtgggctgtagatttttgtgctacatttttggctattctaaaatatttttttacaataattgtttgtaaaatattttttaaaagggacattatgtaaatatcttttcttataaatatgttgccaagagcctatttgtagaaaaaaaatatttatattttaagacttttaaaaaaaacttttacaaatggatcctcaaaggcggtctttttggtagcgacccccttcacatcagcgacttaggcttaattcggcagcatgggttccaacccatgtaactcgtatttcgcgcgcacgcttttcaaactattaaacggtgtgtttttt

SEQ ID NO: 82373 - DNA, 14748 bp, Oryza sativa
acgtttgttgttgaaccatcaaatcatataaaggataaatgaatggagaaagtgtggttgtgatgcaacactgtcaagcatatgaaacagctaggaaggatacggtaaagttcaagaaatatgatattgttcacgtataagagatcttaccacctttaaagccctcacaatttccacgaggatgatccattctttgaaaaaagggtattatccttggatcactctgttcttaattaaataattatggaacacatatcattaaaaatattcttctctataaattaaatgatggaataagggaatattattgaatcaacatgctaacttatgattcctacagagtaacatttcatccagcagcagatcagacagcatgtcatcaaagtgaacaaaagatgcaagcagagacatataagatatctaagcttctccataaaaacatgttcatgttcaacatgcatgtaatgttctatggcatgtaaacataattattctgaaaataggttttgtgtgttactagctgtgtgtctcctctcatggatattaattcaaccggttaagtaaattccagacgatgtgatgagaagtgaatttgatccaataaacaggaatccaaagttagtatattgcatccttagtcaatgtaactggtttcaccttaggaacacacggtacacattgatgaaatgctataataggcctagagatctaccatttgctctttcggcacaagattggaaccccttttcatggtctctgataaactgatggcccctacttgtgaaaagtaaaaagggggaaaggacagccccttaaccagtaaaggtgtttctccaacatgtaggtctatagctgattataaatagagcttgcggatttcacttcagtaaacaaaggcacttgtgatacgatttcaacaatacatgcctgcaaatacaaaaccacgtcctagtgcaccattcatacatatgagccagatatgaaaggagaagctttcatattaatgttattaagaagagaggtgaacacgcgcgtagaccgctgatagggatcgaatgtgggtgggcatgcacgcaacccagcgctctggccatttgcactaggcgcagcttcccgtacatccatatgtatggatgagaagattaaatatggttatttattgactggattgaatagatcaagattacagttcaataaggtattttctatttaataaaacttgtatatggtcaatttggccaagagttgaaaaacctgcaagagcatgaacgaacaaaaattcaagctatctcactatctcgatgtagcaacactgtattgattgacacaaggaataaatggataagacgtaaactctagttgcaaacatatcaaactgaatgaatgcttgacttcagtacatcattggtctaatcatacagtttaagtccctatacaactagcagaagccaaacggaagacgttctattgcacatttcatgggcccgattatctcaccgtggcacctaacagggacagtttcaacctaatttacaccaccagtcagcttctatcactgcaaacataactagcgatcttctagttgattgacgttaattaataaacgggcatgtttatctaaaaaaaggacatgtctatgtaaaataatatagcactatcaagtcaagagacactagtgtctactcataggctcatagctaccttcaaatgttcttttcatacagagatgaaaactaaaaaccgaaattccacacacaaaatttctccacctctcgttctatctgacctaatcccagatcacagccgtgttagccacctcaatagcatcccgctccctaaactctatatatgattcctcacccaatcgtgcactaccggtaaccgccattgtcgtcacgcgatgtgatccgcagatctgcagagcaaacagagcaacaacgccaccgattcccaacccccaacactccaacaaccaccaaacatgcccctctccccgcatgaacccgtctcgattagttcaacgaactagggatttcgaaggaatcgcgcgaaccatacgatccatccaggagggggaaaaattaagggcaaacctccggatcgatacctctgacgcgcgcgcaggagaggaattcggctcgagcaaatgcgtcggatcgaggaaaccctaggatccgggtctcgagtctccaccgcctcctccgcctccgcctccgccccttcgcaagcctccgatccccacacttgggtgggaaaattttggcggcacagcggagcggggtgaggccgcccgcgctggaccaggaggctggaagccgaggagactggaagcctggaatcctgggcttttataggcccatcaggccttatttccgtcaggcctagcggctgtttcagttgggaatttaagtctattatgactccctaattttttccccttatttaaacaccgacctcaactgcaaaaagtataatgcctcttccttctttaaaaacagatacaaatcagctcctgttgaaagcggtttcaactgacgtgatggttttaccacataaaacccacatgtcaacaactttctcttcatctcatcttcttcctcacctctcacctctcccctctctgtgcgtcaacccgaggcacaacgcgaaaacccgcgggttatcacttatttgacatataagtgggttcgcgggttggttcgcttgcatccctagatagtagaacaggtcgtccaccggatccacgtactattgttgctgccctagacaatgtcacatccacgccacagccacagcacaccgcttggcgtgctcgccgcctccgcgccttgcagaacctccataccacctggtctgcaatggcggtctggttcaggaacccaacgtaggacctgtggttggtcaccgctaggagggagaagtagttgtacccgttggctgccggatgctgcggctccgtcctaatggccgcgacggccttttgaggcatgcgcagcggcgctggtccaacatgttgcatagccggatcaaggtgtagcctccccttccttctcggtgaactaatggagccactaaaagggagggaggctgaaagagaaaggggagaggtgaggaagaagacgagatgaagaggaactcactgacacgtcgatcccacatgctgactcatcgagtcgaccatgattaaattgccaccgttttcaacaccatcacgtgagttgatttgccctgattttcgaagatgggggaggctttatatctggttttgtggctgagtaaggcgattaaatcaggagcaagagtgagggaaaataatagacttattccttccaagttgctgtcaggccgaggccgcaggcccgcgaggcttcaactgctccattctaattgggccggagtgtgacagctagtttcggcccgatatttacgggcctccgttaaaacctaattgggtcgctcaggagacagtataccttcaacttttatttaccgtcttctctttctactcccaattaaggcattataagtaatgaccttgcacccaaaaaaaattatggttaacctgtcagtgataagctttcaagcaatcttctcaatctcgttctcactgaatttacttcgactcctttgctgcaaaaataaccgcagatcagatcatcagaacccggtgtttttttacatcgggtattttctgattcagtttcacacttgttactgcgtgccaacggctaatgggctctcgtggagaccgtgccatgtgccggtagcattcgtttttttttttcttttgttctttcaaaaatgagccgctccaacggctagttcgcgagcagtcgatcgcactaaaaattccattggcccaactgaagcaaaacacatcgcccccaaatccaatcctccccccaccatcggacagcgagatggtcatggagatcccgagctcgaagcgcgacatggcgcggggagcggaggacgacggcgaggaggaggaggaggaggagtacgaccgcgtgttctacgaggacatcgaggcgcccaagttcgtcgacctcaccgcccccgacgccgcccgcccctccgacgacccctcctggttctgcctccgcatcggtacggcaacacacacacacacacacacacacatcgctgcaagattttcttgagatgaaattgctgaattcttgagatgaattgcaggttgtgaccagaaccacgagcatgtcgacccggaggcgctgcacaggagcttcttcatgcgggtgcgcgctgcttcttcctggtatgcgcgcgatttcgtggtaggggaggttgtaatccttgtggtttttaatggtggcaggtcatggcagcgaggagccccaacgtgcggctgcagaaggcgatcaggaggaggaaccagaggtagaatttccgattcatccctcactgcctgcgtcgaaattgttgtgtggttggttggttcatccgattgacgtagcccatcctctcgtgatctggtgcagctcgatgctgaaatgcccgcactccgcgccgccgaagcctccaaggtcacggatcgcgaggctaagcacggcgacggaggccgcggcgaagcccaggctgaagacccaccggatttgcaccctgcgggcgtctccgacccggaccaaggcggcgaaggtggaggcctccggcgcgaggaagaaagccctgacgacgccgaggagcaagcccgtccggccgaggcaggatccgttcctcagcgtgaagcaccagaagcaggagcccgtcgcggcggcggcgaggaaggggaccgtcgcgaaagctctgttcatggccacgccgaagaaggacgccagcaagacgccggcgaaggcccaggcggcgccgccgctgtccgaggtctgctccaagatgaggaagctgaatttggcgtgccgggaggtgcctagcagatacctctgtcagtcatcgaatccgaagagttccaagaaatgcgaccagactgcagtgaagagtgtcaaggcagctcaaaattccaggccggatgagaggaagaagaagaagattctaggctgctcgttgcaacatgccagttctgaagctggtagagagaacagaaatggccgtgagaacacagctgcagatgagaatgcttgtccagaagctgcgagctccagcgaggaaccgaaggaggtgatgcaggaatccagaattgaggtggagacatcacaagctgacaattgtgatgacgataaggagaatttgtcatatgttgatcagccaaccgaacaaatggtgatcatctcgcattctgatggtgaaaacctgcagcagctggagaacaatgagaatgtccctcggaaggtactgaaattgccttcttctttgttactgtagctaagacatgttgaaactgaaatgctgtaatggacaatatgcaggtagccaaaatgcagagcaaactgaacgcagagcaaggaggaaagctcaagaaaactaccaatccgaagccatttcggctaaggactgatgtgagttactggttacattgtgaaagctcgttgttgtggagtgtttcactcgttcactaaccttcctcactccatcttctgcattttaggaaagaggagtgttgaaagaagcaaatccagaaagacaccagacgctcaccgagaacaactccacggccgcagttcaggtaagttgctcacgcgcaccaactataagattcctaatgtagtggtcacccactgatctgtatgcatgtacgctgatgcagcaaataggaaggtgtcgtgacggaaagggacgagacaaaccgacgtgcggcgagaaacaggtgagcattgatatctcccccaaacataatttgcaggtccaaatcaatttagaaagcactcatgctgaattgctgatctgcgcaaactgtatatccagaagaagcaaatcagaaatgttgcaacgggtcaggttgatgaagccaaaagggtcttgaacagcattcgttgcaacaaggtgaagcctgcgatgacgaatggaaaaacagttgggaaatcacagggagcttccagagtagcatcatcaacaagaagtaccaagataacaaggtttgcccccacaaaaaaagagtaaatttgcagccccggttattgttttacagaattgccatcatgtaatatttttcttgcgttttcacagtggctccatggcaccttctaaggttggaaaagagaagagtacatcggtgaaactatccaggctacaagcagctgctgcttaactgaagtgacaaatgttttattgtcagctccaagcatgaaaatatgtatttaccgcgtcgaattcgttccattgtattcttgaactactctctagtctgcacactcactcacaccaacaaggatgtatcatgttcccttgttttgtccgtgccattggtatgttgagtgaaatttttttctctgtactaccatcatcatctagattattttgtaacctgaaagaaaaatcagggaagaagaagaggcccaacccaggagaaaattcagatcggcatctgatttcacatggttcttggtgttgtaaattcaagcccattggccttggctgaacaaaatacagaatggcagggacataaatttgaatccagaatgtcacgagatgcccagccgcccaaccaatccaagccaggcagctgaccctctctgcatccatccaaacgcagagaccgaagtcgaacagcgtcgccatctcgccacacggccagaggccgagatagatgccatatgatatgccatccatagaccacacgcagagacgcactgcatatgcctgcgtgtacagagctgttagctgtactatgcaaggggcgcatcccctacggatacggctgccatcaactctgccattgaatccatccacaccatgatcaactggctgtgcgacagcgtgcgatccggtgaacagtttccacggatctgcaacagatcgatcgacgtttatgtgtgcatcgctctgccatctggtaatgttttcatttcagaggtaaataatgttagcactaggaagcttcagcagggtccatggcccaaatggaccaaaccaaaatcttctcttgcaccatactctctccatccaaaaaaaagataaaccttggatttccgtgtccaactttgactgtccgtcttatatgaaatttttttataattcgtattttcattgttgttagatgataaaacacgattaatattttatgcgtgacttatctttttaattcttttcataattttttcaaataagatggacggtcaaatgttaggcacggaaaccagggtttgtcttttttttttggacagagcgattatttgatcacttgatgcttgtagcatcgcacgagcagcaccccccctcccccggcaaaaaaaaaagaagaaaagcactagtatttgcacgactccacttgcccctaagaacgaacgaacgaatgtaaatcctacatttataagcatttttggaaactggatcggcaaatccttgaaattaacgaggtcaccacagatagcgagacggtacgtcgtctaccaccgaaagcacaatgctgttaaatccaaaaaaatcttccatggaaaatcgaaccaagaacttaaggtgctgctgagattcttgtaaccactaggttacatgacctttcgccactccacacagatttgagacaaacggcaagaagcttcctttttctcgagctgcccggcgagacattcttccaaaaacggcggggcctcgagatcggagaacccagtaaacaaagtgcgtaaaaagcgctttccgtctcagttaaaccgacgaacagtcgatgtggaagcaattaagattcgtgatttatgcgtggtagggtagtggactagtggtggtagccgtgctaaagcgccgagattaatttaggaggggcgtacgtactctcgctgcaacttgcaggacgtggtggggtcaggggtgccggccgccggaaatggcgcagagatcacggcggccgccggcgatgcgcggcgcgtcctttacctgatctggcacgcacgtggacacgtggtacgtgacaggcaagaggtgcacgcacgcacgcacgcacccgtaccattcgtttgtgcacatgtcggtgtgtgtttgtccagtgtgcgcagacctgcgagcagtacacttttgtataggcaagcctctttgaatcaggcaaagttaatctactattctctctctgtttcaggtataaaacattttaatttgatcaatatcagttttaagttctactaagtttataacaaatacaataatatttataatgctaaattagtttcatcaaatcaataattagatatatttttataatacatttgttttgaattgaaaatatttttttttacaaacttggtctaatttaaagcaatttgattttaactagagttaaaacgtaacctgaaacggagggagtagtatcgtataaacattaacaatcacactctttttttattcacgctatcgtaatgatcatcgtggctcgggggaagtcgggatggtccaggcgaagcagaaaaagggaaaaagaagagaaaagcgattaaatccaggtcacatgcgactcccccgcgagttgaggcatgagatcgcgcggactggggggctcaaccgagatcgatcggaattgcgattcatcccccatcaccatcgccggtttttccatcgatgtttgcaacgcgatttgcctgattggcgccgggagtttggtagtcctgacaaatggcgtcaagaacacacaaatccttgtgagattgcgagaaacagacagacatgccgcgtctttgtggccatggatggatgtcacgttgacagttttgacgccgccttgccggcccgacatggctgtgtgttcgccattactgttagcacgcgattaattaagtattaaatttttttaaaaatggattaattttattttttttaaacaacttccgtatagaaacttttacttaaaaaaaacataccgtttaacagtttaaaaaatatgtacgcggaaaacaagcaaaaggggtgaaaaaaatgggcattccaacacagccttagcctagccagcagtggccagctaaccaagcatacgggcatttccgttagccgcggccgccggaatacgtacgcctagtattcgatttcggcgaacatcaaaatcggccggcgcgcgggcgggcgccaaaggctttcgcggcgggcggcgtccgaaaccgggtggcttcaggctaaacagctactactagtagctcgccggccgctcgttcttaattgaacgatgacaagtcgacgtcgcagaaaagggtcatcgatcgactgctgctagtagtgctgccagtgtacacgtacgtgccgctagctgttaatgtctgtgtacgttcacgaggagaaatacgcgtattaatttggtttcatcgcttttctgaaaaaaggaattgtactaaccttatagcaaggtcaatggtgcagctagcagtaagctctaaatttttgtcatgtcaaatagctaactactacaagttaactataagctgccttggttaaagcatacatacattaaatacttgtatggatacatcagttgttggacccacataacatattttttattgtctctcatagctgcacgcgagctatatggtttggggtattgtgcaagcgccggggctaaaacaagcgcctggttgtttcattcttgctgaatttctttccttaatcttagattaggctgattaacaggttttggagccgacttaatagagctattgtacccactcttatgggaaaaaaatcatcctcatatcttacagatttgggggcaccagatgtacttcacggttcacgaatgcttcatgcccttctcctccaactctgacaacattcttttattatccgacaccaacaacacaacgaaaccacattaaagaatttacggattaaagtcatgcgccgtgatggaggtagtaggggggtgaggaggagaaagatcaagggaaatcgtcgtgcttagaggatgaccgtagaatgaggtgcaacaagtgggcataaacaacgttgttgaagtcgcgcaatcggcagctagcggtgggccggtgttagtggcagggtaaaaagagcaacatgttacaatgtggcagttggtggtggtggatccggcagtagggatccgcctcaacaggtcacccacttgaggtgtagagggggagggcgcggggaaggaggaggggaggaagctgaccagataaacctcactggcaccatcgacatcttccggccacccaatgaggttgggcgacattggtgaggagtcaagcaggggcatcaaagtgttcagaaaatgcggtgctcaagaaaaatgaaaatgctcaagaaaaatgaaaaaaagagagggaaattaggtttgagtgtttgcacgaatcttacaatcattgaacgaaccaaaattataagattttaaaaggtattctctatccaatgtgtaatagactgtaaaaaaaaagagatttgctctgatccaacaaaaagtaccggtatcagatcgtttccgatcattggatttaatattgcccatcatgcccagttagatctaacggtccgaaacgatttggtaccgtaagataccggtacctcgaggcactttttgttggaccggagcaaatatatatttttttaaaaagttttcctctcccaaagcgtttgctcgttttacaccaacctgacaattgccatcactggtataagagcaagtttaatagtacagttaatcgtgagcgctgaaaatttaacacgtcatctaacagctaattaaaccacgctaaatacagtaaccggctatagtgttgctttacccaacgtaaagttctatttttctattggctgttcacagctatctcatcccttgcacagggctgcgttagagaaagtttataggcgctcgcgcctgagccgacgataatatagtcgttcgcttttctctctccgctctttctctctctgtcatttatattaaaaatctgatgtaagcatactatcactattgtactggtctaacacgggttgcgtacacatgcaagtgtccatgtgttatccgtagtagcctaccttgctgctgctaccactgcaccacacagctagcctgtattgctgacgcttgcatagttgcacgggtgttaatgaacaccgtgcatgcgtactcgtaccgatcgatcgatggcgccaacgccggccacgcaacgccaaggcgatctacaaacctgcacgcgtactaacaaacacgaggacgacgtagtacgttactactctctccatcccaaataaaacacaacctaaacaccgataagatattacatagcacaacgaatctgaatatgttcgtgtccagattcgttatactatttaatgtcccatagataaatctaaacatgttcatgtccagatttattgtactatttaatgtcccatggatgtctaggttatttttttaagttattttttttaaggatggagggagtacgtgggagttttcactctcgtgccgtacttgttcagcttgcagcctgcagctggctgcctttgctgaattgctgatactactactactagctactctagtgatagccaagcatgcatccagcccggccactcattcatggcgatattgattgaccacacgcatcgcatgctcggtggtgtagggtcaatcctttcgtccttcggtgtagcacagtaggggtagtagctcgtttagcgaagggattttccaggggacgacgtttcatgatccgatcgaactagtgtatcatctactatgaatgcatgatcacgctcttgtcacaatcgagaacagtgcaccacaaaaccacaaaaaaggaggagctgaatgaatatgggtgtgaattaccacgatcgaccaccaagctagcttaagcacaggccatcggccggcaccatccgcttggcacgtatggtttgtcgtcgcccatggtgctcgacagaagggtacaaagccatggccaaactgcttggcagctagagtatgatcagttaatatgaagtcaatcagcatgagtttgaggcacccgatttaattccaacgacaaacttacaaaccttagcgaaatcaaggacaatgattttattttgtttttgtgttgtttgattgtgtaaaaataaataaataaaattataccttttaccattaaaaaaacacacacccatcatatattactcactctgtttaaaaaaaaagccaacctaagaggggatgtgacccctcctaatacaatgaatctgaatagcccaacctcttctagtactacgaatctagacaaagggttatccagattcattgtattatgatgttttttttgggacggagggattacgtacatactcatgagcatgttacttttaaattaaagttccatggtaaaaaagaaatacatatgtgctagttgccatagtagcacatctttaaacgtgtattcgggacatatcgattcactaataatacatgggtgatctatgtgagaattgagggggatttgaacataattaattggaaaaattacaaaaatcaccccataaatcatttgaagtttgacattccaccctataaattattttgttgcaaatatccacccacctactcatttttgttgcaaaaaccaccccagtaaacatatgcttaaccgaatcaacatgtttttataaaatgtgagccatcaatatggtctttaccaaaactaaatacttctagagtattcttgatacattttttgtgagattccacatacaaaattgttgacgagagcctaaacattgttgcactgagtttcgctatatgaaaaaaaaatcaatcaaatatggaaaataagtctaatgcaagcacttagacaagattgacttggctaacttagcatgtggtaatcctacatcggcaataacgaattgattcggttaaacacgtgcgcattggggtggtttttgaaacaaaacttagtagcaggtgggtatttgaaacaaaatgacttatggggtggaatgtcaaaattcaagtgacttccggggtggtttttgcaatttttcctaattaattccacacctataataatttgaaactaaccttctcaattctcttcaactctatttttataggattaaacgattaaggcttactactacacaggaaaaaacaatagcctcgtgtagtggaaaaaaaagtgtaataaaaggtcgttgccggtggaagtagaaactagaaaagggataagcgcgtgtgacaaaggcggccgctggccagcacgcacgcagcaaacgaacacggataaataaaccggagtcgcgcgcagaaaaaaccgaccacggaccaaacccggtcgagccgcgcctttttctagaacagcggcgatgtatgagatgactcggcgccgcgcccgcctcctcctcctcctccccgtgtgggaccaccgaccgccccctccgccggtagggcccacatgcccgtctccgctccccagcgcgggacccaccctcttgtggggcccacatgcccgcctctgcgtcggacccacccctgcgcgctttccctcgggcgcccgtcgctttccttttttatttttatttttttgactcctgcgagatgcggaggagatcggacggcgcggtttgaaaagggccgcgtcggtgcggatcctgggccgtccgatcgggccacgatcccgagccgcggctactgttcacgggggtggacgacagcgcagtcacagccacgtcacaggagttacggcttcgttcgtttcggcctcttttgcagtaacaccctccaagaagaagttaatttccctgttgtaccaatccatacctggttctgtctacgaaggaccgatttgtacagtgcaggagtagagaggtgctttgtgcaaaaaaattcgtcgatctgaaaagcaggctactgtttctcccgtggtaaagaaagggaaaacaaaacagagcatcgccatctctctcccctcccctgaaagagctaaaaatacaaaaacatttggcgtactcaacacaacgatcaaaccaaacaaacgcaaattacgtgaaaaaaaaggaacgaaatttgcgaggagaaaaaaaattcaacgcgaggaccacagtccaaagccgctccaaacattccacacacacagcaagattagaaaaaaaaagaaaataaaaaaagccataaagaatagcagtacgatttgttccccttttgcccttccaccccgggggtttaaaccgcgggaaccgcgtaatttgccccccctaattaactccgacataaaaaccttaccaaaccaaggggggtttagggggaaaaaacacgcacggaaagacaagaaaaatattaaaaaattcgcttcctcttcttcctcctcctcctgccgatctctctcctcctcttgacgtgttgagctgagctgttcccacttcccactccgtcctcttcttcttcttcttcttcttcttcttcctctcgctctcgcttcttcttgagcttaaatggcagtgggatcagctgcgtaggtgtgagggggagggattggcattgaggggtggggggaggtggaggtccaggaatagggtgtgggtgaagtgtgggaggctaatttgggggtgagagaggagaaggagaggtgaggggtggggggaggaggagggggaggctggttcttggaccgg

SEQ ID NO: 82374 - DNA, 1116 bp, Oryza sativa
aggatcacttagtatccttggccttgagactgtcaaaaagaagggagatgcaactcgtgcaaggcttaaagacaaaaaacacctgaggacactttcactaacatgggggagtgcaagcggaagtactactaccgtccagaaagaagtgatggagggtcttaaaccacatgaaaatctttcccatcttcttgtctacaattattctggtgctactccatcatggttattaggagatagtttctcacttggcaatttagaaagcctccatctccaggattgtgcagcagtgaagatccttccaccatttgaggagatgccattcctgaagaagctgtccttggtttgtatgccctgtctgaaaagtatcaggattgacttcaactctgccgatgaggaggatgaacttgagttaagcgaaattgaaatatccaaatgtttagctttaacatccataagactacattcctgcaaggcgttgactatgttaagcatcaatgattgtgaggcactaggttccttagagggcttgtcattttctgaaaaactgaagcagtgtgttgtccaaggatgcccaaaacttccgtcaggtttcatcgcaaactgatgatttggtggcaaactctatcaaactagctgtaagtatggcttcactaaactatgtcatgctcattccacttcattgaagaattgctggatattgcattaataaagacttcatctaattcataacaactcaatgttgtaaactgattggcgtactgcttagctgttaatactaatgactaaaagtatatctccttcggacttgtctcaagtgcccttaggggagtttgtttaaaacatactcaacgtttgtttaaaatatagctcactcagtaagaagcttctttcatccttgcaattgttcttgagttattttttttagataatggatttatattaaacccggcctctacacttgtgagggtgtatacagccaaacaagtttccaagagtacataagactcatccagttatatgggagacaacacaaggtaccaagtttacataagactcatcccgatacatgggcaacatcacataaagataaaaccccaataagaatcaacaaagcta

SEQ ID NO: 82375 - DNA, 5733 bp, Oryza sativa
  unsure (1)..(5733): unsure at all n locations
agttcctcaccgacgcatgcgtcgtgctcttcctcatccagagcgccgaccgcctcatccagtgcctcggctgcttctacatccatctcaagcgcatcaagcctaaccccaagtcaccggcattgcccgacgccgaagaccccgacgccgcgtactaccccatggtactcgtgcagataccaatgtgcaacgagaaggaggttggtttgtgctgttgctatcgctctaaaacatgccattttttgtctccgaagtagcaaccttttgatgtttgtttgttggtctgtccaggtttatcagcaatcaattgcggccgtgtgcaatcttgattggccgaggtccaacttcttggttcaggtattggatgattcggacgatccgacgacgcagacactgatcagagaagaggtgctcaagtggcagcagaacggcgctcggattgtgtaccggcatcgtgtccttagggatggttataaggctggaaatctcaagtcggcgatgagctgcagctatgtcaaggactatgagtttgttgccatctttgatgcggacttccaaccgaatccggacttcttgaagcgaaccgtgccacatttcaaggtaaattgagatgaattttgtgcctatagtttgtggtgataatgtatatggtttagggttctaattatgattcatttgtttgctgttgcaggacaatgatgaattggggctagtgcaagcaagatggtcatttgtgaataaggatgagaacctattgactcgtctgcaaaacattaatctttgcttccactttgaggtagaacagcaagtgaatgggatattcctaaacttcttcgggttcaatggcactgctggtgtgtggagaatcaaggcattggatgactcgggagggtggatggagcgtacaacagtggaggacatggacattgcagtccgggcacaccttaggggctggaaatttatcttcctgaatgacgtcgaggtactatatatgacaaactttctgaataacttgttgggttatgtttcttcaccttttcagttgaaataacccatttccctcattatggacagtgccaatgtgaattgccagagtcatacgaagcttataggaagcagcagcatcggtggcattctggtccaatgcagctattcagactctgcttaccagacattatcaaatgcaaggtactgatttgctcttatttgttgtagtactttatttttgtaaacatctaaacaatgaacttatataaccaaatgttgttatgagatatccgattggtctggataaatatatctgttaatgcaaacacgaaataaaattaaggctttacagcattttttcccgtatccattctgtgcaactttgtcttcaaatagcatgtcagatatatcatttaatccgtttattacttaaagtgaaaatttgaacatcaacaggtaaataatgtgatcttgacaaaaaaaagtgtgttcggtgcttttgttggatacacaacannnnnnnnnnnnnnnnnnnnnnnnnnccaaggatgttaacatgatgaaattctaaaatgttagaggtttttttatactctttaactgattctcgaaatattaattcacatattgatatgtcctgtaccattagccttttctctcaagtacttaggtttatacacttcaataaagacgcatgctcatcgagcagcatccatctcactagaatataaaatgttgatatctaattgtatatcatttgtgcgcatgttacaactggacctttttttgcattaccatgatagaatatgaatttgcttatcaccttttgttgtcattgtcatcaaaataatgtactacctgataggatgtctggatgaaacaactgacttgttgatagctctgttttaccaatctgattgctagatgaaacaactggcttgttgatagctctgttttaccaatctgattgcttattaattttgttttattctgctgcagattgtgttttggaagaaagccaacttgatcttccttttcttccttctccggaagctcatactaccattctactctttcacgctcttctgcatcatcctcccaatgacgatgtttgtgcctgaagccgagcttcctgactgggtcgtatgctacattcctgccctgatgtccttgctcaacatcctgccttctccgaagtctttccctttcatcatcccatacctacttttcgagaacaccatgtccgtgacaaaattcaatgccatgatctctggtctgttccagcttggaaatgcatacgagtgggtggtgaccaagaagtcaggccgatcatcggagggcgacctcatttctttggcacccaaagagttgaaacaccaaaaaactgaatcggcgcctaacctcgacgctattgcaaaggagcagtccgctcctagaaaggacgtaaagaagaagcacaaccggatatacaagaaagagcttgcactctcattgctcctcctaaccgctgcagctcgcagtttgctctcgaaacagggtatacatttctacttcctcctgttccagggcatatctttcttgttagtaggccttgatctcataggcgagcagattgagtaaactgtgaaaagcatgatagatgttaaaaaaacagtgacaatggagggtgctccagggatgttgtgtcgaagctctttggcgatattgaaatgttgcatgacgcaattgtgtcgtccaattgatttatgtcacgacttcacacaacatgatccacaatgtacacgcccaaataggcccctcccccctcggttgtgtagatatagttgttcttggactgtaaatttgcctagttattccaagactatccgattcttttgtaaaccaattttggtgttcatgtggggattttatgttaggaggcaattactgcctgtacgagtgattcggaatccacaatgcccttaattagaagccattccttccttatgtgtctacttctgaattctgatgaccatctttgcccaacctgctatgttggtcaatctacctttgctgatgccattctgcatgactccagcaaaactgatactgtccattacaatgtcacatgactggaagctttattttttcctcttaaatgtacgcgtccagattccagcaggtagtcaataaagaagctgcccttctgataatcgccgagagtataaatgttgacaaacttttcaaaaaagtgtcaaaaccggaagagaacttgtgaaacggcatgctttttccaagtgatacaactacactacatggtgtaacgtacaagaccagaaaacatcatcctacatacagctggacaccaccaccacacacctgctgctgatgtagtatcccaattccatcccagttgcccaagaaaattccaatccggctcaattcaggcggcagcagcacacacgtctccagctgaatgtcaattacctgaatctataaaaaataggagtcccatctccatttcaaggggccagaaatgaattccagatagtgaagtgagatggaaacaaaaactaataaacccggatgttgtctcaattggagatgagctgtgagtagccgagaacggtggcggcagcatcagctgcagatagtgagagaccagtgccgagtccatcgccttatctgcacgggcatgtggccgggagacagctgtgtcgcgccaaggcgtccgtccgtccggcccttctgctggtccagcggctgccgtaagcgagcgtttcacatgacgacgctttctgtcgtgctgaactggagatacaaatcattactgtacaatatacaatacaccaaatgtcctccttttttttctttttttttctttcggtagaacaacaattgtactaggagtgagtattaggtgcgagtgctcgagtgcaagtatatatgcagctttgtcagccgtttgccttcttgcagtataagccaagggaaatgccattggtaggagtagcaaacaatggcggacacggcgacacggcttagttgcgttcttgcatctggtgaatctggatcgctctatgtagagtatcactcgatcgatctcttctgatcatggcgaatgattgccgcagctcagcaaagcttgggggaagtgagttacccatagcttaatcatgatgtcacgcattaaaaccgggcagtacctgacttctagcttagctttgctgtaacgatctgcctttgtgtgatttttgaccgtgtgacgtaaaaaggcgattatataatggtccaattatttgcacaaattgccccaccgacgacatgcatgcccaaccggtgaacaacaatgagagctagcacacgtgtaaagtacacccggcgctccattgagtgagtggcggtcgtcacagtaacttagtctcgaagcctaattagattaagaaaaaaacgcgtgcagtgcaccaaaatacgtatataatactaaacacttttaggtggtgttattttctcctgaagatgaagatgaaaattaagtttttttttacgcaaaatgaggtggtattaatacatgattgattgtgttttaattattataaacttgaaaaatagattaatatgatattttagagcaactttcatatataaagtttttacataaaacgcaccgtttagcagtttaaaaagcgagccacaaaaattttaatcttcattcaactcttgttggagaaaagaaatggaccttactccatgatgtattgcttgtgcatgaactatggtagaacatccgtttcacaatgtaagtcattctagcatatgaatatgggaaatactagatatatgtctagattcatcaacaccaatataaatatgggaaatgctagaatgacttacattgtgaaaggagtacattatgtgtactgaagtacttaatattacacagcacagcagagtcatcggttcacaaaagcccgatcaaccgaaacacgaagcccaaccctcctatctaaacaggccgaggccttaaaccaatccagatttcagggcccaacctcctcggccctagccacgcgacaccagcccagggcgaacaacgcacgtacgtttccgttgatttcgagtatggctcgaggggtcggagaataattctccgaaccctcttgggttcacgtgaaccgtccgatcgtgaacgtgcgggcaggaagtggcccggggaactgcgagggtgggtttgatcgcgaggtcatgcccaactgtggccctgtttagttcacaccaaactttcccccaactctcaacttttcatcacatctaaaactttccaacacacataaactcgaaaaatgcctcagttcggacgtccgatctcagagaaaaaatcgaatacctataactttgctatgtacagcctcctatccccttttgcataccctttacatatgcttcatcactaagcattagcatgcatgaaggagaggggacacgaggctatttacatgtacacccttttagcaaacttgaaaatgactattctcccaaattacttatccaatctacgatccgattatactattatattcattacaattaaatatttacaacaagatgttacatgattatattataatgaaaaaacacacatatgtttcaaccatttaaatttaatgtttcgcatgtgagattcggatgtttcagctgagattatattatgttgcacattttataattattgtgttgcgatgtatgtttctttaatgtatcacatgg

SEQ ID NO: 82376 - DNA, 8513 bp, Oryza sativa
cgcccccatcaagagctgttcgtcgccggcgcccgtaagcagcgtgttcagggagttccgcgacgcggcgccgtcgcccggaacgcccgacgccgacgccgacgtcaccgacgacgactacctcggggagcttgatttcgaagacgaagacggattcgacgccgactctttcctcgccgtcgatgacggcgtggccgagggcatcgatagaatcatgggcaaactcagcatggagaagaactccgcagccgcgtcccgcgccgacgccgtcctgtccagcgccgccatacatccatacattagaagcctcatggtgctcggtctcgggttccggcaaggccggctcaacgccggccaagcactgaagcggcatgacgatgagagtgattggtggatgtgccctgccataccagtgaaggaaatcgcggcgcctcctgcgccatcggtggctatgccggtgccagtgccgatgccattgcaggcttcagataagaagaagaagaagagtaagaagaagtcactgaaggaaatagaaagggataatgccattgctgttggtgaatgtaagtttggtgatgagggaactctgggctttgatcatggtgatgctggaatttcggcgctgaaggacccaaagataggattgggcctgaatctgaacactgaagaggtgctgaaggcttggtgtaacagtggttctgttttcgctggctgcgatgcacttgaatcaccaagatcctcctctgatttgcatgtaagtatttctagctcatttgacttaaatctcttttaagatgataagaagaaattttgaagtgttgtatacttgtattataccttagttcagaattatgtttcatactgcttggcatataaaaactttaggcttttgtgtggcatatgttgtacaagtgcttgaaaaaccatttatgatttggttagtattactctcttcttctgggactattattttcttttgaatcaagccagcagttctattatgttatcctcatgtgtaccataattttgtgtcaatacacttctttaggagaaggggaccatacgtagattttgttcgttcaaatttctgctatataaatgtaaaaggaaaacatattatccacaattccaatcatcctatttttatgtgaaaatataaacttatccttgataattgtaatgatgtggaaattctcaagatggtatatgaaaagcacaacatgaaacttgataatggtctcatttatagagggaattttcaaagcctataagaagaactataagaagaacagaaaacttcagcacgataagtgttatatggctcctttgtttgtctatgtctgaagtaaatccttcttcaactaatgggttattacaattagtactaaccactctgaaaatatttagaacaaggagatgccagaacagaaaatcaagttttttttattctatcatgggggagtgattatgtgaaatcaacttttggtctgactgctaattactattacctccgtttcaggttataagactttctagtattgcccatattcatatagatgtttaatgaatctaagcatgcatatacgtctagattcattaacatatatatgaatgtgcgcaatgctagaaagtcttataatatgaaacggaggaagtaccaattttgatgaacatgcactgtcacgttaaagaaaactgctgtttcaccctttacaaaaaaaaaaaaaaaaaatctgctgttactgacaaactttaacattcttcatcgcaggctaaacttgcagacattgatctatttttagataataatacaagcggtgttatccgggaaggaagcatgctgaaattgcggcacaagcagaagcagtgcactcccctcctctccaataagacccggtatcaatcgcggaaggtgaatgctgaatgtcggcctcgggtcaaggcaagttctaagaactcattcctatgcaaacaacttatgcaaaggcaaaattgataactgttccaaatcaatttccacaagttttattccccatctctctaaagtttcttatgtatttgtctatgtttttggttctttgcaggggaagtatgttagccaggcttctcttcttcaacaagcctcagagaaagagaggtagaaaatgataaaagtcctcccatggacatttttggggcctcactctccccctcctaaagagaagcaaatgtgcttctctctttttcatttctgcactttaatcatgtaaagggtagagatgcctgtagagtggcatgttgctatggggatcagataatctttgtccagttctccagctataaaaatgatgaggttatcacccccagttaatggagtagtagtattttctgttctgttctttcatcttaatcctctgaaaggcaaaagaagagaaaaaaaccaaacagggagaaatgattatgagatgaaatttgttagccatcatgtccatatgacgcctgcaaagccgtcagagaatagaagctgctaaaacacctctgatgctctaaaattgtcaaatggagtaaagtttatccactgcgcctgaatctggaaggtttcctgtctacgttcagagattcccctaatcaagatttccttatgtcttactccaatcgaaatggcttgtccaagttgcaggctttcagcttggaagggaccaaaatgctgtagggttggtgaagattgggtatttgggttggtggagattgaaatcctgtgctttggccatttctatggtctcataaatatttgatgcttattagatttgttttgagaagtacaattatagtatcatagtaataaacttagatagttagagttctacaaaatacagttctgaatgtcaaatactcaaatatttacaaccagatcgagtacaaaaaatagtttgattgaatggaaaatgaattaaaaattcatactgaaaaaaaaatgatgacctaagatccccttttgttctaattaagatatagattttaccttgattttcattagcacacatttcaaactgtatttcatacatatagaagttactaaccccatcctgaaataaattcatttgtcagccatctcacaatatcacacatgccaataaacacaaaatgaattagaatacctcagttatatcatatcccaatacaactatttttatattttatatactcccaatataattattctatatttttataaactccaatacagtaattacaataaaaataaacttgttttaaaataaatggtactccctacgtcctaaaatataagcaatttttagtacagtagcaagtcaaatatttttaactttgaccattaataaaaaaataaaaagatcaatcatataaaattaatgttactatgtttatcattaaacaaattattataatatatataactttttttcatttaaaacatcttacttttatagatattgacatattattggtcaaagtagcatctagtagaccgtgtcaggtctaaaaagaattatattttgaaacggatggagtagaaaataaaacaattctaaatgaacttgagggaggaggaagtagcatctttggggagcgagctcctctaacgtaaagttagtgtggattccttagagcaagtttaatggtatagccaactactagcttcaattcatttatagccaatctaatagctcgtccatacaataattacacagtaatacactattaatatctggtcccacctgtcatatatacactgcgtcttgtagtctgtgctacagctagctacaaatctgtagcacgctgctcttctctcttcttatttatcttcttaaaatatatttgcaactggcttatagtctgctattgtagatttgtagccagctgtagcacggattccaagacgcactgtgtgtatgataagtgggaccgggtattaatagtgcagtatgtaactattatatgaatgagctattagattgactataaatgaattagaactattaattggctatactattgcccttgctcttataggtgagtcccaccttcatagcccatatgtcagtggcaacgctgtcgttctctctggagagggagacggcgacggcagtgatggcacagccgccaagacgataggaggtgcggtcgccaaaaaagcgcaaacccagattctcacccttttataaccattcccccccaccaaaccaaccaccgccccaaaaaatacccgccgccttttctcccctccccgccctgatccaccgcacggccgcgcgcgcgccacgccggtgtggagaacgatggccgccctccgcctccccaccccgccgccgccccgcgcccccgcgccgtggctccattcttcccaccgccgtcgggttgcggcgccgcggggcgcgggcgggggcgggggcgggggcggggcggtcccgccgccgccggtgaggacgctcctgatcgacaactacgacagctacacctacaacatcttccaggagctctccgtcgtcaacggcggtgagcctccgcctcgccttccctctcgtgaaaccatggcttgtgattgtcactgcttttgctcaacgtttccatggccggtgttttttttcccagtgccgccggtggtggtgcgcaacgacgagtggacgtggagggacgtgtacaggtgggtgtacaaggagagggccttcgacaacatcgtcatctcgcctggcccgggatctccggcctgccctagcgacataggtgagcatctccacttcagttcaatcgtgtggaatcagaattagaaattgctgcttgtgcttgttcaccatttctacgtttgtatctatgcaggtataggcctgcggatactttgcgagtgtggagatatacccatcctgggtgtctgccttggccaccaggtcgattccttttttgtgttaatccttgtgaactcatgatcagtcctgtaaaatggaaaattcatggacaatttggtggtaggttgaactgaaatggccgttttgttttaccactgcaggccctgggatttgtccatggtgctaaaatcgtccatgctcctgaagctatacatggccggcttaggtaaggccttgaactctattacatgcttaatactttcagctttctgacctgtacagcatttattttttatcttgtgcaattgctatggattagtgtgtgtcatgcataatcttctaagttctaggtgttctttcagttaagtagttaacacatgtcttgattttgataccccttttttttatgtcagtgaacttgaacacaatggatgctacctctttaatcacatcccatcaggtataaactctggattcaaggttagtgtaccactcatgttgctagccatattattggggtttcagcctctatatgcaccgcaaagaacactctacttacagttgttatttttcaggtagtgcgctatcactcacttgtaatagaaccagactctctatctgaggatcttatatcaatagcatggactgcttctccaaaaatgctctcattccttgaaagcgataagcctgatataactagcagtaccttgtggggatcattggataacttattcgtaacaaaccagtcagagtgcagtaccactgatggaaaaatgcccagcataaacgatgcaagtgagttagatggctacagggttctcatgggcgttaggcactctaccaggcctcactatggagtgcaggtatactgtctatatctctgcaatgttttttatttctttttttcactattcttatatttgattaccgtcaaattcagtttcaccccgagagtgttgctactcattatggaagacagatatttcaaaacttcaagaagataacaactgactttggattacagacaccattgcttcaggaaagaaaggttcacagtattggtaaactggaaagatcccaagtactaaattttttgaagactacaagtactatatgtgaacaagtattttccacgcatctcctttagactccaccttattgactttcttattgtactgcagatcagttctccagatctcaagaactttgttgcaaatgacttgttacattctgcaaggttgaaactttgggattctgttgggccttgtgctcttccaaagcgaagcagtggggacaaatgcttacggttgcaatggaaaaagattgataacttcctcaatcgcataggtggctctgaaaacattttttcagtgctttttggccatcatagcgctgaagatacattttggctggatagctcatcagttgaccaggtgctaattcagctagctcttaatatcgtttagttctgtcctgtatagattttatctgatgttaaacgaagattgaagggttttgagtctattaacaaaaatgactagatgatcatggacatgtggaacttcactgcatgaagaaacaaaaaaagtattcccctgattcaatatacttaatttcttcattctgacattctggcagatatagtctgcagaaattaaatgagataaagttattgataatgatagttttttatgtacatgaattgagttggttcaaaccagtgcctatttgacagagagtagtagatgtgtcaaaacttatcactgttatcctgtcattttctccccctcatgaaggcaatgcatccacttttatgagttgagaggttttttcttcaaagttgtgatgtggtgctacttgcagaatagggcacgattttcattcatgggcggcaagggcgggcccctttggaagcaaatgacatttcaccttgccagtcaacggtaggaaggcactttcctgaaacagaagaaaaacattctctatgtatttatataaaccttcatgttatttctgattcctcctatttcgttctagagccaattgtggaggaaaccttactattcgagatgcttatggttgtactgtcagaaactttctcaaggatggtttcttggatttccttgacaaggtataggttgaaatctatgtatcctaggacctagatatagaacttcacattttaatctaaccttgtattctggtactatattcaattatgtagtcagtttcatactttcattttgctagtgcataaatatgaagtttgttttatgtcatttgtagataggagaccactttttttttataagagctatattcaattatgtagtcagattgattttgctagttcataaataagaacttttatgctacttagaagtaggagaccaactgctgtgctataagaaagtgggttatggaagtccgagtgcaaatttctcaccagcacgtatgagtcatctcggtccattcacatatgccagcacaatgatgtgtttgactattatcggaaatgttgggggaaaacatgttgttttgttctgggcatctcagtataattgtattctgcacattatcctatccttgagcttatcagctaagcagactctatctagctatatgtgtttgtgttgtttaaagctttataattccaactaatttacaccacaggagatgcaatccattcaatacattgaaaaggattatgaaggacttccatttgacttccatggtggatttgttggatacatagggtatgcagatttgtttttgcaattcatatgctcttttgtaacttgtattggatatatatgcatagttaattggttattatatgttgtactgtcttgttttatccacagctagcttattttttaaaattaacatgtccactgttttttcctggatatgcgtagtttgttactccttccgtccacttttatagggcttgttttgatttggcatagtcttcagaattaaatttgaccattgagttatcacaaaatttattgttaatagctacaaaacggtgcaatacacgaatctattgttataggttttgtacactaagtttatgtgtaatctgattattgttgttcaaaacataattagcttgatttttgtaagtacacatatgctttattttttgtggatgaaggagtattcaactttttttctcaatctgtgctctttcacgtgtttgacttacatggttgcttcacttttttcttacatggttcattacatttccacttgtaccagatatggtcttaaagttgaatgcgatgcatcatctaatagtgcaaaatcaagtacccctgatgcatgcttcttctttgctgataacctagttgtggttgatcacaacaatggggatgtgtacattttatcattacatgatgaatattcttctggtaatggagatggagattaccaaaactcaatacatagtttatggttagcaaatactgagaagaagcttctcaggatggatgccatggccccaagattatcgatcaatggaaactcgtcgatcaatgggaactcatttaccatatcatccagtgtgaataagcaaagatttgtcatcgagaaatcaaaagatgaatatatcagagatgtgcagagttgcctggattacataagaga

SEQ ID NO: 82377 - DNA, 7367 bp, Oryza sativa
aacaagtatttactagttaattaaaaatgttgcacatagtattattcatatgtttcagtaaatattatacgatgtttcaatagttaacatcatgtgattaaattataaaaaaatcatgtgagatctttttataaaaatttaattataatgaataaaaagatataatcggatcgcggatcagataaacagtttaaaacataaaatagttaaacgtatgcaaataaagttaacaacctagaacctaggcatgatgcacggtcaatatgtaagctaagcacagtaggagggctatccgatctttagaatattatcggacatccgatggttagttggctcctaactttttttccaaactaccaactttctctaaacttctccccaatttcaggaactaaacacagcctgtataacacatgtaatgcccatatatgcatctcaccgttgagacgataaacacaattaagatgtttgagaagaaaattggttctgttagctaagctgatgaatcaaaacattctaccacaatttgcatgcaaggaggcaacaaaatgtgccaatctcgtaatcaccttaggtagaaggaagcttttttaagtttcactccaccaattcataatatgaacatacatgataatgtgcacggtcacagctgttcttgctaagtaaatgagaaaagaaccacataaagacatggtttactgaagtccataagtcagtaacattcaatccacatgaatccggcaagcattttacactttacatattctaatccgtcaatttgcactcagaagatggctggacgtatctcacaaaggatggctgtgcggagggaatgagttcccaagtcagagagtagtgtaggaaaacacatgagagggcgacgtcctctgtgacgcgcggcgaggcggcgaccgatgacacacctaactgatcaataagaccacacgtctgagtacttaatataagtttcgagggagcgtatcctatgcacataggccctcgcgtgtacacaccgtgtacaccaactaaaaattatcacaaaaaattttagaaaaattcatacatgcactttcaatagtattacatctacatgcaaagtcgcatcttcaaattcattctacatagagaataacaaaaaagataaaattctgacaaaattgtaaccttaaaactgtcagttttttttgttacggctaaaatataatgaatttgacgttaagattttaaccctaggtgtaatacaactgaaagtatgtgtatgattttttctagattttttggtgacattttttagttggtatgcacgtgtgtacacgtgagggcctgtgtgcataggatatgttgccaagtttcgaaccctaagtagactatataaatagagaacaaaatcaaaataggggtacttacaactgagtagtaatgtactccccgtcaaaaaaaactaacctatgatagaatttgatataatctaatataacgaatttgtatatctaatcatatattagttttttataagataggggaggatgcacaagcagttagcacagactgactgcacagggcacgacgtggcatgcttcgtgtagtttcaaaacgcacaaaaaaaccatacacgcccgcgacgaaacgaaggcagaaggttcaaggagccccgtcgctagacctgttgaacaagcccatgacaccaagaggcctagcccgttaaccaatcctgatttcacggccccgtccactccgaccactcggcctaaccagccggcggccgcgacgcccgccgaccagaccagcggaaacaacgcgcgccgctgctgcggacggatcgttcacggcacgcgtgaatgcgtgatccgcctcggcaaaaccggggcatcctcgttcgtagccgcagcgggacattctccgaacccccttggtttcatacgtaccgtccgatcgagagaagctgagaaggtcatgcaggggttcggaggatttttctccgaacctctggagggtttacggccgccgttcgatcgagaatgtgctttcaatttactttgagatgataaacaccaccacagtgagttcggctttgcaaaaccaacacgttgttcctgttgaagttaagtgagaacactaaaaccaaccaactccaataagtgtggctgtgagcctgtgatagaggatctgctgatctactagtatgctgctgctgttgcattgccccaatattacaaaaacccttctactactggagaaggtgatgaacgaggcaaacgcacgcatatgcatatcgcgaatttcaccctaattcttgctcatctaccactaactaaccagcttcctaagctaaagtggctatggacctcgcctaacgacaaggatgctttgctgctcatgcgtcggtccacgcggcgaacattggcaggtgcgcgatggacacgccggccctcgccggcaccgagctcaccgccggcgagggcgaggcccaggtgttcagcggcaccgggctgtacagcttcgacgccgccgcgggcttggcgaacagcgtggcgaggacgccgccgccgccgccgccgccgacgcccctgtcagggctctgctcccgggagttgcccaggctcgtcgccgccatcgacatgtgcggcgcgcgcggcggcgcgcccgccgcgtccacggtcgacacgatgtcctgcagcaccgagaaggcgtcgctcggcaggaggtcatggtgttggtggccgccgtgcccatgctgctgctgctgctccgttctcgccgccgctggcagcgcggcggcggtggccatcttccactccgccacgttcccggcctgcaccaaggcggccgcggcgtcggcgaccgccgccgcgccgccgccgtcgccgaccttacccttgcgccgcgccagctcccccgggaggagcgtgctgctctccaggatcttgtccacgtcgtacctcgtgatgtcgaagttggtgacggcgttgagcccccggaacttgatcgccgccacgtcgtacgcctccgccgcctcctcctgcgtgcctgcatccacaaatacaaccaatcacacacgacgacgaactcactcaccatcaatcaaaagtaaaatccgagttttcgccgccgccgccgcgcgcggtcaggtcacaggtcaaaccggcatggcgcgcgcgccgcgccgcggcaaaagccgacgcgactgcggcgaggggcacagcctttggaaaggaagcgaacaaaaggcaaaccaaaccaaccgcgcatgcatgcgcatgcatgcatgcgcaaaagcaccgctgctgcagcaatcaaaagcatgcaagaaacggcagggcgaaacattctttcgagctgggccatggtggtggccatggccgtgcagaagcagcagaattggcatcattgaatctagccatagctgactgaaggtcttatgatcattgtgacaggacacaccctgcgtccttaaaccgtgacagcctctgcaaagccaacctcatacacactttgctgctcatcgctgatcgatcacatgatgagaagaatccggacaagaataactactagtagatcatagtgcagttgcagagattggggaggaagaacactcactgaatgtccccaagtaaaggtccttgttgcccgagacgcggccgattcgcgcctgccatctcccgtgctgatgatgcctgcaaacattgacagaaaacacaccaagttaatcactcagttaacatgcttccaagatccatttgccgtatttttgctgcaaccatgtgattaacaacgacctggtgactccacggtagatcgaagcgccacgcgagaagccactgcttttcctgcagcaaacagacatggaggtttacagatgtcagtgtcacaatcttgttcgttcagtgacttggcgatttcataggtagctacgcagtgtaccttctgaggtgagccacatactcctgcctgctcatgttcttcatctcctccagctcctcctggtagtcctccaactgcccagaaaatggtgaaaacaaacgtcaatgatagccgtaacatcataactacagtcattcacagtgcccttgagctagcactctaaaatctaaactaaaatgtgtactgtttgcttgcaagaaaagcaacaaatgaactaatcagagttggtaatttaatcaccgggaagttgatgtgcgtggaagggccccagtacttgagcgcagcaagatcatacgccctggcagccttctcctccatgtcatacccacctagcaaaggttacattgcaatctcacaatcaaatctttgtttccaaaaactaatcaattcatcccaagtacttgtgtactggtactcaccaagatacactgcagcccatgccaaaagattcagcaggatgatcatgcaagaacatacatatacatttcatcagcatttaaaacataagaaagtgtgattaatcacaatgtcaagtttctctaaccttggcgtccttttctggtctggccttccttcttgcagctgttgtcccagaggtgtgcctcatatctcccagtccacctatgcctgctttttacaaggtttttttacttgaggttaagtgaagctgtgaaggtggaagccatggcggcatggtggcgagaggtgtctgtcactatggcgctgctagctactacctggtgacgcctctgtactgcgacgtcctctggccgaacgtgtcaatggacttgcggtgcaccggctgcttctgcccggcgcggtccgcgccgccgcgcttcttgctcacggcgtccatggccatgtacggctcgccggcggcggcggcctgcacggtgacgcagctggactgggacccggccgagctcatggacagggtgagagggtgcaggtggccgccggtggggatgatggggccggcggcgcagacgtcgtcggcggcggcgttggcgatgtcgtagccgccgccgtgcatcgccgcccagccggccgccactgccgcggcggactggtcgtgcaccagcgccgcgtcgtggccggcgccggcgccggggatgacagcgcactgcaggaagccgccgccgccgtggtgcgggtcgccaccgacggcgccgccgtcctgggcgtgtccctggtggtgaccgtggccgccgtagtagaaggcggagttgtccaggctcagcgccatggcggggcccgcgcctaggaaatcctccagcttgggcgacgccgacaccaccacccctggtcacgagtcaaagccaaccaagcgacataaagagacgcatttgctacaagccaaagcgaccatgaacgcaactgtagccacagcccaagtaagaagaacccgcgctgtctagacgaacaccagcacgagctagccatctctctatccagctactacttaagctagctagctcaccttgctgttcttggtcgcctccccggagtgcctccatgatgcagagcgagccgtcggacttgagcggcatggaggagaacccggcgccatagtacgatccgccgccggccgcggaggtgacgacggcgtcatgcccgccgccgtagtagaaggaggaggcgacggcggcagggttgtagaacagcccacctccatgctgctgctgatgctggtgcacgtggtggtggtggtggtggccgacatcgtcgacgccgccggcgcagtacgtcgccatgtgcggcgacagcgagaatcccagccagccgccgacacctccggcggtggcagccatgctgccgctgctgctgctgctgttgccactggccattgcttcggttatcgatgaggagggattcaggaggaggaggaggaggaggagggaatgaggcgatcaatcattggcgagtacatggcgcaatgatgccgccacatcctccatttctatcgacgcgcgttcggtttctgtgtgtgtgtgtttctgtgcgcgtgtggcgaagcaaaccgtggtggcggatgaggcgaggaggaggaatggccggtgttgttattaaggggaagaaggagaggagagtggagtgggggctttgaaagtgtgcaaaaggaataagttgctgatattggtcttgagcttgacccgttctcttttttttttcaaaaaagaaaggggaaagagtagtactactacaacattctgtcttctttacctctatgttttgcatggggatctgtgttcgtagaggtagaaaatattttccatattgcccatattgcggtggtaatctcgtgggtaatatatcttgatttttcttagtagtcttattatgattttcttcgagtaacccgcgtggttatcgtgataaccgtgataagaatcggtaactaactcttatactaaattggcaggagaaaaccttcgtgatatcaactatagtagctaacctctattaagggtcttttgatttggaggaaaaaatataggaattttggagaattttaatcttgtaagaaaagttcttatggatggctttgaatcaaaggattaaatcctatccaatcctttaaaattactatagaatggacaatcatatagagattttgaaaggaaaattagcaagagctcaaagctcttggaaaatttctttgagttatctctctcattcgattcaggtgtttttcctaagaaatcaaacagtcatttctatgtttttttttctatgttttgcaattttttgttacggcttcaaaatcatgtgttttttcttgtttctttatttttttaatccctataatttaaagggacccttaaaaccggtaagtgaaaacccagggtttgatattggcgatattgtccaatgatatgtactcttacaacaccaaatctcagcttctgtttttgaaatgatccgagtttgattttttataataaaatgggataaagccggtctcaactctctttaaccaacccaaaattatatttttagacgatgagtggagtagtacgacgagagtaaagagattcatttgcaagtctataaagttaaccaacctttaaatggcatcctcaatttatgttgtgtatagctagaaatacacactagcgctttgtttagttccacgctaaaattaaaagtttaagtaaattggaacgatgtgacggaaaagttggaagtttgtgtatgcaggaaagttcgatgtgacagaaaagttggaaatttgaagaaaaaaagtttaaatctaaacatggccctgtttggatccggagggctattaaatagccctccagaatcttgctatttaggagtattaaacgtagattactgacaaaacgcattccttaacccctaggctattttgcgagacgaatctaacgaggtatattaatccatgatttgctacagtgatgctacagtaatcagtcgctaattat

SEQ ID NO: 82378 - DNA, 13542 bp, Oryza sativa
tccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaaaattgttttggcttattaaggaataatgggcaaacaataagggcaatcccaaccctccacttaggatggtgtatatggcattaactatattgccatgtaggacttttagcttatgtgacactatattaattaagagagagtgtgaagagaggaagaaactaggtctcatgcaagacacagcttcaacacgagaacctatacactagacactatcaagttttgcattgggagagaatagtgtcttcataatagatgaagaataaatatgattggtagagaagagagatgatatatttattaatggcccactttaagaaaccatggattgtagagtgtagtttctattatgatgtcttattgacatggcaccatagacactacttatggacactatgggttgggactgccctaagtactccctccattccataatataaggcacaatcatttttttagatgttcaatagtactccctccgtacttgtaaaggaagttgtttaggacaacgacacggtctccaaaacacaactttgacttgttgtttctataaaaatatttattgaaaagtgatatatatatatatatatatatatatacttttgtgaaagtatttttcaagaaaattctattcatataatttttacattttcaaactcaataatttgagagttattcatgatttatattcccaatgtttgacttaaacattgtcctaaacgacttcctttacgagcacggagtgagtacaaggtatgcatgcatgtaggcaattaactatgaccaattttccattaaattattactttttaaaattctccactctcatgttctctaattctattggatgcatgcattgtatttattaggatgatccaaactacaagatgataataattattttcttgatctttaggttagggatggttatgtcttatattttggaatggagggttacctagcagtacagctaataaaacagtagtactactgaagctagtagctaagactgtctccaacaagtgacccataagggcacccaaacccaaaatgagtctccgatagtactatttcagcctccaacagagtacctatacagaagacccattttgcgtgttataagaggcataacctaaatctgagtatcctctctcctgaagacctatttgcagtaagggttctcttttaggtcttattgttggagaagacaaaaaaaaagtattaaactctttgactgtagtgctatacaaacgtgaaatgggtcttgtattttgggtttcatcgttggagatagcctaagaaggaatagcaacggcaaagctgtcatcggttcgaagctgcccaactctgcacgttcactccgatgtgatccagtgccaatttgccattaacagtactccgtacttagcttcgtcacatcacccatacgtacggtacggctgatgcaatgcatgcaccatgcagcactaagtggtgtgtttccttaatatacttgttggacattaactagatcatcgaaaaagcggcgtaaccgcctgccaaatcgagcaaaacgtcccttggatgcattgcatacatgcatggcatgcatactctctcgtctcgccgtcatcatcgccggtcgacgccgccgccatcaccacatatatactcttcgctcgatcgtcgtacgtttcgatatctgactagctccctaacaatgacgcaacgcaaattgaatcaggtgagccgtgaacgaaacgattaacatttacggtacgaattaggaattaggcatcgttcgtttaggggtgataggggagattggctctcgttttccgcgcgcacgcttttcaaactactaaacggtgcgttttttacaaaaaatttcaataggaaagttgctttaaaaaatcatattaattcatttttggaatttaaaatagttaatacttaattaatcatgagctaatggctcacctcgttttgcgtatcttcccaatctcctcaatccccttctcctcaaacactcccttagtatacatacattataaacctaacaacaaattaggtttatactaatttgttctataaagttgttggagaaaccgtgtttttcacgcatatatataagagcaggtacaataacagactattagccaggtacaaacatattttataataagataaaagatgagagaaaaatacagactttaagacacaatgtatgtatgacatgtggggccatatactaaaagtatagtaaacaattatcgtaagaattggctgttagattggctataaatgaattggagttagtagtgggctatactattaaatttaatttgctctaatcctcgcggcttaggaaaaaattaacgggaacggaacaggaggccggtagctcgccggaggaagaagccaagaggcgcgggcggcggctgcggcagaagaagacggagtcgctagctggaggcggagacgatgctaggcgacgtgtcgggattcggcgcacgggaaagtggacaattaaatcaagcgatgatgtggatgtggatatatataatcctactcctactccactattgctagtagtaggagagtacataggccgcggcgacggcgagagtggcaagtgggggagtccgtgcggtggtcgctccctcctctcgcgcggtgacatctaagtgccgcgtgttctcctcttcctcttcccctccacctccatttcccattccacccccttcccttctctcgtcctcctcctcctcctcctcctctctctctctctctctctctcttcaaaataggtgggcggtgctctcgcctcccctccccgccggcttccgcctccagatccgcgccgcccgccgccgccgcgctcgctcgagcgggagctatagctgccgccttcgattcgacgctgcatgtactggcgagaggcgtagcgcgtggcgtgctctccccgacgcgcgcctcgcctcctccccgttcatgtaagtgggataaattcctcgccgcctcacctcctcctccagtacttctgtcacgacgccgcgtcggcgaggtgggtgggtgtgcttttcgcggcgagccgattcgatccgtcggcgtcggcgtcgtagggggagggggagggggaggctctgtcccgtttctacgcttccccgggtgggatttgcgcgcgcaatcaatgcggatggggggagggggtggttattggaggccgttggggaggggttccatttccgtactaccgtactcgatctgaattttcgggctagctgtgcgtcagacgtgatctgcagcaggtgccgaattcaactcaatttcgccacgaattgacaccacccccctcacctgctgctctggaatttctttcctcggttggattggaattcaaggtagcagcatgcaacttgcttgaaatactccaattagtgaggcttggttatgtacacacttcataattgtcgtgttaattgggaaggattatgcaggattacgagcataccgctaacaatttaatacttctaaatcagctgatgtggctagaggattaactttgttttattacttcctctgttcttgggaatagaacaggagaacataagtatagttgggatgggatttgatatggaaacgaatcataggtgtcactgtctgaaagcattgaatattacagttattgtctgcaatatccaaagtagatttgatcatatccaatgtaaatgatgaattgttcctatttacaaactctgctcttagagcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagatagctttgctctctctcttcatttaatctcttccaagtaggaaaatatgctgacatggatctcttgtagagagcttatagataaccattgtgggtgcccttaggtgtttcagatgccatgagatcttgtcttgctctaggaagcaaggatagaagtatgtggctgtaaacagcaagcatagaaccatctcttttatgcggtttcgataagaatatatataatctgcattttctccccttcctgattttgacaaattatcttctactgagttatctaaatgtttattttccttagtacaagatggcgatgatggtggaccctcctaatggcatgggaaaccaagggaagcattactacacaatgtggcaaacgctatttgagattgacaccaagtatgtgccaatcaagcccatcggaagaggggcttatggaatagtttgctcctctataaaccgtgcaaccaacgaaaaagttgcaataaagaagatcaacaatgtctttgacaaccgtgtggatgcactgaggaccctaagggagctgaaactactgcgacacttgcgccatgaaaatgttattgccttgaaagatataatgatgccagtacacagaaggagtttcaaagatgtatacttggtttatgaactcatggacacagatctacaccagataattaaatcatctcaacctctttctaatgaccactgtcaatatttcctttttcaggtaaggctcataccattgtttccatttttattcttgtttacttcctgttcacataatatttcatttattaattgttccaaaagaaatgttataagcagcggttccaccatgacgtatgatattgatgaatgtgatgtacttcttgctcctgagaagtgaaaatgagcctgttttgatggttcaaatccatctattagtccagtaggttgtcattacctattgcagctgctggcatgttgctgttgctgcctagtttcatttcttctattatcagataaagatacaagtgagccatatcccttttttttagtacagctgttggtacactctggcttttaggtcgaatattcatgataatatttagtgcttgttatagtgttttggccataatctaatgctttccaatggattcattaactagctactagttttcatatctggggaaattcacagcatttgggacgagtcagcatttatctacatttgtttctgaaataattcacccctgaacttaggcctgaatcggataatgcagcatttgaagctattgttctactgtgccattagaaaaaaaggaagacaaggaacagcaattgatgcgatgcacttacggttttaggatagaactccactagtcagaatctgggaactagggactagatatcctcaggaaaccaatgctaacctggaccatagctttgaaatcagaaattatgagaggtcataatgacactaaattgtttgatattgattagaaactacctgacaagatgtattatgtagtataatgattgtgaagtgtgagcaaaatagtagtcagcttcaatatgcctgatagaagcttctggtactgcttctatatggtgcttttgcttaggaatactgaaataatattctgaaatcaattcaatgctctactatatgtgtgcaaggagatttgcatgaggttggcatttaaacttcttatgtgcactctttaaggcaagcttttgcgtgtgaagtgaagttagactttcttgtaggccaaaagcttcctagtcaatctgccttttaaattcttttaccttgctattatgagaatttttacattttctgcctattcacgttgcaatttctgacatactttttcctattaagtgttttacattttctgcctattcttttacatttacattttcttcctattcttttacatctattaagtttttcttttgggttgattgttgtagctactccgaggtctgaagtacctccattcagcagggatactccatcgagacctgaaaccagggaacctcctggttaatgcaaactgcgatctgaagatctgcgactttggtttggctcgcacaaacaacactaaaggccagtttatgactgaatatgtcgtgacccggtggtatagggctcctgagctgctgctctgctgcgacaattacggaacctccatagatgtctggtctgttggctgcatctttgctgagcttcttggccgcaagccaatatttccaggaactgagtgcctcaatcagctcaagctcatagtcaacgttctcggcaccatgagtgaagctgacattgagttcattgacaacccaaaggcccgcaagtatatcaagacccttccatacactcctggcatccccctcaccagtatgtacccgcaagcacatcctcttgccattgatctgttgcagaagatgctcgtctttgatccctccaaaaggattagtgtcactgaagctctggagcacccttacatgtctccactgtatgatccaagcgcaaaccctcctgctcaagtgcccatcgatctcgacatcgatgaaaatcttggcgtggatatgatccgggagatgatgtggcaggagatgctccactatcacccagaggttgttgcaggagtgaatatgtgacaggcaagaacgaacatgtgaaggcaacgtgctacactaagatcttcacatgttggttttttgtataaatcttattcgcgattgtcgcgcctatcaagcttaagctatggcgatgtcgcccaggtgacctcttatgtaaatatgtgcgaataagacagcattctggagttgttcttcctgtggacctctacttgtagtatatggactaatgtgttgtatgagtacgtgaagcagaattcggtattatcaaggcttgtaatgttagatgctcttatattacactatgaagtgtcaactttcaagtggccacgtttacacatatatttgctatgctgacttgctgagacatgcttggttttagggcggtttgcagcttaacatgtgttcctttcaaagagcagtagatctgcagtttgcatggtattcctgtccaaactgtctagtatactctatactgatactctggtataaagctccctgcagtttgcaactgatgtattctggaaactgctaagacacctcagctacctttgtttgttttaaagactatctcaactacctggaactctgcattttgtttagtacggcaattaaggactgagttttcagcaaacagacttcgatgctatttttgattgaaataaagcaggcaaagttcggtctctcacataaacgaaacacattcatggatgatgtcgaaagtgcaacggaatgatacacatgacatgtaacatttagccttagaattttattgattcgacgcagcaatccaacttttgacggacttggcctcagaatgtcgacccattgaaccccaaattgaatccctgtaagaacaaaaatgaagttaaaatgcagtggagcaaaatgttgttcagaccacagcagcaagcagtcgcaacgggattaaggaaaaattgactagaagcagtgtcatcagtcatcactgtgtcagtattagaacttaagctcgagtggaaggagaagttagaagaggaaaaatggggaaacaagaagtgagctgaagaaagattgcaaccttgacatcgtcaaatttgacgtagaacctagacctgctgacggagagcttggtctcgaggatctcggcgagagcggcgctcagctttccgttgacgccggggccgatgccgccaatggacatgagctcgccgtaggccgccggctcctcgctggcggcgaacgacatgggcaccgacccgctgatcgacaccatgacgtactgcggggccatacaaggaaaaagccacggaggccgcggcatcagcagaaggaaggcaggaggagcagagcagagaacggccgcggcattccgccgagcaggtggggggcgcgtacggattcgggcttgccgatgatcctggcgagcgccttggagcagtccttgatgatgtcggcggcgacgacggcgtcgacgggcacgttggtggtcaggctcagctgcggcatcgtcgctgggatggtggcgcgcgcgtcgccggccggctcccctcctccgccttggctgcttgggtggtggtgggagaggtggagaggatagcgaggcaaccggaagatggaggagagagaatggaataattggggaaagaattgtcggagagcggccgggccaaataatccaaacggtccactttggtgagaatgtcggcccaagaattggcccaggagtattcttgtacactcctggcccgcttagtatattcttatatactagaggatgctccgcgcattgctgcggacttagttaacatcaatttattagataggagttaccatctcatgaaaaaacaaatagttttttttggagaaattctttttagcagccctatccaaaatttgtagatatttaagtagcacatgtcaactgaaggggcgttcagccataaagctcttttatacggattgacaggctggatacatgtagatgtgtatagaaatgagccaatgtgttcatgtgagctatatttggcactgatgaggcgaagagactcacccggtgactaatgggttgggctctatgctgcattccatccaacgtctaagaagtgatctaatgtattcatcaaacgattcacaatttgatgatgatgtggaagcacgaggtttgagcttttggccactttatagaaagaagggattgggaaaactaaatttcacaaacggaattttgctatattactgtcgacggttttaccttacgcccttagttcattgaggaagtgtgctaccaccacgccaattttttttttatgatagttgtattctagtcacatataagttacatatgagttacagtgtagttacaatatagttatattttaaaagttttataaagaaaaaacttgcgacatttttttagataatccctttcacaaaactatatgtactttgaccaaactatcataaaattgcaaatttagcatcttttttttttcataagacgatagatttaatatcaagtattataaaactatagatttaatattgatattatcacaaaactacattatattagagtttaaactcctagcattaatgttatttttaatatataaatgctatagttttatgataattttgttactaaatatgtagttttataccactttatcttaaatctatagtttcgtgataaattatgtattaaatatgtagcttgtgatataccaatttaaatttatagttttacaatagtctggttaaattaactgtagctttatgaaatttacttttggaaatctgcaatgcccccactcgcttcggcgtgagcggtccgcacatcccctctgcttcggtcacgcaattagtcgaacaccatggcagttcacatctctaactcatacccaactccacatctctaatttatttttgtgagagcacttcacctagctccactctcattctctgatgttcactgtgccaattctaaaataaaaaaagttttgccaccgttacaatcatcaagggaaaacttccctgaattgggtcattgctttctagttatcatggaattccttttcatcataggacattacgaattgccttgtaataagcctatgaagagaaaataatcaataaactttattagtggatgataagctagctgttagccattggtggcaggttagtgctgatacagtctagcctaataaatgctcctttatagtataaattttcttgtttaggattcctagagggccttgaagagacctggctattttaaggctagatttagcgtgtggtaagaacatgattgaagttaattaagaaataataccacttagtcaatcggcctcaaatctgcttccctggagattatatagtaaataatggatttggcatctgtcatcggggtaaggaatctgccagcaaatcatgaaaaataaacgagatttgagtgagaaacgtccctccaaatattttttttaaaaaaattatgagcgtgttagagattaaacacgaaacctcgaattaaaaccgcataccccttgtcactgcaatatcaagtgcatcttaaactgacctaagctgacctatcaagaaaaggaaatactacctgctaatacaaactgacctaagctgaaatcaatgatattcatacttctggaaaaggtttaatgggtgtcaaatgtacagatacctgggtcaatggagtaccattggaataacaattatgaatgctgtacaatttggtggtattcagaaaaaaagttgtgcaatttgacttccactagaaactgtactaactgtgaatctgtacatcatgttttcacaaaaggcttgaccgcttgacttgtttataaggtttaggaggttgctgtgggggtgatatttgggactaactgctttctatgtgctgctaaccctgtggtatactgttatgatgatttggcaaggaagtcattaggacatgggttgcagaagaccaaaggcctaattatggcagaaaaaatattctcaggattgatggtatctgaaaaatattgagcgccatggtggctacgcgattgtgacaaaaaacgtcacctccaaagtatgtggactgatggatcattcagattcgttggttcctcctgcctgaatttgttaatctcggcagcagccggcgtgctatctcagccgctggctggtggaaagaatattcaatggaagaaacgagtaccttctgttctgttgtgttgttgtgttgtgttcatgattgtttccatgatcatttgcccagtacttgtggttaattgaatggtgacaccatgagcccatcaggggaggagaagaagaccccaggcaactagccaactaccataacatgattaatcagtaaacctatcagtgtcagtaggagtagtgctactaatctaatctaaatggagcgtcctagtcatgctacaatgcaattctgcaaaccacagtttacaactctgtttttcagaatacaaatagtctatcatttaaaatttatattaaaatataaaaaattatggagtactggagtactgtactattgaccacccctcgtttgatttctctctccattatcctcgatcgaccacattttcctacttatttaagaagttatagaagaactacaatcttttctacttaattttaatctaaactaaaatcttttaaatatgtccatattattgaacgaaggtaatcttcacctttccactctgcgatgagacattcattctatctttccgcttatatttatacttataagctaaattttaaattttgaagttttttttatcataatttatttttcagcttttaccttttagattgttataaaaatatatatataaaaattttatttatatattatttttcgtttacaactatgcgtttggatagagccgattgcttgagctaactactacttcattcgtctcataaaaacgaatttataattagatgtgacgtactatagtacgataaatctagacatatatatgttaaatttatagtactagaatatgtcatatttaatataaggttagttttttatgggacggaaggagggagtacgtgcctttccatcctcccctgttagcagcagtacgggcaaagcaagtgagagccgcattggccgtgggatggtgtactaggtcagtcacacgtactacgtgtgaccgtgagagccagccagactcgcagacgcagtgtgcaaagtctcacacgtgtatctcatagctttggaccagaagaacacatgtatgtaggggtgatgctaactacactacgcatgaggtgtgagggtagaatagggctgtgggtgtgtttagttctaaattttttctaaacttttaactttctatcacatcaaacatttcatacacacaactttttagttacatcgactctaaatttaatcaaattttaaattttgcgttgaactaaacacagtcagtctagaatggtagagggaagaagaagaggagaaatgtcgtgagaggaggtggggtccacagggaggtaaggtgtgtgatagtgacaactgaaagagaagtttgtcccttcctatggcactaatggtgttaatgtcttcagagacattggctgcctcttctttctctgatggactctaaaccctctcgattctactccactccttaaacctctccagtttttgtgtaattctgttgtcatacggtttattgtgtggttgctgaatcttgaaaatttaggatccaatggttaggagatttttatcggccctgctgtctccagagttttttcggttgaggatcccagttgtaaatttgtaaccagtttttttgccctgctttctccgccggccgatcgatcgattatcgacctgtatgcctggtggtgtccgtgagctgctcttgatttcttccaagaatacaaaaaaaaaaaggattacagctttgccagtggagtttcctttttgtgctcctcgtgtttgttcttgggcagaaagcctgacgaaactgaatcctccaacaaaagcaaatggcgaagcgtgggctttgttgttaattatactttttgagtttgcccattcctcgaggttggtagtggtgaactggttggtgttggtgttgttgttgatgcttctttgatgagcgcactgttgcttgcagggctccttaattaatcgctttttcccaagatttcgtttttaatttatatttatatactcttctttttttctccggcttctaggtagaagcagggggagacagagcggccagtgtctttctctacaagaaattcctcggtttccacgcgcgctttggcatttcttttcttttgtttttcttttttttacctttcctttcatctcttccgctggttttgtgggatatttgtggggggttttgggggtttagaatctctttgatttcttgtgctttttcttgctttttctcgtgatgttggagtggtgtgttttctgatttgatccgcccaagtagcgattttcttttttcttttcttgttgtttgtttggaggggggaaaaggttgcgatcttggtggcgcgccgatggcgtcgtcgtgcatccccaccggcctccggctggacctggagatggtaaaggcggcggcgccgcccggtggctcgtcggcggcggcgcactcgtcggcgtcgtcgacgctgtcggaggcgtcgaactcgtcgtcgtcgtcggtggcg

SEQ ID NO: 82379 - DNA, 799 bp, Oryza sativa
aatggtagtatgagcttccggagaaggaagaaaaggaagatcaagttggctttcttccaaaacacaatctgcagcagaataaaacaaaattaataagcaatcagattggtaaaacagagctatcaacaagccagttgtttcatctagcaatcagattggtaaaacagagctatcaacaagtcagttgtttcatccagacatcctatcaggtagtacattattttgatgacaatgacaacaaaaggtgataagcaaattcatattctatcatggtaatgcaaaaaaaggtccagttgtaacatgcgcacaaatgatatacaattagatatcaacattttatattctagtgagatggatgctgctcgatgagcatgcgtctttattgaagtgtataaacctaagtacttgagagaaaaggctaatggtacaggacatatcaatatgtgaattaatatttcgagaatcagttaaagagtataaaaaaacctctaacattttagaatttcatcatgttaacatccttggagcatattcccgatgccatgagcgcgtgttgtgtatccaacaaaagcaccgaacacacttttttttgtcaagatcacattatttacctgttgatgttcaaattttcactttaagtaataaacggattaaatgatatatctgacatgctatttgaagacaaagttgcacagaatggatacgggaaaaaatgctgtaaagccttaattttatttcgtgtttgcattaacagatatatttatccagaccaatcggatatctcataacaacatttggt

SEQ ID NO: 82380 - DNA, 3216 bp, Oryza sativa
ctgaaggagaatagcagctgtaccagtacatctgtggatatctatgctgagactctctacagctcttgccagaattgcctggaatccttgttgaccttgtttcgacaagcgactgccgacgattttgctgagcaatccttagaccttaaagagccagtttttcgacaaattgctctagaagcagataatctcctttggttaactgagattttggccgacaggaatgctgctggtgagtttgcagtcatgtggtctaaccagggtgagttggctgagcttcactccaagttaccaaccaagtcgcgccatcttgtcagctgcgtcacagcaaggctctttgtggcaattgggaaaggagacatgctcccttcaaaggacacaaggaagcttctcttggatgtctggctgcagcctctcatggatgactacaactggttacagcatggctgcaggtcatttgaccgcaaagttgtcgaggaagggatcgggcgtactatcttgacactcccgctcgaggatcagcagacgatattgctttcatggctcgggagcttcttgaaggttggggatagctgccccaatctgcagaaggcctttgaggtgtggtggaagaggactttcgtgcggccttatgttgaacaagggaatcaatctcagccgggtcggagttgaggtctcaagtggttatagactgcaagaaaaaattgtcatcttttttcatgtagaatatcactgagaaagtagtggtaatgtcttactttttagataatgggtaatgtcttactcggtttgctgttagggagaaccccaggaaatgaaaacaaaatggggatgtaaattagtacttatcttgcaaggcttgagaatatgtgcgcgttgtgcttctgatgcttcattttatcaaatataagtgaagctctctgaattctggttgcagaatttcttatctgcttgttactatcatgacatcagtttgttgcactgcaatgaatattgcagcattgtgcaatagtagctttttttttactgtaatatggattcatgtacaaactcaatgtttacaatgcaactgtaaagatttccctgagatgtgccctctaaaatttgaaagaaaaacaaccttcatatttgaattttacttaatttacagttacccaatcgaattatactatgtgaaaataaagttggtacatttccttgttatgtcggcatattgttatctgtcatttccagatgatgaaaccatggtctcattgtatttcaaatggtattgcataaccaatcaaaactcaaaagggtgagcggagtgagtgattgaaaaaaaaattgttatttgtctgtcctatctatttgttgtttgtctgttcttttgttttctttttagctcactggctatcctctaggagttaataccaatatttttgtaacaaatctaataaatttaactgtggtggttggcatattgaatttttttggtgttttttttttttgggggggggggggggaggagtgtgtgcaaattgtctattttaagaatatattggatctatccggctatattttagaatatttcagtgtttttggataataagaaaagggtgcacgatctcgacgatttattcctgaacaaatacaggtgaagccaagaaatcaactgtaactgtttcttttcttttgaaagaaggaaatcaactgtaactttactgatacactggattaagtgtgtggcacaccaaacaactcaagatgacaacaacaaatttgctccaggcaagcaaaagagctctgaagaactcttctgccctgtaaacaatctgcaatgtgtcatctggatgcagcagacttatcaacaacctatagtagcagtataattttctcaggactctgaaactgaaaaacacctcgctgagtcactcactcgctgtagcagcttcaagctgaggcattccatggacttagctcatcatcctctggaactcatggaagtcgaggccgccgtcgccgtcgacgtcgtaggccctgatcatggcctcgcagtcggcgaccgaccgctcgtcaccgagctgcgcgagcaccctctgcaggcccctcgccgtgatccggccggcggactcgacggcgttgaacacctcgaaggcgctcctcaggtcctcttcttggctgtcacctctctccatcagggcaacgaatccggcgaagtcgagcatgtagccggcggcggcgccgccgccgcccggcgacggcgccggcatctcgtcgcccatggacgcgaagaacgcgctcagctcggcgccggagatcttgccgtcgttgtccctgtcgaagtgctggaagatcctgtgcagctcgccctgccttctccccgacgacgacgaacgggcggcggcggcggcgccgccgccgccgcgtgggctcgccacgtcggactgcccgcagagcagcggcaggccgagcctgaagctcctcttgcgcgacaggcgcttcgccggcttaggaacactcgcgttcgccattcaagaaacccaagaaaatgtagtagaaaagctgtgtggtcttgtacacttgtcagcaaatgccaaattgccaatgcagctatggaagaagtgaagaacaggtgaggtgtgctcctccatttataggtgttgagcaatcatctttgtgtgtgtgttttgacttgactgaatgccatgatcacaaggtagttagggctgcatctgcatggcaactaaccttgcacagtgcctcagatactgtcagcttggcattatctaactcccaacagacagtgccatcacatgctcatgatcctcgcgccgccgcccaacgaacaacgatatctcggaatccgtgatttagttatgagttcaagattccgttggtttgaattagtgctaatttgagagagacccttgacctgacgagtgagatttcagtctttcactcaaaaaattcagtctttgctggcttgcaggtcttcagaagctgacagggaagagtaaactgaatgcagtgaagcagtgagtgacttgtgaagaattcagattcagtagacatttcagttggtcagtgacttctccttgtatttcagagaaggggggaagtatctaaaaatagggaagatcattcagtcctaaatgattttcggtgatcatgttttcatcaaatgcccagatttgcatatttcttttcagtggatattgagatctgaagagagat

SEQ ID NO: 82381 - DNA, 4324 bp, Oryza sativa
cggcggcggcacgcgcgcgtcgcgttgccggcgacggcatccggcggtggaggcgacggcgcaaaagcgacgcgaaagcggcggcagcggacggcggcaacgaccgaaggcgacggcgagcgcgagcggcggcgacgcacggggaattggggaagaaaaggaaaggggagggagtcctcaccggaggggacggcggcgtccggcgacgaggagcgacggagggaggtcgacatgcggcggacggcgaccgggacgacctaaagaacgaaaagaaagaggttagagaggaagagaggggccataggagacgggaatgccggccgaaagcggcggacatggcgaccctcaccaacgcacgatgggaatggcgctccggcgacgaacctcgacgaaggaggggtggacggggtggatctcggccacgcgaacccgacggcggcgacggcgcggtgcggcggcgagcctagcggcggctaacggcggccggagtagcggagacggcggcggcgggtggttgcacggcgcgggagcgatggggagcacgagggagttcggcgaaatgggaaaaaagcgagagggagcgacggagaagcttaaataggggaggggagggccggacgtggccgggagaggcgggacttcgctggccaacgtgggaagtgggggaggagagagaggcgggattcgaaaatcgaatcccggccatctcgggcgcgggcgcgagcgggtgagagaggggagtgggcgcggggaacgcggcgcacgcgcgggcgtggtcgacgtggcccgaaggaggcggagacgtgggcgcggcggcggttgcgggcgcggcgggaggttggggaaggacccgacaggtgggccccacctgtcggcgaccccgggagaggagggcggcggggcggcctggctgggcctcggcctgcggccggcccagcagggaggagggggaggaaaggagagaatgggccggcggcccattcggaaaaggaagggaaaaagaaaaagaaaaaggagaaaagaattttccctggaattaaaatattgcttgctcaattttaattggttaaaattatttcgagcgctctgaaaattccactaaaaatcctgttagtgaatttcgacatgtagaactcaagaaaaattccacatgcccactccgattattatttgcattgatttaacagggtttactcttgctttgcaccggtattttcttagggtctcttataaattaaattttaggcttgggaggagaacttcggggtgtgacagttgctcagcctgagcttggggtttatatagcatgccagctcgtgaggtagatggacgaggtgtcaggtgtggggtagtggctgaggcgtggacccgatctcagccattgttccattggtgtactttgttgttaacggagagatgatgggtgtccagaagattattacagtagaagtataatagatttaatctaatcttccattcaaaacattgcaataaagcaaaggagaacgttaatcgttcttcattcatggtaagtcattcataaatcatacgtacattacaccaccacaactacattagtagaagtacataatccatacatcattcgtacattacaccaccgcaagtacattagtagaagtacaccacaagtacattagaccccacacgtcacatactccataccgctcccgaagtacacacacttctaatctctttacattcttcattcccgaagtacccacccctctaatttgagtagactacagtcctatacaaataataatatataaaaatacagaatgctccacagaaaacatatgaaacataaacagaaatcctaattcccacacccaaacacgcaaaaatagatgctttaatttctatcaagtaataaaaggtaaatgcagctaaaacagttgatgctaatgaagttgcgactgctacgaacattagcaccctaagcttcaccctcgtaagcagaggagagccgacagctctccatcagctttgagatgaaagcggacaaagcaaatcaataaaccacaaataaacattgtaagcaccaaaaagtgctcaagaaacggtattttttgaaaccgagagtttccacgcactggctttgctgccctcctacggaggtctgctgcagcggtacgacccctgtgccaagaaggaaaagaccgagctacaccaaaaggatctgaaacagctcggtaactacatgttcaaaggtggtcgccatgggagcaaagagtgaaagagagatggaacgagcaagaaacacgcaagaagatgaaatctgcaatgccaagagtgaaagagagatgaaacatgtgatgatgcttgtgagagagactggcttgcttgtgaggcagtggtaggcataaggacgggaagagatgtgatgaggcagcatttaaatagctacagcgacaggcataaggaggggaagagatgtgatgaggcagcaacaggcatgaggaggtaggtagggtttctcaaaccgtcgggccagggttaccgcaccccagtggtaagcacggttaccacgcggtaaccgtggcaagccgtaccaaaccatataaaatttataacaagtagagatggcggccacgggcgtagggcggaggccaaggacggacctagagtatactcaatggggggccttggcccctactcaattctagatagcacggggggcaaatgcccccctatcatatttttatttacttattctaactaggagtagactatcggccccactcattttgcttcctgcattcctccctggtggaggcgagagctcctcgtcggcgcgatgcactgcctttacgtgttgagctggggcggcctcggcctcgactacgaggggctagtgagggtgatccctacaatggaggtgacggtgattccgttctgtcgaacggcgtggacacggtggcatggtgcattcgtgtgacttaaaccattgtgttatattcggccataagtgaagtttacttaccatgacggtaagtggggatgtgtacatgcctgtgccaataaggatgatgatgatcccaattatcatggcacggattttgtgggtgtgggagagggagaggacgagcgcaacgagtacaccgacgaaggcaacaatgtcgacgaggaggaggatgaggcggcaacagacgtggcgagaaagagggagatgtaggcgagctgagttaccatgccaggggcgctaatgatgatgggcatgttgtgcggttgcacgccagcctgcacgatcatgtacataggttgaagtgaaatgaatcgaatatttatatacacacatgaattttgattcttacactggggacaagtaccgaacgagggccactacattacctgcaagatgagatcgatcgaggaaaaagatcaacacaaagttaatgaaacgcgggatttgaagaaagctaaaattaagatgccgatgaggcgatgacgcacctaggacgccgaggaccgtgttggcggtgttcggcgagatcatagtcgcgtggacggccggcggttgcctgtctatgccaggcaagaccgaggggaatgcgagagagaagactagtagaatgtacgctgtgttatttgatttgagtgctatttataacatagagctggtttgttttgtgacttaaattgaacttaccaatttttgtcaatatcaaattttgctaagttttggtatggttaatcttggcaaggtaaagttgtgttcggattgaagccaaaacaacccaatttcactattaaaatagcctatttctttagacatgtcaaaatttggcttcaaactaaatagacactaaacactattgaaattgttaaatattggcaaagccaattcaggccacaaaccaaaccagcccataataacacctctttgctcaaccaagggttgtcagcctaagagctacatgccacgtaacatatataacactgatcgagtttattaccatctacttctactgcacgcaacagcgaggggtgtatatatccagttcgcgattagagaaggatagggcggagtcagctgtagggccccactcgtcagttgcagcacatgaagcttcatgtgtcgtagatagaggtgactaccacatccaattttatgcatgacataaataattaaatgcacacaatccctaatatctctaacactctcacatgtatattgaagtttgtgtaggggttgcctcttgcataagaggtgactatttctctctcatctttcttctctcctccacctcattatttagtcctatgtttcatcttgtggcttgtgcttggatgccatattact

SEQ ID NO: 82382 - DNA, 8975 bp, Oryza sativa
gttggctatactattaaacttagctcttagcccttaggtgtcgtaaatctgaaattgtactatgattttttattaaaaaaaaggagcaaaaacgacttatagatattttgcttcctttttaatcggattctggaatcattgacaagcatacatttttctctggaccgcatcatagatgccacccagaccacccggtgtggaacagatcaagtcttttttttttcttttcttttacatcgtgagcacacacagccggggaactattctaatctctcgaggggatattccctcgtttgcttaaaaatcatctaaacggttatgaaaaattctaaaaaaatttgacaacattcatacaacacatatatacaactccataaaattttaagtcgaaactcaatttacacgttgagatataaaaaagacaaattcaacgtatgaatagtagcgtattgtttatatctaaatttgtccttttttttctcgatgtgtagattgaatttgaacatgaattttggtggactagtaggtatcattatactctccattgacatttttttcagatttttttcacaactatttgcatcgaatttggaagggaaaaaaaatataagaggataccctcgagggattagaatccactccccacgcagtcttgtctggtttgatagtggaggaaaccgatggagatggagtagaaactcagggaagaggcaacatgccctggccgtggccgcggccggcggcgacgcgagaggtaacataacatggccgtgggcattattccactcttatatctagtgaaataacccaacgttcccagcctagaagatgaaggacattgtggtatccaagtccgggccaccggtgctcgtcaccccgtcgtcggagccgacaccggcggcggcgaccatccgcctcacctccgccgacaagtcccgcctcggactgtcattcacggcgttcctcgtcttcgagcggcggcggcggcggagtcgtgtccaccgcccggccgagaccgtacgacgggcactgtcacgtgctctcgttcactactaccccttagccggccacgtcgtcgccgccggcgacgacgacaacgtcgtgttgtcgtgcaccggcgagggcgggggcctgccgttcgtcgcggcgacggcgagctgcacgctggaggacgtcgacgacggcgacggcgacttgccgttggccgaccttgctatctggtatggtggggagtcatgctggatgtccgatccgctgttgatgatgcaggtgaccgagtttgagtgcggcgggttcgtcgtcggggtgacatggaaccatggcgtggctgacacctacgggttggcgcagtttctgcgagccgtcggcgagctcgcctgtgggctcccgtcgccgtccgtcattccggtcaggtacagggttggaacattcccctccgatacgatattacttcagtcgatttttttatttttttataattttttgtcatatttatttaaattcaactaaatgttgttcaataaattttcgaaatttcgggatttcagtaacctccgacacgatcggcctaaccgataaagtgaaccctggcctggtcaggtacgatgagtccatgcctgaaatccccgaccagctggctcccgtcgcactgaaggcgccgcttgccgactagaagcacgtcgacttcgcctactgcgacattatgatcccatggagcttcgtcaaccgtgtcaaggccgagttcgtgagccggaacggtggcggcggcggccggcggcgctgctccgtgttcgacgtggtcaccgccgcgatatggcagtgccgcacccgcgcgatccacggccgccgctgccgcagtgacgctcccgcggtgctcttgttcgcggtcaacgcacggccgcacatcggagccaaggacgggtactacggcaactgcatcacgcggcaggtggtggcgtccacggcggacgcggtggcgtacggcgacatcgtcgacgtggtgaagctcgtcaacgacgccaaggagcggataccggaggaactcctccggaacaagctgagagggaagcagggcgtcgacggcggcggcggcgaggggctcttcgtcggcccgatgcaccgcctgtacgtgtcgagctgggcgggcctcggcctcgacggtatcgacttcggcggcgggaagccagccagggtgataccccgcatggaggtgacggtgatgccgtcctgcttgccatgcctaccgtgctcgaggtcgaacggcagcgacggcgtgaacgcggtggcgtggtgcgtgacggacgaacacgtcgacgtgttccgggctgagttggcaaagctgcagtgaacttggataccacaagccaggaacaattcgagattttctgagttggcaaggctgcctgttcttttctgatttcagaattttcatttgcacatttcacaagctcctaaacagtgtgtttcactttcatataaaaagttatgagaaaagtatgttagaatactttttttaatataatttttcaacattgtactagttaattcattcgttcatactcacaaatgactaactataaagctagtccatcaatcattatttcaactatctcaaaaatgacccaaagcgaatgtattcaaattcacgatgttgaaaataaatactatctactagtcataaatattgtacgcttaggataagaatttatcaaaatttaaaactatggccatcaatacgttttttctcaaatatgaccatcaattttgtattagagtgagtttataaaatctagtatatcatgacaacacttctctagacaaatctatgcaaaacattctttttccttctacttaactagtaaatatttaagaaagtattggtagtcaaatatttataacaagaggggtgtaggtatctgtgagctcactgaataaacgacgaaatatatacacattttcagggatgaatatagtaaaacacaaggtttattcatatacaacttcatgaaaatgggagaaaaaagtggccatttggtagaactcatgggccgatacgtcattagctttgtggtatacaacaaaaatcgaacatcatacaatatcaccaaatgtgaaacatgtgcatggcaaaatcagttgccaataatcaatctactcgcctacaagaatgaaggggttgtactacatgcagaatgttacaacatgttgtgttcacagatgcacatacattatacatagtggtcataatcatatgctgctgtgtctccaaagaacctgctcatcaattttagttagtttttcatcatctaacagcttccaggtgtggatcgactcgacttccaccaatgatttctgccctttcttgagttcagtatgaattacccgagctcttcttggccaatgaggtcttccataggcatgataaccaaagccaccaccataacagaaccatatcccattaaggtcgccacaaaaatcattaagatggtcatggccaagaaagacagctttcacatctcccatggaggttagggtgccaagaacaccggagtttacagttgagcaagccaccccttcctgatactggcccttgaaacctgtataccacagccctctgacttctggaattgggatgtgaaagaatgcaaatgcaggagcatgcaagttttgctgtcaaaagtaccgtgagtcagaactcagaagcatagattcaaaagtactgtatttgtaattcgaaaaaaaacactgatatatgaaaaccaataatctgagattaactaatgggtgtgtgttttgctcaggcaaatgataaaatatttgaccagagaatgcagctcaatgcagatttacatgtacatcataagtttgtaaaagaagaaacacagaagtaatgaacaaaggcattttccccctttcacaatgacggagatatattccaataaaatcttgggtgctgtgattatgctagtaattatcatcagcggtacctgaagctcctgtgaggtagcacgaagccaagcaagttgagattctttgatccatccataggtttttactccattgaccacttcacgatcaccactatccaggaagtaaaggttaagtaaactagtattgacaaactcagaaccaaacggcccatgtatgctgacatgatagttgccaaacccatgtaccaaagaaccaggagggtttacttgagataccgagtaatccatcagggacatgaacaccatcagttcctctctggtcatagtggactcctggtcatgatttcctaaaatggcagcccatggtactttatactcgattgcagggctaattgctttgagtagtgactcagctgcatcagatgcactgcccccaaatatattgtctcctgattaaaaacaacacaagcattcaatgcaaaccagattgaccccctttttgttggtgaaggaaatttaaaaaaacacgtaacgtagagattcaaaaaggtaacctctttacccccagaagaagagatgtagtcaaacttttttggaaactgcatgtgattctactctgccactaattcagtaacagcagaaaacccaaagcatggattcacagaactttgctagttgctaagtaatttcatttgggtcgtgaaaatacacgagtggattgccggagatacttctccacaattgcgaacataggcaaacaacaagtgatttggcgagatattccacccaacccctctgaatgtaaacacaattattcagacattctgccagctaactctactaagctactactacatggagcattaactaatttgtttttgttgtgagtaactgttatgttgcttgtaaattaacactcacatttagtactagttccatgactttgagagtgaaaaaaaaaatcaaccaatcacatatcaatagcactaagttttgcacatgattagcaaggaccgccactaatgggcagcgaccagatgagcaagcgcgaagcagatcgccaccaagagcggagcggggataggagggggaaaaacgcaccggtgaaggcgatgaggtcgggcctctcggcctcgatgacccgccgcaggaaccgcgtggtgttgaggtcggagcagcgcgcgccgcccacctccggcgccacgtcccggcaccgcgtggcggcgccgttgccgaagtgcatgtccgccacctatagcatagcaaacacacgcacagaacagaagccgcgcccggtgagcaaccagaggtaaatctcgaaggccatcaggcgaagctcgctgagctagctagctagcgagtggaggtgagcttgaagcgacggacggacctggaggatcttgaaggcgccgtcatggcggaagcggagggggaagggaggggtcctcttgaagcggggcgcggcggcggtcgggtcagggttgaggtgggtggagaggcggatgaggagcaaggagaggaggcaggggaggaggagggagacgagggaggtggaagacgaagaacccatcgatctcgccggtcgccgcctgccacctcccaccgcatcgcatcgcactactcaacaactcccctactgttgctcatagttttttttttttttcagaaactttcggctgtgtcctttcctccgcctttccaacttccacaaatttttgacaatttaacccttttcgaaaactaattttacaaataaatcgtgcccaaacttatttaaaaaatgacgcttttgttcagcgtcaaatcgtatggcgctgaaattagacacctcaacgccaaatagaacgacgctgaatgcacgttggcacgccgactcagtctctcgtccgcggtgacacgatattctgcgccaattgacgtagcactgaggtgtctaagtttagcgacatacgatttgacgctaaacaaaaagtgtcatttttaaaataagttttggccacgattcatttgtaaaattagtttttggaaagagtcaaattgtcaaaatttgtgttccaactcttgtgtccacatttttaaaacaaaattatagtaaagtttatttttaaaatacatattaatctattttttaaaattgctacagctgacatttaattaatcatatgttccttttagtccgcagagatttagttttcgacctgatttgccgtacactgccagaaatttcgtgagagagcttgatttcgaaaataatcattgctttccgaatagtcttgtcttaaaagaaagagctttttttttacttggttgaattagctacagccttatagttggtccattgggccctgcagagatggaaattgtgcctagttgatgtgggacttgggcccatcgtgcttagtgccaaaacgggccaggatttttataccgtgtgggccgacgtgacttgggccggcccgataaagtacagcccaagtcccaggtctacctagtgttctactagatgaataggaaatacagtagtgcagtgcaccaacctctgaggcctcactgagttggcgcgtaacctcgtcgcgccagctcagcttttggtctacgtggagcatgcgcctgggacctcacttggcgacttgtccctaagctaaggagcgcgaaacttcgtcgaagcgaggaagcgcgcggcgccgaaaaagcaaggcgcgtgcactgtgggcatcgttcctggccgagctctgccctcacatcgatttcgcctggtgaaatccccgaaccgccctcctgggggcggcgggcttggcgcgggaggctgggtcggggtgccgacgacgagccggtggctgccggggaggggcctagaacacttccagttgcttcaacacaaatacaaatcaaaatcaaaatcaaatcagaaccatgcaaacaaatcgaagaacacaaatagatcaaaaaacaaagagagagagagaatattatgttttttctgtgtacattcagctgtggcaaagcgtctctccgatggcgttgagtgtgacgcgggcggcggccgcgccatgacgccggtgccagtgccgctgtggtggtggcgatgaagaccatgacggcgcaagggagtgaatggatggatttgcaacgcaaccaaaccatggcccttcaccatcgccgcgacggagtgggaaagggagaggggaggggcggcagacagagagggaggggaaggaggcgcggcgagggagaagaagcagagcggcggccgtggatggagcagctgctcgagtccgcctccgccgagtcttcgccgcgcgctgccaagaaccgccagccgcccacacgatggtgagtcgttgccaagaatgccgcagaccgtgccgccaaagaccgcgccgcggaagccgccgccgccgaccgccgtagaccgccccatctcctgctgctgctgcttgggaggagaggagaaggaggcgcggcggtgtgggaggcgaggaggcgcgggagaagcagagcggcggcgcggcaggagaggtaggccacggtgatggagtggaggagaagacgagtcgctaggtggaagggtaggtggggaataaatttcgtcagtgggcttgaggtaacgtatttggggtaacaggcactgtgggcttcgtttccttcacctgtctccatccaattaagccacacatatatggatgcttacactgtggggtgagtgtcttggggtaaattttttaggctaggggtacgagccccgtagcttacactgtgagaggcctgaaaaagaaaaggggaagtagcagtggagtggtgcctgcggcctgcctgtagctgaaagcgaaccccatttctcgtgccttttttcttctgacgaggggagctgaaaagaaaacttttttgctgtggcaagtaggagtagtactaggctactagccaagtaagattattaaattttaagtacttttatagaattattgtaggaactgaatcattagattttttttttccattgtatgtattgttcgttttatagaaatggacactaccaatttcctgaggattgtagtcttgcaaatttatttcatagattcttaggataagatgagagctcttggaaaaatttctgaaggatggagtgtaggtgacatcttaatcctttacgttttctgttcctttgatttgagaatcataagccctatgaatatttgctgatgatttcaaagtttagattgaattttcggtagtactacggatcgaattaattaattaggccctgaaaaaactggccattcagagggtgtagtggctcggacatggagtcagcaagacgtcagctgtgtgcccattcactggcatgatactggcacatgtatggcgtgacagaaagagctgaaaaaatatgttctttttttgacatggaaagagctgggaagctagctgtggctgatgtggtgagtgccggctgacagagacaacaaccgcatttgcattaccgcaatctttaacacgactggggcctcgttttgggatctaaagaatactacatatattcagaggattttgtttttgcacaagccaacgaaaggaaaaaacaaaagagatctacggagacaacagcatcaatgcctttccatcttcattttcatacgatctactcactgtctcaaaataaatggacagtgtcatatttcacacctaagtttgtttattttgatcgttgtagcttcatgggcaatgacatcactagtatgtaggatccccattgaatgccctaataagtcgaagccaaagcaaaatttaaattgtaaatttaattttgatgtcgattttaaggtactttcagagtagtttatttcagcgttgccttttaaatcactaaaacacatatataaatgttttacttataaattattttttattccttgataaatttgttagatagatctctctccccttgagcccaacggctcaagggggccttgaccgcgccctgatcgggggcgcccagcccaatggctggtgggcccccgtcacactgcgccatataaaagaggggtg

SEQ ID NO: 82383 - DNA, 4454 bp, Oryza sativa
atggaaagcttacattaggaactgagagtggcacatgtctgtgtagcatcaccacatggcagtagatgtgaccggttaattagttatagataaatgacctacctgaaactcatgattgggttcaagcatcgaaaatgaccggttagaagaatctttgcttgttagtttatgttcatccttgatttgaccggtatggaaaatggtatgtaccaacgtgatctagatggacctaacaaaacaaggtactccattgatgctccaatgtcaccacaccgaccacagcaataatgattctcgttgacaatacaccttccattcctatctcaatgcaatactgccatggaggtatttacacacatatctcaaaaaccaaccaaccaatcaagcatctattgtaatatataagtttgtatgattttctacaaataggctcccaaaaacagttacaaaaccagctcaaggagggtacatctagtaatttggcacattgttctgttgtaaatttgttatgtagttacattgtcagttcagtttcttctcggtatattgtatcatgaccgtctgataaacaaaatattgctgtgtgccgttttgggttgtatacagagtgggatcagttgaatcatagcctatcttccaccgaaaagacggtataattttatgtcctcgaagatgatttgtgaaatccagcctcaaccacaagtgaacatttgcaaattttttcgaacagcccaatctcaaaataaaaattccttaagtagcactttgtttactatcgatttttttctcattgacgctaatcaattctggcaccttatcaagtaatctgttcatctcttctgaaaattcaagcttggctcgatttgtctttcctccgatgactactgtacttccgtcttgcaatgcccatatctagacagaaatcaaatcgtaaatctgtagcagttttacaatacttatatttcaaaaataatcataggaagtgccatatgcacacacctgagaatgtgaaagataactaatgcaggtcgttaacatgagtgcaccaaatccagcatacacaataggaattcctggatcagtctgatggcaagggaaataaatacaaggcacgtttaatgatatatcaaacatgtacaaaatttctgcaaattcaaaacaatttatcaggagcactgaccttaagatcgagaccggtgctaccgatggcatcttcaataactatttcgttaccatctatttcaatcggtagttttgagcttggccgacgaacccccacaaacttaccctcttgatcatacaacacaatagactgcagatctcgagcaagcatcgatctacaagccatcaagagaagaagttaatagcttatagggaatgtgtccagtttatcatttagctccaaacaggggaagtgttaaaacttacattcctttgacattggaagaaccggagttttcaagtggcaacaatgttccaaataacttcttatcaccattcaatttcaagggggccatggccaaattgaaaggaccttcaccatttttctttacttgcaatgctgaaaatccccaatcggtttggtagattgtgaccccaccatacctcaaggggtcgttcactttgatagtcttcctcatgacctctttgccatcaaggtcgaaaagtgaaagatcgctatagaattgtgaaacctggaaagccaaaaatatttgccacatgtaaatctgacatcacacaagcatatgaaatgctgggcaaaattgactacctctccactatcatagtactccatgtagaaccgattgacatggacttcagtattaaaaacatcaggcacaaaagagagaactcctttaggtttcatcacatctccgattacaaagttcaacccttggggtacatccaccgatcctttaaagctccctgttgcgctaagcgtggcacctgccatgatgaaaatcatagctatgtgcacaccgataggcgcaaaccgaccagccagtcctttgaaagcatacagagatggacccttagtgaatacctgaaacacacatcaaacacacatgatttaaatgcatatcggagcaaatgaaatgcacagaatgtgactaaaatcacctcatatccataacccatcaatataactcctaaatcctggatggatgcgcggggaagtgactccgcaaattcttgcttccggatgcttcctgctgaatgcatgaacgaccatctgcaagaaacaattgatcagcgcttgcaattatctacaagtataactcatgttctgaattctgatcagacaaactatcattatcaagaagagaaaacctgcacatcagaaaatggccatttctaccttctggcaaccttgacaatggggatttgagtggtgtaagtgcaggccatgagcgacgccgcgagcagcgcgaggaggccgaggaacaccggcgaggagaacatgtgatcgaacccgggagtgaggatccacctccacgtgatgaacccgaacaccgggttgtcctcggggaacttctcgaagtagtagctcggcgcctccccttgatcaatcaccgtgcctgcaattgcaaatcgcaaattgcaaattgcaatcacaatcatgaataaaaaaaaacagcaatcacatactggcaaatgggcaatccattccggagaagctaagctagcgaattcgaagtagtatcaaataagcagcgaatcacctaaggccatgagcgcggcaatggcgaacatctcggagatggcgagcgggaggttggagagcagcgacagcgtcctcttcgtcaacctcctaaccaaccccaacgcggcgttctccttcctcctcgccaccttcccctccccctccccctccccctccccctccccgccgccgccgccgccccgctgcgagaccggtggcgcggcgtcgaagaacacgacctgcttcttggccttgccggttccagcaggtatggcctcgcgcttcaccccaccgccaccgccaccgccgcccgtcctccgcgcgtcgcaggagacatggacccgcctgcgcggcggcgcggcggcggggagggggaggcggggacggtggtgggacctggaggcggtggggttgaggagcaagtagcaggtcggggaaggcatggcggggtggaggagggagtgacgacgacgacgaggaggcgcatccgcatcgcgtccgttggctcccccgcgcccgcgcgaaaaatagggcggttgatgtggataaggcgcgcgtcgggtcgtacgtggagcggcgaagacgaaggcgtatgggaggaaattatcttgcaactgggccggatatttcgagggattaactaagggcccatgatgtgaacaacgacggccctggatagatgggccggttgcaagggtccagtcttcatttcatggtctgactagtatttcttgccagtggcagaggacggaaaaaatagtaggtgtggcccatggactagcgcgagaattcgagcagaacaagaagtaaggggaaaaaaacaatctcaatgcccgatattatatgacgcaacattatcccatcatgacacaatctcaagcatggcaacaagcactagtccaaagttcacaatttatcatccatttgccaaaattgtaaatagaataggcattcaaaaatacctcaagattccagcgttcagtaacacatataggaacaagtgaggatagtagataaacatgtagaaactgcaaaacaaatagcaaaaaataaagattgattagtatattatatacttgagattgataaggtaaacagctatgagtggaataaaatgtaaaagcataccaaacataaaatatttaattgcttctaggtctaggagatttaggcaattgcatttgcctagttttctttttatgaaatgcttttttgattttttgaaaatcaagtcctttgaatatatctctctcaatgttctgaaattgtcaaaaattcaagaatatgtacctcttttgtgaagccaatgcctttccttttctctttctatccattttgtgttgatttcttcagttgaatccttctctttcttttgttgtttgctcggcctgcctgcagcctgcctctgcctggcaccgccccgccgcacccaccctgccgcctgcgggctaccggcggccgttagcccgctcccctcctcgaggccgccctgcgcggcagcgccgccgccacaccgcacggctgccggctgccgcttccctccgcgaccgcgagcaagcccgccgcgccgccgcacgccggcgcgcccgctcccctcagcgccgtgacgccgttgaatttcaccgatttgactaggtgctcggattggagaattggggaaatagggattagggtttcaaggtcatggtcccactcccatttacacaaaaacaagtccaatgggcctaattggggtggggggggggggggg

SEQ ID NO: 82384 - DNA, 9860 bp, Oryza sativa
cttcttacgaaaagagtatttcttcgcatatgtgtctgcgtataatgaaaatgggaaaatgtgtaactctttttatattatacgcagtcacatacgcgagcgtacaccactacataagtaacaccacattcacacccctgtgaatacgctcctaacatatactcagagggatataaaaacctgcggtacatctctaatctcactaattacatgttagaatcacacctacatgtgcgcaatatttgtaggcatcaatattaaaatcctggtgggtgaagtcatgcatacagaactacaccatcccattaattatacttttcccgagaaaaggtgtaacttggctctcatttcttttcgatcaatttggtcaccacaagttttggggaaagtttagccactaggaagtgtgtgattctgtccatttcaaaaggtgtaccccccttgatggaatgagttggacatcgtcatgaccgaacaatacaaaaccttattatatttcgaattttgaacaggtattaggtgagtcagtgttataaaaaaaattgtaaatggaactagcgcatccgtgtgagcgacgggggcttatgcatggtgttcttccgtctgaattgatcggaagaaaaactgtctccagcagaaacgtccagtattatcgagaaagtcaagaaatcccctcctgtcaatccgatcgagctacggaagcacataaacacggccgtctctgtcatcgtaccagtcaccagtccacgccggttcaacagttaatgacgctcccgtcagctgaaaggtgcctgcgcccctgcaaatcattcagctgctgctgcatcctgtcgatctcacgcttcgttgaaccaaccgacagcacggcggtgactcaccccggcgactccgccgtcatccagaaccaaaaaaagccgtcctacgcagttttacgtgctactactaccgtcccaaaataagtgtagttttagcactattcatatttaacgtttgaccgtttgtcttatttaaaaaaaaattataattagtatttttattgttattatatgataaaacataaatagtactttatttgtgactaatttttttaatattttttataaatttttcaaataagacggatagtaaaaacgctaaatacggatatttatagatacacttattttagaacggaagtaagtactaaaattgcacgtatcgaattcaaaccgaacctctgatcgcatcgaagcttccattgccacgttgtgtctttggactgcagagacgtgctcctacgcggctcttggggctggaacccgcgccgccggtttcgagcgtcgtcgggcgggcgttcgctcaccgcggctccgtcgccaccggcggcgcgcggcactcgcgcgcgtttgcccaactgaatcaactgaagtgatgagttttctattccaaaatactatatgacgtggtagattttcctacagcgtttaattatttatcttattaaatattatttattttgttatcacttgtagcacaatattattttatgattttgaaatgaaggtacgtacggcatcgagtagtttcttcaaatttccttgtcgaggctgatggataggtttgctgcctgccaagatttaaacaagcaagcaggaatcccgttttctaacaaaaaaagcgagattggtagtatttctatattttactaccagttggcgcaccacgcaggatgaaaatatttgtaaaaggcgacggcccgctccagcggtccagccatgatagcaactcctctactgcacagtagtgcgatgaaactgatgatgatttgtgtgtactaattccactgaaactttcaaggctagcagtaacaacaactgtaaaaccaatcagcaacccaatccaaccttcctccgtccgaccagggcatgtaaaattctgtcacgaactgtgtaccggatgccacgtcacacagttgtctctgactctgtgactcacgcgccgccatctagaaggataacaggagcacgagagtgagtggtgggcgcgcgcgcgcacacaggtctttctcaattctcccctttcctacgcagttttcgcccaccgccgccgacgcccctcccgtcccgtctcctcttctcttcttccgcacccaccgttgttttgaccctgttttcacaaaacaaaaattttttcactcatcacattaaatgtttagacatatacatagaatattaaatgtgaaaaaaaatcaattacataatttacgtgtaaattacgaaacgaatcttttaagcttaattgcgtcatgatttgacaatgtgacgttacaataaacatttgctaataacatattaattaggtttaataaattcatctcgcagttacctggcagaatctatgatttattttgttattaaactacgtttaatattttaaatgtgtatccgtatatccgatgtaacacaaaatccaaattttttccccatccataaacaaggccattgtataagaggcagccctaccctccaccggtgagagctccacgtctccaaccaaattccatcgtcttcaacccaacccaacccaaacaccaccatgagcagggggaggagcaggctgagctggctgtggagggcgccggcgagggcgctggggagggcgcgggacatgtacgtgcgggggatgacggggtgcgcgcgctgcgtgccggcggacgccgcgttcggctacccggtgttcgtgccgtcctccgccgccgcctcgatgaggagcaacagcttcgggtcggactcgcggttcggcggcggcgccgacgacgacctccgggagctgatccgcgcggcgtcgcagaggcgcgccgcggagcaggagcgggaggcgcgggccgtggccaggagccagagcatggcgtcggggatctccatggcgcggatcgacgaggacgcgccgtgcgaggagttcggcgacgccggcgtgatgcactaccccaggagccagagctgcgtcggcggcgtcggcgggaggatcgctcactgtcacaggaaggtggcggccttggcctgagctgctgcccgccggtcgtgctcgcgacggtgttcatcgccattaatggtcttctctggaggtctagtagccattcaaactttgggattttgcgtttgtaaatatgatttttgttgagaattcgtgagtcgtaattgctatttttgctgctgcaaaacaggggcaaatgcaagaaactgaatagtattttcggaattgctatatgtcacgcaaaagttagcttaacttagtttttttttcccttttagcgtatggtttaataattcacctgtcacgttacgcactcatctatccaaatcccccacgtaagcatacaccagttcgttaaacaaaaaacagcgccaccagcttggtatggccacgtctgaattgaaagcaggactgcagcttgccaattgagtacgcctaatccaattaagtgccaaattgtagaaaattaacggccaaactgtagctaaatttatgtagcacagtggagcagtggacttcattctggaatgcacctatcattagtcaaagtacactagttcggcttcatcattagtcaacggcaacatctaaatatgagccaaacgtcggctgcccaatggctcatttgaaacatagggggtggattttagaaatacgtaaataggaaaatttgtagaagtgagatgtcaaataaatccggcagacatagaaaagacagaaatttacaaagtgtttggatagctgataaggacaataacataggatttttataggttttagagagagaagagagacagagcattggacttctcgaagaaaaaaaagtttggagctcctattcaaaattccctatggaattggagtataggattgcaatccaaatgaattttcctatgttcaatcctatattccaaataacctagcaaggaaattttccatacgatttaaatcatttgaaatcatcaatcaataactcccctaaccccaccgtttttctccttttttttgaattatttttaggctccttgtttaatttagacgttgtcttttactgttttgggctcctcatgcagattagcttgactgctaataagcagttttcggttagtgtactgttcaaagattactaagctttgccttgtgtccggtaccatcaaccgggtgttggatgtttatgccgtgcatgcagggcacgtatgctctatgcgttttttcaaaaaaactctcaatcctctaggaaacaacgaagcagtcctcctggagattcatccttattctaatttttactaaaaaagccttacctttatatgaaatacaatgtgaagaagagaaaattcggattttagggacagcgctgtaatcccaaaaagtacgagggcattctaaaaaaacagatcctaatccaatccctcctctttctctgctgccaacccatccccaacacgcaacatctctctgcccaatcctcctcccggccaatccgccatccccatccccggccaatccatgcggcctcctcctcccggccgggggcaaggacggcgccggcgtttacaaagacgacggagcaaggggacgacaacattgccgccctccaccatgcctcctgtgctgccctcctctaccatgatggcctcctcgaccttgtggttgcgtccacggggggagggaggaggcggcacccgcccgagctgccgccggtgctcccctcctccttctccatccacttgtggtgacggcggcggcgggtggagggacgcccgctgaatccgccaccggttctccttccctccttgttctccctccacttaggccggcggcggcggtggtggcggggggagggcagatccggcgcccgacgccggcggatccgccgtcgtgccccctcccttcccttgtggcggcagtggcgagggtacctacgttggcggcagagccggctgcgcgtctgccgccgatgcccttccctcatggcggcgtcggaccggccgcctgcgcaggactgccgtacgtcttcccccgtcgccgcgttgcctctccgtcctctcctccgcagcttcccaaccgttcccctctcaactctcgacctctcctctctacgtggaacaccatgaccgtcgccgccgaggtcgacgcatcccctgacggagaggagaggaggaagcaagcttgcaatcgcacaaccatctatcgatttctcccttccttctctttcttctttctttctttcgtttccccctctcacatgtcaggttattttttctcctcatcctctccggatgatttcacttttgctcgaaatctctcaggttgttgttgtgttgaaggtggcgaagggggaaactttggtggtggtggtggccggagtggaggatggcggcagcggtggcgatgcccgatgcggagcggcagcggcagtgacggcagcgggtacgacaaggccgggatggactccggcaagtacgtgcactacacgccgggtcaggtggaggcgctggagcgggtgtacgccgagtgccccaagcccagattctctcgccgccagcagttactctgcgagttatccatcctcgccaacatcgagcccaagcagaagatcaaggtctggttcccaaaacagaaggtgagcaaaagcatgcagggatatactatcaaactggtttgccttttgtgtgtctggctgtgaaatgttctggacaaattggttgacaatggagcaatagcaatagtagtgttcaattgtttgccttggttgtgcatactctgcttcaactatatttaggaattgcaagtctatgtatttatttgttttgcttcctttcttgcataatggaacaacctttatataatcaaggaagaatactgtacttaccagagtatgtgccagattaagccatccattaattagatgctgaagtaaactatatgactatattgcgatgtattctaattccactacttacaaaactgtagggtataagatttgcttatttttagaagataggctaaacgagggtcatttaggtcacatggccaaactaagacacatatacataacgtattatcatgcatctgatagtaatgcaaaacaatgcagtactatttactttcactgcaggtatttaggctctatcttttatttttctcaagaggcacttaacatgatatacaaaatttgaagagttacattttttaaaaaacttctatgagttctgcctaaatgattgttatccatggtgtgcctaaataattgttcgatctagaggtgatccaaagattcgtctatattagacgtaacaataatgcagtgttttttttgtttattttttagcctacaaatgtttgacaagaagaggatgaaagagtgacataggcgagctctgtagcatatatagaatgtttgctatccactggtacatctttaacccgagcctacctactgtatagatgtgtttagtacgtgcttactatgcttaattttggggataatatagtacgacgtgtaagaaaattcagaactatgttgtatgctctagctgaatttgtttacttcctacaaaaaaatggatgaactactgatccagttcatgttgtgatcctcctccaaggagtttttttttgtttctttgctatctgaaagattccttttttttttttgctttgttgaagtggaaggagctcattggtgtacctttgttgaaatggctcctttgcatcctcattgtttcacatgtctgtttcatttccgtttttaagggactggccttattaaaggttgtttaaaagcttgaacaagacttctatttgattgatctttagtccctattttacctaccaggtgaattgtcgcctcgggtaagatattgctaacagggaattaactctatttcattgccttgtaattaacttgttatactaaatcagaagattctccggaggaggggatcagggggagaagaaaccaaagaaatggcagcaaccctcttttttccggaggcgatacattgatactacttcgatagtagtagcagtagtagtcgtcgtctatatggatatagaacgctacagagttcactactgctttagctattgatactacttcaatagtagtagcagtagtaatattttggaactaaacacggtcatatatataagcaactgcaacgaggctatagggtcgtaaacaattcactgacacgtaccgggcctctccatgtttcatgagacacacgtcatacatgtagcatgaattatgacggtaacagtacactattcactatttatataatcttggtgggccacagaagccggtggagagtgtcaaagtttacaagaagactcatctcccagctaaggaagcatattttctgcatcaaatcctctttttatgcaagcaaattaggcattaataagtatgttgttgattatatgataaacaacttatactatgaacaaataaaatgcatccgtataagccgactctgtttacttgcaacctgtacactaaccattttaactgtgcgtttttttaatccatgtaaacaatttgcatgctcgccaagtgttgcattctctgttttacagacatgctacctgcccttgcaactgtttagtgaagaattttagatatctactcggctaattccacacgaaacacaccttcctcttcattatatcatctccactcattgacatacgtatctaaacccggaaaggcaaagttaacttaagcgtaaagcccagaactaatagcccaccgataaaataacttttcaacacgtacataggctggtgaattgtactcttcacaggctgagctgaaccttaggttggctctaagtttgtctctattagcatcatggataaatgcacaaaccattagacaaatattaattactcgttgcaattttatttaatatacgttctgcataataaacctattggttctcgttatcaaacccatttacaactaaactctgcttttttgaccaatctctgttgtccttacatcacatgttaccatttgctttttcaaactgccccattttcacctgcccttacttcataaaaaaaatctttcccaatttctgttaaacaaaaaagccccatatcatactgtgttgttcaatcaaattaatatacatataatataccatagcgtaaggtctaactgaacttgattacgtacacttctacctacgcaagtgttagcgtgcgcggcgtggcgccgcgctcgcatttctagtttataaaacaactctccattccaaaggcgccctaattggaccgccacatatgttttaatcgcgtctagcccactgaatgtagtcctcaagtatgctaggaataggttcactttatgtccaccttaaaatcattcgaactgatgtgtctctcaacttgtaaactggtgtgtctgaggtccaggagcagtataggggcaatatagtatccggttttgactaacgtgacaaattaattaatccccgcaccaaatccgcagcctcggtatttgcaacattgccctacacctccacgtcgccctacaagttgagagagatagagagatggggcaagacaggggagagagggagagaggagtaataagactaggtctctgacatgtgggtcccacatagaccccacactgactcagctaacctgatcatagtcaactagcatggtgacccgcgcagattgcgcggctagcatcattatattttatctcatataatagcatatatgttttctcattatattattcaaatatattaaaatgacaatataattttaaattttgcaataactttacaaaactactaatgtgcaatattcatattatattttatatacgtgttagttattaattatttttaatatcaaattttagttatttttaaattatatatattcctatatggactctagactcgtcttttaatatatttttttaattccgaattttctgtaaattgtatttctatatagactctatgctcttcttccaatattatttatttttatttttgaatttttattatttctaattgtatttcaacgtgggctctactcatctttcaatattctttaatttttaatttcgaatttcagttacttctaaattgtattctatattgactttaaactcttattcccatgtttttcttaattttgaattttagttatttgtaaattatatttttatacggactctaaactctacttttaattttattatgtttattccaaattttagttagttttaaattccaatatggactctatactctacttccaatattccttattttttaatttcgaattttttttcttaattgtatttctatatggaatctataatctacttcaaatattccttatttttaattttaaatttctattatttcctaattgtatttatatatggactctatactctacttctaatatcccttatttttaatttcaaatttcagttattttctaattgtatttctatatggactatatactctacttctagtattccttttttttaattccgaatttcaactatttctaaattgtatttctatatggactctagtctcctcttctaatattccttattttttaattacgaatttcaactatttctaaattgtatttctatatgcactctgccttttctttttctccgattaatgtgagaatttctaggccatgagagcgaacgtggaggctcttttttctatttctttaataatataatagattcttcatgtcagcgaaaaccgaacacaatactgttttaggacctaaggaccctaaggtgctttggttttgcaagtcgaggaacacgtatctag

SEQ ID NO: 82385 - DNA, 3124 bp, Oryza sativa
ccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgatgacaacgacgatgtccggcgcctcttcctccacgaactcctcaaccgatcggtatctaaaccctctccctttcatctacaatgtcgttcatcaaacccaaatagaaccacccgactagatctaacctaggtgatcctagagcaaagtctaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgtcgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcagcggcgcgagggccgccggcgtcggcgacgccgctcggcgcgaccgcgcccgcccgagagagagaaagagaggagaagctagggtttcggcggccggccggggcacgaggggttttgatccccgttttcggcgcccggccgtccgatcgcaaaccctaagatcggacggccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaaggccggaaaaagtccatataaggtccctccggggccgaaaatgaataaaagagaacagtagcaatttttccattttattttgtcaatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaaattgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcgggaattttagagatcattcatacagatatttgtggtccatttcctgtgaaaagtgtggatggctatgactcgttcataacattcacagatgattactcccgctatggttatatttatccaattaaagagcgatcagaagcactggataaatttaagatattcaaagctgaagttgaaaatcagcatgatataa

SEQ ID NO: 82386 - DNA, 2527 bp, Oryza sativa
attcctgcagcccagtcccgttcggattacgcgagatttcttcgtgcggaccacaaactcaaccaactccgtgtaggccccacaattccccatcgccattatccgccggtcgctcgccggagtccccacgaaaaacacgcgaagggaaaaaaaaagggccaaaaaaaaaagaaaaaaaaacagagagagggagaccggcacggtacgcgcaccgcaccacacgaaccaatccgaaaccctagctccggcgagccgccgccgccatggacagccgcctcgtggccttctcccaccgccgccggcgctggatcctcctcgcggcgggcggggcggcggcggtgttcggggcgtacaagatctaccaccacccggccgtggcggcccgccgccgccgcctcgcgcggctggccggcgcggtcgcggccttcctcgacgccgccgcggcctccgccgacgcggcggccctggtggcctccgacctctccgacttcgtccgctccggctcggacgagctcccccgcagcgtcacgcagctggccaagctcgccgcgtcccccgaggtctccgcgaccgtctccgcgatctcggaggccatcaccgccgggatactccgcggagtcggatccgactccgggcccggctccggcggtggcgtggccctctccgatcgcctcgtcgacaggctcttctcggagtccggggagcgccttgcggctgccatcgccgggagcttcgcccgccatctcgtagctgctatctactccgcctcttcgactcccggggagacctcctcgccgatgaagtgggtcaacttgattgccactggaaagggccagaaggcgattagtaattgggttgaggtgttcgtgagcacagccgtgggggtgttcgttgacaagacaatccacatcaatacctatgatcagctattccaaggccttaccaatgcaagccatgatgctaaggttaaagaattgcttgtttcggtatgcaacggggcagtggagactatggtgaaggccactcaccatgttatgtccaatgccaattataaatcggttggcagtggcagcaatggtgctggggaagggtgggtcgagacagtgtcgagcacattggcagttccaagcaacaggaagtttgtgcttgatgttactggtagagttacatttgagacagtgaggtcgttccttgagttcgcactgtggaaaatgcacgctggggcgaagaagggtggcaacacagtgatggatagcggactgcgcgcgatgcaatacatgactgataagtctatggttatcgccacaatatgcattacactttgtttgcatgttttgaatggcactcggctcctggtaacagcttgatgatgtgttcaagatcaacacgggtgtatttggattgcattgttggtacatgacttgtaggaaaatttatactgaaactgtaaattcatctagaaaagaagagctgaaatgacgtaaatgatttcgtgttgtgtttgagattgttattcaaaactgctgtgccgggattgttgatttgttgtgcccttggggaagtgtatacacgggaacttttatagtgtcatgtgtttagattgttattcaaaattgctgtgccgggattgttgatttgttgtgcccttggggaaatgtatacacgggatttattgataaaggagatgtgatttgcattttgaatgaactagtgtcattgttacatcgctgatatcatcaggcaatttttatcagtttaagattgattatgcccattactaagctttctggtgatccggttgctccaccaatttgcgtagttatgtatttcgttcttgttaccaaaattctacttccaccaaattgtttgttatgttgcagcatcttttttagccttgtattgtccagctgaactcaactttctcatgtgaagtatcaagtatctaaagtttcggtttattgttctgaaccagtttagactagtcctgagtaaagaattagcaatttgctatccatcttgagtatcataaaaattttagcaggtcatacctagtgtatattatctattgatgagatctcacaatcagtgctctgtagtgacctttattctttgttcttggtccaaaagataagactagtataccagagcttagttcatcctatccccatgtgatgcatcttggtattaggttcagctggcagtaataattctcaagtggtttttgacaccgtggtagattcagttccttttaattccttttggacatatggactgaaaggtcagaaagaggaggaaagtaacttttcattatccattgtggatttgtggttggcggaggccgttttatacaattttcagtgtttgtgtgtttgtcttaccaaagtcatacaaatgccttttcttgttttctctgcaaaatctgacatatccagttttacactttagtaattggaatggccgcaatatgaggttcaagtcttcaagaagacttgcccaacgatgtcatctgcaccatgtttatcatgta

SEQ ID NO: 82387 - DNA, 1177 bp, Oryza sativa
aaatctgaactgttgtcacatttaaacttgttttcaaatattgttccctccattcattttgacgagctaaccgttctaacatattgagcagaggattgggatatagtttcatgagtttctcttagtgtatttctgttatcttatatgattatgcatcttttcagggaaggactgatgacttacaaacagttcatccaagttcttgaggatgatatttcacctgctgaagctgagaaacggtaaatgcacaacacttactgattatatctttgtgctacctttttagtattgatgggctatgtctgtttaaaaaggtatcaagaatacaggacagagtacatcactactcaaaaacgtgcttattttgaccttaacaagaatgatgatcggtaagtcaaaatgatttagctgtacacaactaggaacaaaaatggtccacttgctttaactgacatttcatttgctttcacttgcaggttgaaagacaagtaccatccgaccaacttgtcatctgttattgacaggtggagttgaattcctttttattgagcctgttcccttatgcattcataaacattattatgttgtggaaaaaattttcttgcagaacaataccctttatactgctcatcttaactccttttacatttttgttaagtaaatttcagaaaactacaggtgctttgaccaaattatcacaaaagtatagatttaaggcgctgtatcacaaaactacatatttgatttcgaagttatcacaaaactgcagatattacaatttaaatccctagtactactgttatgttagagttataaatgttgtagtttcgtctaactgcaacttttccatataatgcaggaggaatgatagttgtaaggcaacagcaaaggatttctttcatgatttgcaaaatggaactctggacctgtgagttatatctgcacagcttgtgttatgatgatcttctggacttcttgtttataccttgattttttactgagcagtggccctggaataactgcggctgcagcaagtggcagtgatggaaattctgatgatgatggagacagtgacaagagaagaaagcatggcaggggttcctcaaaagaaacagaccctctttctggtgctcccgtggctcatccagttagctctgaatctcgacgggttcaagtt

SEQ ID NO: 82388 - DNA, 1977 bp, Oryza sativa
ttgttgtatgaaacacttgaatatttctttgttctttcttttaaagaatgtattcttatatatttctatatttaatatggaactatggattgatgatgatatcatattaaaataagggattatgtctagtggttcttggtaacgctccactggcattccgaagtagtattattagctagaaagaatgatgacgctgtagaaattaaatgtactgccaatctggaacctgtttcaacagtccttgtctggctctcattctttgggatgtttcgcggtcagcatgaggatgtgggactgtatattactcaatggttgagagtgcagttcaattgactgtctgtccaaactaaataactgataagaaccacgcctgaatccatggatggatgagtgttgtttatgtgaaatttgttaactggttgtttcaccatagaaaaatcaatattgtttttaggatatatatatatatatatttacactgtagatgtctgacacatttgtttagaaaatgtgttcagttcataatgttgattggtttgcctgcatctcttttgactttttttgtgaatgacagaatgatgcatgctattggcttgttggaaaaactgttttatagttcaaacaaaccaagtttcatgtttgacggagccattgtttcgcttattcacggaataagcgaaacggcatatttgcaaacgaaaagtaatttgtgaataaaacttttatatatgtgttcttagcaatctaaaagcaaaggctgaaaaataaacttcgatgaaaaaatctcaaaatcagctccaagttcaaggttggaaattcaaattttggctgataagcataagcataagcgaaaagatgaggccgtgaggcataagaccaagcatcaggtccaagataatgaaaacttaacagggtttgcttttatacttcggtgtttttttgtggagttggtctgacatacagaactgttgccatgtaaatagagcaggcatgatagattgatgtaatgttggcaacttggcagagaaatcagttatgggctcactgttcagtttctctagcaatttgtagctatctttatcaatacacaagcttttgtgattagactgccatttgtttttcttttaaaagcaaaaaaaatgcttgttttctaaccgggttgattttcgggggtttaaggtaccctgttgaactgtaaacaaataattgaaagccactaaggacgttcctttggaaaccaggtgcaaagattttctcactagttatatttgcaatgaaaggtttagtcatttagtttgctgctttatctgctggattcaacttgtggccattgggctgcattatgtgatgatagttagctgcattatctaagcagtaagcaccagtaaatgcagttactagatcatgtgtgggttatgcactggccaggtgatatacaggggtttccaatgtgctaacgtggatgttgttttgaattgtttattgttgtcatcacttgaaactgccgataaattcatcattcgttttttcccttgcctgtactgctctggtgggttgaacagatatgggatttagtttttttttttttgacatatatgccttgggcctaactattaactaagaaattgaatgtacatggtctgagctaaacaatgaatatatcctcgaatagttgggttggacgagttgctagcttggaactaagtacagggccctatacaaatggaatacatgatgtgtaatccttgttcttttaccctttcctccccaccttggtttgtggccgttggggttttatggttggctcttggctgtactgcattttcagaagttacatggtgaactgtgtatacctgaacttttctggtattctttgacattgtttggtgttgaaaatattgttctaggctactaataataatttgtatgctgcaactgatggttcaatttttattacatctgttgactagtcatgca

SEQ ID NO: 82389 - DNA, 1473 bp, Oryza sativa
cccgtgagtaacaaaggcattattaattgctgcagcagtctatctgttacgattacgacatgtgccattaattgttttcaccctgactatcgtcttacaaataccgtttgcatttttgttatgcttttatgcaggttagtccaaatgtgcagtcacagcctactggacttaaaaagtcatggcaccagctgtttagtcgctcagcatctgtgtcaccttgtcctgatgttcctgctacagcccgtgaaatgaacgggcaaccagaaccatatggagcacaaattagcaatgctcaaatcttcctatcgcagtatccccctctggacagtaaccctagttcaagccgctgtatgcaatttccaggtttcccaccagtgaatggagcacctgccaacatgtcactctctcattttccagctggacatatgccctactattgtgagccagaaccaacagtgtttgaagaaccagaacaatttgaggacccatgctatgatcctgatgcaattgcgttgcttgggccagtttcagagtccctagataactttcctctcgacttggatagcgggttcatctctagtgacatcaccaaggaaacacatgcgaagccttcaccaatcgaatctcctctttcaagatcacgtacattcgaggataatcctattaggcactcaactggaaaagggcctaatggttctattttgcctgaagctagcaatgaacatgggggcacatggcaaatgtggggcacgccattagttcaagaaagtttaggtctacgaggtcctcagactgagtggctcctaccaaacacaaatcaatttaaccatggtgccagtcatttgaatggtggaacaagaagctcagtgggttctggtttggatgacaatgatttatggctgcagaaagcgcctttccagcaaatgcctcttgatacaaggagtctgttcctttcacatgatgtctcagagaatgctatacacaacgatttggattttggatcaccaaacaaatcagcccgtttgcaccccattgggccacctggtcattcttggtccaagtaagtatgttgtgacattcttgtaccgctttcagtattttctgcggcgatgaagcatttgattccattatagacaacaatttgataaccttggtttgagctagaaacatggtcataacttacaacagaattaccctaccccatactttgattatgtgagcataattttcatttaggtcataaaaaatcattactaatgtagcttcatgtatcaatacacataaggaccaaatgagatcaaattcacatagtattcttacaaggaataatcatatgccataggggactcctaaatttcttttgtcataatgactaggatgggtgctaccactttatctataaaaatggggcaagagtgataccagttaagagcaaacaatacactctgaatctccaatttagaaggaatcaaa

SEQ ID NO: 82390 - DNA, 5076 bp, Oryza sativa
tggtaaggttgaaaagggagtacctatacatctttcgaaagatttttatgatcgtatcacacagatttttaatctttggattaaaatccgatagatataataaaaagcaaaaagcaattaagaaacaccataatggacactaaattaccataacctcaagaaaaagaccaaatccaatacaaaatttaaaatttacatgcgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgggttgaaaatgacatcaaagtgaaaagcccttaaaaaattcgtctcgtaattttctagcgacctgtataattgtttttttctacatttaatactttatatatgtgttcagacatttgacagctaaaaaattccatcgcgtgcatgtgtgtgcatcgtgattcgtgcccgccgcggatacgacaataacatatgccgtgcatgccaggtggcggcatccgccaccaccaacggcgacacgtaggacggctggagggtcccgcgcgtcagatccgggctgggcttgtggcgcacgcgcctgacacgtgcgcagcgtccgcgagccatcgatccggtgcatcgcgcggcggccatttacttcgcgattaagctaaagacgaacgacgacgaggtggggcccacgcccacgtcgcaccaaccggggcacccacaaaagcagcgcgaccgcgacgtcgtcatctaacgcggacgcccatctccaccgtccgatctcgccactaggagtgtttccaaccgtcggatcgtttgcgcgcgtagatacggatatacttgtaagcgaggggtagaatctctctctcggtgccacagctttaaagttagtttttaaaagttacggggggaaattttaactctcacgaagaagaagaaaccccacgtaaccgttgggcccgcgaagtgggtggggcccactgctcgagtgtcggggtatggtctcgggtggtctgcctataaataccagccatttcctcatcgttcctcccttttccccgattctctacttcccccctctagttttctgaaattgcggataggtccttcttttttgtgtgttgggacttgggagagtgagaaaaatgctgtcagtgcaggaggcgcttgactttgacctggacgcgatgacgtccgggttcgggttcacgccgtgggcggctgacacgtgccctaccttggagcagctgatggcgtcgtccgcgtcgccctcgccgtcgtcgtcgcttgatgacaacgcggcggcggcggaggaggagaacggtgaggtggaggaggaggaggagcggaggcggcagcggcggaaggtgtcgaaccggctgtcggcgcggcggtcgcgggcgcggaagcagcagcggctggaggagctgcgtggggagagcgcccgcctccgcgccgagaaccgggagctggcggccaggctgcacgccgtggcgcgccacggcctcgccgcgcggtgccagaacgcgcgcctccgcgccgaggccgccgcgctcgcccgccgcctcctcgcgctccagcggctcgcccgcggccgccacatgatgatcacggcgtcgccgccgcagttctcgcgtcgctgatggcgtagaaggcgcacacaggtgaagttttggaacggacgatgggtaactttgtcgtgagatggaatggacgacgctgtgcatggcgcactacttagctagtgaaaggggtctctcgtgtcgacgtagtatacagtgcacgtacgtgtacattgcatggacgtatgactgatataagtacatggaacttgatgtaaattattacgatcactactaccattctaccaaagttaaaattaaatatattaccagtttttgttgcatcgacgacgtcgacgcctgtacgtgtccgaatccacgtgctctcatttttgtaacgggatgatcgaggactcgatcgtgtgtactgtctgtgggcaaacggaaaggagctgtccatgtcttgtttgtacagcgagattaggagagccacaaatgagatcagtgtgggacactagttgtctacttgcttagttgctcctctcgtggactccaaattaatcatactgtgggtcgctgtgtatgcaatcgaagtaacccggcaaatacgacaagcacagctgcacatgtccacacacaacacaatgcatagcagtaacaccaacttgctaaaacagtgttacgcgaaatgaacaaataaattgtgcttgtataaaaattttggctagctgtcgcaaaccaaagtaggagtacctagtaccggtaaaaaaacttgttaaacactcgtgcgtacggattgaatcaaagccaaatagcacatgatactcaacattactgattactactactactacttagtatactagtataaaaatttaaaatagtgttcacttccccctaacgttgtgttttgtcgtttctttttgagaatgactcatatttatattttttgtactttgaatttgcaaaatacttcaacaataatgtcgtgttctttcagtaaacagctcgtgcagatttatcctagagtggccctatgtggtatcctaatttatgttaaacctagcaagatcagttacgatatatcctaatttcttctgtcttggttcataggcaccaaagaagttcatgcatctgaacaaacattttacattttgtttacgtactacttcctccgtttcacaatgtaagactttctagcattgtctacattcatttaaatgttaataaatctaaacacatacatatgtctagattcattaatatttatatgtatgtggctgtgggcaatgctagaaagtcttacattgtgaaacggatggaatagattgatattacgcacccacaaattcatgtaggagtacttcttactagattgatactacacaggaaaacttgttcatgtggtgcttcgatccggtgggtccgtcagtcagccggtcataaggagtaccgttgtgctagtatgcgcatgcttagctttttaagcgccatgtttcttccaagtttcgttatgtaaataattttatcaacgaataaaaaaataagtgtttaattaaaattttgaaaatttgaggtagaatttgtttattcaaattttagtataaacattttaaaaattatgttgaaatattcaaattttggttgaagttttctaaatgttcaatataacgttttaataactgagttgaaagtttcaaattttcagtagaaagtttcaaagcttttattgtgaaccacctaataagagaaaaacgattttgctatatctcactcgaaagattttttcttatctctcactcgattttctcactcaaatttacagttcattttcttgtaagttacagtgtaatttatgaaacttacactgtaacttttgtaagttacactgtaatttttgaatcttcgcatgtaaattttaaattttgtattagatttggtctttttcttgaggatatggtaatttattgtctattatggtttttcttaattgctttttgtattttattatatatatcggattttaatctaaagattaaaaatctgtgtgatacaatcataaaaatctttcgaaagatgtataggtactccctataaatcttgcgacagatttcatgttacatatcattcgatttttggaccgtttgattgcgtcaagattcgtgcttacacgggtgggaaaataaaatgtgcgtgttcacgtgtaagcgaggagtcgaccgcacgatctcttgttgccgaacaaaggcctttaattttaccaactgagcaaggaaccaatattgattttgtatctaaagaacagacttacatactacgtacaaattaattacagtgtaattatgtaataatcacactgtaactactaaaattacagtgtaactatactaaaattataatgtaactatactaaaagtacattgtaactttttaatgcatatgttgatgacatttttatttttttattaaacctctttagacttataactgtcagattgggtccgttgttacgattaagctagcccgtttccctcttcaacgtggcgcacatccatatgttaaaaaatccgagtgagatgaatgaaaaaatcattcgaatgattgctagacactcccgacccaaaatgactccaggcccgcttcggtcggcatgcgcacgtgggcatcggcgctccgagtcctacgaggccggaggtagaagagacccacaagggtacgagcaaaatctgaaggaatccaatccacgaacggcccagcaagagcccaccatactatccagcccgtctcatctccgccgcttaaaacccccggccgccggcgaagcccaccgcaaatatcgcaattagccctaaccccctttcttccttttcttccttcctacgcacacgcacgcagccgagagcaacggcagcggcaacgggggcggtctcgccggaggcggtcacggggggatcgatgctggaagagaggaagctgttcgtggcgggcctcccgcagcagacgcgggagggcgacctgcggggccacttcgcccggtacggcgaggtggtgcacacccgggtggtgctcgacatggccagcggcaacagccgcggcttcggcttcgtggagttcgccgacgaggcggcgacgctgagggcgctcgccgacgacgagatgcccaaccacgtcttccgtggccgcaaggtgaggcgacccctccccccgctcgatcgcggcttgccgctgtcgagatcgatgcttgttgattactgctgattagttcaacctgtgcttgtttcgggttgaacctggcttgctgtgatcatcgggcggtgtctattggattagtagattaaatgtggctaatttccggttgtatacctgggtttaccatgatcatcgggtggtggattagtattaggttagtagattacatttgttcgaattgatggggttaagtgataaggaagctt

SEQ ID NO: 82391 - DNA, 3390 bp, Oryza sativa
catctgctcatatacttactatgttccttgctagaatgcttgttgagttctttgaccagatgaatgtttgtagagttatccctagtaatttaaatcatgcaggtgatgtctaggtttaaatgattttcatcagatgtagaggtcacagccttccacatgccatttttcattgatatacccgtgtatcaacacattaagcaatactcttagtctccaagtcatgatatttctggcatatctcttcttctcagttttttttaacataaagctttgtccatatatatattgtatagcatcaaatagatgaatcttttgtgcacttctcttcagaatgtcgatgccagacaaaattctccttttgtattgatgctcatagcatagctatgatattttgagaattgagaacctattagtccagtttgatctaagaattatgttttgttgtttttcatattggcatttctgtgtggatgcagctttttaaagggctggacttggaggcactatctgttgaacttataatattagctatttggaacgaggcccttaatgcatgtagtttatccacggatgctacacatgatggattttttttgacccaagctcatgtcaatttcctgcctaagaatgaccatcgtccatctcgaaatgtagtacaaggattggatttcaccaggctcgtttctgtctgttcctgggctgaaagtggctttatcaaggcatatgaccgtgcagagaagatatcacataggttgcgggacaacaatggttagaacattggtatcttcatgtcctagtatagttttgtttttgttttttgctataacccttgtttgtttccagataacaccgagatgccagatgcagtggagatcatattccagacagctttaatatatggaacaactggtgctgtaagtatcagtattctaggttcttgtatggtttctttacagctttcgtttttccttgcacttcatggatttggggggaaagtgggggagtggtgtatgcatttcacgattttgggtaacaagcaatgatgctacaacggaaaggaaacctgtagacttgtagttaatgtgtaccagcccaggatccaccgctgtgcactggttgtccaggcggttggttagttattatcactccatattctgttagaccacgaacaaggggcagaaatgaatactattgttttaggctgtgtttgagggagagggaattgagaagattgggaagatacgcaaaacgaggtgagccattagcacatgattaattgagtattaactattttaaacttcaaaaatggactaatatgattttttaaagcaacttttctatagaaaatttttgcaaaaaatacaccgtttagtagtttgaaaagcgtgcgcgcgaaaaacgagatacaatctcccctttctcatgtgaacaaacgcagccttagactgcagtgggaaaaaaaaacaactttttttacaaatgagcaaaaatgtttatagccagccagtctctgctctctacttctattaaagcgctattcatgggggaaagcggtattcatggggaaaaaacttttatgaaagcactccaatcatgagttcaagacccttgctactctttttcctccatctgttttattttctggccaatacttaatcctgcccttgtaaacagtttgtaacattttgatgatagtaatatattcatatgggctggccttaggccttagccctttgtgaatctttcaaaaaatagcccccgtcattccctagctggggaactctaccatctttcataaaccctacttctaaaagttctccaacatgtttcttcacttagagctgatgtttataattcgtttgtgtataccttttcaggcaaaggaagttttgggataccaaaatagatcggtggcgctatactcaaaagcaatcatcttgctcacatttgtattgcaagaagcaactaatttgccactgaatccgccgttttccctttcatcatctgatcagcaacgtatccataggtacatagctaatttgaggagccatctatgcagtgcccagctgaccggacaacaggagagatatgtccagaactaacttttacatgggaaatattggtgcacaaagaagtgaaagttaaattgattccgtggtaaacttcaagcaagctttgttttgttccccacgagtattagtctttgcctccaacttttttttgtctaggagatgcttacttgggggaacttttgtaatgttttgtttgcatgatcatagtccatgtgttctttttgtatataatatataataacacttctaagttgtacagttatttgccatagaactgaaatgacctcttggctctgtatataagtagcatgtaaaaagagcaaatagttttttatttttccaagtcttaaaactgctttgcctacttattatggactgtccaaattctgaagtgagcattattttgagctatggtgtttggtgtatggaagctgacatgtacaagaatagcaggtaatattatctttaccattttacaatatattgctgagacatggattatagtttcagttttttctaggtaaatttcctgcttctgcttctgcttctcacaattggttgcagcttcatctttctaacttcgtacaagtaggtctgatgctttttttgccaaccatatgtccatatcccagacaagatgaaatggattgcatttccatcgctacatctgaaggtatgcggtcataaaactcttgtccttttccaagaattctcgtgagttatgatagaaagagatacaactatgacaaaagtgatggttccacctgatgtcataatactagctttcagtattaaaaaaaaaacctcactataaaataactcagatttactgaagaaaatttgatcaaatcatttccgactaatgcttccactatatagcatttcatttgtgcacatattctccatgtaaggttggagtatttctaatatactccctcattcccaaaatataaggatttttagagttggacactgttattaaaaaagtatgtagaattaaataggtggaatgattgtgattgaatgagaagtggaggtaggtggaaaaattgaatggtggagagttgtgattggttgggaagagaatgttggtggagaagttgttatattctgggacaaattttgaaagctaaaagttattatattttgggaattgggacgaagggagtatatgcttatgggggaagaattcttttttggctgaattcctccacttaagggtctgcattcttctggatattgttgagtaatatctaaattactgaaggtttaaatcatatagttgatcccatcagtttcgtttgtagtaagtgggaat

SEQ ID NO: 82392 - DNA, 2544 bp, Oryza sativa
atagggatgaaacccatatatatatatatatatatatatatatatatatatgaaaataagcttgataggttacatctgtggaatcaaggttctatacttctattcttatgtagatatagtaaaatacactactgaaattaatgcattcggcaaaacttgcaaccacaatgtaatttacaaaggagttaagcttgtcgtgataattttgttctacctaattggaagttttgccacctctttgtaatttacaaacgagttaagcttgtcgtgataattttgttctacctaactggaaattcccttagatatcttctgggtggtgtttactttacatctcacacctttactcctaagcacattggagttatgatctagttttgtcattatttgagttttatttgtttatataattatttttagtatgtttttaatcaaacaacttattgatgcatttgataggttgatgttaagagagccgagcgtagacatgatcataagcaaaccagtccatctattaagaaccaaaacgacagcgtgcagaaaaatcaatttatttttcaaaagaaggtctttgttggtggtttgcacgaaactgttacagtgaaggacctcataagttattttgagaaatttggcaccataacggatgctgtggtcatgcgtaatagaactacaaatagagcaaggggatttggtttcatatcttttgattcacatgaagctgtgtgcaagatactactaaataggttccataatttaaatggaagggatgtcgaagttaaaattgccgtcccaaagagtccaacctactcagaggcaaaatattatcacatgagaatggatatgagtttaagtcctatcacttattatgatggaatggtccatgtccatccatacacaccatacacatttggctgtgttacacctcttgctcacttaactcattcaggttatggttatggaggacctattgattattcatgttatgcttatggaggaccaattggacatcagcatgatcttgtgggttcttactattatgctaaagattatagcaaaactactcctatcgacctcgataccacagataccacaaagaaatgacttgctggtgagtgctacttatgtggatttaattatttttataatatattttagtagatcaatagtctcttatatctttaaatttttacttgatttgctaccatttgtttatagtgtttcagatttacttcaaatatatatgccccatgtttttagttgttgattgttgattgagtaactaatgactaatggatgtgtcttaccatgacatagttgacttttattttatgttgtatataatttggattgtctttgtggtttgctttactgggcaccacaactctttcgatatttgcctttcatacaaattgatattataaattcagattaaaaaaatgatttaaccatttattcagttatcctcttcccactcattttaagttattactccattacaaaataaatgtttataggagacaatgttcacaaactctcaaaagttttacattgaggaaagttttactgtacaatcgatttttgtttcccctattacatatcccttaaggtctatttataggtttataggcaggtttacaacctagggtttagtgtgctaataatttttatatataattgtttctctgatagggacatatatataactagcatcttttggctcattaggctggttcatcgtcattattcggccaccaccatgccgcctacagggccttcctcttcttttttttttggctttcgtcttacattgttaggctttcacaacctggtgctttgctcccttgtttcgcctagctccgcgtcgcctagacttcataccgcgccgcttcgacaagctcacttgttattatttcacctagcctcgtgtcatctggccttcgccttgcgctgcttcgccaggctcattagttgcttcggcatgccagtcaaaggccctcatagcatgcctccaacaatctttaaatatcaaaaatatttgattgaacaaaaggattttaatttgtcattctgttatataatatcatttatgaaggacactatttgatacatataggaagttgtctgtaaatgggttgacacttaccgctacagttgggtccaaagtttaagtagatgcacacaacaagcctaataaaacaatataactaacataccattattggattcatggtttgaatgtgtaacataaactaatgatattattgtcgcgtacaaccacacaaacttgtccggattcatggtttgaatgtgtaacataaactaatgatatttttatcgcgtacaaccacacaaacttgtccgtattcattcagttgtgttgtttcttagtataatggtactccttttgtcctggtgtactttactcttactttcattgcaaggattatttatatatttcctttatatgatgattttgtcgatagtttcattgctaagattttatatatatatatatatatatatatatatatatatatatat

SEQ ID NO: 82393 - DNA, 1396 bp, Oryza sativa
tgaacaactaagaataatgcacaaaatcacctcaatgaatgtgagcccttgtgctagtgaaattcacttccttctatcttgccgttattgttaatcaatatctattattcccctttgcttttgctctccttccggattgtgattttcctgagtttgtgattgacaggatagccgtgtacaaagtcctttacaggctttttggtggttatgtatctgatgttgttgcagccattgatcaggtataacatatgagttacttatctgaatttctttccactgtaatgcaggtgctgccatgttagtacttagtacctgacaatagtgactcaaaacaattatttctggaatctgccatagtagttgttttcttcatagactattgcagaaatgagtgaaacaacatctgccagttatgtaatgcatgtcactatcacaagccttcaatatgtaggaactaatgcatggatggcaatctgcattttgcaggctgtgcaggatggtgttgacattctcaacctttctgttggcccaaatagcccgccaactgctacgcggactacatttttgaatccttttgatgctgcacttctttccgctgtgaaagctggggtgtttgttgcccaagcagcaggaaatggaggaccatttccgaaaacactggtatcattcagcccatggataaccactgttgctgctggagttgatgaccgcagatacaaaaatcatttggtgctaggaaatgggaaacttcttcctggacttggtgtatcacgtaagttctgtttattcatgtattttagctcaaattttggttttctattactacatgtatggtatatgcattcatgggcaacaaaaattgtacaaaatgaattaaaatgacctaagctaagtggcctaccttttaacttcgcccccccccaaaataaataaataaataaaaatcactcaatgttgttgtctgcgcttagggtgtgttcggaacccctggttcccaacactaagtgcccgcacggaaacggagcagcgattagcgggtgattaattaagtatttactattttttttttcaaaaatggattaatttgttttttttaagcaactttcgtatagaaacttttgcaaaaaagcccgtttagcagtttgaaaagcgtgcacgcggaaaacgagggagatgggttgggaagaggggctgccgaacacagccttagagaagtatgaatgatagggcagcatcagctgcacttgatttttttttgttatgtagggtgtaggactgtaggtagatctttatacgaaattgtgtttttttatctcattgtgaaaatactttgtgtgaaagagacaatcctctgtttttcttcctttgtaattccactgtcatatgttactgcatc

SEQ ID NO: 82394 - DNA, 8470 bp, Oryza sativa
tgtccaccggtggccgacctcgacctgctcgagagctgcgtcacgcaggcggcggcgccccccgtcacggctccggcgaccagggcggagcggaggaggaagaggccgaggccgcgcccgcgcgccgcgccgccgccggagaagcgcaagaagcccgaggaggccgagaaccagcggatgacgcacatcgccgtggagcgcaaccgccgccgcctcatgaacgaccacctcgcctccctccgatcgctcatcccctccaactacatccctcgagtaaattccttcccgccatgacgccgcaataatatctcaattctcaagcaaaaagaaacatcaaaatctctcgcaagttcttagcgattactacaatgcaattgcggatatagggtgaccaggcgacggtggtgggcggggcgatcgactacgtgaagcagctggagcagcagctggtggcgctgcaggcggcggcggcggagcggagcggcgtcggcgtggtggcggcggcggccaccgcggcgtcggacggcgtgttcgtgtccccgcagtacacgagctactccgaagcgcgcggcggcagcggcgtcgacgtggaggcgacggccgcggtgggggggcacgtgcgggtgcgcgttgccggcaggcggtggaccgggcggctcgtgcgcgccgtcgccgccatggaggacctccgcctcaccgtgctgcacctcgccgtcacctccgtcggacatgacgccgtcgtctactgcttcaacctcaaggtcaaaacaacgacaactcttcatcaccttttactgcatgttccctcgtttttttaaacctacatttgatttgccacaaaaggtagccattttctaactatatttgattgcggtttccatcacaaggaaaaaggaatatttcgttgctgatttcaatattgaaaggtcactattactaaaaggcaattttcagcttaattcacctgtaagctactccctccgttttaccatgtaagtcatttagcatatcccacattcatattgatgctaatgaatctagaaacggaggaagtatttaaagcagattactctagtttctaatggttttctcttataacacgtttcaattagacattttttttaaaaaaaaacgtagatggcaataaagtataatgaaaatattttatagtatttttttcattatagattgcgtgcaatcttaaatataaactttgaaatcagtctttgtccttcttgcctatgcaaatagtgatcgatgtttttctctttttttttttaagaaaaagaggattgagaacagttatatccaacaaattaaaatacatttgtacaaagagggaaaaaaaggtgagctatttttaaatatattttttaacctactagacgcatgtgctcttttttacttgcatccgattgagcatttaggctgtgggccacacgctaaaccagatagcttattagctattgtaaacagaaaaaatgactgtttatttttctttaaaaaaattctatgttgaaagcatttgaaaaaaatacgccatttaaatagtttggtagctcaagaaaagcgatggagtggttaaaccaactaggtaaatcaaacggtgtcgtctaattaggattgttacaactcatggatataaacagtaccacataccaataaaataaacaaaatagatctcagaatcaaaatatgaggaatgcaaaatatgtgccattactttgctagtgccgtctatttttcttgcgagaaccatttaatgatttttagtttggatatatatatactactagtagaaagaagtgattatgtaatagtagtatttgtagagagatgtgtaatgtagcatgtcgtgctcggcgcaccagtgagaaagtgatgggtaagcgaatcgattaattgtccccagctcgttgcagagtgttgcgtgggatttccaacagatgaggaccgtggctttcgtacgtttctgttaaaggatttttggagtatgcagatggagtgttcgaatacgatgagcatcccagtacttgggtacagacagactgtgcttaatttccagacaattactaattacaagctcctgctttcttacgtgtccttttctctcttgtccatggggaaaacacaggatcggaacaaacggatacaaccacaagccagtcttacgtatcccgaaccatgcatttcagagatagtataacagcttttcagtactcctccgtactgtctaatcaaacaagtagtttactgtgcaatgtgaatattttacctccgtttcctaatatatgacggtatatcaaacaaaaagaaagaaatgaagagagtatatatatatgatgggtttattattatgtaggagtagctgagtataatggtgtgtgacatgtttgagtgcagatggaggaaggatgcgagatggcgacggcggacgaggtggcgacggtggtgcaccagatcttcgcgtacgccggagcatgctgctgacgccgatgtacgggccggaaccaagagaagaagcaaacggtggaggagggaggcaaatgcaagcaaaacacatgcaacacagccagggataagtcaaattcgccgaggtgggcagcaggacggacgtacggcgatgagctagagagggtgagagagatgagagagattgcttgcttgctatggtagctagaagccgggaagggaccatacatggcaggtgggcccaagaccacggcagcagtggtcactcctggcagtctcaggctcatgccggcctactgctcgaggaagacctctactgtagcaagagggagagtgtaaaagtgcagagtagtgtgtagctcggggtaatcaaaagcaagctaagctaagcaaaagcaaccacacggaccgacctgttgttcatttgcacctttctcgccttgagcttgcttgcattgcatgagcgacgcgacgagatgttctcgacaggcgatcctatccttgtacgctctgtaaatactcctacacatacagtaggaagtagagtactctactgttgtaatcctggattccttgcatgcaaaactttctgcctggctggtgccctggctgtagttgtgtttctctttaggagtggcaggctttgcctcatctggtgctgtagtcactaggagtactagctaggtggagtactgtacgtggcagcgcagggccagggcctgggtggtggtcaacggcgatgccatcattgcggaagcttttgccccgattcggtttctgctgctcgcgcccagtggtaaaaatgctcgcaccggactaccggaggatattctgccatggccgtctcgtctagctagctcccctcccctcccgaaatcatcatcattcttcggcgtgccgccttggtggcgcacgcgcgcgcggtacaatcacccaaacccaaccgaagtctccacgccgaacctacggacacggcccgagagagacgcatgcagtggcaatcgtagttcaggcgggccgtgtgcgcaagacgagggagcaaagtacaggagagcatcagagagagacagggcgtacgcaatagcagtagtatcccatggcatcgcgtcggctattagtgccaaccagggccggtgcaacagtcgatccgtcactcgctcgccgacgccggccggccaccaacttcttcaccaatatgcccgcctcccctccgccttcgtccttgctctccttctctctcgcatgcagtcgcagaccatgtcgatcgcagcgcatctcgctgccaccgctgggcacgctccagtcgctcgaccatgcatgcatcgactccccgctgcaagctgctgctgcggcattatactggaccagtatcgccgattttgtgccggctgctgaaaagcgaaaaggtgatcgatacatcgcccgcgctcgtcaggctctcgcttatagccaatctaatagctcattcatacaatagttatatactacactattaatatatggtcccacctgtcatacgcacactgtgtcttagagtccgtgctatagctggctacaaatctatagtccgttgctcttctctctccttatttatctccttaaaatatgtttatagctggcttaaagcctgctattgtacctgcccttagctggctggctggcgcgattagagcaagtctaatagtatagccaactactggctccaattcatctatagctaatctaatagctcattcatacaatagctacatactacaatattaatacatggtcccacctgtcatacacactctgtgtcacctagtctcacctgtcatacacactatgcgtcttggagtccgtgctttagctggctacaaatctgtagcctactgctctcctctcttcctatttatttttttaaaatatgtttgtagctagcttatagcctgctattgtacttgctcttaccatgcagccaccaacacaccaatgctgcgaccaagcatcatgtgagtaatttgtgcagttttgcctgcgttggccgctcgaatcagcggcaatcagggagcgtctgcgactgcgacgacgacgcaagacgcatgcagcatcatgtgagtaatttgtgcgcagtacgctgtctgctctcattgctattgccgtggtacggaattgtccacacgttgttgcatcctcttgtttttttgcttgcaatcttgcatggacatgcaccgctcctacctcctacgaagcagcagcacaactctaatccagttactacagtggtatcaagattttagaacaagcaactgggctgggccaggagcccatcttgtcactccgtctctgcatatctgcctcttcatgtactggtgaactgagccttttcagtttcagaacctccctgttcttttatgcttaaatggaatgatggtgaacgcgtatacttcttgatcttcttttttttttaaaaaaaatacaatatatgaattccaaatgatttaaattcatttttcaactttataatagttaattaattcatttgtaccaatgaataattatcacaattcagctattcaggcatttagcgcatccactacactgcgtacaagatacacatgaagttcacagttacaatttagaaatgttttccaatgatatgtatatcaaaacttaaaaagtctagcagtgaatagttaacgcagaatgttcagaaatggtttgcatctgaaacaaacaacaggcatgcaattgggcaacaacaacaggaacagtaagatcttactcaggtttgacaagctgagctatgtgcacatgtggtgtatcatagggacttcacaagaaaaaatgtggaaactccaccaaataggtgcagcatgaaaaccatctacagtttggatgtaaatgattacagcttgtgaaaagtagatggtctgtttgctctcaaactgaccacggagggaaaaagattcaagcactaggaacaacatattgacgaacaaaaaggaagtaaaatctacaggtggccatcagtaaggtgattcatgggtgccagagaaacagactacaagagcaccttttccttcttctcaagtattggagggtcaacctcgattcccatattagcagcagtgcccgctataattctcatggccgagtcaatgctcttgcagttcaaatctggcaacttctcttgagctattgtacgtacttgatctgctgttacttttccaaccttctctcgctgcggttcttttgaacctttctcgatacctaagaataaggattggaggtgagaaatcatttgcttaagtatccaaagctcacaaaagagctacatgaacaatagaaaggataatcatagatgtaacaaggtcggttgtttgtaagcgattgtacgcagtcgtgtgcaatgcgttcatccttgcttttagtctgcagacatgcttgaactcgcaaacagcacagatattttgtgactaacgagtccatacaacttattcatctctctgatgtattcatattacaaacttcctcaccatattcatgaaacaagggaaatgacaaaccagagtaaaaatacatataatcgtaagcagagcaagttgcataaatatgtgtgcttaataacatctaaaaacttattggttaacttattttaattgatcaacaatccaatagataccatctagcgctactgatcatataccaaacacaaactagaaatatgcaagagtgaaaagcagtagtcatttgctatttttttaccttgttctcgctgtcctatggaaatgaagaactaaaatatggaaaatgcacatcagaatcaaaatgggcgaagcccacatgttgcattatctttcaattggctgaacaaggaagtaaagtgaataaataatgtactagtgattagcttttcagagaaaacttttttacgtctcatatgcacttcatttcacataagtgcaacattggtactaatgttatagcaaacatctaagtctaatgtatatgtcatggcaaactggcaacctgtgcagttcaccctatagattagtcaaacttttcggataaccatatctaacttgtgacatggaactttcaatccattcttctgcataatactccagaagaacataatattcttatagcattgggccacatggaatacaaaagcaaaaacattgacctagcagaagtgttttcattttattttgtccaaccgtataaacatatcgcaaattcaatacatggacgaaacaaaattatagattcatgctagctaaaagggtgcacacctgctgccttgaggagaaggactgaggcaggaggggtcttcaagataaaggtgaaacttttatcctgcaaaaaaccaggcaaacacacatataattaggagtacccacattagagatgcatgttcacacacattcagtggaattgacgattttaagctcacatcgaacacggtgatctcgacagggatgatgtagccggccttctcggccgtcttggcattgtactccttgcagaaggacatgatgttcacacccttggcaccaagcgcggggccgaccggcggcgccggcgtggccttcccggcctccagcgccagctttatgaggcccaccactgcacaacaaacaaagaacgcacgccgcgattcagccaacgcgagcgcaagcaaatccatggatgctgcagagcgagacacgaacctttcttgggcttgcccccgggcttgggtggcgccatggccctgacggcgagcgccctccgcgagggggcagcgagcggcggcggcgtcggccggaggaaggaggcgggggcgccgagaaaggaggaggagagcttggtggcggtgggggatgggacgccatgcagggacaaggaggtggtggccatggcggcgcgcttggagcggggcgagatgaggagatgaacggcgggagctttgctctctctgctcttccttccctatctactaatcctttcctcccttgagctggtaacagaaaaccttaatacgttttcctttgacagtagcgtaaattacgaaaatacgctttcctcgtccgggtgtgcctgtttttcgggccggacacgtgaaagtcttcctgggcctacgttcaaaacggcctattcatatggcccatgcggcccggctgccgtgcgtctccgttcaaacattcaactgccggccgctcaactctccaccacgtcggaggcgtcgactcatgtcaatttgtttacgtgtatttgtccccttttccttatcctcccggttttatattgttacttaaaaaaatacccgtgcgttacaacgggtgaaagctattttaattttattattgttgtatggtttagttaaggtgaaattcactttgagaataaaatcatgatctgcaattgtgattccgatcatctcaagttaatatgtaagttttttttaaaaaaatatttcttatacaactcctcctgtatttccaaaagcgaacgaatttaaaaccgattgaaatacatttatgtattttcaaaaccgaacaaacttaataaccgactcatacacggatgacgtaccaaaatatcgataaaaacatcttcaatttttataataatagagacaagtcgattgagtggttatatacgaacttatatatgtaaacactggatggctccatctttttttttatgcttatctttatcaactaaaatttgaatttttaactttaaatttaaagttgattttgaggttttttttcatcgaagtttattttctagtctttgtttttagattgttaagaacatgtatatcaaaactttattcataaattgtttttgtttgaaaatatgtcatttggtttatatcccgaatatatgaaaatttattcataaattatttttcatttaaaaatataccgtttggtttattttccgaataagcaaaacgacggaactccagtagtacaattgcgttgcaccgattgatttgattgattactcattccaacggctcgtt

SEQ ID NO: 82395 - DNA, 8478 bp, Oryza sativa
attcctgcagccctgcaggagtaaacaagctgatttgaatgagaactgtgcctctgactccccagcattgctcaccatgcaaaccaacccagtctgccgaattcctaaagaggagaaatcaaagatgcatccctgccctcccgaccaaactctactcatgtgtgggcgatgcctcactggtgacgaagcagtacatataaacagtattttgtcctccatggacaatttattggcaaaatttcatggccaagcaggcaagcactgtgtgtcgtcttggtctcttagagaccataattcagtctgagttccggacaaaaaatattcaggtcgaaattgattgctgttactattgctagattgcaacgcggcttagttttgcctttcctttttctccatctttgaataatcaattattcatatttgaacgtacgcgccatttttttcttatcttagatcaaagttgaattactctgatcagagttcagctcgtacaatgtactttcacttcaagtttataaagcatcttcagattagtttttattaaattcaccattaaatatattaaattttctagtatatttgtttagtgttaaaaatattactgcattttgtcaacttgatcaaactctaaaaaaaaacttagagtaaacctaaaataacttatggggctcgcgatgaggacatcactccttgatactaggtgaaaccccgcgcattgctgcgggaatttagtatgaagatatacatcgaaacattatgtgaattatgttggatgataatttaacatgtttgtatttgaaaagctcttaaattataaaaactataaagatatagcatgtttgcatgatgtttaaatgtgatgattgttagtggatgatgatgtgacatcttgttaattagtgaatgatgatgtggcatcttgttagtggatgatgatgtggcatctttgcatattaagcttaaggagttagtggggtataactttatagtaagataggatacgcgtgaggggaagtgagaagcacttagagagaggcttgagacagaggtataattcatatcaagttcgaggacacctcggaatccaagagtagcacacactaaaattgacacctagaactcattcggactcggttttttacgttctatatatgtatgaaaaggtaacgagatcgcctttccaatgggtctggtctcatatcaaaactcctattgagtatcaggaatcatcaaaacaaaagagcgtccataatcttttcagatgatgtgttagcatctttaggcccgtgtaccatattggagtttgttcgggggtcctaggttgatcctagaacttaatcatttagtagttgtcattggattagggttgagttttatttagattattccgtcgttgcagtttcaccacttagttcagtttgtgcaaccccaacttgtgagcttcattgtatatttgcaatatattcagattgcttcttatactctcttgtttgtgttcttgattcgcttgctggagatagacttctccacgaggttaaccgcgttttggcacggttgataaccaacggagcaattgtgtagtgaatgataatggttcgatcgttctggtcggagcctttggatcatcaacatcgagtctacacaattgatttatccttacctatcggaagattggaacctggttcctcatcagctcgttcaaactgttatcaaaatcatccataccaaatttttaatatggccaaattaattttggcaaggcaacaaactgaacaagattttaacatcgcaacatcgccaatccctaccaacatttgatagtttcagaaaaacttctactcacaaaattataccaaattttggtaagatatcaaatcaagcattacctttttacatattgatcttgtaaaaaaaaactggcattgccaaattttaactttaccaacaaattgtaagtttttttttctttttttgcaatatacttcaaagtaatcaacaagcccatagtataaaacgaggggagcgctctgtatttatagctcatttggaacgcacgattcttaacataggaacgggaaaaaagaaacgtaagattgaaagtgtcatgtcaccttaaatcctatgaattaaagaaacacgagaaattaactgcaagaataaccgtttggattgagaaaaaaaatgtagaaatcataagagaaatacacatatatagatgattttcctaagaggttaaatctcatgttaaaatccctaaaatttcctatttttgagccaattcaaataaaggaccacacgatttttttgtccgtaggagtagatccctaaaacaaaaaactttttccaaagaagtccggcatgtaggaactagctatatcattccaacgtactaatcttctagtatatatccgtattctcctagtaggcaccttgtctcatagtagcactctcttttctttctttctaatcttgttgccaacttgaggcactcgactgatctagtactaccagactacctctccacaagaggccaggccaggacaaactatgcacacatagaaacgacgccggtgtgcattgcatgcagctgtttcgcttgctgcagaggcatgaagaaaaagcaagacagaatgagaaaaaaggcaaagcaaaaaaggcacagagagagagaacacaggttgcacagcacaatggggagcaaagtggcctattttcagccttgcacactgcacccctctctctgatgagagagatgatgatcgatcgatcagccatggctggccatctctactgctccccttggctttaatcggccatggccatggcagctgggtggggaatgtggaggcatgcatcacgagtacctgtgcccccacacacgcacgagacccaaccgtttccagcggcgccgcggcagcagcagccagcaggaggtgtatctctctcatcgctgcaggaattagggctcctaggcatgtacatttcggtgtaaaatctccatcaatggctctctctccttctcagaagttcagataccagcattgcaagtttttcaaccacctactgttcattggtctcaggcagtcaaaagctatagtatctgtctacttcgtacaaggatagcataaaattaaatcacagtagtagaatgtttaattagcgatgcagataatatcctttgggtatgagtgacggtgatgatgacgaactgcagcaaagtaggagtatctcccttggcgtacgagacgctagctgaatgattgatacatcacgtaccaatctccatcggtttcatactctcatcatgtactggtgtgtgcatgttctgacagactacgtacaaaaaaaaaacgtgaaataccacacagcatctcaagctgattctgtattctgtagtagtacgtaccatctctgcaggcggctcgtgtaagagcatctccagcagggacactaaatatagcccctaaacagattttgggtgttagaggctaaaaaactcaatccagcagagcccctatcaaggatcctaaattaggtaggcacccaaataacctttcctagcccccagtctcaggggctctactgcacagcccccatccacagttagaaaagcgcgggagccgcccgacgtggtcttggtccgccggcacctcccctgcccagggctcatccccggctggtgcggctcctccctgcctaccgtgtcatccctcaggtgcattcctctacccgacgctccttcccggccgacgcgtctgctgtacctggagtctcctctagcctgcaccctctgcctaaactcgatgaaaaacatggcccagtggccgagtcatgcgatggcgtcgaggcactggatgattcaagtgttgttgcaggctgcgaaattgagaaagtagtagcagggtagcactagcagttacgattgtgggacttagaagaatggggaaagtgatacatgcgatgtgctatgcagcttttttgttgctttgcttggttgttgcttcgtgagagaagtagctggtctattggtggatgagaagacgggaaaaatcaacacatgtgagaaaatgcatggaagcgccacagcagcataagctcgttttacccgagctatgaatacatgctactaggatttgtatttccattttattttttttaaaagaatcgaatttgaattgtgaatttaaatatggttggattattatggttttatactaggagtagcgtagagtatagaactatagatttgtactttaaagtatatgttaaaatagaagatgaaatgaaataaggggcgagaaaagagactgctgttagagttaaaggtattttttaggtacttagaaaataggggaagctcccattaaatgatgctctaacactgctccagtttgctcgtacagtacgtactaagttaaactacagtgacgaccaaaagtaaaaaaaaaatggaatctgcaatggcctacggagtactatactaacccccacaaaattctcatatgaaacaaacaaaaactccagcagcttcacgccaacgaaccagaccagagaccccccaaagtgaacaaaaaatcacaacttttcaacctgaatctgccgcaagtcgccattggttggcatgcagattcaaacttcagcgatggcgtcggcaaacggcatcatcgcctacgcatgtaaatctaccgagaaaaatggaacaaaatgtcgatcgcctagctagctactacgtggacgcatggaccacgaactgtcaccaaccatggcgccatttgcagggacgatcagctagaaagaaacaaagataaagcctgagatgtgagccaaagttaccagtttgcatgccaattaaggacaatgagtttgtagataaggaccatgcaggctgctgcaggcagaagctagcagggcgcctgccgatgatgatgcagattcagaatttcagatgtgtgtggcatgtatcctactccctccgtcccataatataagagattttgagtttttgtttatattgtttgaccactcttcttatttaaaaaatttgtgcaaatataaaaaataaaaagttgtgcttaaaatactttgaataataaagtaagtcacacaaaaataaataataattccattttttttaataagatgagtggtcaaacagtacaagcaaaaactcaaaatcctatattatggtacggagggagtagcaaattccaaatgcgattaattatcgattcgattcgatcggatcgtgctatagtaggtgtctctgcatcctccgttctgaaggtgtgttcagagaatgggagcagcacatgcgcgaggacatggacgcaccttcagatggcgacccctcagtgcaggcaagcagctagctatagtgcagatgcagggaaaggtgaggatgagtatgcatgtgtcatgtgtgtgttacatttgtagctgtgtaaatgagagcactgtgttagtggcattaggggttgttttgttatggcaggcaggaggggcaggagggagctaaagttgcttttaatgaaacaattcaatgtgtgtactgtaccacatgtgggggcatggctcatttgcaggtttataggagtataactaaactgatgggagcagaagaagttttaggagtaaattccctctgtaccctgaaaactcactcaatcccttttatgtcactaaaatttatccgatcccttctatacccctgaaattttaacttgatccctttcatgctcctaccattatattttctttcatttcactattacccctgaaaactcactcaatcccttttatgtccctaaatttacccgatcccttctatacacctgaaatttttaacttgatccctttcatgctcctaccattatattttccttcatttcactattacgtttggttgcaaatgtcttttttttttgcccttgatgctttatatttgaatataagctgaaaaaatgattgaaaattttgtttgagtgcatagtatgtgcattttatgaaactaatgagactaaatatttagtgcagaaaattttgacataaattttgaaaataaaataaatgaaataaattaaaacttttatttaaaattttaataggacaatagatttttttatcgggagcattcataaaaaaaattatcgtgagcattggtagtcctatctttataggaatgcttctcttttttatgacttttttataaaaaaataaatatatattttattatttcattacctaaaaataaattttgtgataaataatgcatcgcacgacaaactcataactataatagtctcatgcgacaaacttttacatttttaataatgtaattaataaatttctatgttcatccaaagggtaaaatagttatttttatagaaattagacggtcaactgacagcatgggtatggaaggaatcaaaatcaaattttagggtatacaaggaagtaagcaaaattcaggggcatagaagggattagctaaaaattcaggggtatacaagagattttctcaagttttattgggtttgtagggaaagagaatgatatcattccagcattttaacttaaaggaaaatacctccgaaaaagaccgaactgcccccacctctcctactctaccgcccttcctcctcccaaaattaaccaacctataaaaccggataaaaatactaaaccctataaaatcattatttgtattctttttagattcggttgtaacaccctagtatagcactaacatatagaaaaacctattccttgcccctccttccaatcacacgtcgcagcaaatgctcctacggccctaactcctcatgcaccacatcgctcctcacactggtgaggggtgccaacaaccgctccttggctgccaacatttaaaataaggagagcgtcatcgcactccttcccgcgctcttcgtgctactctcaactcccacgagattccccataccgccattgttagtgatctaggagccaggacccccaaagcatacaacgtgcaccatgaagttgccatgtatccgctcatctggctcatcactcatgccaatgatcaattcaggggcaacacgtggcctctcctaggtcgagaaggctaggatagaatccttggggaacccaaaggtcaaatccaagacggaagttgaataacatgtctaagtggcctcgggtccttaacttgtccccatttaaatgggatggttatccaccacagaggtgagggcatggaagacagggcaacgattgttgtagccgttgctcatcacctcacccatgtcgggcctgatatgggcgtgggaaaccagaggatcgtggttgactactcctcccttcctcgagacacacacctttgactacctcttgcgaggcaatggtcggcaggccccatgcccagcgaggcatggtgaaccctattcaccattgtagattaagcaagcatgcatggcaatgctatgaccacgccccactcaaagatgccccgaggccccagtggattgggtgggtcaacgtagcaagatctagctcgccatacctcatccgcagtgtgccctgttaaggcccgccccgaagctagcgatgggggcgagaaaaggagttgctgataaaacgtaccatactcaaatgttgatacgaataaaaccttacatcgaattttgaccgtatggtatcccctagagatgttataagggaagagttgggaccaagagagatggggtcggatcctagtgactaaggagggacttcaacacatttagtaaagttcttaagtaacccggaagagaaaggaagagaaactactaatccgagtagtcgataaacttgtaagatctttcaaggacaaatagagaaatcaccacaacaataggagtagggtattacaccttcgggtgacccaaacttgtacatatctttgtgtttatccattctagagtgatagaggggcccaagccccttactttgatgcgactagctccttggctgaactcagaaaaggcagtcccaccggatccccgcttttgggttccacaatccgacggtcgtcctccttatctctaatggctccctccacctgatactgtaccattgaccgctactttggaaacaaccgcttgagatgcccccgttgcccacattgccctcctctattccttcgtcttcaacgtctcatcgcctccacctcccctcctccctccttcatcgtcgagtctccaccgcccaccgctaggctgatgtcaccccggtctccgtctaattgcaagggatccccccccaccctcgccacccctcctaacccactcttacccctaccccacacctggacactaaattgtctgagcttgatggagttggagaacgaggtcatagcacatgaattgtggagtagatcccaaggacaagaattcatagtattttgcataggttttccgcctaatgccatttagcaaatctgtttaatttaatcaatgc

SEQ ID NO: 82396 - DNA, 3719 bp, Oryza sativa
  unsure (1)..(3719): unsure at all n locations
gaccgttcgttttatttaaaaaaatttaagtaattattaattatttttctataatttgatttattgttaaatatacttttatgtatacatatagttttacatatttcacaaaagtttttctgaataagacgaacggtcagacatgttttaaaaagtcaacggcgtcaaacatttagggaaggagggagtagtaaacatttacgtagctctgttaataatacctcaaaggctgtttgtacaggtgatgtgtctgaaaatagctctgactagaaaaattgtcgcatggtacccatttatttgaaagaaaaatatataattttttattctgtataggaacaataaatttttatataggaaatttttctatatgatttttgaactaaaggattattgaaaactattaaatcctatcaaatttctaaggaatacccaaattttacataagttttggagcatttttaacatgtaagtctctcatgaccttatctctctcatcctatgtaatcaacttcatgtaatctgaatacctgatgtgacattggctactatagatacaaccgtcgttcacatcaagatcaagccgtacaagttctgcaatccagttcggccacctgctacagtctcgacttcaaacggccgccaaatatgcatgcgagctccattttgggtctatgagtacttgatggaaagctctcggagtcatctttccaatggatccagcttcatcgccaaattccatcccagtcggccgaaatcacaaaaaaaaaagtgttgcgtcacctataatgggcctatgggcttgtaacttcgtctgggaccccggcccaagtggggcccatgtggggtgcgccccaagctggtggagcacgaccctaggcacccctaggtcgtccttccacccctatatatagctaattaccccttcagggtttctcgagttttgattaattgtaagtttagccattgctacttcgcttgcagcgcgcgtgtcggctagaccgtccgtctgcttgttcggaccccactttatcgtgtatcaatttatctttgtgcgtcttgtctatctagcaattcagttgctttatatcttgttcttgcttgttctcgattgcttgcaggaataaggttaatatacaccggcaagatcaataacccacggagaggtgtatcgatcgctaaggcgcaacgcaacgtcttgtacggttgtagtcggatcgtcaacgtttctcccaaatcgtagttatcatcaactcaccgaaagatcgggccaaacaactgccttgagtgtcgagtggaactcagggtctatcaggtggtatcagagctttcgttgctcggtgagttcttatctacccataaccagaaaatagccataaaaaaaagaattgaatcctttacctagccatacttgtgccattgcattgttcttttcagttttgctttgttgaattttgtgttgcatcgtcacgtcgtgttgctggtcttagcgtctagttcgtttagagtttcgagttctggtcacgttttgtaccacagtcgtcgctggccccgtgtctcagttgtcgtcaggacctacgaaaacggaatcggctcgctgccacggttctattttcgtagttttcagaagtttctgtcggttagtttttgagttcttgagttgcatagcttctgttcggtgctgtgtcgtgatggtgtgtcgtgatggtgcacctgtgatgttgcgtgtgaggaagaaggaaggaggatattagattagatcagtttttggtagtagattggatcggtttcaatttgaaccggattcggtttccttgcatgcgacttttccttttattcggccgtggtgcccttcacattaacatgccgagtgagtccgactcctccctctcctctcggtttgcatctatgtcgtggcttcccatatagatacattggtgattttcttttccgagtgttggattggaaatctgttagcaaaaacggaaactaccggacgagagcattccatttttgtataaatttaatttttgagttcgcacttttgcatctgagtccctgtaatttttgatatttacaattcagtccctgtaactttgcattttggtccttggtcagttctggtcaggaaaaaaaaaagaaaaggcagaaaggtgctaaaaaagagaaaagagaaaagccgcaccgaaaaaaaaagtgtgaaaaaaaagaaaaaaaaagaagagacaaggaaaaattcagtttattcttgatcttggttttggatatcagagtgatgcttgagttgttcctagtgctatcttgtggtatcgtttgtgtctaggttcgcgtctctagtacgttctagcctaggaccagcacggtacttgactttgaaccattattcaactttgcattctctgatttgagcatttgctatccctttgctacatatttaagcctacccagagctccacagatctgattgcagccgtacagcaagtgtttgccaaggaatcgatacatccaacctcaattggggtgcttggttaagtcggtgtacatcaccattccgcttgctttggtaagaacttgtaagagcttggttaaaagcttgagtgtgtgtgatatttgagctgccactacctagtagttgataggagcgtgcatatttttgtgtgtttcttgtttgctactaaccatggcaggattgcgtaagggaatacgagaacatcgacttctacaccttcgacgagatatgacgacttctccacgcgggcnnatgaggtacatgactataattttgaacaagttgcatctaagttaccattctttgatgggaaatatgattctattacatacattgattgggagctagcagtagacaatgaatttgatatatatgatttttctgatgctcaaatgattaaggctgctagtaataagtttacctcttctgcattattttggtggacttatgttagtaataaacctgaaacttgggatgaattgaaaaccatgataagaaaacgctttatgacatcttattacaaatgtactcttcgggagaaattagaacatctgaaacaaggtgatagaactgttagggagtacattcatgaatttaaggtctgtatcatctacagtggtctcaaagagtgcaatgaaaatacaatgcgtagatttttcaatgggcttaattctgaaattcaggttttgcttgataatgtgacatataatcatattgggcacctattcatgcttgctcgtagcattgagagtcagatcatatcaaaggcgaggatgcatgaccaatgtgatttatctcctatttatgaatctccaatatacttatgtaatgatgatgtgcaaacattggaggagcaatcttttgtctcccctgttactaacgttttgcaggaagatcagcacatccaagaaaaggagaatgatatacttgagaagaaagaggatgaagcacctgcgatgtctgaagaaagctcgcaaggtaaattaaatggtgctgagagaaatgaaggtgagtattctcaaggtgagctacacttgtccacttttcatgctatagtagagcaaccattagtggaatcaattgctgagttacctttgtcacaagttgatttacttgctgttccttgtgataaagaagagttgtgcgataatgcttcacttatattcatgccacaactagtgaatgaacatgctattcctgttgttaatactaa

SEQ ID NO: 82397 - DNA, 7294 bp, Oryza sativa
aatacttctttcattggggtgaagaaatacattatgcaattcatatgatgatatggattagggtccaacctggcgcttctggaattcctgtgcaatttcaccagccaagtttctagcaagcgagacattgacattgttagaaaatccaattcaaattcaaaagacaaacatatgtattccaacagaagacctgaaaagaataactttttatcaataatttcttgagtacaattcaatatttttttaatacactgagaacagttaaatatttgaccacaccataaattctaaataagctgatatgaaggtaattgtttggtaattcatcataaactacctcaggaataaatctttacaattaagattcacaagcagcaactgtctcattaataaaattgcaagctaaacaatttaggaggcctggaaattggtgtcacctcacatattcatgaccccatgaaccaatgtcaccttcagagcctatcattcggtagttgaggctctcctgaaacgataaaagaaggcatattagccaattcttgaaggattgatactgtacagttaatggtgagaaaaagttgaactctatctgtctatcatttaaaacccacgaaaaaatgtatgactatttatagaagtaaatcattctcagaagttagcatgcaagcaaattaaaaaagcactgggaaattgacacaaggaaaagacatcagaatggtatttttcacatactctttctccttcagcggacattgtcagggccaatactgacaaaatatcagccatatacttctgcagaataattgaagaatatcatataagcatcaagtagtatttgaaccgtgactcaaccgagagatcaaggattgattgataccttcagatcagattctggcattgtctcaaagtaagccttgagagttccatagtgcgggcgaaggaatttgagaggctttgggacagaggtcattgaacttgtcgcagaacggatctcctgcctgttaagcataaatcaccattaacaagagaccaataagagaaatgtgaaaactgtctatgcactaactggttgaacaatgcaaagtgatgccaccaatagcagcagtagccactcagatgcgacattccagctgagcagatcaaacaatctcactatgacgcggtagagattagagaaattgaacagttaaagcatgacctcatagtaattgtgattaagtagtattatacccaagatttaagggcaaaaggataaacaagcctccaacaatgtgccgaagatctacattcttgcaacaccagcaattaagcagccaaaccaataactcgggcagaatttatgtggattttcaattctcaggactgtaagtttgcagaacaacaaactcttgcacaggacaagtaagcagtgcaaccaaaatacctagcagttaataatagtctactagatgacatgatcatccgtccaaaccatactatgaataatgtatggaacttgtaataaactaataggtagtgtgataaatgcatccacccaaacgaggtaccagatgacacaaaacagaaatccctgaactacgcatcacgcacaatcagaattatacagttccacaccatcagaacaatcctcgttacctcatgctctcgagggcgagcttctggacgccgggatcggtgtcctgcgcccgcaccacgtagagctcgagctgctccttgagcgcctggtcctcctccgactgcaaccacgcaaagcaatccgtaagagagagatggggggagggaaggagatggcgaatcgggggtgggcgggtgggtagctcaccaggtcgtcgtccttcttctcatccttcttcttccccttgcccttggccggctgcggctgcggctgctgcggcggaggcgggacggggtccgagggggaggcggaggaggcgtccccgttggggtcctcgcgcggcggcatggcggagggcgagggcgatctccccggcgcgcggcggcgcggcgaggtagggtttaggaatcgagctccgcgcggaggcgagagcgcgagatgaggggaagggaagagaagaggagttggagactgctgctactggaacacgccgcaactcttggggagcgatgaatttcgctccaagaaagaaaaagataacgagagagaaagagagattcggtttaataaaggttttggtaataaactttcagtttgatgaaattgcattcttacattgttttcttattattattgtgatgatgattagtcgacggtttggctgattacatgttgggaatgaaaacataacatgggtacaaataaaataaaaacataacataggtaagtaggaaaatgagcattgaaatatactcctccgtttcatattgcaagttattttgactttatactagtaaaaatttcttaagtttgattaaatttatagaaacaattaataaaataaacatcaaattatattcattaaaattaacatttaatatatttttataatatgtttattttatgtcacaaatgttgttatgtttttttataaactttgtcaaacttaaatattaagaaaaatatcaaagcgacttatagtatgaaacgataatttttttattattttttgaaacttttgattttttttattttaaaatcaaacaattctaaaacttattttcaaaatctaaacattttagcacgtcaaccctcgtggtgtggcaaaatagtactgtcacgtcacccacaacgggcacgacaattttgtcatgccacgccagacaagatgacgtggtaagacaaacgttgtcacaccaattagaccgcgtagaaaaaaaaattgctagcatggcgaaacaacactggtactcatccattccatgttttttttaaccttttgaactttttaattttaaaattaaacatttttaaaactttgattttaagacctgaatcttttttagcgtggcaaaacaataccgccatgacaatttcagagaaaacgttatgccacatgcataaagaaataattacccgtaaacacggacacatatataagtcgttccattcgtaaggaatctaaccaaataaattatgctcaaattgtaaatgtttttcattgttttatgagattattggacaaattctctaggagaaaggttcgaggtataggtagcaaattgtactaaatccaaaagtagttcaagcaagctataacagtttgcacgccctgggcacttagtgacccttacataatttctcaggtgaagacaagactactttgagttttttagtgatttttaaatctatgatatgttaatctcgtgaactagcaaataattagtgaaattagggtaaaaatatcactggctgtctccatggatgcaataaaatgcaaacatttaattgatagaaaggatttataacagtagaatttcaatatagtagacactacatatattgtggcctatcatcgtctacgaccaaaatttatttatggtaaaacttttatactctattcatatagagttagcgatttaaaaagtcaaaaataagctagataagaaaaattcaaaatcaacttaaaatgaagttttaaattcaaaatttgccggtgaaagataagccaaccagcgaatgacggagctgctaacattctcatgccccatcgggtgccctaatcagccaaagataaaaccaaaaatagctaatcatgtccccatcgaatgccctcaaccttaatttcgagattgatttcaaaatattttcaatatagttcctttctcagtattggcttttaaatcaccaagaaacacgtatataaaatttttacctataaattatttttttctctaataaaccaaaacggttttgtagtgaatatggcaacccatgggctttcaaacattctacattctgtcagcctagtttggtttcaacctaaaaaagaaagcctgatctgatcggtgacagtcggagccacatgaaaacaacctcgccaccaccaccggcgcagcgcgcagtgtcgttcacgtgctgttgcttcttcaatgccgttgctgaataatcttgcgcctgccgcgaggtcactgacatgtcggtggtgatcagctcatcagtgccctctgcccatcactgaaagtctgaaaaaactcatccataaaagcagagccacttcaccagaattcaaagctaaatttatatattaatttagagtattaaatatagactacttacaaaactaattatataaatgaaagctaatttatgagataaattttttaagcctaattaatacataattagagaatgtttactgtagcatcacataggctaattatggattaattagactcaatagattcgtctcacgaattactccaaaattatggatgggttttattaatagtcaacgtttaatatttataattagtgtccaaacatctgatgtgatagagacttgtccaatctaaacagtgtctaagtaccctgacattaccaacgttcatctccacggcactgcgcccccaggccccagccaccgccggccgccgccggagatgtcgccgacgaccacgtccgcggcggcgttggcccccatcgccggagcaatggagcatccagttctacggtccccgacacttgttcctcgtcaatggcaagagtccaaaacctaccgcacctctagactccagggggcccaccacccgctactgccatctgggacccacatccgcggatgtgggcccacgtaagcagtttccatttgcgacggacacggtccatggaccgggagacactggcatgtggggcccactagggctggtccacgtgagccgcatgcgccacgtatcacgcgaaaaaaaacaaaaaaaaaggaaaaaaagaagagggaatttgaggttccttgcttggttgcctcctccattaaagacaacaaaagcaacgccattagcacacacctccactccactccactctcccaccactctcgcttcccgaggcgcgcaaaccctagcctcgtcgcgccgcgccgcatcctcctcctccccccgcctgagtagcgccgccgcatgcggctgcgcgaggcgcggcgaagcgactgacggggggtgatccgccgctttcgggggctgatcgaggcgggaggaggagcggcggcgccggggaatgcccgacctctcaggcgatctccttcgtggtttttggtaataataaacaggtttgttcatctctcgttttacatttttctttctctccgtgacgcgcgtttttttttttgctgttcctcttttggtggtttacctggtaatagagctaagctacagtaggataaaggaccatactgtttagagattccttttgccaatttttaaattttttcatcggtattttgtttgaaggaaaacctttttttttttccttcttttagttttggctgtattttttaccagatgatgatattattcatattgatctttgattttgttgtttcacccttttttagcagcttgcagtattggttacagtgagataatatttgttcagcctgttctagtagatcttaactcatgcttgatcctttagcaaagtggtataaatttttagtttcatttcaaaatcaatctgttctaaagaaaatgcagctattaaaatgcatacggagtacacacagactagccgtttacagtacgctatattgtagtgtagactgtagagtataatcgttctgaagagccatttaatgtcatcggccgccctaatttaataaggttccgtaaatgcgtgctccatgagaggcttgtgaggtgggcaactccagtatcacaaagaaattgtgggcactgccgggaccagtagtggatgactagggtagtgagtgattttactcagtcagtagtgcagtcctgtactcctgtagttgttgtactcttgactctcccaaaccatcaaattgatgtctagtgtcatgcatacttgtaacttgtaagtgcacttccctgacagttccattctttggaagattctgtggtgtggcaattcggatattgctgaagatgaaggcgcttgagctcgcgtgtttgcttcttatcattgtaccacaagtggttcttggaacacatgatgtgtacattgttacaatggaaggcgaacctgttgtcagctacagaggtggagttgaaggattccctgcaaccgccatagatttggatgaagatatggaaattaccaggtagtttactattgatgatgttttttcaccatgccttcgaacatttattttgtgttggctgactcttggtgaatttgtggagtctatgttgggttgcatggcatattggacttgttagttcttattgttgaattgcatttcacatgtcttgttgcacttggagcttgctactgaggaagtgcacctcctaaatgtttcttgaaatggattccattttcttcccattatgatatatcatatatgtagtgtgtgaggtttgagctgttaagagtcttccaacatgttaagaatatctgctcgaaagccttcattagaaaaaaaaaaggtcaccactgttactgtctttcagctctctgatattgaaattgattatccccccattaagtttttaatcacagcttgcttgtatttgtggagttgtggtggaaacatgacaattttgtatatgttccaatttactgatttcagtgaggctgtgacttcatactcactccacctacgaaggtaccatgacaagcttctagactcacttttggtagaaggaacttatgagaagctttatagctaccatcatcttattaatggttttgcagtacacatgtcacccttacaggtatttagcatttttatatcttttcttctttcctggtttaagattattatcttggctgaacacagcaatctttcactgtgttaggctgaattcctaaggaaagccccaggagtaaagcatgtggagagagatatgaagatacagaaattgacgacacacactccacaatttcttggattgccaacaggggtatggccaacgggtggtggcttcgatagagctggtgaagatgttgtgattggctttgtggattcaggaatttacccccaacatccaagcttctctgcccacaaaactgatccttatgggcctgttcctcattacaaggggaaatgtgagatggatccagtaacaagaagaagcttttgtaatgggaagatagttggtgcccagcattttgcaaaagctgcaattgctgctggagcgtttaatcctgatgtcgattttgcat

SEQ ID NO: 82398 - DNA, 8034 bp, Oryza sativa
atcatttttttcccaaaaccttgcaaactttgcataacatatcaaacggctaactggtttatgatataagaggccttactatatgtaaggatatgctttatttaaatggtaccttggttgcagtacagaaaaatatacttttctaaatttgtcaaactccaattcttcacaggtatgcatgggcgcatggcatcagttggccattgacattgcaaggtaaacgtccatattggatctagtattattatttttttttgaacgaatcatatttgatctattatgaaatttaacaatgtggctcctaatcagaatttgatatcttgtaatgctacagtaactgtacagtcaaacaactattgccttggaatatccatctttctcagcttagcaaagattctaatctgttccatatttttcaaagatgtgttagaagatctaaacttgtggccgctaacttgtagtttgtaaactttttaccactcatcacttgtccgttgtgacagatgagaccagtctgcaataagacagtggattgaacaatggaatatggaggcccttactcatctgaggcctgtgacagatgagacccgaaatctccatgtacagtggatgccggaatatcaggtactaacaaaataatccctcttctgaaaccactgaaccatcatttaatatcatggtattgctgtgacacaagagcagtcactgctgtagtcctgtgccccctcactaaaccgctcttcactttgacgtgcaaattctggtgcagtcgtggatagataatgagaaccttatactactcttatcttgcacacaagaattatgctcaaatacctacaactgagttcttttgtgtagaacttttccaaactggattgggcatttaggcaaattatgtgctgctgaccttctctctagccatgtccttagtagatggaatactgcagctacaaaaaaatatgagttccattatatgtacgacccagttgtataactcatgtacaattagagacgtgcaactatatatcaattaaacaagagcatgtccatatgcactgcagccgtttaccgtcggttgatcaaattcagtcgtacatgagttggacagtcggaacgtatgctaccaaaaatatattgtgggaggctgggagcctaggaaatgaagtctaggacgatatcacatttgcatgaagtctccacctggttttgcattacggttcattgtatcagaaatgctagacgactttgatatctggatactcaagggcctcatcttttcgcttatgtttatgtttatcagccaaaatttgaatttttaaccttaatttgaagctgattttgagtcttttttattgaagtttatttttcagcctttggttttagatcgctaagaacacatatataaatgttttattcctaaattactttttgtttacaaatatgtcgttttgtttattccgctaataagcgaaacgatggctccaatagaagagaaaccgtaaaaacgtccacagaaatcctcactgtggcagtgcttgtggctcagttgctgcaatggagcggccatagcgccctgtcagtccacagaaatcctcactgtggcagtgcttgtggctcagttgctgcaatggagcggccatagcgccgtcagtgccaatgtatctttgacggtgagctcagagaaggaggacggttcacggtcgtgtttttggcgcgaaaaaataagtgggagggatggataaggctggtattggtaccacctactgttaaaatggggcaggtttttttgtttgtgcaggtatgcagttggaggctttcatgcgttaattgtttttagctcttgtgtttatcccatggtcctgccggcacaggatttggttaaaaattattgaactcagctgatgcttgctagtactggttgcatgcgccaggagatttcaccggagcaagcataccccagctcaattaaaaccggtgccagtacctttggtaccgtccatggttgcatgggtcatcaaatcctgggatccgaaacaaatctctacaataatttcccggccgttgcatctcatgctttgctgcccgatgcatccaaagccagcccaccctcttgcctagtagctcctgcaactctgtcgctcccagccttttttgactccatgtctgcctggctgagcctgaggtcaaagaattttccattggtactactagctcgatacacataaaatgagtaataaactgtggaacaaaaatggtatagtacgagtaggcagagaggagggtccgaatacgattttgtgtacaggtgtatactatgctgtgcggctacttctttcgatgtctcttttcccgtgcgtgtcgaagcatggcgaactggcacagtgcaggagcagcggctgcaatcccttttacccttgcttcccctgcggctcggttcagatctttctggcacatggcccatgttgcctctgccgctctgccacttcattggaaatgctaccccgaaaatacgctcgtccagtcgtcgtctctacgtgtatgtatgtctttttttctttttgcatgcccttctctactccactttgattaattacctgcacttgtcagctgaacctaaggtccttagactcctactgtacccagtggcgaacccagaacaaaagttaccgggggtccaatacatactaattatctaattattgactaatatattaattaatatagtgtaatttatataggatttgaataatctacccggtgtcctgtgacaccgggtagtataacctaggcacgcccctgactgtacccgttggctggttgcactagctgaaccagtcttgcatcaaagatcaaactagacaagtcacatgattaccgacatgattaggattgtgtacctacatttatgtgatggttaaggttggccaaggaacgaatgggggcggccttgtaccaccgaagtgccgagtccgtagaagaaagtagggaagctatcccgataaagtttgtttggaaaacatgcacatacctcgggcagaacgcgaccaatggtaaagctagacctgcattgcaatagaaacaccgggtaaaaaccacagcagttaatcgcagtcaccgaaatgacagcggtggaaagaggttacgacaagaggctgaggtagggggagagtaaaggaaacaaggggaaaaggttaaaagttggcgagagagaaaagggtttggttgtctcgaagaaattccagaaacggcccaaacttggctcatctcgtaatcaccaataatgcaatcgcttcgctgagcccactgccaagacatcttgtcctgtccacaacgacgccaatcgaggaggagagattgcatcacatcgctcgctgccttggcgtcccccttgtaccgccatctgtgtgggcgtggctgcgtccccgtctccctcctgtccggccctacccaccacctccggcgttctctgccttgttactgttaccgtgtctcctgtgtcatgcattgcaatttgcaatgcaacacgcccgtatcacctgcatcgtttggtggaggggcaagagcagcatgggcattgctgcgccttctgccgttctgcaccacaggtttctcgcgctccaggtactatctgaagctcacggtaaaaatttgaatccccttcctcacacttctaaggacttgtttagtttccatggaaaaaatttccgccatgtcatattgaacgtttagacacatatatggagtattaaatatagataaaaaaaattacacagattgtgtgtaaattgcgagatgaatactttaaatctaattgctccatgatttgacaatgtgatgctacagtaaacatttgctaatgaagaattaattaggcttaataaattcatctcgcagtttacaggcggaatctataatttgttttgttattagtctatgtttaatacttcaaatgtgtatccgtatatctgatgtgatatgccaaaactttcactcttggatctaaacacagcctaactttgtctcaagataagtgcatctgtttagttcaaaaatacattcattttagggcggagggagtgccggtagaatgcatttgtagactgtactaatattacccaaaaaaaaaagtagttgtatgttttttttcatggtgatcgatcgaagcacagtgtagctaaccaactatctccaaatctgtcgtagcgcaatttgttcgtatgtacaatcgtcgtcgatacgtacgtagctttcatggaatcagctagcatccgcccgtctccaggcctacatgcatacttgcagctttgatgatatgagcaccacactgacactgcaagagacgaggcgagctatgatgcatggaggattggaggcaagttgcgggagcgtgacgacacgtactcgcctctcctcgctggctaactgactagctcagccccagctcgatcgttcgttgtatccaccaaaaagtcttgggctttccactctcatgcatgccaccactccgtactacaccgtccgcttaaatcatgtgtttcttgcatttcttgtatgcacgattgcattgcacgcacgcccaatcgattccgctgaaaacggtgggaacctgctgctacgcccgcgcattcacggccgcggccaccatcgagacgatcgatcatcgaatgccccatgcttacgccactatagatcacttcatccccggcaatgtcgccggccggttgccatgatagcgcttatttgtgtgtctatggtggcgcatcgcgtgctgccttttggtctcgccggttttgtgcttcaattccatccctttcgatcgcgtgctatcttttagctaagctacatggatccgcctttgacgccgtccctcgtcgatcctgacaagggcttgtaccgtgtgtacggtttggatgcacgtactgtccaaattaacgatgcaatatgggaaggtgtattccgatacggtgcatgatggtgtacgtccagtattatagccttcttagtttttttttcccagaaaacgtcacatcgaaattttggatacatgcatgtagcaatatagataaaattaaaaactaattgcacagtttgtatgaaaatcacgagacaaatcttttgagcctaattagcccatgattagccataagtgctacagtaacttacatgtgctaatgatgatttaattaggcttaataaattcgtctcgcggtttccatgcgagttactacctccgtcccaaaataagtgcagtcgtggggaaccgtgtccgacgtttgaccattcgtcttatttgaaaaatttatgaaaaatttgaaaaaaaaattagtcacacataatgtactattcatgttttatcatctaataacaataaaaatactaatcataaaaaatttcaaataagacgaacggtcaaaagttgaacataaacagtgtaaaattgcacttattttgggacggagagagtatgaaattagttttttcattcgtgtccaaaaaccccttctaacatccggtcaaacattcgatgtgatacctaaaaattttcttttcacgaacaaaacaaatcctatatatatattcggttgcgatgatatatagagggagcaaatctgcacagtagctagcacgaggatggagtccaataaccgggcgggcgcggcatacgggtacaatgtgtgaagaagacagcggtgggcagtggccatccgatgcctccgacgaaaaatacgaaaccctgcatgcaggatgtggtccggtagccgatcgatgtggatcgttagttgtgtgtgtgtgtgtgtccgtggtacgcatgcacgtccatgtgctgacatgcatgcgtagagaccgttcagtccatggaccgaccacctagctacgatctacatactgtacggtacttcgattcgatcggcgccatgcatcatgcataatgcagccacaatacacatgcacatttcttatgatattttagtttctgattacatgattacatcgaacctgccagtatactacagtgcacaactgtgaatacacctccttaacatgaacttaatcggtatagtagttctaaatctcccaaagatatccgtactacagctcacaaaattacgtatgcaaagcgttcatggtccaatacgtcaagaaaattacatgggccgggtaggggtgaaaatgcgcccagccacattatttcgggacaaattcgggatccgggatatttcacggatattgggtccgaatacgggtattttatggcagatatgggatcggattcgaaaatgtagtatcctaaggatatggttatccggtaaaaaaatcgggtatatattacccggataaatatacagatattatctatattatgtttttgtgaggcactttttagtattatgtattggttctactatgatgtattgtaccctatttatttcctatgttcctaatgcctaatataatcgtattatgtatatatggaattgttaaatggttattgtctatgtgatatataagattgttccttcgacttgatatccgaataaatattcgtaatcgatagtgtacgtatctattttggtacgtattcattccgtatttttacccgacattatccgagtttatatccgtattcggcattatccgtgtccgacccgattcgtcacgcaatttacacgcaatctgtgtaattattatttttatatatttaatacttgacgcatatgttcaaatattcgatgtgatatggtgaaaattttttgcgtgagaactaaacagagcctaagataatcaacagtacgggtaaagacattaatgtaactgaactgaccttaattaatgcagcagatgcgctgacagcactgttacttatctgttcccggactactgctaaagggttgacacagcagtgatgatacgggattagtaattaaataatcaatcatgtgtcaacaggtatatataaaacgggaataatcaatcatgtgtcaacagcactgttactctactacttgctcgctaacaccgtcgctaatcagttgcaaggagtcgagctcgcaaggcggccgggaggaggaggaggtccaggccccacggtggctgccgctgtcgccgtgccggacaaatctgcaaatctgccgcgcgcgcgccaccaccctcctctacggcttcaataattcactctcacttgctcaaatcttcatcctcgttacctggcctaccaaaccttacaagagacagccatttcttctccatccaatcgtctcctctccctcattctacctcaacctctctgctagctcctcacctctacaacaacacattaattgacatagacagcagcagctcgtcgtctgcttcaattgggagcaggaggaggagaggagaggagcgagggggttgctgttgcagctgctgccccaggggctcattactcgccagcgcagttattgctaccactgtagtataccttgccactaccaccaccaccttcctcttgtaatggagaggatgcagctgcaagggcccatcggctcgctggtaagcttccctggccggggacggggacggccactgcactgctgctactagtagctagtagtaattgagcaaccatgtagcttccattcctagtctctgcactgcagcacatgtaatgcgatgcgatgcaattcggctgtattaattgcattctgctgcttcttcttcttcttcttgcagctgctaggttgcaacatctagccctgtccgcgctcgcacgcaccattcaatgcattctcgcatgcaacctgctgcagctgcttgcattgtgctgtcttcttcttcttgcatttgcatccatctcttttatggcgttgccgctgtttctgtttcttgctaacgtgctcaactctgccggttcatggcgatggcgcggcggtgcgggtgctaatggaacagtgggcggcggcggcggcggcggaccacgcggccgccagcgccggcgctggtcagatgccgtttctcgcgctgctccacggcgccatggaagcagacggcggc

SEQ ID NO: 82399 - DNA, 1004 bp, Oryza sativa
ttaaccgtttgcgcacttccagcgttctatacttctattgcagtgctctgttgtgcaatggatttcctggcagttcatatctgatatcttggcagtcagaaactcctctcatcgtccactagcttatcagctacaagcctacaaccaaaattttaattttaaaaattaattttagagttgttttcttttctcgtcataacatattttccagcattagctttcgaaccgctactaacaacaatataaaagttttactaaactatttgggttcctcgttcattttcctaatagcttatcagtcgtagcttcaaactgaaaaaacaccctcctaaaaccgtgctggtggtttaacatcatacaagatcccaacagtgtgaaatgcaaacctctgtctgctttttaccactcggtgtgtacagtgccatacgcgggcacacgaaaaacattcagaaaaggcgacaggttctttctttgcggttgcaggaaaagaggccacaactacttgcacaagggaagcgaagaaggacaggcgaataccagaagcaaaggtttgcacataaagccaggccccaatttgtagcagatgggccaagttttcaccgtgtttttcacctcttttcagctgggggacacgggcaaggcaaacaaagcaaatggaccattttccccatggcccaggcttcagtccagtgcactccagggctctaggccatccgttttgagatattttcaggcctgaattttccctctcaaaaaccagaaacacccagatggacacaccccggcacagtactctcaccgacgaaaggactgtcttttcccttatacttatcagccaaaatttaaattttcaactttaaatttaaatctgattttgaggttttttcatcgaaatttatttttcaacctttacttgtaagtcgctaacaacacgtatataaatgttttattcagaaattatttttcgtttgcaaatataccgttttgcttattccgcgaataag

SEQ ID NO: 82400 - DNA, 3096 bp, Oryza sativa
caacttttagaccctccactttgtcagattgcagcaaaactgatgctgcctcctgcatcatacgtcaacatcagattcttcactcatacagacaccatagaaatgtacttatgtaagaaataattcaaatgcaagtaaaatatacaatatactacatatctgatgcatatatatgataccaaagttcaaacgaatactataaatcacttatcacttaaatattcactccatcaacaaagcgaacaatctatctgtttgtattctacttgcattatcctgtataaaatattaggatagtgaataaaaccatttgcatgtccaaaatactgtacaagaatggcatttgtatgaatgcaagatgaagaatgcaacaaaaccatgttgcaatgcgcaacaggctcctttgttacattataatgccagcaaaagttgaaaaccacaaggcacattactgaaagttctaatatgtcagacacactgaccaaacagtttgtactattatacaattgaagcacttattacacatttgtcgaattcagcatatactggattaatgtgtcatctagatcatctgcataataaacctttcaccaatattatataggataaccactcagaaactctatggaccaaacaaatagcataaccatatccatcaaaagtgcaaccagagctaaatagacaaggagactgtcactcaggaaatagaaaacagaagctcgtaagtgcgacatagctacgagtaaagaagtaaccatgcataagcaaataaaactgtgattttgctggccaacatcaaaagtgcacactaggcgtagtaaacaatgccataaataaactcagcctagcagattgatgacatcatggaaaaattaatacaaaaggaaggatagtaaataaggaatacgatagcaattggcaaaaacacatgaacattcaatttcagatggcaaaatattgcagtaataactgggaatggtcttattagcacgacgaaacacaatgcaccagtacaactactacgagatttgattacataatggattcgatcaccccctaaataccagaatggctaattcagtgtactaagaaacatacgacagacatcttttgcatagcactacattcgatgaaacaatcgaaagtttcataaactatcactacaataattaatgctagtaaaatccaaccaatagatggtaactaatgcaactgcaacatgtttaacgcatcctagcagcatgaagtacaacaatattaactgaaaaactacacgaggcacaataatcgaagctggatgaactgcaacagcacgagtatatgaaaatccacgcaacatcacatgaccgagctgacacgttagataatagacgcaatatacacacccaaagtatctgtattcccccaaactccatcactagcaaattactcataatcaggactatcaacgacttcccaagccttagaaatcgttcgatccgacgagatttgaccatgagagaactcctaaaatggcataaatccgcaccactccagatgccgaccagagagaaaccgaaacctgcagagggtgaggagatcaggggaggaggagggatcggggagttgctcaccttgcgatgggcggattggatttggggacgtcggcggcggcggcgggatcgacccgacgagggttcgcgaagcgtggggaaatttgcttgcggcggctggattgtggaagaggggggaggaggatggttaggtaggggtgggttatatagctaggttggctagggcttccattccgtgttggggttggattcgaattctgtgagaggggggaggatctgttgggcctgaaaataggccggaccagggcttagtttggtggattcccacggcctgttttgcaagagaagagaagaggaatggaagtttaaagaagggagttgatggtgtgattgatcatgggagtaaacatttttagtacacatctcttgtttggttttcgcatctaattccctcacagtctcatgaattaacatgtcttccttagataagagattggtaggagtcggacgccttgattctctatcctaaaccctctcgaattctcaagtcctccaaccaaactaaactttttaagctcggttggcatgttcgttgtggtgcgaatggccggtcgcgagttcgactcgcgggacctcacctcgacgggttttttctcgtctttctttaggactgtccttcgggtagtcttgactagaaataacggtacacatatacacacgcgtgagtgttcagtgggactgtatgtttcctgtgcaccgaagcctaatgcctctaatctcaatcttagcgtgtgttagggacgcgcacgcgtgtgtgtgcgtgtgttgttgtggcgtgtgtgagtgtacactctgagttgtatcctctgtcaccaactccctcaaaccaaaccgacccctattattttgggctgtaataaggtccttcacagtacgtctagctctcgtgtgaacttttgatgcgccatctcggatatcggcggcggcgatcggccacgagggttcgcgaagcgtggtgaatcctgtggcgagcggtggtggttaaatctctctctagaagaagactcgaagcgggctgtatctgggctggtatggggtgaacttttttaattgggccgtaattattttacacacctgtacatgtgggccgagagcgcgggagtccgccagaaaaattatgccgtctcgaactcccgacgtcgccggagacgaagacgaatacgacggcgagtcggcgacgtcgacacgagatggagcccaatttctcccgagaaaacggcgcgagaaacgaggggaatctcctcctctcgtgatgcatcgcacacaacaattaacgccgctctagcaacctgggagtactcctatcaacacaaacacacaacagcaagatggagctagctaaagatgctctttgcatgcaacgatgcaagcaagaagaacactactcctgtagagtggtagtagcggcagctatacacgcctatacaagcgaatttttttaaaaaataatacgattttaatagaaaatcgcaaaaatataggt

SEQ ID NO: 82401 - DNA, 754 bp, Oryza sativa
atatatatatatatatatatatatatatatatatatatatatatatatatatatatatatatatatatatatatatatattgacccaaaaacagtgagggagacccccactgtaaatatatatattaaagaaaatatatacaagagaagcaacaaaaagagaatgaaatatattttgcaagcaaatgaccacaatcaattaatgcattttttcacaactacaaagatatgctcaaatgcaatgtgcctcattcaattcctttctaaggactaccaatctataattttcatgtggtagggttttgatttgggatctcttcactctaggctttgacactagtttcttttgagtacatctcagaatatcataaccattttgtcaaaattatcagtttgatgcaactttagctaactatttccaaggtccacatgcaagacactcataatagtgaaaattctagtaaaatcgtccactacgatgttgtttggtgaaatgtctgtctaaagttgtagcaaaattctaattttgactaaatagttgttgttttgtgaaactcttcttttgaagattgaacaatatatatacataaaacctactaaaataatactattataaaatacctttcgagacaatccacgtgtaggattttcatgtatttgaactacgtatttaagatgtcttatgagggcataatcgtcttagatatgaccatgcctatgtttacatattaattaactaaaggcacatgcgttct

SEQ ID NO: 82402 - DNA, 1779 bp, Oryza sativa
tcatcagcaattaacaggtagaccgtcgcgtccatctgcactgccacctgcacggcagccggctcgatcttgtgctaacagaacagggcctttgtccaccacggatagatacatctttgccactgcagctgcactgcacatcgcagttcacacgcacgaacgaacaagatcgtccttgtgtttctcttctctgcaccccccccccccttggtactgatgtggcacgcgtaccaagagacaaaaccaccagcagtagcagccatccattaatacgccttgacccactcccctggatgtctctctcgccaccgtttgcattcgccaatctccaccaccacatcatcttcttcctcctccacctcttacctcgtcgtcctgagcgctcctggttgcagttgccttctcctgacaactcctcttcgccttggctaagttagctagctcatcatcacactctgcatacgtgcttgtcaactccattgagagcgtcgccgttgatggctgagccgccggcgaccaaggtgtaccacgatggctgccccggctgcgccatggagcagaggaaggaggagcacaagggcattccctacagggagttcctcttcgttgccatcaccaccctcgcctcctgtatgaattgaacacacatatacatgcagagtcaacttagtttgatgtttatcataatctcctctgggtcttatcttattctactggtttttaattagtagccttgtctgtctctccccttaaattttcagctctgccaatctcttccttgttccccttcctgtacttcatggtaagtttagtttccatgcattccatctaatttcatgaaaaatatattttttacaaaaggtactcgatccattctcttctctagagcagataagagacttgcatgttgctcggacagaggaagatattggattctatgctggatttcttggtataacatttctgaaaaataatttgtcactgagtaacaaattattttgaacacttcttcacaactacgtcaaaaatgcagtaacgtttacatgatatatttctgctgcaggcgcatcatatatgatcggtcgtggtttcgcatcgatcttgtggggtatggtggcagatcgtattggccgtaagcctgtcattatcttttccatttttgcagtgtaagcactatggtacctttcctaaaatattgacaggaatgtatccatggcatatggcatttactttgtagtctgttccatctgctaaacaatttttaacctgtctttgaatctatacttccagcattgtgctcaatactttgtttggattaagtgtgaagtactggatggctgttaccacaagatttcttcttggtgctctgaatggattgcttgcaccaataaaggtacctttttaggagacattaagatactttgaaatgtgaaagaagtttgttggggacaaatgaaggatgtggtgtcaatatcgattggtattcttattccatcaaacatttactcaattattttttctattacttatggctgcaggcgtactctatcgaagtttgccgagctgaacatcaacctttgggcctatcaattgtaaattacaaatctataaatagcaaattgcatctatatatacgatgtaagaactctgtttcatccatgtcatctaaattttaggtgagcacagcatgggggataggtcttgtagttggcccagcaactgggggatacctcgcacaggtaatattacattatattattcgggttcatagatacattt

SEQ ID NO: 82403 - DNA, 656 bp, Oryza sativa
ccatccataagccctatcaaccatcaccgtgccttcgcctctgacacaagctcgaaaacagtagttccgaggggtgtgtggatcaaatggacattccttatggtggtcgccaacatgtgctagtctttgtggatcatttttcaagttcggatgcatgcatatttaattatttaccaaaaaaaattctgagctgttcttgcatgcttgtctacatcgatccacagctgcaattgctgacacatttatcggggtctctactccttgtctattgactgtgtaggctgcggtgcaaaaggaatatccagataaaatggttgtgactgtgactcggtgcctgttcagcacgatgcagtcgtttgtcgtcgcggtggtcgcagagcgcgacttctccagatggaagctaagattcgacattagcttgctcgccatcctatactcggtaagttgtgcacataaaattttcaatcatcctcttccactagtgtattcactattggcatgttcttcggcacacgcatctgactattagacgactggtggtttgcttcagggtgttatggtgacgggagtgtcctactacctgcaaacgtggtgcctaaagatgagaggccccatgttcttcgcctcctggacgccactctgcttcgtgttcacaa

SEQ ID NO: 82404 - DNA, 729 bp, Oryza sativa
gtttgtttcctgacttgtatatcaaggaaacaacttaagacttagtcggtcacgactgtatttaatctgtatctgtgtattccgttagggatatagattatcttttgtaacccggactccttcctatatataaggggggtccgggcgcctctaggggcagttgttggattttctccaaatcatacaatcaataacacactcggcggattcatccccggacaggagtagggtattacttcttttataagaaggcctgaacctgtataaatcctttgtctccaaacccatacactttcctagcttgatagccaccccttttattattgccgaaatctagtttcgacggccctgttccaccgaatcttctttctcaaaccccaaccaaacaagagtaagccatgtgtagtcggaggggccggatttcagctgaggggaactctgagccagaaatacttctcaatgcccttcaagacttcaaacaaaggatggcatgcgaactggttttatgttcagaatcctgagcctgctcttcccgaatactcttgtcttcccccggtgtaccaagatacttggaactctcttccaatcggagatgaagctgcccaagccttggaattgttggatcgcatgttaaaactcaaaaaacaaggcttgcaaggagagcagatcactcggcatttcatcaaatgccgactagcgccaattaaagaaagatcccgtacagctttt

SEQ ID NO: 82405 - DNA, 10441 bp, Oryza sativa
  unsure (1)..(10441): unsure at all n locations
tcctcctttcgtcttcctcccgttccggccttgtgcagagaatctcaactgagatatgttcagcatatgtttgctccaacatcacatcaaataccaagccacaatcaagcaggagtacaagtatgcacttgagatctctcgatttagatttagatgggtagtggagtctgccgatcgaagggtttctgcctggtggtgctgaatgggtgggtgcatatgcgtctagcatttcgcatccatggacgacaatacgggtaagtaaaatatacagcgtggtctgtttttaggatggtttggtgtcattgcatgcctagcatcatctcctttctcaacgcagagatccagcttattcctggcctgttacttaagaatggggcatcgcttggctatcttctgcagcaccgccgctggagcgacttctgccaggcagccctatgaatagctcagtttcgacatccatgttgtcgttggtggtgttgatgttacggtccgggttctcatttcggcccggacagtcaaaggagcagacaagggaggctgattcttacactgcacaaagttcatgatcaagggaagcaaatcaggtaagatgatctttcagtgccccagaaaatttccggcatttatattggtgtgcacataagatatcgcacgaataagttcaaataatcatatgctaggctgggcgatcgacttaagctggctgctggtgtcttctcggcagtaaaagtttcactcgtcttaccttttcgcgtaactcttcattgtccttgcgcagcttcatctcctggtcgatgttaatgcaaaaaagagacaaacacgacattaggaacagatgattggtcctgcgtttcaggttatatatatatttatttatttatagtaagtacgaagttggtgaggtaccttctctctcagtttggcaacctgctcctcaagcagctttgtctagtatgcagagaattggttgtaagtttgtgcacatcatatatatagataaattaattgctgataacgtagactgaaatggaaaatttattagccaaccttccttcccctgatgctaatgaggcttctctccagcttgacctccaggctatgcagttcttcaatagaacattcatccaacttttcacccagcagttttctgcatatcaacaaattaaacacgatgataacagcctattttttgacagctacaaggacggcacttctgtaattcagctgaagggggtaccttttgtaagtttcaagagcttcaaagttttttttgcccaaaccatcaaggggtaagcttttacctttgttacaattcagacaaccaaacaatctattgaaaattgtccagctacaataaaacgactagaagcacattttatttcagaacacattttttcattgcttgtttagtgctcatgttctttatttatttctcaccaaaacattcctaccataatctcgaagactatgcacatccttggtgaattgaaaactgattcttaaaagtctagaatacatctgattttctttgtcttaaaaatagtactgtccctgcttcagtgcagggatcttatatatgcttatttatacataaccataatctactgtttttttattaaaaaaaatacaatctatcagatatagggcatcttcaaataaaatttgaaaacagagttccccaaaataactaacttaatatacatttcgttttacctcaatatacaacgaaatctattgatggagcagcattgacactgccaacggaaattatacgcacacatatgacataaattatactaaaatcagtctatcagcaataacactatggtacaaggatgaccaagtttgtcaacaagaattatatacctctatatcttgctgtactgtcttgttgccgatattttcctttgtatacgtcctatagcgttcaattgttttctgcgtactgaagtaaagagaaaagcagcaagattatgtcagaatagtgttagaattctgtttcaattacaaaagcacaaaacgttagatatatctcaattaaatatccaattagcttcataaattgttaattaagaaaaagaacgcggtcaaaggttgacttctttctgcaactagagaggtttttcgcctttcgatcttctgatgctacataaggagaaaagatcaatcttttagatcatgaaaagatcaatctaactatacatgtttgatctctgtcatattgatatcttaagccagaacaccccacatatgtatcaagaaaactcatgaagttggaagggcatttacactagtactatcaagaaaacataggagtgtttgttggattgttgcatacttttcgagtcactgtgtgacctatatccaatataaattgccggatgataaactacagacatatatagataggtagatattgttcaaaagaaaaaaaaatagatatactagctacagataaaggtagtcctccaacatcttcctgacttaaatgcagaataaaatttagggcttatctgctaaaaacaccagaagaatttataaaaggtataactgttccagaacttctagtagtttcattctgcggtctcaaactttgcccaagcttatcattgaatggtctttattatccacagcctaataatcaaattaatgtggtaactggtacaaatggaatcgtgcgaatgaaataatcatatatacagctgctgaacaaaacaatatcacattgttgctcatttttttgataaacctaggagaacattttgataaaatttgaggaaaaccatgaaataataactaaaattaacagacatatgatacaaaattcaagacagaaacttgcgtttatttgatttgaactaatcatcagacattttcaacagttgcctttttagaacttggtaatggagtcttgaaaatgaaaaggagttatggttaactaagtgtatttgctgctgctgttaaagtcatgtaaccagttaaaactggggtgcttttctggtggcnnaccgtattcttcccaggcgatgccaatataaagagttattaaataacaagtcaacttcgccataagatgtgctaattaatactccctccggactaataatattagttgttttgaataagggtaaaatcaaactttaaaatcttttactataaataaattataaaatatttatcttaaaaatatggaaatcatatgtatagattagtcttaaaaagtacttcaataaaatcatatgtttgctgatatttctatatatattataatagaaaatagttggtcnnaaagttacttttttgggagaaaccgtgctcttgtccaaaacaataagtattatcaatccggagggagtatactttatcaacaaaataaattgcagaaagaaattctccattcatctaaaacctgatgcacggtaacataagatcaattagccacatgcatatgcacttgtcgggacccatttaaaataaataatctatgaaatcctttggctggatggaagtagaatacaccaacacctaacaacttctttagtaagagtaaagaaataaatatagagtaaattatagtatatcaactgtgacccatgatggcagcctcccgctactaaaattctttatgaagccaaagaaggcttctcacaattctagtgtatcgaacttgctatttgtctaagtagcttcacttataagttgttttccaaagggctcgtgtgtattgatgaacgtcttatgaaaatttcttcagatggaaatggttgattttaccaaaaatgatgtggcttaagtatataaagaatctagaaaacatggtaaaaacgtcatttcagaaaagctttgtagaggcaagtcactcttggaggttagaatcattggtaaacataaataagttgtaggaattttctcccatgtatccatcctctatgagaaggtcaaggaaaacgtccatattcaaccactcaacttggccttgatctgaattttgaccttcgactataaaattgctcagttttgtacctcgtaataaagctatccctaagcccaaaccaggttttttttatgacacggtgaagtaattggtggtatgatttggatgccacaaagcatctactccatcctttccatattgtaagccattttagtttgtccaaaatcaaattttaaccaggtttatagaaggatgcaccaacatccataatatttcatggtggatttaatgaatgtgatttgatgttatagaagttgttacattttttatgaatttggtcaaagttaaaagaagtttaacataggacaaaactaaaatgactgataacatagaattaagtagtagctatcaaactaaaataaataagatacataagagagaaaggtggtgagcatgacaagtgggtcccaatattttctacatttctttgttgtttattgttgatttgtgtggtgaacaactcttttcacaagtaggtaggggtggcattttccccattggaaacagggcctcggtgggtccccacccctacagggccggggacagggccaaatcttcacccgtgggtgttactgagtagggccctgactttgagcggtgttagggccgaggtgacatcttcactcgtggagccctgaagtttaagaaatagtcacctcatgtatgtatttctagccatcaaaagcccataaggccaaaaatagaatataaaaggacaaaaaaacaataatccacctgcacaattcgatgctcccatcggctgcatgatttgtgcgatcgcttcaatgctctgcgcatgcaacgagtcacgcacgtcgcccatgcgtcgactttatcccgcccgccgctatcaccggagtcccacaccatcttgtccacaggtgccccacaccttcttcctcatcttgtggtcggccaccggcgcccactccattcctctccctcttcggtcgcctcccgacgttgtctcttctctccatacgattgctttatttggttgaaggtggcacttgtcgttcttccctccttccaaccgtcggcaacttccgcttgcttaggggatgttgggacttggctgaagtgcgaggccctataggggccggggtttcggccagggactaatttcaacctgttctttctttcggggtcgggaccgggtgaacctgcaagcgaacagggatgggagtttttgtccaacacgaaccgacccaaccccgttgccatgttggatccatctcaccacatcaatggaaccatgttgatgaaccatttttaaagttgcgggatcagtaattaattgctttatagttaaaaggacaaaaattagatcaacgcaatagttgaagggctaaatttggactttaattgtaggataaccaccatttatatacccattgtcattatgatatagtatttattctcgtctcgaagcatcatcttaacgagataaatggtatatttgacttgagtctaatgtatacacatttttcgaccactaaaataggcttattgcaaattacattttgaatatacacaagaagcatgctaagtcaaattacacctttttctcactttgagtcaaagggccaaccaaagaactacaacatatttgacacgtacttgggtttatatcttacattggtgggtctactctcacaatggttcaactgatgcacatgtatatcaactgtgagttcaattcatccttcttgggtcaagggtgaaaaatagatatacatacgagtggtaaaggctattattttatgacttgtacaatggtattgtagtagcggcaaagtcgtgtagtgtggggttgttagcttgtgaagacatttattgcatcttggaaaacattgaaacaaaacatttatcactaagcattccaagtggtatggaaaaatttaattacttgccacttttgcaattgttcctatatgtttgcttctaatgagaatagttcttaaccttgtgccacttttcccactatgggtattccaacatggaagattgacattaaaagttcattttgctccagccccttcccccaaggtctggtacccgtggaagtcactgccgcaaccaccagatgctatggagctgtcgctggggaccctatgtgagccatggttctttgcgacgacagtgaaggtggcgggagctcagtagaaccattgatgatgttggggccgatggtggacttggagggtcaattggatagagaagggcatgtggcgaaagcttccaccaagaaggtcgatggggatcatcgtccttgccagggacgtcagcaacagatggtgagagggccttgaagaagagtagactagttgtggcggcgggaggcaacaaccctccttctcttcctcttctttcgcctcctttgcttccacaactcgtagcatggtttcacgtgggaggatactgttgctagccattgagttcttaggcacgactatcttttgtaattcgatttgttgccgtgtggcgaggggctatgatagtgggcagtggttgtggggtgttgcatcaaaaggaaggaggaggccgcgcgtgcttgcccgatgttacgggggttgcgaggtggcataggtggatggtgaggtgcatagcgaccaataagcaaatggataacatggtggctcacccgagatagagttcatcgacaaggacttacatcaacagcatagtggtgagctcctctacatccaactacaagcatctaatttcatgagggtggagtttgtcgacgaggactacatcaacggccacggtggtcagctccgctacatgcaaatgcagatctaaggccaaggacagccatggacatccttaatcgtttcttccttttgatcggggcaaaattgggatctcacatcaacaatccatatgatgccaatgtgttacacatagtggcatagtatttagaaatcttctctccaacggcaaacacaggacgacgggttataagagcacaaatagttaaacttcctaatggtatgagcttaccacttccatgttataaatgtcttttgttgatacaaacattataaatacttggctttttatgaatcaatgtaaaatgcatcgtaacccattaaaccatgcattgaccatgttgtgtttttgtccttccccctttatctatgtgagatcaaaagaacggtgggggaatattctaaaaccaggtctatgaagctaacttctcgttataggatccaaatcctgtcacaaatataccaaaccgagtagataattagctagctaccaatttacatggtgatcacacaaggttagttcaactaaacttccgtcattcattgtggtccaaggctcaaagccacaattacaccatagcgtatgacgtctattattgattccttgcatagaaacttagtagttatggatatatgggttttttcatatccacaaatcttatgttttaagaaatccgcatcatgcactgattgatgttgtataatgaattaaggtatggttggaactttgatgtgatcaagttggaacaatatatactaattttacatctagatttccaatttataggtacatggtaaagatgaattagttttttttttgtgtgtttgaatccttctctttcaccaatttataagtatgttttttttacatacaaattacaattatatgacgaaatcagaacttaatttttctctaggttgattgttctactgtttaagcctatatacataaaaagaaatacatttgcttgtttttgtctgaatgatataagatatatgtatataaacctatattttaaacagaatagctagttacatgataattttgatgataggtgatttagcaaccaagttttataaccttcagtagagaactataacaagggattagtatgagaaatatatatttcaactaagtaggaattaacatcaatgatgaatctaagcataacctggctatatagttggccataaggcccgaggcctgaaggcccggcccacggcacgcctttttggcccggcccaagcacggcacggcccgacttgggtcgggcccatgccggcccggcccgaccgtcgggcccgtgccggcccggcccgaccgtcgggccgtgcctgggcctccccaccagcacgctgggctggcccggcacggttgggccggcccggcacgatgggctggcaggccagacccggtacacaaagtatagggactaaaaatagacatataaatgtcaatgtctaaagaatagggaccttaaatagacttattttagctatttatataccacatcacaaagaagagggaggtaaaataccctttttttagctatacaatgtcacagcccaataggagggagaaactttagacttattctgaagaaaagcacgatggcccatcgtgccttcgggccggcccggcaagacccgaggcgtgttgggccgtgcttgggctgtgagtgcggcacgtgggctggcacggcacggcccggtgcgtcggtcgggccgtgccggcccgacaagcctcggcccaggcacggccgggcttgggccgtgccgtgccgggcggcccacatggccatctatacctggctatgatgggagttgcaccaggcaactagtaacacagaaagaccatgaaacgcgcgagagtagagttgtagatagtggtgaagggagacaatatttaacatgcatgattttgggggaagagataagaaaggaaagatcaacacaaaaatttgtcggactttgggactagtgtagtttggattagaaaagatgagaagattatcttttgagattcaaattacatgcaaaagaacataacatattactagaaaaacaacaatttcaaactatttcttatgcatcaatgctaacacatctttcattctaatattaaattctttaatcaacctatgcacatattatgttatgcaaattctcaattttccttactcagaatcgctcaaatgattttaccataaattagcaacgatctatactaaccaatttaccttgatgatatatatgcttttgggtgtaacatatctgaagtaagaaactaaaggatttgttttttttaccttgatttctattttatccttgatcacattagtgttggagtaatagccattagaatattttttttgcacatctcttggtttatgggtattaaataacataatttttttgatcaataattagttatccttgagcaatatacgacataaagtaaggttctagcaagggtatggtgtgttggtattgagccaagcataaaaactcttgcattatagccaattgtgggttaattcatattcacaaagtcagacaatagccggactttggttgaaagacaatgcacctacaaatgggctagatagatcttggaagctaatgtgcacctttcctcttcctaaatggcagttaattatatataataattgtcatattttctatctaatactaggtaccatatataatctaatatgaatctcaaaggaggttgactgcataggttcaagtacaaataaataactcaacctagccaaggtctatgaaaaacaagagtacaactttactgtctttgggagggtatggcctcatatgggtgaagctaactcaaataactatggaaataaagcaaattttataattttaaattaataagcatgcaccacaatagcgaattttaacttttttaatgcaaatactgtgtaattaacataacaactaaaaataatgaggcaaatattttatagagaaaaaaaaaacaatttacatcgatagttacattttttttttgctaagtgcttaagacaaacatcacatgctacatatcaataaaatagcaaaaatgtggtagctattttgtgtatcgagcatgttctctcattgacccaagatctccattttgagctaagtagtgatgctgtcaaaataagtgcactccatatgagaaaatagagaagatagacataatagtataattaaagcatctaaaagtaccattgccaaaatacacccattttacaaagatatgtccacaaataaccacaacggcagccaaactggagacaaaataacaaagattttcaattctagatttatcttagcactaatatgttttttttttaaaaaaagaatgactattcttaattacactgtattcttttatgatgataaaacaactattgttggtatatcaaaaagaccaaggacaaatgccatagaaaacgataaatatgttatcaagcaatttatcttcaattaccatgcccaataaagatgagactacatcaagacatgcaaaagaacatgaattaagtagttttattacaattgtggtcacaattgttaacatatttagcatgctaagtagttttcttacatgaattaaatagttctcacaattgtggtcacaattctaaaaaaaaaggggcaacaa

SEQ ID NO: 82406 - DNA, 707 bp, Oryza sativa
catacgaatttagtaccaattatttttttaaaaaaaactaagcatttaaaaaactactatgcccaaagttttagaagtttgattaaacctagtcttaaaggttaaatatttgttacttcctccgttacatacatacatacatacatacatacaaaatatgaaacggaggaagtactgccttaccggagggagtacataatagcattaggggtgcgcattcggtctaaccaaaaatttcggtctcgatcttcggtcttttgattttttcggtctttgaaaagtgaagaacaaatttcagcgcaaaaatgttaggaccgacaaattcggtctttgtcttttcggtctcggtcctaaccgaaattcaacaacattttcatatatgcaaagaaataatggaaattttcaacacaaaaatcacaaaaaaaaagttcgtaagcacttatgagtaaagactcttattaggttgcatgcctagaagaagtagggatgtgaaaattagagtttaatcctattaaacatagtggattgtaggttgcatttagacatttttgataattcggtctattcggttacccgaggaaactaaccgaattgaccgaacaaaattcggtcttttactgcctagggccgaatttctcgatctcggtctttttgatctcggtctccgtctttttctacccaccccttaatagcatgctgcatgcgtc

SEQ ID NO: 82407 - DNA, 2454 bp, Oryza sativa
caaacggcccaaataaatcccagaagacggcagatcgctctccccagtccccaaccaattcggcattcgcgagcgacggcaagccgacgccagcagcgtgaagtataagcggcaacggtgcaaaatcattcatccagaccttggcgtgttctgcacctcgcatgcactgttttcttttctatcctattttctttgccttctcttgccgatcgagcatatccttattttttcctgttggatctataagggaagagcacatatgttggatgcatagatgtccagtgattttggtggtttgggaattgtgatgtatctttttttcacggtaattcaatttattctttaattagttacttgactgattaaccccctataattgggcatgcagacggctgtcggccggcggcagttctgttatttttttttaatcggaactaaaaataaactttaatctgataaaaagttttaaatctttagtcccggtttataagagaaccgagactattgtaaaatttgacggaccgatcaaagatcgtttctctagtagtggctctcaacccagcggccagtggcactactatctgctgaatgtattgcatgttttgatcggcgaaaagatgtactgatactctccattcagaatttagtttgctgctacagcatcaaatatatattttctagtgattttgtttgtgaatttgtcagtggcagatacttctcatggtgatactcatgtcctaatgtattatgattttttctgagatctagtgtgttctgtgattcatatctaagcaaccccataccaattaatatctttaaaaatagcatatactatatttatactaactaaaaatagataaaaattagtacataccgcaactaacctaaaatgtggagtagtatatactgctactttataaaagcatatactgctattaacttaaaaattagtatataatgctacaaagttaaaagcagtacataccactactactattgtaaaaatatgacatataatgctactggtagaattcagtatatactactactactactaagttaaaaattaaacagtatgtaccactactactctataaaatagtatatactgctagtaactaaataaacagtatatactgcatgctactaacatttaaaaaaaagtatatactgctactaagttaaaaatagtatatatatacctactacattacaaaatagtatatactactattaacttaagaaaaggtatatactgtactaactcttcaaaggagaagaattcagtacatactctttcggagaagtaatcagcataactgattaagaaaaaagtatatgctgctctaattaagtaaaacgagtacaatttatgctgctactacttaaaaaaaaggtatatacttaaaatatttataaccctttttttaatcagtttgaatggtagaagatccatctgtttagaggatggtacgttcattattcaaatttaaactaacagcacactccctacgttcaattgtgcaccaaatgcggtctgtacctgtgcatgcatgcaccatgcagcgattagagaaaaacaatattttcattctcttcccaccagtttaattagatgctaatggttatccactaaggggagagagtatgtactcccgggagtacataacaatgatcctataaattaaaatggttctatactaccgtccatagaaggcagccccgatgaagagcgctattggattcacatgtggacccgttttgatttctattcgagaaaaaaaaaatccgtagtacgacataactatcccacattaatcggtataccggagtgttcctgacgcataaatacctctctctcaaaccatcctattggtaaatcgggtcctcggtgagagcacgatctaccggcggtgatccggacggatcaatggcaccggccgattttacggcgacatcggtgtccatccgatactaggttttccttttttttttaatttcacgatcttgtttgatttgatttcagatgcatcaagcaagagagagagatgggttgttacatacctttgtagaagagctgcagggagcaagatgagggagccaactgcctggcgatagaagacgaagatgtagatgttcatcccgtggttgaaagcagccttggatatcacaaacatgccagtgtagatcagttggacgacgatggcgacaaaataaggcttcatacttgctttcaccatcttgatcgatctagcaatggcaggcgtgcgtggtgtttgtgcgagtgcgttgtcttcagtgtgcagagtgtgtgttgtctacagtgtacgagagcgcccgtttagtttctctccatcaacctggcactatttctatatatttatataaaaaagaagcagtcagtatgccaagtgtaaacgcaagagcacggaggtactgtagctttgattttgg

SEQ ID NO: 82408 - DNA, 15946 bp, Oryza sativa
cggcagcggcgcacaccaaccgtggaggcgatgaacccaatcggcagcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtagacggaggcaccaatcggcggcgacggaggcaggccggcggtgaagtcgtagacgcccaacagcggcggcataataggccagccgtgtaggcggaggcaccagtcggcggcgacggagacaggccggcggtgaagtcgtagacgcccaacagcggcggcataataggccagccgtgtaggcggaggcaccactcggcggcgacggcggcaggccggcggtgaagtcgtagacgcccaacagcggcggcataataggccagccgtgtaggcgaggacaccagtcggcggcgacggagtgaataggccagccgtgtaggcggaggcaccactcggcggcgacggaggcaggccggcggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgatttcggcaataataaaacggggtagcgcacgagacctaaaagtggatggatgtggagacaaaggatttagacaggttcaggccctctcaatgagaggtaataccctactcctgtttggggatttgaatccgccgggtgtagtatagatctaacgatcatatgtgctcatgccccctagagggcctcctgcccaccttatataggatggggggcaggattacaagatagaaaccttaaccaacacggtatcggcttcctaaatctactttacaatattatcaaatcaggactttaggccgctccataatataaaaggaaacgtaatacccaagtcatgatctgttacatattccatacatatatgttatcccctattactagtcggataaccatgccgtgtgggtatggggtacccataatctccacaaattctacctacctacctgctgctgcctatctcttcaaatgcatcagggtttgtgcagacgatctcgagcagcaaagatgcacgtatgccttgcaattctgaatatatttatactgtactgatctagatggattctgaaaaatactactatactggtgtacgtggcgtacgtcgtggaccggatgtgtgttaagatgacaaggcattacttaatcctagataattagtagtatacgtgtgtcgctgaagttgtcctgatccaggcttggaatttggaatagtcctgccagaaaaatatggctgtgtttagatctaaagtctttagtatttttccatcacatcaacctatcatatacacataacttttcagtcatatcatcttcaatttcaactaaatttaaactttgcactgaactaaatacagtctatattatcaatctcgatcatgagaacaaaaggcactagttttcttcctcagtttgacaagctgcatatactcctttctttaagagaaatcctcagtgtgatagcgttttaaccgacatgaacaatcagtagaatctcctagaatactcttaccatggtcagaattaagatcctcagagattaaattttcttagcctatggtgctgtttagttcacaccaaacttctctctaactctcaactttcgatcacatcacatcacatccaaaactttcctacacacataaactcctaactttttttctaaactaccaactttacctaaacttctctccaatttcagaaactaaacacagcctataattaacacgcatgcatgcttcagttatcaaatcatcattcatctcgatagaacatctaccttctccctctgtttcacaatgtaagtcattttagtattttttttcacatttatattggtgttaatgaatctaaacaatatcaatataaatgtgaaaaatgttagaataatttgtatcgtgaaacgcaggaagtaattagtactaacaattaaatcaaggtacgcacgctacgttgctgcttaatactcatccaaatctatcggcgaaaatgacaccgatcgatcatggagaggggatagccaccagctgctagctgtccatcatcacaaacagctatagcattggatcacttgtactcctatcctatctagtagactagtactatcgtgtcctgtcgaaactagatttcggcaataataaaaggggtggctatcaagctaggaaagtgtatgggtttggagacaaaggatttatacaggttcaggccttcttataaaagaagtaataccctactcctgtccggggatgaatccgccgagtgtgttattgattgtatgatttggagaaaatccaacaactgcccctagaggcgcctggaccccccttatatataggaaggagtccgggttacaaaagataatctatatccctaacggaatacacagatacagattaaatacagtcgtgaccgactaagtcttaagttgtttccttgatatacaagtcaggaaacaaacccaggatacacataagatattctatctatattcggtatcctatattcagtccaaatatcatcgccgtgtagatatgggatatccataatctccacagtagcccccgagacctttgcagtcaatcatcgtagccttctcaaagataataatccgagtgcttcaaacttttcatgccaaggcctgccgagtagcgaagacaaagactgtaaagggcgaaaagataaaaatatggtgcatcgaatagatgcacctaattaggtgtagcccccaactatgtgattagttaacaaactaaacatatagttgagaaatcaaataatagcacaattgtgcatcatatgacaaaagcacacacggcgcctaaataggcatgctagccgactgctttttagccataatgaaaagagtccgagtggtttacactctaaaaggttcacgaatgaacacactggacaggcatccgaatataaaactctaaagattacccaccaagtattataaaaattatggtaatgaataagtctaatagcctaggctatgactatttaccataatgaaaataggtatataacataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaatgattttatcagcattgggcaacactattgtgcgcataatattgccaaagcaaaatatgcctaagtccctaaggaacacaatgggccacgctgttaaaagtattgggctgaagtactgttcaggcctaggcccatttgcacctccgatacccttaacaagaaatcccgagatccaagcgacgcttcgtcttccccgccggaactctcgccattttccccactccttgctacagtgcagaactgcgccggcgaactagggttcaccactccactcaaatccaccttcgaaaagtgcatcaaaatccttcccgtgatccaccgccttaatccctcatttctccctagccatccctcgaatcaaatcagcgcattcggataaaatcgatggcggaagagaaggaaagcttcgaaggccaatgggcgccgtccgacgtaacggaagagaacctgaaggagatggtggcgcacggcgttctcccagccaaggagatcatcgggtggcggccacgcgttcggtaaggcttttccaccctgatacacatgagatcgtagtcttctcgcatttcttctatggcggcttcgctcttccgacctcgaaattcttccgcgggatattaagcttttatggaatcagcttgcatcacctaaacccgaattccatagtccacattgccaatttcatccatgtctgtgaagccttcttaggaattaaaccccacttcgccctttggagattatggatatcccatatctacacggcgatgatatttggactgaatataggataccgaatatagatagaatatcttatgtgtatcctgggtttgtttcctgacttgtatatcaaggaaacaacttaagacttagtcggtcacgactgtatttaatctgtatctgtgtattccgttagggatatagattatcttttgtaacccggactccttcctatatataaggggggtccgggcgcctctaggggcagttgttggattttctccaaatcatacaatcaataacacactcggcggattcatccccggacaggagtagggtattacttcttttataagaaggcctgaacctgtataaatcctttgtctccaaacccatacactttcctagcttgatagccaccctcttttattattgccgaaatctagtttcgacagttggcgcgccaggtaggggtagcgtcaagcttttcgccgatcagtgcaatgggttccatctccggcatcgacggcctcgtcttcccacccgggcagacgtttcggttcggcagcctcgacttcgtcaccaacaacttcggcaagatttctctcctcgactcggaatcagaccagtcgggagagaaccggatttcggtcccgtttggattcccgaacgcggctgaaagctacttcaagaccatctcaaccgagtcggcttcaaaccactcggccgagatcgcatcttctccaacgataccagatcaagatgatggggcttacccactagtcctgatgaagctccccgacgatttagcggccgtctccaccacgacagcgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgacattgtggagtacgacgaatttagttctcgctacaacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggcgtgagcagcaggaccgtgagcggaccgcgaaggaggctgaggatcgacgtcagcgagctttggaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcaatccgaccacgtcgtcaacatcttgaaccagacgaagaccatgattgcggcttcggtcccagttaactccgaaagcgtccacacgccgactggcagccgagttccccacttccgatctcatgactaccgtcatccaagcctcagcatcaccggcgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccggaccgccacgacgacgaccttgacggagtagcagccttcaccgacgacctgcgtcgagtggattggccagccggcttcaagccgactggaatagagaagtacgacggcaccactaaccccgaatcgtggcttaccgtctacggtctcgcgatccgcgcagcaggaggagacagcaaggccatggcgaactatttaccagtggctttagcggattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccggagaatcccttcgagattacatccggcgattttctgaacaacgtaacaagatctccgacatcaccgacgacgtcatcatcgccgcgttcaccaaaggaattcgccacgaagaactagtcggcaagtttgggcgtaagcctcccaggacagtcaagcttatgtttgaaaaagccaacgagtacgccaaagctgaagacgccgtcaccgcatcaaagcagtcgggcctcagttggaagcaaaacaagggtacgccggctacgggaggtggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactgcacggaagaactctgacgaagaacaaagcacgtcgaggaagaaagacgacggcgacgccccggcaggatttcaagaccaccgcaaggagctcaaccatatcttcggcggccccttagcttatgagtctaaacggaagcagaagttgactgaacgagagatcaatgctgttcaacccgacacgccccagtatcttcgatggtcagaaatcgcaattaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaaaaccttggatgatatgcagattcctcgctccgagttaaaaccaagcaatgcgccttttcacggagtaattccaggattatccgcaactccactcggccagatcaccctcccggtcactttcggcactcgggaaaacattcgcacagagaatatcagctttgaagtcgccgatttcgagacagcataccatgccatactcggacgcccggcgttagccaagttcatggccgtcccgcactacacttacatgatgatgaagatgcctggtccccgaggagtgctatccctacggagtgacatcaagcaagccgtcacatgcgacaaggagagttgcgacatggctcaaacccgcgagatggcgtctgcccgagaggatatccgactggctgcagccacggcgagcgaaggagaaatacctgctaccaagacttcaaaaagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattataccgacctcaacaagtcttgtcccaaagatccttttgggttgcctcgcattgaccaggtagttgactcaaccgccggctgtgagcttctcagttttctggattgctactcggggtatcatcagatccgactgaaggaatctgactgcttgaagacttcattcatcacgccctttggagcttattgctatgtcaccatgccgttcggactaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaaccttcgtgagcatccgtgctttcaggatgaaattgaaccctgaaaaatgcaccttcggagtaccgtcagggaagctgcttggttttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctgctgaagaaaacagataacttccagtggggacccgaagcacaaaaggccttcgaagatttcaagaaacttctcaccgagccaccagtcttagcctcatcacacccgcaggagccgttgttgctatacgtatcagccacctcccaggttgtgagcacagtcttggtcgttgagcgcgaggaagaaggccatgtccaaaaagtccagcggccgatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaacggacgtattgctaagtgggctttggagttgatgtctttggacatatcattcaagccccgaatttcaattaagtcccaagcgttagctgattttgtcgccgaatggaccgagtgccaggaggatacccccgcggagaacatggagcactggaccatgcattttgacggatccaaacgactttcgggcactggagcaggagtggttttgatttccccaactggagaaagattgagctacgtgctttggatacatttttcggcgtcccacaacgtcgccgagtatgaggccctccttcatggactgcggattgcaatttccctagggataaagcgtctaatagttcgaggcgattcacagctggttgtcaaccaagttatgaaagagtggtcctgccttgacgacaacatgatggcgtatcgacaagaggtacgcaaattggaagataagttcgatggactcgagctcagtcatgttcttcgacataataatgaagccgccgatagacttgccaactttggatccaagcgcgaggtggcgccctctgatgttttcgttgaacacctttatacgccgacagtacctcacaaagataccactcaagttgcgggcactcatgacgtcgctatggttgaaaccgactggcgagaacccctcatacgatttttgacttctcaagaactccctcaagacaaagatgaagccgagcggatttcaaggcagagcaaactttatgttatgcatgaatctgagttatacaagaaaagcccttcaggaattctgcaacgctgcgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaattgtgcgcacatgtgaaggttgccaatttttcgccagacaaattcacttaccagctcaagagttgcaaactatcccgctgtcttggccgtttgcggtttgggggctcgacatggttggcccgtttaaaaaggcagtcggcggttacacgcatctctttgtggccattgataaattttccaagtggattgaagctaaaccggttgtcacaatcacagcagataatgctcgagacttcttcatcaacattgtgcatagatttggagtgcccaatcggataatcactgataatggcacacaattcactggcggagtttttaaagacttttgtgaggactttggaattaagatttgctacgcctcagtggcacaccccatgagcaatggacaggtggagcgagctaatggcatgatacttcaagggattaaagcgcgtgtctttgaccggctaaaaccctatgccggcaaatgggtgcaacaactgccatcggtactttggtctttgcgaactacacccagtcgggccacaggccagtcaccttttttccttgtctatggggcagaggcaatgttgccgagtgaagtcgaatttgagtctttgcgctttcgtaatttccgtgaagaacgctacgaagaagaccgagtggatgacttgcaccgattggaagaagcccgcgaagcagctttgattcggtcggctcgatatttacaagggttgcggcgctatcataatcgcaatgttcgatctcgtgcctttttagtcggtgacctagttttgaggaaaattcaaactacacgagatcggcacaagttatctcctgtcacgcccagaaattcacgaaccagaatttctaagctgaatgtgtattaaacccctgtccaggaccagccagggtacacaaacgacaattgttgacatacagacccacgccttacaaaaatataaaagattacaaatgcagcggaaaagatacaagcgagctaagcctgaagacttgactcctgcagcgggcgactccattccacaggcaaaccttgacggcagcgacgaaaccaacctctccgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgccacaggcccaaaccaccacctgaactaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggaccctttgtataaccccctctaaccgatcgcaccacaccttagggtttgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactcaagcccagccgttgcccacgctggcttgtggtaagtacgataaattcttccagggcatcccgcgaaccggtccttaatcgccatgggcacgtctagcaaaaccatgcacccacagcccaccatgaagtgtattttaattaaccaacaccattgcggtggcactaatccaaagctattgccaataatcaaagtctatgctttaatgtgatccccttttgtgcactagttgaactaagcatggctaagcatctcctaaaccaacatctagtcattttaatacccaagttatcaatggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatgaggccacagcaacgtcttcgagaaaccgcgaatcgacgaaacgggcgaaatctacgcgacaaacaaagcacacaagcaaaacatgctataagactactgaaacagataacaaagccatttttaatggattctacacatttttatgaatttactgagacttgaatggacttaatcggagctcggatgaattagttatgaattttagaagattcactgtgtttttactaataaagaaaaagtccttaattaattattgcgcaatattgccccagggctgacgtcagcaaggggtggggcggcgccgacatgcgggacccgcgggtcagtgactcaaggagagagaggggtggctggcaagcgggccccaccgagcggcggctcaagagagagagggaggggcgccggcacgtgggccccactggcagtggcacaaggcgggaggggcgcggctggtggctcggctcggcctcaaagccggcaggccaagcatggcgagcgacggcggcacgcgcggtcgccggcgacggcaaccggcggcgcggacggcgacggcagacggcgcgaaaagcggcggcggcggccgaagacgacgatgcgcgcgcggaggacggcgacgcacacggaagagagggaaagggggaggagggggagtttttcaccgaggttggccggcgcgagtggagaccacggcgaacgacgacgacgagcgacgggaggacgacggcgacgggcgaacgatctccgggacctcctagggaacaagatgggagggattagagggagaggggtggttaacggcgagtggattcgccggtcgaaggcggcggccatgggggtactcaccggcgcgcgaggaggagcaagctccggcggcgggattgaccggggaaacggcggacggggtggcgcacaagcttgcgaacccggcggcgtcgacggcgcggtgcggcgacggctctagcggcggcgagcggcgaccggaggagtggaaaaggcggcggcggcgggtgtagcggtgcgggagtgatggagggctcgggagggctcggccgagaaaggaaaaagagagaggaaggtgcgggcgtgcttaaataggagggggggcggcgagtcgtggccgggaacggcgcaatttcgccggagtagtggaggaggtggaggagaagagagagagaggcgggattcaaatttgaatcccggccatctcgcgggcgcggggtgagcgggagtggggcgtgggcgcggggagtgcggggcgcgcgggggagtgggcaacgtggcccggggcggcagggagcgcggggcggctcggcggttgccggcttggggagcggcggcgggaggttagggacgaccgacaggtgggccccacctgtcggcgcccgggaggagaggggaggtgggatggacttcggggaggggagggagaagcgggctggcgcgggaagaaaatgggccgggcccaagaaaaagaaaaaaggagggaaaagaaaagaaaaaaggaaaaaggattttccagggatttaatattgcactttgcttattttaattggttaaaattatttccaaggctctgaaaattccactaaaaatcctgttagcgtattttgacatgcagaatccaagaaaaattccacatgccgattccgattattatttgcatttattactttagggtttctctctaggttaaattaaacaatttcttcggacgatttattttatgaatttagagcaagggaggggtacttcagggcgtgacaaacctaccccccttaaacggaatctcgaccccgagattcggaagagctggcgaagaggtgcggatgggcggccttcaattcatcttctctttcccaggtggcctcttcctctgagtggtggctccattgaactttgcaaaacctgatcaccttgcttctggtccttctctcactggtctcaaggatacgaactggcttctccacgtaggtcaaatcttcttggatgtcaatgtgctctgagctagcttgttcctcaggtaccctcaaacacttcttcaattgagatacatgaaacacatcgtggataccaaccatattagatgggagctctagctggtaagcgacttcacctctgcgttccaagatcctgtatggtcccacaaagcgtggtgccaacttgcctttggtttggaagcggtgtactccccgaagcggagtgacacgaaggtacacataatcccctgcttcaaaagtaagctctcttcggcggttatcagcataactcttttgccgagactgggcgattcgcagtctttccctgacggtcctaactttctcctctgcttcagttaacacttctgtcccaaacagttggcgctcacctgtttgatcccagaagagtggcgtacgacacttccggccatacaatgcttcaaacggtgccatttgcaaactggcctgataactgttgttgtaagagaattccgcataagacagacttttatcccaggctccgccaaagtcaagcgcacaggctctcaacatatcttccaagatttgatttactcgctcggtctgaccatctgtttgcggatgataagccgtgctgaaattcaaacgagtccccaattcttcttgcagtttctgccagaattttgaagtgaattggcttcctcgatcagatacaatcttcttaggtaccccatgcaaacacatgattcttgaaagataaagctctgccaaccttttcccagtataggtagtgtgtactggaataaaatgagcaactttggtgagtcgatccacgaccacccagattgaatcgtgccccgacgatgttctgggcaaacctgttatgaaatccattccgatttcttcccatttccattccgggatctgaaggggttgtagcagtcctgcgggcctctgatgttctgctttgacttgctgacaaacatcgcagagtgcgacgaattcggctatctctcttctcatgctgacccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccattctcatcctcatggaaatctcgagcttttccaaccctcatattctttttcagctcagctatttcaggatcatttacttgagctgctctgacttgatccacgagcgtagtgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagccaaccacgccggcagatgcataattaatgcaaggggg

SEQ ID NO: 82409 - DNA, 4637 bp, Oryza sativa
attcctgcaccccataattaagaaaatattcttttttagattttgcttactaacagattgaaaagaaatctatatatgagataaactttcaagtaaaatttaaaactttctatcgaaaaattaagggatttgctagatgtctattagattaatgggtaggccaaattaaatcccaataataccatattggaaatttagtgctatgggtaataataccatattgaaaatttaagtgaagagatcttaatttaaatatggagctagtggagaatctctgttcaccggttgagatggtggatggacagccacactcgtgcacagagctgtgtattaactcgggttaatcgcacggattgaattctccgaatgtaactctcacatgtgctacaaatcctctgcgattaatcgcgtggatgctctccctctcttgttctgtatcggaagatgattaattctggtgtattaactcgggttaatcgcgcggattgaattctccgaacataactctcgcatgcgctacaaatcttccgcgattaatcgcattaacccgggttaatcgtgcagattgaattctccgaatgtaactctcgcatgcgctacaaatcctccgctaacggggttaatcgcgcgaattgaattctccgaacgtaattctcgcatgaggtacaaatcctccatgattaatcgcattatattctagtgtattaacttgggttaatcgtgtggattgaattctccgaacgtaactctcgcatgcgctacaaatcctccgcgattaatcgcattaactcgggttaatcgtgcggattgaattctccgaaagtaactctcgcatgctctacaaatcctccgctaacggggttaattgcgcggattgaattctccaaacgtaactctcgcatgcgctacaaatcctccgcgattaatcgcattaactcgggttaatcgtgcggattgaattctccgaatttaactctcgcatgcgctacaaatcctttgctaacgggatgaacagacacaacgctcgcacttatgttcttcctctctcgcactttctttccggctgttctcctatttcggaactccgtctgcttacgtacttgcacgggtaggcaggcaatcaagtctttggggagcgtctcggtgcaactgctcatgttctgcttcgacttcttcctctacatcgcgatggcttccactggaaatggcgcaccaggagctggagggaacggcgatgctccaggagacaacactaacggaggcaatacaaatgactcaacctccttgcaccgttttctgggtatatggttctatctctaattgatgttcttcatgttacttatatattaatcatgctatccttaggattgcaatcctaggtgaatgttgatgatgcttatgcttatgttatgaaaaacatgcccatatttctatttagtcacaccactagattattactattgtgaatgttatgtttattattgtgttattttagattaaaatataccgaattatgatcaaatttacaaaatgccagcctgagggatcgacatctcagcgagcgagattggtgaattgaaaagtggggacgaagctgatcatggacgtcggcggcaggtagaggcgccgctgctggagaagaagggcagcaccggcatcggcgatgggtactgcactgagaggtgcccgggtgcggcgtcgatcggcgtaaggccgcgagctccggcatcccctacaggagcttcctctttgtctggatcatcacgctctgcacaggtaaccaccacttcattcttctctcttccactcacccacatgcatcatcaatcgcgcgcatctgcacctgattcgcttccccctcctcttaattgatgtccacatttttatcgagttatatcatgagtttgtgtttaatttctcctatatatgttctccattgatcatgccaccttggagtgctatatagaagtatatacatactgatgcagccccttcaattaatcaaaatctttaaattaacaattactactaattttatgaattgctttgagattcgtgcacctcaaccaactattgaatttgggcatgacactaagggcttttttggagagattctgaatagcttctctcataatcagaagctctccaaacaatttagcttttcattgatattctaataagttgtagttgtataatcttaggcaataaaatagaagtcagaagctagaaaatctaacttttttatattctaaaaagactcttcaaatttaatctctggccagatctaggagcggagggagagaaggggagccgccgccgtcgccccgtccatgcggccgccgtcgcaccccctcctctggccagatctaggagtggggaaggagaggggggagccgccaccgcgtccgcgccgccgccgtcgctcccctcctccggttggattgggagggagggaggggaggggaggagagtgacgggccggtgagagagagagagagagagagttgagagggaaatgagtggtggccggtggggaggggtggaggagaagataaggaagacttaaagatatttttttgggtaggtatgatttttgcaggcggaccacataaggttccacctgcgaaaatcaatttttccaagcggaccacttaagaggtccgcctgcgaaaataaagttatttttcgcaggcagacctccacctggaggattttcgcaggcggatgacgaaaatccaccccgttttatattttcgtaggcggatcatatttggttccgagggtcatacccgctttgaaaaataaaaggccaatttcactaaaaatccttttttaagtagtggtggctattgattaattgtagcttaatcaaatacgtgaaatttctatatgttacactaaaccatgattgcaaaagatggctaaagaaatgttagtatacatgagaacattcttcaattgatcagcatacaaagtgatctactgctaactgacgaaaacgagacaacatctaattaagccactaattaaacattattacttttgaccaaggtaaaataatgagtatagtactggtttcgtttacacaaagatcgagggttgcactctacgcgtacctgtttgttaagtagttaatcatgagtgatggagaagccgggagttaatcatatttgccacacaaaatcaatatgcaattattgaattcgtacggacaagctgacgatgtagactgataaataaaatcctgtatgcatgcatgcatgcgccattttgtactccagtaatcttttgtttggcatgcatgtcagcatgtgtgcgtggttcaggcaatgtgatatatagtgaattgattggcaatgtgagagtgagttgattgaagtagcaacaacctgtcgggcctagcggccggccagcctgactgactgacgtaggagctgacgatgccattgcacattgttggtgctactgatgctcaattagattagatatcctcattaataataagctattagtagtgttttactgtttgatgataacttatttctagccgtactgggctaaaatgtatagtaatactgaaattaaggaactgctggattcaagcagcagctggttgactttggttaccagcacacaattaacctaaaatttaattaactgttggttctggccgattaattagttatcttacggttgcagcagcaatggtgttaccattaatttttttaatttctacgtaatctatcggtgggatgtacgatggattaataaacttcaactaccttttaaaaaaaaaacttcaactaaataattgttattactgtcatgtactctgacttatttttcgaggggacaggcagggagttcctacaatttaatccagtttataaggaaaaccggaccaaaaaattttacaacagcacggttaatttatgaaaaactggcgaaaaccccggcattgacatactgaacctaaaaactaagaacagcagtccgacaagggataaaactcctaaaatgaatccttcaagaaggatacgccgacagaacaacgacatcgtccgatcctaacgaatctaaggttttcatccggagaaatctcttgaagtggggtttgaaccagggctccaatagcaacgccttcaagaaggtaaacggcacccaagggtgtcgccgttgctagcatcggcaagttgagcaaggctttcgcctcggagtcccatccaaacatagcatccgcgacggaagccaccaaataccacctgcacaccgggtactgtttaagaagattgacagcaactgcagcaggtggcaattccaacttggattggtgcagctatacatgatgtaacatgggaaagtttattcgtcgctcgaggaaacactcctttaattttttatactatttgaaaaatcataaaaatattaataaaaagtatatcaataatacaatatattgataaataaaatacaagctcaaatttaactagaaatgaaaataataaattaactcagaataaaacatgtcattcatagttaaatttattttttaagttatatatattaaattgaatttacatatttgtcgagtgacacccccacatatttaatttattttattatcttttttattaaat

SEQ ID NO: 82410 - DNA, 7171 bp, Oryza sativa
attcctgcagcccctatggtagttcaaaaccgatgaagatgatgctaaacgagaaaacccgttagtgcatgattaattgaattttaattattacaaacttaaaaataatctttttatattttggagtaacttctatatagcaaaaactatatgcattcttaataatcacaaaagaaaaacgaattttctaaaaaaaaaactttcgtaagttttttgcccccaaaacttttagatttgtgatcatcggatcatctcgagatctttgcatgaaggaaaaaaaatgttagaaattttcacacatgtcacgcgtaccatcctaatactaaccaatctatagttgaatgcaagatctatataagttatagcatagttatagtgcaattataatgtagttatagtacaggtacatgtaattacaatggacacaactacaccgagagtgctagctggatagtgctaaagagagacaccattctttccaaaaaaaagctactagtacactcaatatctatggttttttttcttcttagagaagtttctcttaaattactcatccgatttataatccgattacaccgttgtgttcgtaacaattaaatctttacaacaagatctcacatgattatattttgataaaaaatcacatattacttttatgatatgtctaaattacttctagatttcactaagtcacttcttagacatataaaagtaaatttagtaaagcttaaaagtagtttacatatattatagaagtaacttataacaaaaagaaagtaactttaatttagaactatatctagattcattaacatctatataaatgtgggcaatactaaaatgacttacattatgaaacagggggagtaactctctgtagtagaaataattatattgtgagtgagcttaaataagaaactatgtagagtgaattcgcaagtacagtgtagagaagatttataaagtccacaaaatatagaattaactaaaaataataataataataatcaacttagagaattatgaatgtacagaagtaatttagtcaaatatgaaagtaacttatatatattataaaagtaacttagtatataataaaagtaatttataaatataaatattttttcatcgtaatataatcatgtaagatcttgttgtgaagatttaattgtaacaaacacaatagtgtaattggattgtaaatcggataagtaatttgagagaaaactttataagaaggaagaaaaagacacacatgtctaagaggaaaaacagcgcgcacatcagcacgtgtagcagtaattcttctcacaattggatcgtcgttggttaacactaaaccgagaggcttctcggtttagattttaccaattacaatgcagttacacttcaattatactataattatatctaaaagttttttattaaaaaaatttgcggtaatttttttagatacaatcgctcgtattaggccatgcctctggtattcctttgcatttcgatcgtgtagcccaatacgacggcccaaacccaaactccaatcccagcgggcccagcaagtcagcctcacatcttcttcttcatctccctgtctctgtctctgtctctaacctaaacccacacctcgcgcgccgccgccttgctctcctcctccccgaccccgagtcctcttcgtgtgagctcgcactcgcagtcgcagcaatggcgatcaagcggaccaaggcggagaagaaggtggcgtacgacaagaagctgtgccagcttctggacgagtacaccaaggtgctcatcgccgtcgccgacaacgtgggatccaaccagctgcaggagatccgcaaggggctcaggggcgactccatcgtcctcatggggaagaacaccctcatccgccgctgcatcaaggtgcacgccgacaacaccggcaacaaggacttcctcgagctcatgcccctcctcgtcgtaagttcaccttcttcttccatgttcatacctaacctcgagtccactgtttttcctgacctgtttttcttgttgtttgtagggtaacgttggtctcatcttcaccaagggtgacctcaaggaggtccgcgaggaggtcgccaagtacaaggtataatcgatagccaagtacaaggctatcgatctctgttcaatacatacactgcaagaacataacagaacagtgttcaataaactgcaagaatagaaaacataacagaatagtgttcaataaactgcattgggttgaaggggcataatttgttctgtaagtgaaattggtggatttagtgtgctatcttaaggtgatcatgctgagttatgaaaataataataggatatgctgggttactttgaatttagctctatgttgtgccattttatccatatgcgttgtatatattctctgtgtgtggtattattagatgttctgtgagatgtgaaagtacaattttcaaccttatgtaacttttccaatgctatttatatctcaagtattccattgtttatatcatgatgtgatgccatatataatgatacatatagatatagggtttgatattagctagtattggctattgggtcatgatgttaaaagttgacttgttatggtgtgagtagctcaagtctctagctggtttatgtttttcttttcactgcaatctttttctactacaatgtagtttgtactgactgatctctgtaagaattctaactaggtcattatgtcgtgaacttgtgatgctatccaatgagtgaataaccatgatcttgtttttgttataaaacaggttggagctcctgctcgtgttggtctggttgctcctgttgatgtggttgttccccctggaaacactggtctcgatccctcccagacttctttcttccaggtgatcatttgtcgatgtgttaacatattgtttatcctcagagtcaaatacaagttctcactgttctatcttgttacaggtgcttaacatccccaccaagattaacaagggtactgtggaaattatcacccctgtagagctcattaagaagggtgacaaggttggctcctctgagtctgccctgcttgccaagcttggtatccgccccttctcatatgggctggtgatcaccaatgtgtacgacagtgggtcagtcttcagccctgaggtgctcgacctcactgaagaggacctgatggagaagtttgcatctggtgtttcgatggttgcctcagtgtccctggcaatctcatacccaactatcgcagctgcgccacacatgttcctcaatgggtacaagaatgtgctcgctgttgctgtggagaccgaatactcatacccacatgctgacaagatcaaggagtatttgaaggtaacctagtttctatttcataatttccctttttgatgtctaaatgcgtaagaattgtctgaggtagtctgataattagattgcggtactaagctgtagcatgcccatgtcttggcacaaacttatttgttctggtcttaacaatcaatcaatcaatcattgagaatttcatggtttagtaagaaactgaattatctatgatagctatttcacttagtttgatatgcctttagtgcttttagcactttcttgagactgcagtttacttttcttattcacgatgaagactcagttaaatattgattactactggaagctaagttaatgctgatttttgagaacttgggcatttcaccaccacagtttcttacatatttgtcttgcctattcttctcaggaccccagcaagtttgctgttgctgcccctgttgctgctgctgacagtggcgctgctgctgtagcttcttccaaggaggaagagaagaaggaagagcccgaggaagaatctgacggtgacctgggcatgagcctcttcgactaaagcctctgatgccatatctttgccaagtcgaaagttttgtttcagttctaaacatcaaagtctgtctataatctttagcatttcaagcttctggtagtcaagaactatctaggccttagcgtgtatccaacaatgttatctttattatgcaattcaattcagttgtgcccgtattcctctggtgtcatggtgtgtttgtgcgatgatcatctttctgttcatcctcttgtgcaattgttgctacagacgatttgaattggaatcaggttgatgctcagctcaagaactattttgatttagggaactaccagactggacttttcaccttttggtcctttgtaaaaacattatacaaatagatccttaaaaaaacttattctaagaatgaatcatttttgcggtgccaatgtcatctgcatcgtagtccaactgtccaacatgacccgttgaaaagtcactaatgtggagggagacggtaccaatatcgtttgtgccaagaacctatttgttaaaaaaataaaaaaggatccatttgtaataaaaatttacaaataagttctcggtgtcaatgacacttgtgccaaggatctatttataaatatttttttattacaaataggtccttttttattacaaatagatcttttaaaaattacaaatatattctatttgtagaatgatttttctaaaaagatcgaaaggtgaaaaatccatactaccagacgaccaaagggcgtagtgataagccatacatctctgatcattcagtcccttgcaaaaattgtcatttaagtttcgttaatgcaggttctcgtgggcacaaaaacgctagcatatgctttcttcattctaggtgaagtttgttgtctttctgaaaaaaattgcacaaattttcccagtaagatgcagacacatgcatcaagctgcagggttcaatcctgagcatcgatttttagattggacggctggtaaagcagcatgtgcttgctgcagaacccaatatataaagggaggcagccatcggttcaggttcagtaactgtgctcgagtgggcagttttgcagcagcagagcagatcgatcaaccaaggataaataccatacgactgatacgagctagcagctgaaaataaactaagatcgacgggaccggagccagaggagatcgatgggcagcggcagcgaggaggcggcgccgctgctgctgccggtggcggcggcgacggcgacggcggaggagaggtgcccggggtgcgtgcaggagcggaggaaggcgagccgcggagggcggatcccctacacggagctcttcttcgtcgccgttaccactcttgcctcatgtaatccgttcatttcagctactgcattttttttatatatatactccctccgtttcacaatgtaagttattctagcattttctacatttatattgatgctaatgaatatagacatataaatctataatcaatataaatgtgggaaatattagaaagacttaaattatgaaaaggaggaagtataagcaaatgattttaccagctgcattatccttgcacttcttattagtagttcttacatcttcatccgtctcttaaatctctcctcttttctactgcatgcgcaacactgcaatgcaccaaccatatggtagctatatattgattacagttatcatcgttgttaatgtttctgttcatgcatgttcatcaacgtgaacacatgcatacattgatacatagcactctttccagttataaacacttaaatttaagataagacgtgatcaacttttaaaattttgatcagatcatcaatagtttctcaaatgcttaatttaaaagaaaaaaaatagtgtgtgtaaatttatctggaaaggtactattataaaatcataaatctatcaaaaatttaaaacttattctaacataaatctaatggttaaaaatcaaaaaattaaccaagtcttatcttaaacatccaatatttatggcatcatttgatcatccttagccactagagagatgaagggggcatcgatcatgatgaataaacggtactacaagacggacaaaaggcaggttgcaagttgcaaacttggatctcctactcctaaataaaaggaaataaaaagtaaactaggatgcccttctggtacttgacaaaaagaaaagcataactagcacccaccaatacaaccccaacttgctctcttcttgacaaatcttgatctacatgccaaataaatatatactagtaatatattgccatattgatgcatcctaggctaactatagtatataagaccacatatttacctgttttgagatatgccaaaaacaagtatatatataatgacatggacccaatatatatatatatatatatatatatatatatatatatatatatatatatatatatatatatatatatatatatataagaggagagagaggagaacaaaggagaggatggaggaagaagacgagagaaattttgtccgaaaaatttagaatttgcattgaaagggtatgtagtggtacatcttaaacacatgttaaattatagtggcgtggttccaatttcacaaacagtaatgatatatcacaaaacaggtaaatatataatggcatgatccaattaaccctatatatataggagtacttgtggagccgcttgaattgaagctcaaacatgcatgtaaaatttgttcaggatagcaagtagtatctgtctatctgagatctgttccagcactatgcacctatgcaattatgtactatcagtatacatatcatattaatattggagatcaatagcgtaactaaccacaaacagcagcaggagcaagcacatgctttcttgtcgtgaataacaggattcttgtgtttgttcccttcatgctgcaagctgcacatctcgtttctgatttattgcttcctctgtcctttaaatattgcagctttaccaatcacgtgcctcttccccttcctctacttcatggtaagtatgtattcacttctccatctaattatttcatcatgcgtcttgagctacagtatcacctgcgtcgcacaaagacgtttacctaacttgaaggacactgctttgcatcattcctaattaatctctgaaccctggatcatttcgaatgcatgtcccagttcacacatttctccctaaccattataccttaccacttggttgcaacttggatctcatgagatattccaactgtagccttcaccgttttgctttgtatagctgg

SEQ ID NO: 82411 - DNA, 1360 bp, Oryza sativa
atcccttatattgtgggacggagggagtagtacttactagtgctaggctgctagctagtactaggatttttgatgtgaaatagtagtggagattctctcggaacagtaattttggaacaatcacgagtaaagcacctgttaggatggaacttttcgtaatactaatacgttgtgaatcgagtgagcatgatctttttataatcctcgtcgagcgcgagatctgattgtccggtacagtattttattcaaccgaacatgacaaagtgttttaacgtcgaaaagtcactagtttacctcggggtgaggtgagcagccaatcgggtggggtgtcaaagacagaaaccaaaaggcagccagtcatcagagcggtcactgcggcacacgtcgtggggcgtggttggaggttcgctcaagtcgtggtcgtcctcgtcccggttggatggactagggggtgcaatgcaaatagcgtatggttacgggcgggtaattgcaaaaaatgcggcgcacccgtgttgtggcaccaataatgttgggcttctctccccgagaagagacagccaatggggggggggggggggggggaagcggaaccaactttttcgcgggatgggaaatttcggcctcgctttccttgtttgttcggcccggatgcattaccacttctgcccctgggtgcggtggccatgatgacgataaaaaacggaaatgcaaccgcacgcactcctcctgttgccgtttgcctctgtctccccctaccgcgcggtggggtggccactacgcgaacaaagggaaacggcaacacccgcagggaccaaaaaggaaagccgaggaggagagggaggggagagaagggagagggggtcggggagaaagaagagcgagcgagcagctttggctacggccaaaccctacagcgcctccaccaccactccttgccttttttggtgagtcgccctttgccgactctcagatccccttgcgttttaccacttttgccttgtccgccgcccctccaattgggataaaaaagaaaagagctgcatctctcgctgctcctcctcctcctcctccgccgtgcaggccgcagccgctcgtgtggttggttggttcatcggcgatcgaagatggtgcgggggaagacgcagatgaagcggatagagaaccccacgagccgccaggtcaccttctccaagcgccgcaacggcctgccaagaaggccttcgagctctccgtcctctgcgacgccgaggtcgcgctcatcgtcttctccccgcgcggcaagctttaggaattcgccagcgccaggtacgcaccccccctcccccctcctcctcctgcccaatctgctcttcttcttgtc

SEQ ID NO: 82412 - DNA, 5526 bp, Oryza sativa
tggtgatcgcacgccatgaaactccaagctacaggtgtttataatattttcattatctcgattctcttgagctacgcacgcagacggagcaagttactaacactgatggggactgtggagtagtttgatcactgctgcactgtacgcaataccacgcatattgcaatcggctattctcaccacaaaataaactcaaccggtatacttatgcagaatactccggattatttttttcctttaaaaaaagatacgaacatgtaaaagaattacatatcaattatattagaagaaaacataatttttgatatactaacacaatcagcccaacagatctatgcctcgagacgagaagaaaatagaaaaaaatctgttaggagaaaagactactacaaaactctgctccaataaaacgggaaggtcgttacggagccgggctacaatcccaaaagaccacatttacgaaaattcatataatgattgtttttaacagcgggctataagtcgtatatatggttctcttcagttaaacctgaatatagaacctccgaaatcaacgtccgatgttgtgtcgatcggatgcctggagtataatcgcggtgttctattttttggacctgtaagctgattacaaaataatgttaatagtacgaaacaatgttatacttgtatatgattgtatatgattgcttcttgattaagatatgcatgatcatgctccatattaatattagtatggagtaagggcccgtttagtcccccaaaattttttcccagaaacagcacatcgaatctttagacatatgcatgaagcattaaatatagataaaaaagaaaaactaattgcacagttataggggaaatcgcgagacgaatcttttaagcctaattagtccgtgattaaccataaatgctatagtaacccacatgtgctaatgacggcttaattagtctcagaagattcgtctcgtggtttccagacgagttctgaaattagttttttcattcgtgtccgaaaactccttccgacatccggtcaaacgttcgatgtgacacccaaaacttttcttttccccaactaaacacacactaattgcttcctcgccgtctgtatagtactactcaaataatcaccgctacaatcgctgtcttgcatcattgatttgattaattagctgattccctgaagagagagaagctagatatacgtggtcttacgtaacaccgattgcgtcacccgtgccgtatactccctccgtcaaaaaaaaaaaacctgttttccgtgtccaacgtatgatcgtctgtcttatttaaaaaaattataaaaaatattaaaaagacaagtcacgtataaaatattaatcatgttttatcatctaacaacaatgaaaatacgaattataaaaaaaaattatataagacagacaatcaaagttgaacatagaaatccagagtttgcctttttttaattacagagggagtacatactacttcgtacttttttttagagagagaaactactctatgtactgtgtgtaccgtgtacgctactgtactgcggttgggatctgccgagtgatcgatctgctcatctgatccagtccagtcctacagctccttgattgttttctttgaaaggatgtgcaccttgattttttttttccccaaaacactacggacgacatagtgacatactagcacacttatctgcacgaaaacacattctcataactatgcacgttcgagaattagaccgggaatgctccatatttatttttcgaaccaacgtatttgtactaaacatccctatctttacgcatatgtgcacattcgaaaaaattgcaccagcatattttaagattagcaaaatcactacgctgcgtacttgcgtctcactgtcaaagttgttagtatcccgattcgtattctaatatcatatgtacgatactatgatcctaccaaaccgaaacaatattgatccacctagtatcttaatttttatagtaacccgatcttactattcattttcacacgatcatatgaaatcttagatagtattttgatactacgatccctacgatcacactatatgttatttaaaattaaatgaattgaaaataatataaataaatatgctcaagtttacataaaaatcaattaaatttatcaaaatcaatattacgcacgaaaaacaaaggagaaaattttgaaaaaaaagcttataatagatttgcggcttggaagtaaccctcgttgatctgtgtatgtgcgttaggcaggtcaaataaatgtagaaaaatgacttttctccttaattttaatctcaatactcatggtgatttttggcagccggcagctaaccattgatcataacaatagcaataaaaattccctccgttctaaagtagttttatttattttatttatcccaaacataccaataaaaactactccctccgtcccagaatataagaagttttagtgttggacatgcttattaagaaagtaagtagaagtgagtggtggagggttgtgattggatgagtagtggaggtaggtggaaaaatgaatggtggagggttgtgattggttgtgaagagaatgttagtggagaagttgttatattttgggacaaatcctgagagttaaaagttgttatattttaaaacagagggagtaataattaaaatactcaactttatgaaatttcgatacagttattcttttctttgtatacttccaatgcatttatatccaaatttcacaaacttcgatataataattgtttgagaaagaacttattttagaacaaatcgtaaaagggttaaaaacaaacttatttaagatgaaggtatttaggtggtgtttggatggagggactaaagtggggctaaactttagtccctctcacaaaaacataagtccctagttatatttttgtgagagggactaaatttagtctctagttatcaaacacccccttaagatggagctagtactctgcatgacggccatgtgctagtttatctctcgccacgggagtttgtgggccatatgctacgtagatgttgggccatcttcgtgggctcaggctccaccagcacgtccgctcacggcgcatgggatgcacgcggcgccgtttgttcccccacactcccgtgggccgcatactacccaggacggtggcgcgttgggccgtatcgtccccaagcccatcacggcttttgccctacatcgcctcgatcgcgtttgggcccgctagtccatgctagtatacgcgacagcgacgtgtacgtacgtctccaacgcgaatacaacacctccacgtggcgtacttgcatgtgaggcagtcttcaacgtatgtttccctgtcaaaattctaccgattcctgcggtttcctgcatcctttttgcctctaattgcgtgtgaccactagcttttcgcctatgttcccttccgtgcctccgcgtgacacgagctgtttgagcagcagtgtatatcaactgaacatcgaataaatactacttcatccgtttcataatataagttattctagcatttttcacattcatattgattatatatatatatatatatatatgtgtgtatgtgaaacggagggagtaatgatttattactaccatatatactgaatttttttgagaattaatattatttttatggaaaatcgcaaaagtagtggtcaaccggggaaaatcgcgaaaataggtccctgtcgaacgggtgcagttcgataggccgcctatcgaacggccagagcgcgactggcgacgagatcggaaggctgccgttcgacaggacctgtcgaacagcccccgttcgacaggcagggctgtcgaacagcccccgttcgacagggtcgcgttctccatttatttgtaataagttattttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtcctgatagtactaagttaatcgtaaagtgtttctcaaatagtacggacagaacataaatgactaaaagtttaatacaaatagataagtcaaggacgatcagtgcccttcgcacgcttgctaggtcctcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggatcagtgaaaaagaagtcctcaatgaatgctgtgcgaggggagtaagcaggcactccgtgatgcgtcgacgccgaaccgtactcatcgtctgtttgtacaagagggagaaaccaaaaaatatggcgtagttagtaacgatacatataattagaaactaaagcgtgttattgtttaaaatgacttacatgtatgctgtgtgtggccctgctctggcgcacgcggagtgatatgaagtccccatactggtgtgttcaacacgttgtcccccgttggcatgtaagggaagtgtgccgacccagaagctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgttgtaacgccccgattttcgttcgggaataaaaatcaattaataatacattttctagaaattaaataaaagttaaatcaatttaatcaagtgaaataatgggagaattaaaattttcccttaaaaatcattggccgggaatattttgcaatattctttgtgccctaaaatactctccggaattttccgtgaattttcggagctcaagaagtaattttaatggcacaaagttcatcgaatcaattaaataaaaaaagaaaacaaaataaaaactccccttcctccttgggccattttcggcccaagaatccttcccctcccgcggcccgcgccctctctctccctctcccggccggcctccctccccatctcttgggccgtcggcccgtttcctctctccctcgtgaagtctgttttacgtcccccatccagctctccctccctctctccccgacaggtgggacccgtggaccccacctgtcatccctttcctccagctccaactgccgccatggccgcccgagccgccccacaacgccg

SEQ ID NO: 82413 - DNA, 610 bp, Oryza sativa
aaatgtaagtcctttaaaagcaatgagttttgtttctgtaaataggggtcatagatccatgatctattgtcgcaagtaaccgcaagataagattcgtgcaggagccgtatccttagcaagatactaaatcaagtcagggctagctcagagtctcgatcattaagaagggacaattgccgctaatccgacagcgatcagtagcctgtcctttctgttaccagtcgtggaagagttcggattctccccaatttgtccaaatggagtggtatatcaaggtaagctgaagagagaggccggcgtttcatcatccattgttttttttcctgctgtatcgaatcgtacaaagaaacaaggagacggtctctttctagtatcgattaggctgtgacctcccataagtgatacaagaaccggcatgctgacatttcaagaggatgcagatgcagactgaaaactgaattattgacatatatgacgacatctatgtacgaaaaccttgagcaaattggctaagtgaaacagcgaaatctaagatctttttcggcggattgatggcgtttcgagggtggccaagggcccgtctttgctgttggttacggtcaaggtataa

SEQ ID NO: 82414 - DNA, 11006 bp, Oryza sativa
  unsure (1)..(11006): unsure at all n locations
tcctgcagcccgtataacatctgcactatgcagatgccatgctgccctctctctctcctcccccaagaatctgcttatcttgattatttcttcgagctctttgcctctttcccccaaccgcacgtctccgcccgagagattctcgcctggattttgccgacgagtgcgtttctgatctccttcctccaatcctcatgcttgcttgctgcaatctgggctcaactttaaagtgtccactgccgtctggctataaggacagttgctactacatgtaggggattcactattatacccgataaatttaatgacgacggccaataggaaaattcggcctgaaaagacggcaaaaactatatttccccgtgtggcgattgaggtcagtctagaaatttgtcgagaacgaacgcacttaatgctttgtctgaacgaacgcacttaatgctttgtctgaagaaatatttcagaatccctagagcaagtttaatagcagagctcactgcttattataagtcaatgttggagctaacttgtataacaggttagctataaggttaactttattttttccattctctctctttctcactctatgaatttaatgcaaattttttggagcttgtgtggagctggctcttgtatgagagccaacactacccacttttttttatctctctcttttacataagcatatagcttgcttatagcccattactattcttgctcttactgtattttttgggggtccgggctgcttagacgtacggctagttaatcagtgatttgttttgcaatacatgttctttcttgggctacttgctgttgctatcatttgggctgacatgacgtgcagaaacaaaaccaatgcatgtgatagtgtactgctgctgtatgcacgcactgtggtggattttatttcctggccacgtactgtattaactagatagaattatcggttccacatctaggggtggtctattgcttcattagagagtactactatgttgtattcagtggtacataaccaccggttctttacatctcaccggctaatcttatcaatttccaattacacatgacttaattagtatacgctagttaactagtgtattagaaaagctatgctaagctactgaattgccaaacttcactttgctttgttcagttgccgtctaaacagtcacactacttccataaagaaattagttgtgagactggcaaggttagaaattctgaaaacataggcaacttagtactggcattccggagggcaatatgatatgagcactaattagttaatgataatgtacgttgcagtaatcttgccgtgcatatgaatttctatgcgtaacatgcatgaaagcacactaacgggagtttccagggagcctccaatcttattaatgctgtacaactaaaacaacatgtagcttattgccaaaactgcatacatctaaaataataatggataaaagaaaaccatgaaattctatgtctctgatctttctcgtcgtctgaggtcattacctgaagataatatgtaatgcacccatgtgattgaatacaaggtaataataatatatacatgaacatagggtgggcactgactaatatgaattaaaccaagataatacttggggtggaacctgagaaccacgttattatttagatatggcagccgaccataataatccagaatggtagaatgaaacaaacatatttgcttaccctacgattgtctattagtcaatatggatatttgccataatagacataaataagttaatgtggttcattggtcttcttgaatagttagtacaactagcatgtattcaggtttgtgcagaaattaaaacaggacacacatattttatctgtcagttattgttttgagttaaccttactgaaatatatgtgtaaaattgtgtactgcaagattattttcagctgattttattgatgcatgttttgaattagaaaaggcagcattatctcctaaaatgtgtcgtataaataaatatgcattggatctgttttcaacaaaaacatagactatggcaattgtaggtgttgattgaaagcatgcaataacaaaattttcctgtcccttaggatagaaaaggctcctcttaccttgaatgcaatagagctctttgtcattatggtttctttgagaagaactttgggttgttggtttcaattctctaatggaattagtaagattattgtgtgatcataatttggagtaacatttcccattacccctatgtacgcaataccctttcgtttgttacatattcccttaacttgcttacttatcataatgccacttgttagtttccctttataacaattgtcatagaatagttctttgtcgcatactccatagagcaacaaataacaattttagttagtttgaataaaaattctgtatttaaatttcaagatttcatacctataggtgtatgtatcttttggcatgtttgcaaccttttattttggatatagacattttagtttttagcatatacatcaaaggatgttatagcttccttatccaaactaatagaataaaccaaagaatctatgatagagaagacattacatttggatcgctagcttatatttcttttatcatgcatagcaaagagaagcaaataaaattatttggatgcaaagtctgctaaatgacgatatgcgtgtgtgagttcgtcattgtttctacgttttcttgctcttgtgggtgtaggcccaatttggttctctaccagcgcaaggtctttgatgtcattattagccttttcttttctagcggagcgagaatcttctagcattaccaaatggcatgcctttcccatcaaggataggatttttcctttctagatatccaagcgtaccctacattatctcacccaatgatacttctctatcattgattattcttacttaaatttcaaaggattgtaataaactttcgttttgtgcatgaaccttcatactaaaagggtaaataacacatagtttgttaatattaattttatagataatatataatgtttggggctttgcataacatttgggtataacatgatatcatctgataaaagttggtaaccaaaagaatatatcagcatgcatgctttcagcataaaaaaggaacgcatgagtttcgtaccaaatttagtgaaccgttacatgtagagaaatgtggtctcaaactcaacttcaagatcataaacagtgcacgtatcacttaaaaaaatgagagacaaaacattaaaaaaattatgaacacaagttacaatatattatcttgaaataccatctcatttagaggatgagttccttaactcaatatccaagtcttcatgatcatttgttgatgaggattgagaccacacttccttctcttttcctaattggatcaggaatatgccccaaatctgaaaaaaaaaatcattgaaaaaaatcaccgatatgccaatacatcattggtaaagtctataaatttatcaacaaattttcaacgccatgatattactaatacacgttgacattgggcctttgttgatgctatgttccacatcaccaatctattgctgatatatacaagcttggaaatgataatgaccaagccatatagtatcctcttcctaagagagtatctaatataagatacgacatcaccttactttttggtacttataatcatacattgatgtgtcaagtatttagatactagtgatatgcacttttggatatattcatttaaactatatccacattttcaccatgaatcatacaagatttagcataaggttcattttggctgaaaattataacttaattctaaagtttttagagaacctaacataattgtggacatcatcatggtcttgtgactttgattcaagttggttgggtgatgcacatcaattgatatctatgatagtcttatagtattagaaaaagtcatgttcatcctagacatttgcatcatgctccaatgtatttttaggtgttcagtcaaagatcatgaaaagatagaacaaacacatatggtggcttccatggatgcccctatgctacttttagtattagaaggaaaaatatttctggggccttttgaggtgtagatgatttggtaattccaatattaaaaaaaaattaaatagttgtatccaagctaattcaacattcataaataagaacatggaaaaactagagttggggcaaatccatcttgtacctcattttgtgccattgccatacaatattcccgcggaaaacgtgtgtagtttcatctagttttatttagattgggagaacgaagtactacaaagacaacatcaagtctgatgtcgatatatctaagctagcgttgctactttgacaaataatgagctaggcactagtttgaaactgccaggcactattgccatatgttggtgattggtcccactagccttgtcacatgcaaagtccacgaatcctcgttttcgctccgtgctacctctggtgaacgacacatcccctaaaagacgagcatttatctctttctagagaaaccaagaatagtgtatcgttgcgttatccaaaacctatcgccctattttatccaaatgataatgttggctagtgccattgcaccattactctagcatgatctagcctcctaaacacggagcaagatggtcagtaatcctttaaaaaaatctcggaccacatataaatgtaatagttatagctaccactctttgatgttcgaaaggaaaaattcaacactttataaagttcaatacctactttacgtacataaaataattaacactatcttttgtatggtaggtatttcattctttttcaatgaattgcttttggatttctcatctaaccattactctttaatggccacacaagaaacttgtcacaccctgccctttcaccacctagcagtgacacctgagagggtacgccgtaggaaatcaacgcaagctgactcccctggaaccacgataacggtactagtctcaggatacaattgctggtaccgcggtcaatcgagatgcaccatgtcaactaaacgcggtacatatatattatacctttaagagttcacactttcggagcaacttctggagtgtaataggcaatcagggtagcaacagcgaaaccttgtgtaggtagacccaatccacaaacaacggtttgggatttgtaaggaaaccctaaccatcaagttcacttctcttctcgagaaggaaaaaacggcggttgagtacatacgtactcagtaagtcatgggtaactgagaatgcaggctggaaaggagggttgggtttgtttcgcaaattttgaaaacatttttccaaaacactaagtgtggcattgtttaccaagtggtcggaaagaagcatatgccttgatcttgtccgcgaattgctttgcaacaactcaagcggacaaaacaaatattagttggttaaaattattctgccggttgaccttatcatgacattggtggaacaccatcagccctcaggcagcttccaactccttatcatgacattagacaaatattagttccttttcactttcaaaccatcaaacgttagcccatctcatcaactcatctctttgggtcctaaagccttccatagtctccaacacacaatgctttccttcgggaaacctaatatatgacgctaattgacatcctgatctacacaagattgtttcagaccacgtaatggtcctccatcagtcaccacgactgattctggtaatgatttccaaacccacaaaccactttcgcaaagcataggcaaacaaatctacgtgagaggaatcgccacacattcgcccattaccatttgtaagactcttcgaattagtagacctttacagaggttgtaaacttcacccacaagatgcgatcttactccttcactggccaagctgggaaggtttgtgacaaggcctttccaaatccaactaggggtacctcatgtcacatagaaggattctctttgaactgagcatcagggaaacttcggccctcgtctactaaagaatacgggatgccgctactcaatcgtgcataacacgttaaactttgttttgtgcctagcgcaacaaatcaactcacatctcctcatccggggcattccccaactattggaaacaaggcatacttggccaactatttacttagccagaggtgccccataccacccatatagtcgcactatgagaagctcggataaaattaccaaggaataagtccttatatgcaaaatataaaccaccgcgtgtcagtttttaaaaggattcacaacatatttttccacatcaacaaacaagggtgatgtgagctcatgagcacggtttaccgaggtaccacggggtggagcgacaagggattgggggtcatcagcgtcctattggagtaatgcaactactgggtaggtctgttggttcgtcgtgcgaactgagaccagtcaaatttaacgtgctcactagcaatacaattcgcaaacaaaacatttctaaaacaaggagcaatatgatgaaaaagtgccttgccactgtcttcgtcttcgaagtcttaaaaaatcttcgtccgaaataaattttgtcgtcgtcgactacgtgcatcaaagagaaaaataaacaaaatcctaaaataaaataccattgttaataattataagtgtcatttggtagatttcaatcttagaaaaaaaaatggagacttgaatgggatcgatcggagttacgaatagggatatatgattttttgaacatttaaatgattttctggaaatagaaaaggaattatttgaaatttggaaaagaatattctttggatcacaagtagggatgcaagcgggctgaccggtgaacctacttatctgtcaaataagtagtaacccacgggttcacgcattgtggtccggtttgtcgcacctagagatacaagtggattgatccataaacccatatatagatcaaattaataggtaacccgcgggtcaatccgcgggttatccactattttgcttataagcgggttcatgggttggcccgcttgcatccctaatcacaagtgggtccacaagtcattgagtgggtgaagaaggagataaactggatttttttaaggaaactgggggcacggacttggtctttagcccaaagaggaagaagggtgacgagggtcataaggacttggaaatgcagtgggttgaagtcgacctatgcacacgtgtcctaggtggtgagaggctggcgagtgggagtgtaggggtggtggcccgcagcggccgacgtggtaggccatgcaggctttgaccaaggaaggaggagactagctagaaatatcgatgacaggtggcactcactagcgcatcactaatttacggtggtttcaagccgacggagaccattggcacattgagtgggcaggtgaagaagggtgaatggctcggatggggtagatgatgcatgataggggctagtagcgtggagccaagtgtggcggcgagcggccctcgctgtgcggcgaccaatagagcggtgacttgggtgtgtgatggttcgggtgaggtgtgactcttcaccaattgaagatagaggggagaaagagggctcatcagaggagaagaggagaatggtggcgacaaaacatcgacggatgagatttggggaaaatagctccatcgatgaatagggctcgggggatggctggagcgtggtcgcttagtggtgatgagtgtggtggtggcgttgagttggttgttttgaggttggtggtggtggaaccgcagtgggcagagtgatagcgactgacatggagcggcatcgtgaaaaggtaatggtgtcggtttaggggctcgatatggagggatggacgcgcgtaagacgttgagcgggaaggatggaaaagaaaagaatcgagagaagagagggaaggaaagggatcataaaagagagtaagatgggaggagagagtgggcttgacaggtggttctgtggggagcacggtcgctaacatatggacccgcgcgagaggtggtgcatgcatgcatgttgggcgtgtgccgacggccttgcgtgagttaaggagaggggatcgggccgttgctgatctgggttgaggggagagagaggaggctagtgttgggctaggcttgtggtgcgcgggagacttgaggaagagggaaggggaggagggagaggaaatttttagggaagcttttgaaaatttctagggaagctttctagaccatgtgcatagtaacaagtgaaaatttctagggaagcttttgaaaggctatttgaggatttcgagttcggatttgaatacaaatttgatatttgaactcaacaaattaaggggattcgaaggaaaggaactcaaggaatttgttagaatttgataatgagaaattcaagaggatttgaaatacagaaagtaattttggatcggggtttttgtggtcgagggagagattcaattgagacctttggcacctatgtccttaatcacacacaatatttcactaatgtggtaatgggcaattgcatccattcccccactttcaatcccaactgttgttttacccccactttttagggtttgcaaatttgcccccacttttttgaaaacaaacctgacggttgccctcacttttgacggtgttagttccaggggcgaaaggacatttatatctttagtggttgttgcatttttgccccctttttttcatcgtgtgattttaccctattatgtaatgatataagattgtgataaataattcaaatatgagcacatctcgtgtgatgtttttgtactttaacaaaaaaaatgacaaatactagtcaagtatagaatttgaacataattctagcagcatttcaacagaatttcgacacaaatagcacaagtaacatatatatagcaaacattacaaattgtccaacacaaataagccacaatacatagatgtcatagaccacaaacattacttagtgttacatagtcataacaacacacattacatgtgcacaacatagaaggcacaataccacatattacaagtccagatcatattgcaagtccatattagcacaaaagtgcacaaaattatttaaaaggggcatatagatgtccaaatcatgcaaaccatgaagctagcctccctcctcttcattgccttccccttccacctgcatcgccactgccacttccccttccacctacatcgccactgtcacttaccctttcccttgcacttgcacttgatggttaagagagatcaacaataacaaaataagcataagcaaaatctgaaataagcaaaaattgaagataaatataaggaaagagcaatacatgactcactttgatgtgcaacacttggttcgttgttcccctctctactgttccaatttctaaagatgagtgcctcctcttttgacttgctgtgggacctccttggcaagtcttggccgtgtggcctagctcattacattcagtgcattattttctcttactagtgccagcctcatcacttgcctttatcctagccattcttggtctcccagggttccgtaacaatttaggctcttgattttatatcctatatcaacatgtccatctatccttcaatgtcactggactgaaagtccctacatatgccttcttgaacttctcaatggagaaccagtcatccacaaaatcatcgatatggacatccctactaagcttcgcaatgaaagctaaagcatgaccgaaaggctttccagtcacttgccaaaccctacaggaacatgtttgttactctccaaatgtactgcatgcctaaaggtgcccacagttacttcagctgttccagcttcacatatcaataactcatgttcctggatanttctttggccctttagcattcagagactttgtaatagctggaattattctttcctccatgttaccaacaatattccatcttacaacaaacttgtttgtgatgatctgtcttattgcatcatgcatgtccacaatccgtcgatccttggttgttgagacccaactattgaagcattcagaaagattattattgatgtaatctaccttgcactcttcagaaaatttggttatgctctaaatgtatgaatgattgttatccaaccaggaaagtgcatcggaacacttctcctctatctcactcatgaagctgttggtagccgctcacatattttgggcaaatagagggccatggaacttctttttcatgttcttccacaagtgcctcatgcattctctatgttccactcctggataaacatcatctacaacactctatattcctttgcctgcatctatactaatgaccaaacctacaataggactatagttcttggttattcagttgaaattgaatagatggagcatgcaagaaacaacttaaagaatagacaacttttggagtaccaatagctttgttcatgttctgaacaaaccaagtccaattttccttagattcggtctcaatcaccccatatgcactggaaaaagtcagttatgaccatcaattgcaacagctgatgccaactggcctctagaccttccagtcaagtgagtggagtatatatctatgtaacgcctacatcctttcaaaaacccattgatatagggtttgagagcaacagagaacctcgtgaagcagacatcaccattgcactctttactgtccaactcatctaagctgcttggcactgatcttaatagctcttcacgataggtaggcagaagatcgtagctgtcatcccactttccatttatcctctgaagaccctaaattataggatattaatatggtgcttgcagatcctatgctccccgttgaggggttatcccgcaacaagtccaccactcgatcaactacccacttagttgaggccatcatttcaccatacttgttgaaagataaacaagtgcgctttgg

SEQ ID NO: 82415 - DNA, 5213 bp, Oryza sativa
tttccatgttatctttttttttggcggaggaaatactaccaacactccatcatttgtcattgcacaggaacaatatgcttacaagtctgatttggaggagtagtaaattattggccacgccgccctccgtttcccttcgtctctctagcatcctcatggtggctgggggaagaggaccgctctcttatcgcatcacataaatttgagtttttttcaaaaagtaatagatatatacatttatcaagtagtctagtgtttgtatttcatttattcgccgttgtcctagcggaaaaaaaaatctatagtcctttttgcctttaaatctctgttgttatatctactttatctatgaggttctcgatggagactttcagaaagtcttttgttttaattatacctgctttattcatgagattcttgactgagactttggaaaaatcttgtttgtagggctgctgacgatacagttgatggtgttgtggtattatgactattattacaaagttgttcgcatatttctgtgtatgttaaatttgatcagttgtgagattacatccgtctgcttatattcttgcagttacgaacaatctacgaacgatttggagtctcttttatcatggttatgtggtccattataatcacacaaaataaaggatacaaacatggacggatataatgggaagatgtacccactcagaggcacacctcatattcgagatcgcaaccagaccatgttgctaattggagcaggggcagagatatagaagttggtcaactagagctgtagttatactaataaacctaaatatatatccattgaaatcgtattaaaatttcaacaactagaagataaaggcaaaattatgtaaattacactaagtgtgttcttgagcctgtcgaaatcatagtaaatgaacagagatagagaggacgaagaagaggaggtaatatatgaatgcaccactgggacgcacgttaatatcaagttaacgcatatcatcctcattgtatactttcaagaaaatggtgcaatgagaaattaatggatcggtgtttcaaataaaacatcgtgcaagttttgccactttctgaacatataagatgaatgctttgattatttgagttatactctctctgttccaaaaagaacccaattctatatttaaatccggacaaacactatatcaaaatttaaatccagaattgggttttttagatagggagtagtagaaaaacgaacaaagcaatcctatatgttttatcaacggttctagaaagcctatgataaaatataaactatgttgacaaaaaatctaaaattaagttttattttttccatgactaataagccagatagaagcaaataaacaaccacttgacgaggagagagaaatatagaaatgaagttgtaaatagtagtacttaaaaatactatgataactttacagttgagtcgttctgaattattttaacatagcagtataatatataaataatgatgaatagtgatctatacgatgcgtacgggatacaagtgggtgcaccacggcttccacttgcactgatttaaataggagaggttgtccctccgtcgtcctttgggggggcgttggcacgtgaaagtctcgtccgcagacgatccacccagctacgagacggcagtgggcatgaacagcgttggtgtgggctggcctgtccacgtggcgctctcggaatgggcattccgtacggacgctggtcctaggacaccgacctgtttgctccaccctcggactcgctcgggattggctaatgcctctccatcaaaaagatgtggtcccaggcaaggagtagtgttgttttgtccatcaaaagtttactccaagactgacatgtggccctatagatgcatgggaccacgatgtcattgagcttgcctagctggttgcacactttcatgtggtaatgtttgatgaaaagtaatggagagaataagctgacggtgtagggccatgccgtttaggagaagctgatggcgttgtcaaaagaataatttggacctgccgttctaacattggcctcgtttagttggggaaattttttttagtttgttcgtcacatcagatatacatacacatatttaaagtattaaatgtagtctaataataaaaaaaattacatattccgccagaaaactgctagatgaatttattaagcataattaatctaccattagcaaatgtttaccgtagcacaatattatcaaatcatggcataattaggcttaaaagattcgtctcgcaatttacacacaatctgtgtaattagtttttatttttttctacatttaatactccatgcatgtgtcaaacattcgatgtgacaccgtgaaaatttttgttttggaaactaaatagggccattgtagatcacctttttcttgcatcctccaccttgtaaaacaatgaaattctacttttttcatcatacaattaagaggtttggtttgaaaattcaaagatgccatttaagcatccaccaaaaagacacgaaccggcgtgtgaggctagtatcaaagcagaccgggagtggaaagtgacatgctagaatctggaaggaatggaaaatggtatccgctgtaacccctttctattccatttttaattgctcccgatactttaggtccacgaaaaatatcccatgtagagcatcttcaatgtgtttgctatttttaactccctatctaagcagcaagtagcactccagagggctacctaaggctgagtttttagtgagtttggtctgaaaaatccttattaattatgaggacggttcttaaatcgataaacagtacattatatctaacacttttctatatataagttctttaataaataaataaatctattttttaagtttgtaataattaatactagattaatcatgcagtaatagcgtgttgcaaattagctcatgcaaatcgctcggtccaagggagcctaaatctcacttcctattttcatccacatttttctacaagtatcttgtaactaccatcaacaatttattcgcaccaaacattccactcgatttatagttcactaaaaattcaacaccaattctctagtatatttaactatttaagtacaaatccagaaaaaagaatgaagcaattccttagtacagatttactatcttcccatgttctgtacacgttcatcagtatcaaattcggtacaatttcatcgttataaaataaagatcagcttagctctctcgagctcagagctcccctcctgaacgccagttccctacctcaacacttctcctctttctcggctagagctatagaaggtccctaaagcctacccgatgttcgaagtggaggagatgcggctcatacctagtccacttgagctttgtttttgggcaaatcaagctggagtttggtatgaacttcatgacaagacttgtatgtagatactacccacttacaatagtatagttgacacaagaaagagccagaccattaatccacgggaataattcctttttattattcttcactcctcttcaaaaccttctaaaactagcaaaatattcgtatgccattatatatgggtttttttttaaaaaaaatatcatggacatattgcaaataagaaaaaaataatttatttctaaatttagtcatggttttatgtttctttaccttttaatcattgcttttggaccattaaaggtagatgttaaaggtgtaaaatatgtaggatcgaatcacaagaactaagccaaccatagggggggtgaatggttggtatacccaaaaaccgaaaaattttagcggaaataaaagttaccctcgaaatcgatggaagtcggtctgaccgagattgatctgccggtctgaccgagtcgatgtcgccggtctaaccggtgatgaatctccggtctgaccgccgagatcgcctgccgcgcctgtcgccgctgtcggtctgaccgccgtgctcccgccggtctgaccgccgcaatgccgccagtctgaccgccggtgagttgccggttagacctccgaaacccggtgaaacacaaatcgaagaattcttaaagtagatgacgactttattgattctctctgtgtttacaaagtgcaccaacagcactccttacaaaaatttcgactaaactcgaaaccctaactcaaaactcaactcaattgctctcaaaagcaataccgggaagcctcacgctccccctctatttatacatgaggtaggcagcctaaagccacgaaccaaactcatactaagagtcctaaacaccttaggaaaccctctagtacaagaaagaaactttacataaccaattgtaccaaatttggactccttccaaattcgactccgcatcccatacgcacacaataactccatcgtatgccatatggaatctccatcaaccacgtgcatcaactctagcctaagtatcccgcatgatctttgaccaccacggatgtcgtcttatccccaagccgactcccggtccatcaccgcaaatactctcccgagacatcgagtcacctacacatggaacaaacaaagaaaccatattccgagaccaagctatctccaacttgactcatcagcagcaaacaatagtattacatacgtatagtatccatctagaagttataatcatgaaataaattcggacatctaaataaacaacccgaaaccgaaaccgacacagaccgcgggctgcgccggtctgaccgcgcattacacgccggtctaaccggctaccagagctcggtctgaccggtcacataaaatgacgaatcctgcgatcacgtgtgaaatccaatcatatccaaaaccacttcgtgaataaattccaaataacaaaaccaataatctccaatgcccaattgttcatcacaaaataataataaaaaacacctttgattttacaaaatatttaaatgcaaaaacgactttcacgtaggttccatgtgtcagtttaggggacttggtggtgggagtggcagactcaccatatccaccactcttttttttcttttaaagtagtatagatcttctctgaaagtccactaggagtcgatgttaagcttaatataacatcggcttttatctcatctcttgatccaaaaggaaataggagcacatgtgatttgaaatgtcacagtaaatcccagtgaaaaaagcctaaggaagtga

SEQ ID NO: 82416 - DNA, 653 bp, Oryza sativa
aaaagatatctatatccctaacggaatcccagatccagattaatacagtcgtgaccgactaagtcttaagttgtttccttgatatacaagtcaggaaacaaacccaggatacacataagatattctatctatattcggtatcctatattcagtccaaatatcatcgccgtgtagatatgggatatccataatctccacatgtacgattccattggagacgtacgtcgccgccgaagctaggtatccactttagcaaaaggaatcagattccggccgggcacacgggaactattaatttctccggctgctcgatctctcatcgtgtcgaaacatgaattcggcaataataaaacggggtagcgcacgagacctaaaagtggatggatgcagagacaaaggatttagacaggttcaggccctctcaatgagaggtaataccctactcctgtttggggatttgaatccgccgagtgtgtattgatctgacgatcaggttgtgtctcatgccccctagagggcttcctgcccaccttatataggatggggggcaggattacaagatagaaaccttaaccaatacggtatcggtttcctaaatctactttacaatcttatcaaaccagaactttaggccgttccataatatataggga

SEQ ID NO: 82417 - DNA, 1130 bp, Oryza sativa
gccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacggcaagtctaacctacatctaatagggaagtgctttgtatttgaggatgtgcggactctggggttctgaattcgtgggtac

SEQ ID NO: 82418 - DNA, 12139 bp, Oryza sativa
ctctcttctctcctgcaaggctgcaacgcaacttccaaggcttaatggcgatggtcagtcacacaccgaagaaaatgaaaagctttgcagtgcagagcaggtagttgatgcgcaaagaggagtgagttcaggatcggttctcttgaaagttcagttcaggatcgatcgatcgattgtcacatgaagaacgataacaaaagtaataataataatggagactccctctgcaggtggtagacccgaaaataatacagggcccatggagcctactgggtacacggatgaataatacaaccacgcatcacatgggtagagatggagagattagacggggagaattcgcattatgaaaagatctaccccaatcgctagcttagccctcttgttaattagtgccgctctaacctaatcgacaggaaatactagtcattagtcaaatggcacaccatacacgtacactaaccacccaacaacgcaaaatattgatgcgtcggctgttacattgcagatgcaagatcgatcggttcatcgatgggttgctctgctgctggcgatcagggtggatctacgatgttagcatcggtatcaggtaattccgacgatttttggcacctatggttaaaatgcttattcttatattataacacataaatataagtataactagaatgctatgatatctatagacacatcatgatatcagtgaaccagatccgtcgttgctggcgatgcggatgagcaggtggtgtggttcactcacgcggttgtcattctctcgcgccacgtctgagctgtggtggtgtggcgtggcacgcgattctgtttcgccggcaatggtcccggtctgcggcctgagcccggggggatcgatcggattgaaagctaaaaagcgctgaaaagaggagccgtacctaaccgccaccgcggagccttacgtacgtactccactccgcggagtacacacgcacacgcatctgttgctgttgctgttgttttggtttagcctcgtgccgtcatgatgcgtggcaacgaagcggctgggtcggcgggcggcggcggcggtgcggctcgcgtgatcctctctctcgccgtgccgccgcggcctccggtctccgcgaggccacgacgcggtcgtcctggaaaaccaagggcttttgttcgaaatgatgccaaattacaccctattaaaattttaggaacttcggtagttttaagctgtattcgtttgggatggttgggaaccaaactccccgcatggaaaacggagcaatctattagcatgtgattaattaagtattaactatttttttttcaaaaatagaacaatatgatctttttaaacaactttcatatagaaacttttttgcaaaaaaacgcaccaaaatagtagtttgaaaagcatgcgcgcgaaaaatgaaaaggagagttgggaacaaggggaaacaaacttaatgtgccatataaagtgtttgatttgctaccgatttatatgtttgctaatatagtaccaaatttgataacaccaaaacctttggcactgccaaaatatttggtaggataaaaatcggcactaaaccaaacaagtcctaaaacctcgggttgtctccttttaggcgtggcatagatatgaattatccctgtcacgtttttagaagtaggatttctcaaaaatattcgtctgtaacagcggttatatagcctttttctaaggtatgcaaactttagaatatttgattcatccttttcttttctctatccaaaatctatcaaattattcagttagaacgcgacgcgacctaaaatggggataagtctctggcttcgttcgcaacagatgaatttacccccccaaaaaaaaacgatgcatgcacccgtggaagtgtgtctgtcgacttttttaatccttaacctgctcgtgcgcaagatggggatggatcacgaatcgggaatggatgttttaccttttccctgaaacttttccatctccagcaccgcgaaattcggtttagattagagttgaacgatcacactgaaggctgtagtggaagccaggtcaaagggagagctcccccgtgcagctgggggccggccggcttgactttcacttgcaatgatggggacacgcactcggcggcatcagccgctccggccggccacgtcgccggcgccgccgtgcagccttgcccgtgtcgccccgttccggtcaaaccagcagctgttctcctcgccattcattgctattttttattaccacctggtcccggaattattatgcactaatgcacctgaccacacgcttgttgaaactgcctgagacaggtcatagagtcatatagagaacaaagatctgggtggtgaaattctgcactgggtccggctctaattcttgaacagatcatggcatctgaatggccaggtttgcatcgaggagattggagaatcttaaggtgtatagtagtatactttctgagctactcctaactggttagtggcatggtggttgctactggaacaaacatagcctgatagccaatgacctgcctagcctaaaaactagtcatcctgtactggatccagaactgacccaacaaacctgagcctaacttgagcaatcaatgtatcgcacccatttattagagccagaaaatagccccaggcccagtggcacgtccatgcacaggaacggtcccgtgcttaagcaatccggcgctagattaggcacacatcactgacgcagacatcttcaaacacaggaagttctagtgacagcaactcgcgaacaaccaaaaccgaaagaaaagtccgaaaggttcggctgaatatatactagtttagccagctaagcaattgggcgtcagcacatggctgcctaacagcctctccgcgagtgacctcacgggaggaagccgttcagtacgagccctgaaagctgcagttcagagtgggaaagatgtgcacagcgtacaggtgatcatggcaaaaagttttcaacaggaaaaatatgggtgcctcaacaaataattgccaaaaccgatattatacatggaagtgggccaagaacaccactagagcatatttaaaggcattgtttactatgatcaactcccaaaattctgttttcgattccacttttccaaaacttggggggtaacaactaattgaaaacacagatgatagacagttctatcgccagtagcaacggtagttagtaccttatgaacttggatagcagcatcaatcggtggcactcaggtaccttctttttcaccccccaggcatgcagaacttgagtatctttatgcagaaaaaaaatccaacagcccagtatttacggaaatagcttctttaacctattgatggccacaccagctgtcttgttcatgggttctagaacaagggcgtggctgaaatctgcaaattgtagtaaaatggatacacaataagaacttgtacaaaatagtggacacagtttgcagattccaagggagacctgttaatggttaatactgtgaaatactggtaaggtatacagaggaagaaaggtaagacggaccatcaacagcctccttgtagtaacccagcatctcccttgcagtgcctctcctcaaataagcttttacaatctgaaaaaataaaaagatcgatgtgaattctcacatcaatgtatataaaacactactcaatgaattgcgaaaaggatcacacttatcagaatctcaactagatgtgaaagcacctactaaaaaacttataaacagcactgcattaatcagaaacagcccaaattctttggatggttgattcaatgacagaaccagctcatcataaagtaggaaatatagcatttcgagaaaagaattggaagaattgtcctatatcttgtacttccccttttgtttcattatcaataataacatcttaatagtagaataatatatacaaatctgaatgtgcgtataaaagtctgaaccaagaaagcagatcctaacctttggatcaatatcgatggcacttgtgcaatctgcctcagcttggcggtaactgaaaggggtccgaaaagacaaaccatgaaataattgatgcgcgaaaaaaataagttacagaagccagctcatcaaggtaatctttgagaaaaaagatgccatagaggttaataacatacctagctagctctagaaaagcagcagctctgttgctgtagtatgtagccactttattatttaatttgattgcttcagtatagaaatttattgccttttgccattgtttctccttaaatgcaatgttaccctgtcaaggaacaagtaacagaaagaaaaactcagtaaggacacaaaaaagggaagatattaatgtaataaatccataatggtggctttgttttttacttcaacagtggttcaaaagaacaacttgaacataattttgggccattacaaatagttttactgcactattagacctactggttggtactgatctgtatacattactattagatctgtaccagtgagtatactctgacatactgatttctaggttattactattagacaacctttttttctcttttcctttaacatgacaaattataagatgtaacacctaaaaactggcatgtatcgactagtgcattatcattagcctttttcttcaatttccatctagatggcaagctaagtgctactacggaaagtagtaactgtgttgagcagatgttagaaaatcgaaagctatgctaaaaaaaaatcatcaaaataagaaaggaactgactttctctttagcagcttcagcagcttcttcactcatcgcctgtttactcgagacattagactttgctagagcgtcaacttgctcttggatggtagcataaattgtttgaatggtgtccaataaaaatcgatcaccaccatgccttgcaatcaaagaaactgaaactggacacttatcatgtgtacccagaggaaccgtcacctgaaaagggtcatcaaaatagttgaattagttaagatgcaataagggtttaccagaaaagcatgcaagtccatgtgcaatgaagctaaagctagccttatcagattcatgccctcccaaacattcgcctgtatccatctcaggccaaaacataaccacggagagtttgctcctccagaatcaggagcgaaatatcaccacaaaatcatcaattgaagtcagataaaaactagcaattttcaactttcatggttagctatcagcaatgttaacttattcatatgctatcattctgtgttattcatgtgtcttaaccatgttagtgccttaggctgcagcaatttcgaaattatttttgcaagtctagtcacttcactggctatgttggaactgcccttgtactaatgatgaaacttgcatgcagagctttagaaactcgattgtattgatgcccagcgaaattgcaattaaagttgcccaataaaagcatactattgctgactttaagaggcatgtaaattttgtagagtttatgttgttgtttgttaacttccatgaaagtttcacccgtctaaaatgccaaatggatccaaagagttgcaaaattaagcagcacaacttccattggaggaaaagaaagaacaggattatatgttagcaacataacctttgaatagcatatgaattgtactatcatacctggcaacaccctgacatgctagctaaagatgtaagacatgatgtctgaacattgtagtcctgagatgaaagttccctggcatttagttttggggggcatcccagaacagttggaatgaccagaattccatcatcctgtggattaagaaacatcatgacaaagaaactaacagtatgataacactaaataagattatcacagcacattcaacgacatgttaacgaaatagcatcataaaataagtaatcagtacaataccaacaaataagattatcgcagcacatccaatggcatgtaaagattatgaatcagaaacaagagcagttcaggaaaactatcaccacataacatggatcctcaggtagacacttttactctaagcctttctgtttcacaaagaaagttctcaaatgtatacttcaggctaacagtacagtactaaaagtaaatgaaccactattttcatttccagaagaagctttgtaactgggcccaacattgtgttaactgctaagtaattggttcaaaacaataatatagcgaaggaaacaagagcaacatgaaatatcactgatgaaaataacatatccaagttcacggttgcagaaatatgttaaatatttcaatttgtccatatattcaattgattctagatttcatccacttgttttcaaacaacataaatttcaaggaaatgacatttgtaaaacctaaaaagcattagatatgctttccatctatcgttcagaggaataataatatgtttttcaataacatttatccaataaaaccagcaaaactatcagtgatggccaactaagtgtgttgagaaatcagtcagaagatcaaacaagcagttcctgacaatgtaggtactcgctactgaaatctcgctaaattccagttcatcccaaactcaattctttaccaaccttaagaagagcaccgagagctgcacggacttctttccttgcatcttgactgttattgatagttgactcaccatcatcagacaaattaccaactatgcatgcatcaacagcaggcttaacagagtttatccactccatatgttgatctttgaattcatgtctggaccgaataacatgatactattaatttttttggcacgagttaaatagaatacaccaaatagaacaaacagacacgagaaaaattatcagtttaattattaaaaaaaacaagccatgtatataaacaacagagtttgtctagtatgacttctaaaattagaaaacctaagccaaagccaaagtaagaccacataatagagcatggaatgtgttctttgtttgcaaatgccaaagcttgcagtagctaagggaaaaaaaacagctattccaattattaattatcgtgatctgaaaatagatatgtaggagggaaataatctacatgcaagcaacgagggaaataatctacatgcaagcaacctacggaagtatgtagttcaagtcaactaacatcattgtttcataaacctgtgaacatcatcagtttccacataaataactatacaggctagaactcacagaggaaatttaatactaccatattttatatgtaaccagtagttacttatttatttaataacatgatcatgtagggcaggagcatacttgtgaagaaactgcatagccctagaaagtgctagcaatgaagaaaactttgagtcaccatgaccatttgaattgttcctcaggctgggtattcttgaagccaaataattttcaagattaacatgacccaggacttgtcctaatgtaatacgcaagggaaaaaaatcaacatgaggaagttggtggccagcaaaaactaagggaattttaaaataagaatgacaagtgtaaagaggagatacatactcccaaatagcttttccacagatttcgtcaccacctgagtcaatcttcttgcatgcacctttgacatttcaaagcaatcatctgctatgtagaaatgtctgggttgtcgaatatcagcgtagggtagcctcagaaggagatggccaacacgacgcagtacacttggatccctcgcaaaccaacctacagacaaattaattaaaaataaatggggcacggcaagtttacaaatttgaattaagagtgattctggaagagattacaagtcaatacatattttgttctttaaaagaaatatattttcaaaggtacctatggcatccaggctaggagcgacaggaataacaccattgttggggacaacagcatgtgaaggccggaatgccaagacgccacaataactacctggtacccttactcctccaatggtatcaatacctgcagaatcacattctcagcacattatttatctattaaagtatatatgacccatgcacacaagaccttatggttccacaactgtcacaaagaggatgtattaattttggaaaccagtgaaatcatggacaggcaccaaagaaatttcaagtcaatgcctgaccctaaacatagaattgttttggatcctctacagtcgcaatgaaggttaacatctaatggagggaagtcagatggatcagacttggtagaatgatgcaatgtaaaggaaggcagtcacatcagaacaacttcttttcttgagatgcacataatagtaaaccaggaaaatggattgaaaaaaaaaatcatacatcaaccctaaaactgacaattgtcaattgtcaatcctgaaatccagataatcactaccacacataaacaactagtgaagtaattcaaatgtacaggaaattcagatttatactaagctctgatactaaaggatgaggagaaagtggcattaaacaaaatgttgcccaaataaggacagcatgttgcacgcataaatctctagacaatgaattaaaatagtcagctcacctaaggaaaaatctacaatgccagcagcaacagcaacagctgacccacttgaacatcctccaggtactcgatctggagcagcaggatttgttggtgtgccaaaatgtttattctcaccatggatactgcacgtgtattgcacaataagtaagatgtaagcacacattagacaagtgaattatggcaaactaatcttataaaatgtagagaacatttctgcttttgtgatatttcataaaatgaaatagaacatggaagggtttagtgaacccatatgcagaaagaaaaaatggttttacctaaatgccatttcatcaataacagtttttccaacacacatagcaccaccatctacaagagatgaaacgactagagatgtttgtgttgctgcatcatgtgtctttgcccattctaagctgccaaaacttgttatataaccagttacgtggaatctgcaaataatcaaaacaagacatctgaggtcaaggataaataaaatgatgtacacgacgaatgttaacaccaaattgataataccggtctgccccttcacagtgctgggaacaagttaagtacaaaaatgaaaaggtgcaacagcattttgtggccaatagtgcgcaaatttaagaaacacactttgccatttttggcactaaaaaagaattgtcatgcaggcatgcacagttttagataaatacatacatagctgctgcggatcaaatgtccatttggataatttgtgtaacctaaaatttgtgccagtagttgggttgcagaaaatagcattttctccatgaagcagatatgcccacaatacaattttcaggtcctaaaataattaagttcagattggtatctattagcaagtatctattaaatttataaggatataagagcctcagaggagaactaagttcacttcagaagaagtagtggtatcttgacccagagaaaataccttattccagttttagtgttagaatatgcactgaactgtaaatgcaccttaagtaggttaaaaactaaaaggttccaaaaaaatgtctggctttgagttgaaccagatgagagcatatccttaaaagttcaaaactatgatattatctggtattttagaacaagataattaaccatagtgtttataagtttgcatcacagcttcatgactgtatgaatgataaggttgacattcccccccccccccacccacaacaatgctttcaaaaaaaaattttcacaatgaagcatagaacatcttattatttcaaatttgtaacaccttgtaccttttatacacaatagtgtctattcataaagctgcaaatactttagatgggtggtttcaatactcttccaacgatagttcaagaattctttggcaatagaaaaaaatactattctggtttcctttgaatggttaagtaatcagcatcttgaagcaaattatagtccacgtgctaaaaaactgtaatctcaacttcaaagctaaactttaggaaacaaccatttgtcatgcaaaacttaaagcggatggtttcatgaataaaaggtataagtatctaataatgatacattcatgtaagtttagatacatgcatgatacattgccttgccaaaggcgaagcggccacaggatgctatgccttcttgcataataaattcaccttaccacaaaccatggtacagttactaagcaatgtaatactatggtagatcattaagtaatcgaataaacattacatggcattgtttcccatttcagtgtcagccaataatatttggcaagtgatacatgaatatatctcatttaaagggcgttataatgaactgtaagaccatctccactctgcatcttttggaccaaaatagtgtgatgcaaacacacctagctacaaactactcgcgttttgaaagctttccatatatgtaaacaaaaggatgatataattcagcaaacccaatgtgccatctcgagtaaattcgtgcctccctaactgacctgataccaataccccaatgagaagtagtgataccctgatagcatgatcaaactgatcaaattaccgctcttaaaccggtgctagcacgctcccaaccaatccaatcagggactaccaacttcaaatcacgcaaaaaaaaaaacacaagcgaggtcggggagcgcggagagagcttacgcgtcggcgatggcgaagcagagccccgtgagtgggtgtcgcgcctgggggggcggcggctgcggcggggggaggagctcgaggcgggcgatgaacgcgccgttgtcgggccgcgcgggccgccgcagccgcttcgccgccaggaggaccccggcgatgccgaggccgagcagaacccacaggttggccgccgtcgaggacgccatggggtcgggttggggtagccgctcgcctgctccgcgcgggggcgagtggggtgggggggagttcgagggttagggttttgccgcgaggcggcggcggcggccgcggaggcggacggcgaggcggcggcggaggcggaggcgtggcggaaggattggataataccgggggttcgctgctggcttcgaggacttaaatacgtctttggaaatgaaatgaaagggaactagctttttctgtgtttagatctaaagtttgaatccaaacttttagtccttttctatcacattaacctatcatacacacataatttttcagtgatattatctctaatttcaatcaaaatctaaacttttgcgttgaactaaacacagcctttatcaaatgggttatcaaaggaatttgtctctctcttttttagagtttttttttttgcagggcaaacataatttttgtctggtggtacaaattgagaacttgacggtattgtatcgtgtttacgtatgtgtctaagttgcaaataatgtattgaaaagttgttacagcttgcaatgtacactaaaacctaagaatgaattaaaaagcaaaatctgcccttcagaagcttttgtctaaggtacgtaagccgttgaaatataagcaatacaaaatactgaacgtaaacctaaggctgcgaaaaatggtgtagacagtatttttaataccgtcagtttattgttatataattttctatgtgcaagcagtacacggttcggttatatgcagaatgaacgatcgtataggggtctaagaaattagggcaatttaggtttcaatccaaaccattgtattttttaacatatttttggtgtttcttagttcattctctttatctccttctctctttgtttagcttaaatggatttatttttcttggccgcaaaaagtgttacataataatcgtaccgactcaaatatatgtattttctggaaacattgtgaatgtgcatttcaagcattgaagtttttttttagagtgggttttataaaactccaccagttatggacaaagttgtacaaaacaaaagggattttagcacgtaactcatagccatgaatattattgctcaaaagtttcacatgaccacaccattaaccaatttaacatacttatatatcaaaatttaaaaaggctata

SEQ ID NO: 82419 - DNA, 8030 bp, Oryza sativa
  unsure (1)..(8030): unsure at all n locations
cccatcgcggcatccggtgaagaagcggtaaagccaacatccgctgcaacgcgcgtggaatgcttgcgccggcgcgcgctcgtcacgcggcggttgaaggtgaaggtgccactgcccgcgcgggtggcggcggccgccatggtggtgttgttgttggtgcacgggagtcggcggctgtatttggggtggggtgcgtcactagtcacagtagggtgggcaagggcaaggcgtagcatgggaatggaattgattatatgatgtggcacgggcgaccgggcggggcgggacgaacgactggatccttcacgttttaggccctgtttggataggaagcacacaaaaattggcctgtttggtgggagtttaaaattctgagaaacaattggttggtaaccagcttctaagaatctggaaaagctggaaaatccagtttctagcttatagttcattttttggattatacatttacagcttctcagaatcgagaccaaaagctatactgtttgagggagcttctgattctgggagaagttgcagcagctagaaactaatatttctgtgagagccattcaaacaacccattagactgtgtttagtttctgaaattagggagaagtttggggaaagttggtagtttggaaagaaaaagttgggagtttatgtgagtaggaaggttttggatgtgatatgatgtgatgaaaagttgggagtttgggggaagtttggtgtgaactaaatagggccttagtcttttttctaaaatataaaagttattttacatattgatccttaaaaaaaacctatataagtataagactttagctcggcaccaaagttattggcgcgcaggttaaatgagttgacctaacgatattgtcgctgacagagttgggtatttagctatttggcatcgaccaccagtgattcagtttcgtgccaacggttgtagttttggcatcaacacgtttaatgttggtaccaacgactctagcgttgagccaggatttgtcatgggataagtttctttcaattgtttaaaagagagggttaatgttttaagaggtgtattagcttttcagtgccgaccacctagtgacttaagttacctttggtatcaagacatcaaatgtatgcattatcaaccccagcgttaagttagaggttagtaattgttaggataaacttttctaaggtctatttacaaaataaattttataaaagggctaaaatgtcataaatctaggagcgggcgatgtggagtggggcccgatggcgggagatcgggggattcctggtccgcgcctttttctttccttttcttgtgtggcttttgtggcgtcgttttcctgcgcgggccggaaccatgtttaacacaagctctttttttttctttttagttttgtttaagtttaacccaaacaattgagctaatgaatgatgacgtgtgtggaagaagtcggtcagtacggccgtttgtgcaggagtacgcaggaacgagcagcactttagtacgtacgtacctgtggttcgatacggtatttttgcttgagtgaagcgtcaaacgattaattggccgacctaaaccgtctaatatcatattgactatcgggttaggaataacactattctctaagcttaggtatatacgctatcgttatgtaatattgtggcattattatattgcttccgtagttaggcaaggccgtagtagacatatttttattagtacttggtgagtactccctcaattctaaaatgtatgacaccgttaatttttttcacaatatttcactatttgttttattaaaataaattagtataaatatgtaaaagtataagttaaaattatattttatttaatgataaattaagttataatatatacaaatattttaaataagacaaataattaaatgttataaaaaaattaacggcgccatatattttgaaatggaaggagtactaaaactgatgtttacaacacgaacgacataatgtgtctaaaatatctctgaaactgaccaaccgcaaattattgtagtccgctccgaatctgaagtagaactacaattttttgcgccgttaacgcccagctgcacaataacactgggtagcttgcagggccgaatcttgttcacgtgacagtgcacgtttgcacgatattttacatgcaggctcgatggtttgttatacaggtgcacgcggaacacgaacagggtagcctgacgaattaagtctaatctaagattagcatcttggtcggtttcggttggcgtgttttgtcgtaattagcttttcaagtcgtatgtggactgtggagtaaactaccactaccatctctcaaaaagaggtcgtatataaccatttataccacgaagagagagctgcttttgtaacaaatctcacatcctcgagcagctatttgctcgacacacgatggaatgcacttacgccgaacgcacgctgttttgaacgcttcgcaaggtcatatataaccatggcaaatgagaatgcacatgttgataattacagtagattgcatggcaagcgtccatgtttatcatttgtgaaaacagaaagtttagttgtgatgcaagacgtaaagattcacgcattcattaacaccatggcacgttgggacggacaaaaccttgcccgggcactcatttagaacacgttttttagaaataaacaaaaaaaaagggggttcaattctcgcaagaacagaaagcttttcaaaatttccaacgaaacagtttacctgggctccatttggacggacgctgatgtccgtgactcctacaccgtttcactgatgaaacgtgcggttggccccagcctctggcatccaatcagcacttcagcagtacagctgcaacctacagcaaaaaggggcaacactggagttggattacagtataacgtcaccgcaaaaacatttccatggttttaaacaagtttgggtcagaacttaaggacatggatcctctgcattactgcacctgccgtagcaatggctgataggtgagtccgatcccccatgtcagcgacaattactacaggtgcagtaatgtagaggatccccactgtagaacttaaaaaactgggcagactcaatcttcaagtgaatttttgttctgtccactttgaagtttttacatcgatccagatagatgatgctacttgtttagacaagaatataaaaaacagcagtgaaatagatgtatagagtagctacttcagaaatatatgatccaccctaaaaaaataaatatatatatgatccagggtacggtgagcaccttgagagtagcagaatagaaatgtttcgagaatagtacacttcaagagcacgttcacattgtgctcggtaatgtacaggataacaggacacaatcccttgcatccctctgtgcctattcaagtgccaaaaatgccaaacatgcgatagcattggcaatatgtatgcttgagctctccactggtccacttcgtattaagttcacaactaataactactgtacagcatagaggtcccccaaataaatggttacaaactacacaagaattttaatcccaaaatctatctttctacccacatacatatagttatctaggagtatttgaaagtatacacaaaaggtgtttatggttaattccagagcaactcatcaatggtcatctcaacatgttaaagcaataaatccaagattcataggtatatcttactgcacagataaaaaaaaagaagaagtatctttctgttctaacatccaaggttcctcaatttattgtacgtatgctgggagaaatccactatcaatttatcatgggcgtatgcagggggacctataagattcatcaaagattaatcctaaataaacttgaaccaagagttacactaaagctctagctacatagtatgatgattaatttgctaatcaactgggatggccagttttcttaagctctagcaaattgctctgttgatttttttttttggttaaaacaccgtgttttcttgaaaaaaaaactagcataatttcctatgcaacacagatgttaacaagaattaaacagtacaaacgatgcaaattgcattgattcttcctagccatggcagcacaggcaacacattagctagaagttacaaacaaacatccaaacccacaacttcatgtcatccaaatgaccaaatcatgctttggaactgccaaaacatgaaacgagtcaattaaaattaagagaaagaaagaacaatgtgaaataaatcaaagataacagaaaatagtgcagacagcttagcttacacagttgcagttgccctttgttatgaaaccagagagcttttttttttaaattttttttgcatccatcacactgccatataaaaaattttcaatagctggtatatcagtatctgcaagcttagtaactcaaccattggcctaaccattgttaacaactcaacagcaatatgaacacccttccagaagctatgggatctaacaatcttacaagatagctttcatttatcgttcatacaagaaacgagaagtccacaaccatttagctcatgaaatccaaacaactgttaaatttaaaatgtccagtggcaaacaagtaacaggagtatgagcatagacaattggtgattacctttgccttgaaggttatgttagtcacactttaggtgtagcccaatatcttctagcatgaggtcgctgatgtgggctgtgtaattgtgccaatataattgttgttgctttaacatcaacaatgcccatggtctggtttgctcttcttgtttcagtggccatttgacagcttttttctcacctaatttttcaatacaatcatcaattagctccacaatcatccttatcaactgaggcatcaacaatcaagacaacaaaccgcataaagcaaatttattacctcagaagtggccaaccatgcccatagcctgtcaaaaagctcatagaaaatcagaacctttaaatttcaaccatggccaccaattggttccagcagactgtgaaacctaagcaatgttactatattaaatggagcatcagcttcacagaccaaatgagcaatatatcaacaagtacaatctctcttctctaattttgcttttgtggtcggtgaactgcatcgtctctctaggacctgctcttcttgactcttctgacttgaagtttgattgatgtgataatgaacgtgacctggttgacgaggcaaagctgcactgggaataaaaggactaaacactttaataacactcagcagacaagaattaagattattttgtctagaatctatacaagagacttggatagacaagtatattctagagcagaagagcttagaggaaagattagagcatcaatttcagaactcaataaattaaatgactaaataagaaatattagcttcatggttacaagaaagatgcaaaatgtacaccaagagggggttctcctattgtatatgtggatacttggctggctttagtgggcctaatttcaaaatatctaaccgcatgaaaaaaacaaggaacaattgcttatttgaccctgttttgaaaaaaacaatgaatatcgatgatatatcatgcatggcacattggcgcaacacaatatatcatcaataaagatgataaacagctacaatattgtatatatccttctagcgctggtccctttaagatgctaaataatgctatagcacatcacatgtcaccattatttgcaagtatgtatgccaattatccattcatgtaaaaatggaagggaaccaggtcaagcatctaaggggagaaaacttaaaactggataggtcagcacaatgaaaagcactgatgaccaatcctaagatgacaatgttcatgcacatctggacatttcaaaaaaataaatatcacttctagaattgtaagtgtatgtgtatgtgtaacaccacaatttgtatgaacaaaaacagatcccagttatccgatattttaaccattcttcgaaggaattttcacttcttcagtagataagcgtgatcaagtaactacaactatccctatacatacattacatttccatttatcagatgttcatatgataagctctcaaaagataatgaatcaaaattcgaccaaaatttattctaaaatttaaataaaatactgcaaaatgtaccttgtggagttttaaatccactctctcaaatgtcatctggccaaacacctgtcttaataagtgatgtttggtatttcatcacgtcatctaggctgctgccttttcttttcaatctccttatcaaggaaaaccaatattgtttccgtggcatagttcggagcaattccttctgcaatcatcttcctcaaatacttgtcagcttcctttaatctaccagcttttgcattaatattgatcaaggtattaaaagtgacaacatctggttttatgcccctcccaattatctgctcaagcaaagagtttgcttcgtcaaccttcccggcctttcccaattgattgatcaatgtgttatacatgacgatgtccatgtaaacacctttctttgacagttcactaataatcgagccagcaacctctgcttttcccatctgaccaaggccttgaatgatcagattgtatgtagctatatcattggggcagagctgtccacctctctcatgaagaattgcccatacctgtttcaaataccctttcttgacaaatgacgtcatcaatgaattgtatgtataactcgttcctttccttcccagagttgtgaagatctcaaacaacttgcaagctacactcaacttccctttcgctaaaaaaattgacatatatgtattaaccatgtcagcatcaaatgtcttggctcccataccttgcaccctctgccctctgtcaattgtgaatatagcagaactattcaaatgatcagcatgtttagcaagatgatctaggtgcggtgacaaagaccaatcatccttgggctcatcttttggtgtttcttcatttgcaccagtgcataccacgggattgaccaaactcatcacatcatcaatattgccatcaaagggaaaaattgatgttccatctttctctctgtcctgtggtccttgcaaagcagacatcatatttgatttccatcgaatagcatctggcaacacagaactatctctaatgaacttaactatctgctcttccaagtcccaacgtctactcttgttaaaccctatgagcaatgatgttactgtgaccaaatcaacagcaaaccctcgctcctccatttccttcattaactctaccgcctccgcaacttggtcccccttcccttccttgcaaaactccctcaccataatactatatgcaatcccatccaacagttggccttttctccttagatcataaaacagccggcacgctgcttctgctctcccattcttgaatagcccatcaatcactgtgttgtgtgtgcttgctgagcattgaataccatccgccaccattgtctcaaaaaaaccgcatgcctcatccagcttcttagctttgaaaagcccatccagaagcgaattgtacaccacagcatcccccttcaccccatagctccctcgcatctcctggaacaaacgcaaagcatcatccatcctaaaactcttgcagcacccatccacgatagcccggtaggtgaacacatccggttcaatcccaaatgacttcatctcatcatacaccactaaagcatcagcgacccttgcaccaaccacaagcgcacggatgagcgaattgtgtgtgcatatgtctggcacaagaggaggagaggcggtcttcatagcagcaaaaagctttagcgacatatccagcctcctccacttgccaaacgcgtggatgcaaatgttgtagaaccttatgttagaagggaggcccctcctcgacatttcgccgaacacgtgacggaagtcatcgtagannnnnnnnnnnnnnnnnnnnnnntatagtngtgtgatactatcngggcgcacg

SEQ ID NO: 82420 - DNA, 2824 bp, Oryza sativa
ctagaacatgaacacaacgacttgtttattcaaccacctgcccaccatccaaattaccaatccaacgaacacaagcccattgatcatcgtactcgatctaagcattacactactattttaaatgtctgccatgtttccaaatgcaactttagccatggataaacgtcttgtattagaagagcatgacgttatgagaagcagaccagtgtttattaacttctcatttctaattaattttctagattatacttcctcaattttaaaatacagtaacttaagatgagattagatcattctataactatgagggcatgttcactttaatgacattttcaaccttatcaaattttggcattaccaaaattttggcacatgatttcttatatagttaccaaaatttggcagcaaactaaatatatgcactttttagcaactttaccaaaatttggtaaggttgaaaatgacatcaaagtgaacagaccctgaatcttaatataattatcttcagattcacatgttgctgtatattaggacgaagatagtagtaaaaatctaaattgtttgaggagcttaagaagctgcatttgctaaaacttccacagataagaccaatttatatactatgaagtagtaccatattgatatgatttatgtgcgtccattcttaaataacaatagtcggagttaccctcgtttggggtacagtaacccctcttccccggtaaagcaaaccccagtgcacgacatgccaagagaaagcagcagcagcgagaaaccctgtccgcaacgcaatctatgcgaagcgcacacgattccggagctcaacaaaccgagatggcgacgcctagccccttaggcaggtagacgacgcttgagcttgacatgagcacattagcatatggatgcagcgacaaataacagatgcatcatcacgcatataccacacctcgcttgccctctcgcaacccctttgcttaagcaagaggagattccagacagttgctccccacctactagtcgttccagcagaacaccacaaatgttaacttctcccccatacatacaaactatgtttgtatgcttagggtgtgtttagttcacgtgaaaattaaaagtttggttgaaattaaaacgatgtgatggaaaatttggaagtttgcatgtgtagaaaagttttgatgtgatgtaaaagttaaaagtttaaagaaaaaaaatggaactaaactcggccttaatgtgagaaaaatatactgtgcaaatctaaaaattactatagaataaaaaataaacgtctaaaatttatccatacttatctaaatttgcattacatatttcccgcttaatcatatataaacaacaatttttactgctactttaatttctttttctttttgattcgttcaaaaaccaaaaattggatagtgcttgagagccttataaatatctctctgaatttcttaatcgtaacgtggcaagctcgtgctacctgtacagctcactgtttatgacgtggtaacaatgttttgccaaagatttgtcatgccatattttgatttttgaacgaatttgtttttgccacggtgacatggaaggccctgccgaacggtttaaattaattacctgagcgttcatttctgaaacttattgaaatcttctttaaaagaacatcaaattcgcagcaaaggggaacccggtctcaataattaatcgaaggaataagcacaaatgcttcgcattacaggcgcgtatacatatatatttatcgtattttttaatctgatatatatataattttcttcttctagtctactacggcgaatgaatgccatggcgtgcgtacagcgagaggagagaaaaaacccaaaaaaaaaaagaaaaaaagaacgaatcaaattgcgccggcgatgtcggtggcggcggacggtgagctcgctcggttattagtcgaggcgcatcatgtcgttgtggaaggcgtcgacggcgtcggcggcgacgcactgggtgatgaggcgggcgccgggcttgtgggcggaggggcggacgaggatgcaggtggcgatgtagtcgaggttggtgagcggcacgacgtggacgggggcgccccacccgtagtccacctcggcgaaccccagccgcgaccagtcggagaccagcagcgtccggtagtcggaggtgatccggtacgggtcgtcctcgccgccgccgccgccgccgctccaccgcgcgaactcccccgggagccgcttcttcccctcccggatcagcctcaccacgtcgttcaccgacgcgtccgccaccgcccccgccgccgccgtcacccgcatgatgtagtagcagttgccgtagaagccgtccgggagcgcgcgccggagcacggggcgcgcgttcatggcgaagcacacgtggacgggggaccccggggcgaaccccgccgcgcgcgtccgcgactgccacgccttggcgatgagcacctcgaacgcgctgcaccggtggcccgtctgctccaggaacctcgccttgaagtggtcgatgtagtcggtggagatgtccatggcgaggtactggaggcggagctccgtcgggacggggagcgggcccacggcggcggacggcgggcacgggatcgcgtcgcgcccccacgccggcgccagcgccggcgccgcccgcccgcgcgcgatctccccgaccgccgtcatgaactgcgccgcgccagggccgtccgcgacggcgtggctgaaccggaacccgaccacgaagccgccgcacgcgaactgcgtgacctgcattggggaacggacagctcaatcacacgggctgcaggaat

SEQ ID NO: 82421 - DNA, 22690 bp, Oryza sativa
  unsure (1)..(22690): unsure at all n locations
ccgtcccacctccgtacgcgtcgcttcccgtccgtctcacactctcgtcgtttgccagcgatacgccgccgctagcgcagtaaaccgggcccaagggcgggaggaagagcgtgccaccagccgcctctcctcctccgccatcgcgctcgtctcacctcgccacctcagcctcgcctcgcatcacctcgctccgctgccacgttcctccctcgccgccgcctctgcgtcacccgccgcgcactccgtgtcccccgccgccgccgacccacccgtgagagagaggaagagtgaaacagagagtgagagagagagaggaaaagtggaagagtatgacatgtgggttcgacattttttttataaatagaatgatgattggactgccacgcgacgccacgtagaccaaaaccaccgcggattgggtcgagagggggtaattcgtctagtttgcatagttgggggtgaagaatgtccggttttatggttcaggggggtaattcggtcaaccgcgatagttcagggggaggggtaattcgtactttttcctattttctttagataatgtattttcattaaactggcctctatatcacgagagatatacatagccaaaacgatataaaagcatttggactcacacctcaacaaagagaacacacaaccaaaaaggaaaaacctacaagttcggcacatccctgcattccgacatcttcttttgaaacagtcaaaatcgatgagtggaagtcgtctagtcaccaccacccctaatgctttgtcactgcgaaactccattggtgccatcttcatacacttaagtgaactaatgccacgcgtcgccggttagcccacctttatctgtcgtcatccagtcagaactaaccgaccagacacaagatgaaaggttatggttccgtttcgtcgtattcctaagcctctgccaacgatagggctgccgccggcgtcggaatcctcctccgctacttggactcctagcccgctaccatctctgcttgaatcctctgccactaacgccgaggatatcatctttcgcctagactcccagacctttgccgcccctagagccactgtcaccaacgagatccacccacctgatccaccttgcatcgacacttaggtcaccgctgcccctagggcggcaaccaccgcaaccgaggaggtctctgctcagattcgcatgccaccgccattcttaggatcactgatgcctcgaaaccaccttcgtaggatccgccttctccttgccgaggattggtcgtcgacacttaagagttaagacgttatcgtcctctgcgacacccgctgtcccccaaagagacgctgctgccaacgtctcgccattccaccgcctccccgctgccatgcgcaggcccgcccaccgccgcccacgacccgtcatctcccgctccgcccgcgcgggctgcttggttatgtttgggtagagaataacacgtacgcgtggaattgatcatgtgaaatacctgttgttgtatatacgtagtatagtagtagtagttttctaaccgtttgtgctggtctataaagaaaacacttgtgctggtagtagtttgatccgttcatgaaattaatatatacttaggctatttaagacttttacagctgcagtacagtggtgctaacgtgtacagtcagagaagttgttgacgtatcgcccccttctttgacccctcgggcccgtgcgcgtgcgcctccattcgtcaaccgtaaatgctgcaatccttgcacccaatcaagttcacataatctgatgaaatttcacaaaagcgttattcacaaaccggtcagtattagctgattctcgtactacgttaatctaaagtcgtctgtttttattagtttttgatagaatttcagtatacattaataagaagcggttttttacttcgaaatcaaaaaagacaaaccctgcaaccaattgttcgctttctcacacttcacgttgctacttggcccacccgtctcacgatcgactccgcgatgcaacgttgcgacgcgacgcgctcgctgccacggtgcgggtggtgcatcctcccgtcatcggtggacggaccgacgacggtgtggtgtactggtgtggttagtggagtacgtactacgtccgtagccactgtgactgggcacaatctctcgggtattggggcagcgggctagacgacggcgacgctaccggccaaatggacccctcaattcccccaattcgtcttgtcgtggtactacctctgtcccaaaataagtgcagccatgagtttcagcgcctaactttgatcgtccgtcttatttgaattttttttataattaacaatttagttgttataagatgataaaacatgaatactactttactcgtgacttatgtatttaatttttttcaaaaaaaattaaataagacgagtggttaaagttgagcgcggaaaatcatggctgcaacttattttgttacagagggagtacatttgtgctagcacgtactacgatcgagtgcacggtacaggtacagtgcaggaccatggtggacagataggacaccacgcgtgttaatcctttgcaatttatttggatttcatcatttcattatcataataaattattagtcaaacacaaaaacttcgcaacttggagaatgaactgacaacctgacgtcaaaaaccatatttcatgcggcttaatttattggaataattaactatttaccactcttacgagtgggtaaattatttgccacttgacccatatgtcataaacacatgaggatccgcatgtcatagatagcgagtggcaaataattaattatcacatcttaaaagtggcaagaaattgaatgtccctaatttatctcacagaacagtaaggcagcgttcgagagggtgagagagtatgtttgtttgtttcgttttccgcgcgcacatttccaaaactactaaacggtgcgttttttgcaaaaattttctataggaaagttgcttaaaaaaatcatattaatccatttttgaaatttaaaatagttaatactcaattaatcatgagctaatagcttacctcgttttacgtatcttcccaatctcctcgagccccttatcctcaaacacaccctaagaacaccctgagactcctccctctcaagaagctctttggcaatcctgcggcctctttccaccaaccaatcaaccaccgggaggcccttaattcttaccatcggatccatgatcatacagtcaagtctaatagcacaacgaagaatgcagtgtgctagctctatcagcccctgccaatgacaggctccagacatgaccaccctcctgagctttatcatgccgatacggtggcatatccgctctgatcacctgtctgatgacgaaatcagagatgtcaaactgcacgcaacaattcagcgcacttgtgagactcatcgcataatgtttccgtcagtaattcatccaatgtttggaacgcatgaatttgtggaagaaggaaaaaataattggaatgaaaaaaagcaaacacaaaagtcaaaaccagagtgtttgcaatcaggttggtggtgttttatgagcagctgcaacaacaacatcatcaccaacaatagttagaaaatgataataataataatgcactaatatgttgtcttcagaacagatgttatcctaacgaatctaccttcattaatctactagattttatataacagattgttttaatctatttttaaaatttttctcttataatcatagatttcaagatgagaaactgggatacatcaaatcactctaaccctacggttttctatttcaaactgtgttcggataggggaagttgggaactaaactctccgcacggaaaacggagtggtccattagcgtgtgattaattaagtatttgctaattttcttcataaaatggattgatatgatttttttaaggaactttcgtatagaaactttttgcaaaaaacgcaccgtttagcagtttgaaaagcgtgcacgcggaaaacgagggagggaggttgggaacatgggattgcaaacacagccgagcatgtacacctgcagcttaagaatagggtcatcgcaattgccaataatttttataaggtgccaacatatttcaaaatttaaagagtgaatttcataaaaccccagctattattataatgcaagttgcacaaaaccacatggattttggcacgttgcacatatcctcacgtattatatcctaaagtttcacaaaaccaccctgttaaccaaattgacatactcctatatcgaaattttgaaaaacatttacttacatggatctaatgtttatatgatggataaataacttataatatgttattgtagaactaaaaaatatggtaaatcaatatcaaaatgatcaatagtgtggttttgtgaaactttatggccagaatacttggggttatgtgccacgtaccgaaatctctggggttttgtgtaacttagatcataatacctggggttaggtgaaattgactcaaacttaaaacaatccgatagtatatataggctatgtgacataaatgggatgataccattgaatatgcatatgaaattacttccatattgtcatgactttgtaattacaaaacaacagttaaagtaagctcaaaggtcaaattgtaattgtggcttaaaaatattaaaagaaggaatggttctagaacattatgccaataaagaattcaacaggcttcgaaatataaacaaatttgtattgtatcaccaaataataaggtaataaagcatggtagtctccaatttccaatagatagaaactttgttacccttttgtatttttcaactataagatcaaaatcaaccaactcgtatggtattccaattttaagcaatgtagttgtagctttagatgaatgaaaataacaaacatacaggaaatggaaaaaaataaaaagattggtttcagatgaatgaaagaaaagtaggtaattgaaaataacaaggatgatgctgtgccaccacaaaaatgtctacatataatgcatgcttaagaaactgtcaacatattatgaagttgttaaagccactcacgtgcagttccaattcctctagaactggagctacctccaagaggtaggccaaacgaagaatcccatcaactgacctgccgttcccataaagaggcaaatacaagttcagatgcctcaaattgatgaatctgactgaggttttggcgaaccttttcaactgaaacacaaccatgatagtctaatcgattatggatgagatgacgaacagatgtctaactgattaatgaatttaattgctttcagaaagagacaaattaaacctcatcatagatgtagagtgtctgaggtaatggagagtttctgcacaccaggaagaacagcaggaagctcggtgcatatgtaatccagattatcaccatagcgcacgctcttatgtagcagtttaaacttcatcacctttggagattcacttagtgccaacggaattggccgattgatcaagtcaaacgatgtgagatttggagcttccagctcaatcttttccaggttgcagtagtgcaaacaaagataacgcagccgcagcagcggcttgcacaaggttagctcggtgtaggaacagcagatgatgctcagccactcaagagcagtgcattccggcagcatgactgcatgaggcattgggagtcactcaaaaacaaaactttgtgcagggtgagcttcttgaggtttgcaaagccagcaaaaccagtggttgttgtgttcaggcagacgtaggccaggttaagagatctgacatgagaaggggagctgtccgggccactgaaaacatgcagtgggaagatgtacttgtcatcaggcaagcccttgaaaatgttcttcgctccaggagtgaaatcgaaagcgatgtgccttgctctcgacgcggcgcagaagcgaacccatccatcgacatcaacatcgacatggcaggtgtgcttcctgcgcagcccgaacttgacaacaaacttcctcagggtaggaggtgaacatagatgccgcagaagactgttcactctcctggcaaacttggtccttgtacgtttcatgcttgtattcttgggctggaacatggtgcctcttttcaagaccaatttcggacagcagcatctccacagctgctgccacctgcgagaaagaaaggccatccgcgaggactctctgaatgcaaccgtgacaatatgctgcgtagaacatcctgcacattcatatgtaggcaggtaacatgaataaagatttattaccgagtaaattggtttgttgattaattagtcataagtgataagtgatgagttcagtggaatcgtttagcagctgtttaagtatgaaaggcacattgaactggttgcttacatcggacagatggtgtagttgcagggcttctgaattgaccatgggaatagatttttatctgctatacagatgccaggttatgagaatgaaagaaacagattcatgcacatcttataaccatattcatctagaagattataaaaaaagcattagatataacccccaaataaacattggctaatgccttgttcggattcatggtgatcatcatctgtaaacctcaaaaaaaaaaaaaaaacggacaagtccctagcatagcatatcagtatatcactgaacagtcccaatattaatatgcaaataaaacacacttgcatacagatcaacccaaattactacttcaacgcttgtaataatggcctaagatgaagaagtagaactgaatcagagattcagagggcggcaccgtaaaaggaaagaaggcagagcggcggcgagcaggaccccgccaaggtggtaggtctggtgcccccagcgagctgatggcgcaaggccggctcgccggcgacggcgaagaggaggacgacgaagacgacgtcgtggacagcaccggctcacggcggacggcgcggacgccgggagccctcgcgccgctcgaagtttcggtcgcatccgtttcttcctctccgattaatgtataccggggattggatcttttgggctgacggctaagtgggccaggcccacgcggccatctctgggctggcgaggcccagtaactattggcgaaaggataacagagaggctgggcctgcatccagtgtcaagcctccacgcgcctcgaggagccgagccagtggcctctgggcccaccatagccgaatcggatgccgcgattgatagggcaacgtcccaatcacttgtgccacgtgtaaacctgggaaaacgcctctggaaaatggaaagagatggggagttcgcgaccacaggattggatcgcctctgccctctggaagtggaacctggatgatgacttttgattttactgcttcatactaataaagaaagttatttaggataatatttaaatcaaatctttagaatataaattatgaataactctcaagttgttgagtttagaaatataaaaattatatgtatagatttatcttgaaaaatactttcataaaagcatacatatatcacttttcaataaatatttttttatagaaataagaagttaaaagttgtattttgaagattgtgtcgttgtcctaaacaattttctttactttataagtatggagggagtactagttttgacgttgtttacatgtgcgtcaatgctcggaggaaaagtttgattaggcaacaaaaaccagcggctaatttttggagattaaccattttgccttcgtgatgatgggaggttgggatacttgctcaatgcctttctatgcgtggttttgattatgaatgctgtcgttatcttggaactttgacagcaacggtacatataaacttgctgaatactaatatgtcactacatttaggatgtatttgaggagaaggggattgagttgattgggaagatacgcaaaacgaggtgagctattagcttatgattaattgagtattaactattttaaattttaaaaatggattaatacgattttttaaagcaactttcctacagaaaatttttacaaaaaacgcaccatttagtagtttgggaaacgttcgcgcggaaaacgaaacaaacaaactcactctctcaccctctcgaacgctgccttagtttttttaaaaaaaaaatacattttctaacactgtacaggtagaggcgagcttcaagattatggcaacttggatgattgctgcaacagatgtctggcttcagctaggctagctagctagtcgggaataactttgtaaaaaggaatttgcttggggacttgtcccatcaccttatttctcattttgatttacttttatcttacctttttattactattaaatttatggctgtgtgtcttatgacagaagccggagatgtaatccatttttattattaaaaaaaggaatttgctcggattaacaattattccctgcaacatataacagcagagactatagacactcaagctgatcatatcatctttactcgtttcctttgtttattttccttaacccctggatgaaaagcacaagtaggtgcatttctcttttaatagtgagagaatattgcttcttcttcttcttcttcttcttcttcttcttcttcttcttcttcttcttcttcttcttctctctctctctcttttaaagatggggcatctacaacttcatctactaatgtgtcgttatatttattttttaaatttacatttgctattacatcacaggcaaatttgaaattttggatgttctttgtgatatatggtttcacctagagtagctaggcaagaataactatgcaaaaagaatttgctcatattaaaaagtactccatcatattaaaaaaaagtcaaattaggttgggatttgacaccatatataactacgaatctagatatgaggttgtccaacttcattgctttagatggtgttaaatcctcacctaggttattttctgggacggaggaaatactcccttgcaacatgcaacagtagagttagttaactgaataacaaatcatgttagtttttcttatctccgtcgtttattttccttatctcctagatgcaaagcacaagtaggtgcagttctctttaacagggaagaatgttactgtttctttataggtatctaacttcaactgtaaaccataatttttcttattaactactgttaggtcttatgtcatctagaacatcaactatatgtaaatcggtatccaccatatagttgcaaactggtaaccatagaattgtgaaataggagtattttccaagctaatcatgccacacaaatgaaaaaaaagagtaggttgtaacatgacaacttaacgatatataaatctatacacaattatatctctaaattcattaacacctatataaatgtgaacaatgctagaaagtcttataacctgaaacagaggtagcaacaaataagcgcaaaaaataacatgagaaagtgtgcacgtgccccagtgacatgcatgtataaaatgtgagcaccattttgaaaaggctgtacaccagtattttcggacaaaattatgaaaagtaaaatcactgccaaaacctagcaatcgacaaaatcagctgaaaaatcattgcaaaaagtgcatatgctgcccacggatacgatggaaaacaccaacatacggcctcttaaaagccagaaacggtacagatggcaccagccaccagcacagttttttccacggcattctctatttctttacgtccacggtaaaggaaaagaaaaaaaaaagcccatcgtttcacttacgtttgcatgacttaatacaaaatttatatatacgtgtccatttaaaataatgctaataaataaaaaatgttaaaaaatatcataaagttaagttttaaaattcaaattctaacatataagatctagttctcttcttcaacttcaaacttcaatattcctgttttccattagtgcgtttttaagctgttaaatgatacatattttaaaaaaaaattctatacagaaactgtttaaaaaataattaaatcttttttaagagaaaatcaattaaatatatttttcaagtttataattattaaatatttaattaatcatatgctaatgatttttctcgttttgcatatgctaaaaatatgtagcctaagtataatcataagagaaataataagctgaagaaagaaaaaaacactttaaaaaccgccccaaaaatataagcggcggaaaagaaaagggataaaaaaacaaaacggcacaacggaatgatcctctcccgcaccagctataaaccgccacacgccctcgtcgctctcgcccccgcaccaccactccctcctcctccatctcctccgctcccgatctcacaaccaccgactcctcctcctcgcgcggcggcggcggcggcgtgagccagcagcagccatggtgctgttctcggtgacgaagaaggccaccacgcccttcgacggccagaagcccggcacctccggcctccgcaagaaggtttcccatcccaccaccacctcttcctcctcatccgattgtctccggtttcccgtcactagggccccgatctggatctaggcgcgacgcgtggtggatgggtaaaggttgtcccgatctccgggttcccgccgcggatctcgtcggcggtttgctcgcggcgcgggggccttttcggctctcgcctgaatggtggcgtgggctgggatctgatactgactccgatgctcgccgtctcgagtctggaatgtgcggttcctcgttgcggtggttgattttgtttgtcccgcgaccagtcggatcagttagtctcgtctggagcgttggatcgatgccggattcgattgatctgaattgtatgcgttcgtgggatttgattcaggagatttttttttcgctctcattgattagctttggctaattgtatcgggatcttgccgagtagtttttttttatttttactcattgttagcgatttgagcccgagcagataccgaaggtagatagtgactgtgtgccctctggcttaggatctcaatccggcttgttgctgctctggatttgttagttgttagcttgttagtcatcgtgaggaatgtccataagattctagaatgtttcgctgcttttgattgggcatgcctgctgcccaattagtagcatgttgcatgtatcagtgcccagtctattctgatgagtctggatccaggccaaaatgtggatcaagcttgtattcgtgtgcattttaaaataggatgaaaaaggagaatttggttcttactcaccgttgctaaaaaattgttgttaatacatgctgctacgagtgcagaaattgatgagcaagtttattaaatgggatctggtggccagttggtgttatttttagggttcaagctaacgtcacaaactgcctaactcctgcgcttgaaatgttgtgtatggcacattgctcacaacctgatctgtgctactgtaactgttaccaggttactgtattccagcagcctcattacctccagaactttgtgcaatccacatttaatgcccttcctgccgacaaagtaaaaggttagctacttatcagatgaacacctgtcctgcttcaataatctatctgagcccttctttattcttgaaaaataatcaaatatttaatttcgttttgaagtacatattttgaatatggttaggaaaactggaaacatatatgactgaatttgctatccctaatccatttccaggtggtaactttaaccatctggtaagaaagaaaataatgtagttaactagttttagagataccatactgatttgataaattatcatggagctggttttatgcataccattttctgcatatcccctgtaagttagaaatgctattaccactttccgtaattaaagtattttctgatatttcattgtcatttttcatatctttctatcatttcttttcttacaggtgcaaccattgttgtgtctggtgatggccgctatttctcgaaggatgctgttcaggtaatttatgattgattaggcctcatggttcttgtgcaattttgtgatccttattgtcaattttgttatatatttgcagttgcttctacggatttccctttaaatatttgtatagccacatacttcaacatttatcgagctatgtgatggaacccacgcatgattagactcgtcttgcttagttatacatgcctccacatcatgtgacacatgttgattgttgagtgcagacgtaccatagtaatagtattgtgtttattgaggtcaaatattgttcatttttctatgttgtgtcaagttaaatggtttcaattgtttaccagaagtcacaccaaaacaaaaatgcgacatcataaaattgatcataatacctagtacacaattttgtatcgtgcagtgcctatgcatagtgcttcttaactatgtagtttatttattagtggttgtaatctatctcagttgtagattgctcttgaaagttggaactttgaattgtggttggagatttgacatttattttgcttggtatagatcattacaaaaatggctgccgctaatggagtaagacgtgtttgggttggacaaaacagcctcatgtctactccagctgtatctgctgttatccgtgaaagagttggtgcagatgtaagatttattttacaaagattaactttttgcagtgtgactgttagtactcactgcttattttctctgtgttaacaaattaccttactggtgctttatcaaatcatcaaaaaatagggatcaaaggctactggtgccttcattttaacagctagtcacaaccctggtggtcctactgaggtatcacagttatgatgtatctctgctgctaatcaagtggcacgattttctgtgtttatcagcaacttttcatttgatcttggcaggacttcggaatcaaatataacatggaaaatggtggacctgcccctgaatcggttactgataagatcttctctaatacaacgacaattactgaatatctcatcgcggaagaccttccagatgtaagagttgacgctgacttgttagtttttgttgtttgttttgctcccagggtattgaaatatatgtttcactcctttattcttgcccacatcgcaggtcgatatttctgttgtaggtgtcactaccttcagtggacctgaaggcccttttgatgttgatgtttttgactctactatagattacataaagttaatgaagtaagttgcttccatttgaatttactgaatgctatttccatatgtattgttcgatgttttcttttcaataagtgaattttccttgtagcttcataagaacctgcgaaaaatgggtgatttaatttgtaatttgtatttaattccaggacaatctttgactttgagtcaattaaaaagcttctggcatctccgaagtttacattctggtactcgcttttatcctgaactatgctcaccctctcctcatattaactgcctgttgcacatctgaacctttggtttgcacttttagttatgatgctctccatggtgttgctgggacttacgcaacacgcatctttgtggaagagcttggtgctgctgaaagctcattgttgaactgtgttccgaaggtaatttgttttcttctatcatcacaatttgaaaatagaatttagattggtgttcattctttacttgtatttttacaggaagactttggagggggccatccagatcctaacctcacctatgcaaaagaacttgttgaccggatgggccttggaaaatcctcaaatgctgaacccccagaatttggtgctgcagctgatggtgatgctgatcgcaacatgattctgggtaaaaggtattcttcagcctagatagcttgaagtttttgtatatactcataagtgctatgagaaatttatgatgtgtcctttgccttctagattcttcgtaacaccttcagattcggttgccattattgcagccaatgctgttcagtcgattccttacttttcttctggccttaagggagttgccaggtacaatgtaatcctgcatattaagctgcagataacccctgcacttttctggtttacaattttttttaatgggggcttttaagttgcatactgcattcactgtggtaaatcgcatctttcattctgaatgtgcatccaaacaagcatgaaattcagtgttcatcatacaatgctaatattaggatattagaaaagatcaatttcccgatggggattgactggttatgtttattgctgaaaatcctggaatgttagtgctctgatatctagcctcttcggtactggactccgtagctagtgtttgctagaatttgtactacaaaaaagaagaagcaaaggatccaggattgataaaacagcacaaataaaacaaacagatgaaaaaaaaagaccccatactgcctaccatccattcttgaatcttttatcaaacaataactgttagatggaaccctggatgaagatgactgacatctgacatacctatatcggcggctgtctgctgcttatagctgtcactggtctaggatccaagaatctgaacagaaactggacgtttcttttgatcgtggcattgatgtttcaattcacttgctttctgatattatgtcaatatgcaagaataatgtaattctcatccatcaaaggtgttaactgaccatatttgcagtaaacttctaagtcagaacttttaatgaaaggatgtaaaataccgctgtgctaccttatgttgatctattgataaaattgcaggagcatgcccacatcagctgcccttgatgttgtcgctaagaatttgaatctcaagttctttgaggtaagtattaggaccgtcagtcacatgattttcaaaatgccggacaagcatatcatatgaaaaccatatttcaggtgcctactgggtggaaattttttgggaacttgatggatgctggaatgtgctcaatttgtggtgaagaaagctttggcactggtaattactatgaacttgatctatggaacacaatgacatatagcagtgaataaaatgcatgtaacttcatgcattttgatatgtggcacctctaattattgagaatttaggatattccacaaacttggcttagctaaaggaatagggcaatggccttttattgtttccatacgcaacggaatgttcttattttgggtaaaatatcatgcatcaatgaaaatcaagtggatcacatttaaataatgagtcacactgcagtcaggatatgactagctcaccaggatgcttatacctactatgttgtttaggttctgatcacattcgtgagaaagatggtatttgggctgttctagcatggttatctattcttgctttcaagaacaaggacaaccttggaggcgataagcttgttactgttgaagatattgttcgccagcactggggtacttatggtcgccattattatacacgatatgactatgaggtactttacacaaatattcaatgtacatttatgtgtatgtatatacatttggcaacatgctaaccatgccatttttttcttcctgaagaatgttgatgctggagctgctaaagaacttatggcaaaccttgtcagcatgcagtcgtccctttctgatgttaacaagtacgtacattgttcactaacccatgatttagggagcgatcaatacttcgccagctgctatagaaatcagtctatttcattttaaatgaatgaataattttgcatacatctgattgttgtgttttgttctttgccactttgcacagctctgtagtatttcattaatgttattttatggtcgctactgcctagtggttttccagttagctaaaatattttcattcagtactagctctaaactgtaccttatatcctcagattgatcaaggagattcggtcagatgtttctgatgtggttgccgcagatgagtttgagtataaggatcctgttgatggttctgtctccaagcatcagggtgtccggtacctcttcggagatggttcccggctggtatggtcccattctgttattgtttgttgaccttataatatccttcattttgtttcttgaaccaaagcaaatgaagtagcacaatttggcattgcaaattcgggtgtttatcgcagagtgtgagtgcaacaaatactggtgaactgaccattagttcctcaaattctaggtgttccgcctctctggaactggctctgttggtgctactatccgtgtctacatcgagcagtatgagaaggattcttccaagaccggcagggattcgcaggatgcccttgctcctctggtaagacatccgcgctgtatattggctttgccttttggaccgttttccgagcaagtttgcggacctttttcttcagactttaattcagcaaatctgaccatctgctttatccaggttgatgttgcactgaagctgtcaaagatgcaagagtacactggccgatctgctcccaccgtcatcacataaacttttcaagagccattctagaatgcttttgaggctacccatgaactttctttatggcctcctgtttgatagcctttttacatctctccccgaataaacgtgtatgtatcaactgttctcgttttcttgccaatactgcgtttctgctgcaggtccggtaaagtgtgcggcgataatgttgtcagttctgaaactgaagagggtactttatataagcgatatatcgatgttttttttgcttatctgtaatgccgtttctagttatgatctctcattctcatgggatgccattcttgaccatccatgattacaaacaatccagaccccagtcacaggcagattatacgattaggtcgcagttgacgcagcttagggatctccgtgaccgacacgaaatctggttgtactccgaccgaaatcccacttcgactcggatttcttgggtatgtggttgtctatttaaccatagagaacagggggtgttacattggaaattgggagatcagatcgcatggacgagccgcgcgtcgcccccgtgccatgcctggccctgaagcacggcgctgactcggacaagccagtgctgttcagcatctcggacgcaacggccatcgacaacaatggcggcgtcgacatccccggcctgacgaacggcaacgcctgggtgacgccgcaggggtggatcctagtccgctcggcctcggacgcctccacgttcctgcagaacccccaggatcccgacggcaagatctccctgcctcatcttccccgtgaattgccgagcacctgctcctgccggctctccggcaagcctaacggcagcgaaagctgcatcgtgctcctcgtcgagactgaagaagatgtcactgtactctggtattgccgttttggcggcggcggcggcggcggcgagggtgaggggtgggtgaggcacgagtacgacgtcggcacgcagtgggacatccgcccgggcaaggagggccagcgcgagaaggtgccgatacgctcgatcgccgcttgccggggcaagttctacttcaacgccacgcccgagagcgtcggcgtgctggaattcaccccgacgccgacaacgccggtgttcggctccatcgcgatcgccgaccccctccccggtgggtacggcgtgctgggtgccgcgctggggttcctcgtcgaggccgaggatgacctgtacatggtgcgcctgttgctggaccgggacttcgagaccgtctacgacctcatcgtctacaaaatggatttctccgagcagcagtggcatgaagtggacgacattggtggccgcgcgttcttgctagctccggcctacttcggcgcttcacgtgcggctgatgaatgtgggttggaaaaggacagtgtttacgtcccttacgcacataagaagtgtttcgaggtgtgcaaggtagaagagaaaggagatatcgatgtggttaatctcatcgaagctccagatgcgaagatcgggatgtggatcatgcccactgattagccgtagtatacgtttcaattgttagcttgtttttttcggttctttaacctgtttttttgggccctcttgtaagtctatttaacaattaattggcttggtattatctacctcgagttcatgtggaagtgacaatttgcaaatctatgggcatctctatccaaatgatttggttcaggtttgttgtgctcaggttgatcctctgggttgcatcccataaaagtacaagctggttgactaggtctaccgtgagcttcaagtcaagtttatgtacgtcttaaaaaaaatcctatgaaagtggccagggatggagctagaacgaaataaagatgaatgccactcacttactttactatgtttttgactgaatttaagttgataatggtgactaagtttgaatttaaggttgcataaatggtaaaaatagatgaactctagctaaaaaattttcttgaccaagttcttggcaccccctatcttgataatgtagttatgtccctagaagtgacacaatttatcggaaccattgtgagggtttcctctcaactttaccctcctgctccaccatggtggaagccaccattgacatccttctgctcgccaccgtaccactatcagagcttcctagccatctttccctcagcgtctggatctgaaccttgccactcccgttctagccgtctccatcgccttacgggatggtcgacgccacatttggacaagccaaactggcgcccttagccttctcctctatgtattgagttggcggctcacatcaataaaagtgacaaaaaaatcaagaaattgtttctctccaatgtcgaaaatgtaagaagtgtagtaaagatggtgtttgaagacatctgaagtggtgtcgttttggggtgtccaaggtagcctaacccaccacacagtagggtactagggttaccctaatcacaataagtccgctctaccacaggtccaatcagaattagaactctagatcctgaggtatgcgctcacaccttctaatctgtactctctcattatcatttttcgatgtttgattaacccagagaaacaattttattgtcattattgaggagagtagatggtatctggaggtaccataaaattttgcgttgccattggtattgtcattgcaatagatctatttcatgagatgctgcaggtgatggcctcatgagaaatttgagagcacatcgcagttatttctgaattattggaagtttctaacagcaccagcgtcagagaacacacacacacagatttccaggggatcctctagaacgcgagaaagcaggcatgcaagccgggcgaggcgactcctcctcacttgccgttggattggccgtggccgtggccgtggctgggctcccagaggatggtggtctcggcgatcatggcggtcaccaggtacgggtccatgttggacgccggcctcctgtcctcgaagtaacctgacgaaacaaaccaaaccaaaaccgaaaatcaacacgcgaacatcaaaaatagcaggagaaatttctcccatcgatcaatggcgacgcctcctttacctttgccgtccttctcggtgtcccggccgacacgcaccgacgcgccgcggttcgctacgccctggatgaaacgaagcaagaaaaacgtcgccggagttaagcaaaggaggagcagaagcagagtactataaattgagttattttaccatctttgaagagataccataatataataattagagataactttatcatttattttttttccggctagatcgatatgtggttgtctattacgctagtacataatatagtaattagggataactttattatttatttttttcccggcaagatcgatatgtggccatccattacgctagtattattcatattccatcaaaaaaacaaaaaaataaaggaaaaagatttaatcactgctaaatgacgattatatacctctccgcgtcttttttttataataatgtccctccatatttttactaccgctaattagggttgtagtacaaatagatctaaacccttcgatcaaatgagattaatagttcagattattttctactaactgtagagagtaacgtagtggggctcaattttttttttttggtacctattaagactaaaatttttcactagagatgagtgtgacgagcgatcttgtcctacccagacgaagttgttgatgtcggcggtctcgtggcggccggtgaggcggcgctcgttgccgtcgccgtaggcggcgatgtgctcacggtggcgcatgccaagcttcttgatcgctttcttgatcacctcgtagccgccattgctcctcatcgacttggtgctgcaaccgcaggtcacatactcacattgcagcacgggattttgcagaaatgcaggtgattttttatcttattttgcaggatttgaagatgatttcttgcttacctgtagttggtgtgagcaccggcgccattccagtctccctgcagcgtatgttcatacagattcagagatgacatgtttatgtgcaatgagaatcagtgagcagatcagattgaaaatgtttggtgaaatgtgtgtgttcaccggaatgggcttggggtcgaaggacacgacgacgccagcaatctcagtgatcctctgtaatccaaagaagagcatgtcttatcagcccaaaaaaaaaaaaccaatgcaagaattttgcaggattccaaaggttaaaaaatgtaaaaaaaaagatgatggaatcaaaattttccagcgaaatccatgtgttcagattttgtacgtttgttttttcagtctacctcaagaatgtagcgtgccacccagacatgatcccctgcggagacgccaacgacagggccaatctggaactcccactgctcacaaaatcgcacatcaaacgcatgatcagctcatggacaaagtgtcgggaaaaaaatggcacagaaacgcgaggtgtgcagaattcagaaatgtgttctacctgccccggcatgacttctgcgttgatcccgctgatgttgatgccggcaaacaggcaggccttgtagtgggcatcaacgatgtcgcgcccgtacgatttatcggctcccgccgcacagtagtacggaccctatcacaccattttcgttgttcaagattcagtgccgaagatgtaaaccatttccattatgtttttaaaaaaattgactagcaaacattgctggtcaggttatcagcaagtgaaatgaataaaattcagtatgtaaatgtaattcttctcttccttgttaatgatttaggtaacaactggtattttaacataaaaaggacaataataactgataaatttctctagtttgaaaaaacaagagaagaaatttgttgtggttgagatgcaatactgaaagtgtataagaagttcagaattacctgagggcctggatagccacctagtggccagccaagaggccagttgatgtgcttctgaagaagggtgtactcctgctcaatcccatacctgatttttgatttggcaaccaacataagttccatttgacatcaggattacatctctgaataacaaagatatatactgaccatggctcttcagccttgacatcaggatgactgaagatccttgctgcattgtaccggttgttcgtcggaatcggctcgccattcggcgcataacagtcacacatgacctacatttacagcatggttaaaaaggaatcatgaacaaaaattcatgccagaagctttttgtaactatgaatcagaaaagaggggaaaaaattcttctaccaggatgttctttccctttctgaatgggtctctgaagatggcttgagggcttgtcacaaaaatgtgaaaggtacatcagtgtaatgcacacacaccaaggtgtaatcaaatcaaagagtacaaacaagaagcatactggaggatgacttcactgtcgtcaccggtagcctgaccggtgctgaagccatcaaagttccactttggaagcttgcttgggtcatcaacaggtccagacaacgtctgatcagaggcagtaatcacaagtcacaacaactttcaggtaattactgggtcattgctccaagttttcagatatcaagagaaggattaaaggatatatatatcagggtgtaaagagagtgtttgtactctggctttgctcctcacatccatcccagtaccaccaaccctgaattatgggaacacatggtgtgattaggagcagattggtaagtataaacaacatgcttacgtgattaacctcttttaaatgtaaaatactaagtaaagatccggcattctgggataaggagactaggagaacaaccatgaaaaggaattgatgatgattcagaattagatgaatcctataatcaaatcaagaacctgtagaaacatgcagttcatgatctctttaaacaacttactcacaaataaacacgcctaataaaaaaaaatcaaagggcgtcagtgaaatacctgaaaggcaatcacaaaaaaaaaaaaaaattagggccggtttttgcggcctttatcggcacnngctgnagtgncttataacagtgattacacggc

SEQ ID NO: 82422 - DNA, 1878 bp, Oryza sativa
ttgaagatgtctcggagaggttggtttcgtcgctgccgtcaaggtttgcctgtggaatggagtcgcccgctgcaggagtcaagtcttcaggcttagctcgcttgtatcttttccgctgcatttgtaatcttttatatttttgtaaggcgtgggtctgtatgtcaacaattgtcgtttgtgtaccctggctggtcctggacaggggtttaatacacattcagcttagaaattctggttcgtgaatttctgggcgtgacaagttggtatcagagccgaccttgaccgtaggacaagccaaatgaaaaaacctaagagccctctgaatccttttcattgcatatgttctttgcaattggatttgttccgggaaaattgggatctgttcttgtggttcaagggaaaaatcttggtcgctcgtttaagtggggtttttcaaaacaagtcagtctagggttttagtaaaattattgggatttattcgtcagacagttggggtttgatgggtgaaatgcattaggtcctagctctataacatgggttgcaaggtgtttatgcttcgtttgttattattaatatgtatctaatttctcattattttgtcgttatgtgagtctgtcttatttattcgctctcatgcaaaatgatctatgcataaaatttcgcttttattcgtttcccttatttgagtcttttattgctttatttaaatttggatttgagcatgcattgattcctatccctctgtactctttagatgtcagacctattctccgatcgcaagcgccgctccaagcttcagagtcgccacccttagctttatcgtcttcttagtctgtttgcgtgctagtttttgtgtttaggtttgttgcttgtgggttagtcggcggtcgatatcatgtgtgagtggtatgacagcctttattaggagttgtgtgcctctttttcagtgttttaatcaagattaagataatggcacttaatcttataagaaagattagtttccgagccgtctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgataacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaaaaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacctgcacgagttcaaccgccttgcgcgctacgctcctgaggacgtgcgctccgataccgagaagcaggagaagtttttgtttgggctcgatgatgaattggccaaccagctaatctccggagtctatgaggactttgagaagctcgtggacaaggctatgcgccaggaagagcaacgcaacaaaatgtaccgaaaaagaacggcagctcagatcagttttcctcaagggaacaatcagaagcctcgcttcatgacgg

SEQ ID NO: 82423 - DNA, 4990 bp, Oryza sativa
ccccttgccgctttccccttgcggccgcggcgtcatgtttcggcggagccgggttcatgcggtgcccgtgccccagccgccccgcctcgtggccgtccgatcggctttgggccgatccgggccgtcggttcccgtggaccggcggtggaccgcctcggtggtcccggtccacggtggaccggcgcccttgtgccgctgaccggtggggcccgcttgccggcgccgcccctcccccttgatgacgtcagcgaggtccatttcctttgtaaaaataaataataattgcgcaataaatcgagtttaattctagaaattcattaaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagatcgcggtcgcgaggaaaagagttcggaaaatccaagtgaagaagcaaggcaagtcacacattccccttgagcatgttgatcccaatttataaatgttttaccgtttgcaaataaacatgcatgtcttgctaattacatgggaatagggtttacctatctgctcgcttgtgccatgtttacttgatatctgttctttgtcaaccttgggtaataaattgactagctcatgttacttatgtgacctagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggctggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgcgacagccgtcggcccgacgtctgcaccacatctgccgcgctccgacaggagacacgacgtagtagtgcggcagcacgtgcacggaagttgcgaaggacactcgccacgtcgtcagacctgacgactggaggtctcgcctctagtctttgcagcagggtgtcggactccacgtgaacgtgctcaacaaattccgcctgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactaggtgaaccaattgcacatttattagacatactgaactacttgctaactttttaaaaatattgaactagttgctcaaattccacaaataaacacgtaccattgacttgtaagctgatctaggctgaggggcaaacgtgtcagtaatcgctgcctggtgggggacggtgctacttctcgtttgtaggatggtataaagcaccgtaccactcgtagatatacatctgcgggtacgcaatcgaagagtaatgctccataataactcccatcgtctggaggtgtctgaagtgccaagttatcagctgcgtgctcccactcttgtaccgtcggctgaaccgtggtcacaataactagctcgtaggaaagcccgagcccctttctgaagtacctgcacaacaacaaattcacacatcagaaaaaatgttgtgcagtgatttattttaaaaaatgtaggattaaacaactgtgatgtgaactaacctatgaagactatctgccaaaggacgaccatctctcggagggaagtcctgatacatgcccaactgtttgagaaccctgtggacattgtgtggctcgacgtgcacgtccagcacgaggtgacaagtcgtcctccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactgcggctgtaacaagtagtagttttcattagtcatataaggaaagtttgtgaactagtattcataatgataacataaacgaatttaacaaaaattacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctggttcctcacgcaagcatcacacagtccggcatatgtcgccgcaagtaccgccgacccccaactgtactgtggaatctccgcgataggtaactctgcaatctgctccgcaaagtggatgaagtgcttgtccacggagtcagcgtgagttcccgtgaacatcacccatccaaacaaccacaacaggtaagcgcttaagtgccgctgcacgatccactcctcctggtcatcagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagctatcggcagccccaacaaataagacacatcctgcagagtgggcaccatctctccaactgtgaggtggaaagtgtgggtctcaggcctccatctatcgacaagagcactcataagcgccgcgtcaatgtggattcgttcggaccttgcacgtgaaggctcgaccaaccgtgcaaacgtcaacaacccagctgctctcagcctacaacatgacagagcgcaagttattaatacatgaaaatataaacaccttgtattagtaaaaacaatatattttcacacaccttggaacccaacgaggatcaatacgccaatattgatccggtcctcgcatctttagcacattgcagaaagttcctgtagtaagacgtcgcgatcgatggttcctatcgatctccttgtctatcagctgcccatcattttgatcagccatacctacagatcgaaaaccacattagtacattgcacgtatggtaacagtgcaataaatgtatgcaacataattcaattaacaaatttgcatgccatttcaatttaaaattacagtaccagcacacatagatacagataagaatagttcagtacatttcaatttaaaattacaagcccacgacacatatattacgatattacaagtgcagtgcagttcgaaatttaaattacaattccaatacaaatacatgacgatattaaaagtgcagtgcagttcaaaatgaaaattacaaggccattacaaatagattcgggtaataaaagtgcaagaaagttcaaattaaaattacagacgcactaaacataaattgaacgataacgatcttcaaagtagggagtccaccaaggatagtagcgaactaaggattatttttcttcttcgacttcccctttggaacgcgacgaacatcagcgcctgtggcatcatgccctacattgtacatgctgcaatctttacgggaatggttctccccgcaaagaatgcaagctttcttacgacgagaacgatctttcactttagcttcatccataaggttcttgatcctgcgtgactggcgacgacccttagtatcaactaataaatttgagtcaggaacccaattggcttgtcctggaggaggacgagtgaaatcacacacggcacgccaaccacgcaattcaccacgccaagttgcctcccacgattcctttctaaagtagggagaaacaaaaatgtttccatcaacacccccttttgcggaagcagcaagaacatgggaacatggccga

SEQ ID NO: 82424 - DNA, 4242 bp, Oryza sativa
tgacaccgttgactttttagcacatgtttgaccgttcgtcttattcaaaaaaattatgaaatatgtaaaactatatgtgtacatgagagtatatttaacaataaatcaaatgatatgaaaagaataaataattacttaatttttttaaataagacgaatgatcaaacacgtactaaaaagtcaacggtgtcaaacattttgaaacggagagagtacatccgattggtaggatggccacgggagttgccatgcatcccattgaccagggatgaaccggccatcgtgtggcccattcattcattgacttgccttagtccggctggaccaaaggcggtttattgcccggttcatcacaaaaccggccgccaacctctggttccgatttttttccggttaaactgtcagtccgttccagttttttttccactatgcaattaacgccatgttgtagaaaaccaccgtacaacttgccaataaggtagcttccttcttctttcttttttttttttgagaactaggttagcttccttctagagctccttgtacgacctcgttggaaaactcattgttggacctaattcatcactctttttatttcaaactaaagggtttcctttttagacttttctaattgttccaaactaatagaggtggcatcaatcaaatttgctctttcttgtcctatctaagagtatcttgatgaaactcttatctttatcgactttcgtaatcaaaattttagttttttcaagctgctcaatggtcactttacgacatgattagtgttatgctcggtattattgtagttgagggagaataagtgtaacttccgttcatgatcggcccgttaagaatttagacccattagtcccacccccaactcccttttcttttcttcctttttggccaaattttcaaatttctggtggatacactgcacgcccggggaattttctgtcgaaaaattgtataggtaatccctaataaatttctaaatgtgcttggctgattccttttcttctcgatcgatcccgttattcctttttaatcttttcttgtgcggaattgcagcactttttctctgcttgatcacaacgcagcaaggacatgagaatacgtgagattctccgggcgatggagctgcaccgtgtgctttgctatcgtctcgcgtcgcgctcgcctgcaataatacggcagccagatcgagatggttcccaaaacgactagaaacggaatcacgtaaagcaccatggatggatggaatcaccttttccccaggaaagcgcaagtgtggaatggcatcatctatcctaccaagttcctaagcccctgaccatgcagtgcacgaataatgcacatcgatcagctatctagagagagagagagagagagagagagagatagatagcatctcgatcagtgctactgatcaatcgatcatcccctataaatcccccatcccattgccatgcatagaggcagcacatcaacgatcgaacgaacaacgcactctgcagctagctatacaatctctgtttaattagctaggtagctagcgagtcataaatcaagaagccatggacttttacgggcggcgcgagcagtacggcgggtatggcgggtacggtggcggcggcgccctggcgacgccggggtacgcgccggcggcgccgtacgggatgtcgcaggtgaacatcgaggggaacgggtgtggcaggacgctgccgccgcagccgacggtgaaggtgtactgccgggcgaacccgaactacgcgatgacggcgcggaacggcgcggtggtgctggcgccggcgaaccccaaggacgagtaccagcattggatcaaggacatgaggtggagcaccagcatcaaggacgaggagggctaccctgccttcgccctcgtcaacaaggccaccggccaggccatcaagcactccctcggccagtcacaccctgtaagctagtctcagcgttctttctctgaatctgaatccgccggccattgatggcgatcgacgacgatgctcttgcgtgcaggtgaggctggtgccgtacaacccggaggtgatggacgagtcggtgctgtggacggagagccgcgacgtggggaacgggttcaggtgcatccgcatggtgaacaacatctacctcaacttcgacgccttccacggcgacaagtaccacggcggcgtccgcgacggcaccgacatcgtgctctggaagtggtgcgagggcgacaaccagcgctggaagatccagccctactactgagctgatcgatacatcgatccagctctctatcaaggctcaagttgatatcaacgaatctggtgcagaataattattctctgctagctacccacctatatacgtagctaagagtaacttatgctcgtccgtaccgtatgattatcgtgtggtgtgcttgtatcttgtacaagttaattaattacctggcaataagagctcctctcgctgggcgacacatatataaacacatacagttggggcttgattcaacttgcatatatgctgtgcatatgcgcacgaatttttcaggtcatcggactacgcacactatttttagaaacattaatttcaaaaacagcgctagatagaaattccggatttcaactaaagaaatgttaatggatggcaagcaggctttaacaggccatatgggctgtgacgtcggaccgttccatattggaataagttcacttaccgtcccacataccttatttcttctattttttttctcttttcttatctttcttctcttctcttctcctttcctctccaatcttctcgatgcacagccggcagcagatggcacggctgtcgccactccgctccgccggccgcgtgctcacccgccttctccggtcactcgccgccggggttacttattccttccgaattactcgtgttgtgttaacgggctattcttggaggatgtgtggtccaagaccagcccggggttgctgattgttaatgggcccgccaagctctacgatagaacattcatggtcctctgttgggccatcacctagtaacaggccccactttgggccgtcagttgttatctctgttcgatattgggctgtaactgggacaaatcgcatccgaggaaagaagcggagtgtccttctgttcagcgtctctcctctcctcaagacacgatcgccgccgcccgccggagagaaggccggccggttcgacttcgacgcggcacaagttcgccaccagttccgtccatcccaattgaaattcaggccctccctcctctcatcttgtccttccatcttttcatcatttccaaccgtgtgaggttagtggtaactggtaagatccatgaaaatctgcaaattttgtgcttcccacccaatttatcgatcttattttttgtgttatgtacttgtgatttatccattcttctggtagttatcacacctcagatatttttcaagtcagttcatggatgatccagacactttgaggaaaaagacgacgacgattgtgccacaagttaaagacggccaaaagcgtcagctgcatgactgcatcagaaattgacaatgcccttgcgaattggatagctcttcttcatcttcatcttcatccaggttgctccccttctgttgtgtctagatatttttttcgatgctgaactactcttttcaatcgctgttcttttcccaacctgacgtgtcaagttctgtagttgagtttccaaactctctgtcaagacatggcttttctttaccaatccgaattgtccagttctgcaattcacttccaaattcaaccctatcaggattttaccgttttgttctgatggtaaacaagtgtatagctgattcctgcgtaacaatatccgtaacgactctatccgtctgtacaagacaaagatgacaccctcatgtgagtgcagtgacaaggacctactacagccatgcgttaccttccaactcgcaatattgagcccactacgccgttgcctactcttccatgacaaaagaatcatgctctaccttacccatgatctctcaataatactacaaattggcaccgctgtacccaattgatggaacagaacaatcaacaatgcaattcgtattgctctcattttgattaggcagcagtaaccttcttcctgaatcatgacatggtgtaaagcagcatccagatccaagtaccgacattttcgacacaaccaagtacactcattcagaactc

SEQ ID NO: 82425 - DNA, 741 bp, Oryza sativa
ttcctgcagcccttggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagtgcataacctcttatatatatttttttcatttacatttggccgggtaaatttaaatgaaatgtacataaaaaagataagagtgaaattacaacaatatagactatgtggtattatgctgaatgatctccaaacggccagaaggagccattcatatggttggaatcgtaaccctgcaaataaaaatggagaaatatttcagttcaaaagacaacatggagacatcgcatgcacagttgcacactcatgtttcaaccataaaaatgtgatgcgggcaccatacaagattgtttcagttgaaatctagcaacaataccagcaaagcacaaacaaccaaactattaacactcattaaaatcgtctagcaagggtactgagattgctgatttgttaagaaaactataccataaagacagagttaacctcacttatctgctggagtctgagaattattcttttggcaagtaaatcccaattactactaacactggcaagtgtggtagatcatgaatgtggataaaagttacactaacatcagaatatatggaacaaagagcaaccaagtattaactaaatctgaaagag

SEQ ID NO: 82426 - DNA, 838 bp, Oryza sativa
gtgaatttagatttgcagtatataacttacaaatgacacctgttgccctgttggaacacaggttctccaaaaaaattggaatacaaaacacagcatacacacaagaggaaagtcacacctacttgatgatctgagatgctgttgttgaagctactcttgtctggtgctgcaaaaggaagaacagcaattcattatccaacaaagcgcagcgcctaaggttcaaaccatggggcagaatgtaatgtagaatagacagtgttaaaccccccaaaattgcatgacctataaacaattctgaaatagcccatgaccagccaattgaaatctctcctaccatccaccatctctgttgactaacaaacaaattttccggtgagccagtgcagatctaggaggaaggcactaggagggcaaggactcgtaccctcgggggtgtcgctatcggagaactccttgtcgagcacgcggccgaacatctcggcgatgctgccgtccccggtggcgttgcccgagccgttggtgaccagtttcccgtagaacttctcccgcatctccttgtcgggcctcgccgcggcggagcggagctgcaccccgaggacgagcgcgagggccaccaggagcagcgcggcggtggagcgccggcgagacaagggtacccgtcccgcggccgccggggccatcggatcggtccggcggcggctcgaccgaccggccgaggcggaggaggcggaggaggaggccgcggcggcggcgggagggggagagattcgcgggtggcgcgtcggggtcggtggattttgattccgcgggaagattggtgtggttggcgcggtggcgg

SEQ ID NO: 82427 - DNA, 921 bp, Oryza sativa
acatggattgctgtcattttcaaactaagtttgttatgtattgtaagctattgttttacaaatgcactttacatgtcaagggcgcgtggaactttcatgatatatccagacagatatttgtatgtgtaaagtgagttatgaaaaatatattagttatcaataactgcttacgttcaaatgagatatgtagtaaagtgcccttacgacgacatgtctaatactacaacggtttagacattccgtgttaaaaatcttatcatagcctttaagaacgtcatcgattttatgaccactttggaaaaaaatctgaaagattagcttgcgtttattttgccaaggagttaaaaaacacgttagagagaaaaaatcacgaaaggaaacgaaatcgtgacagaggagacattatttctcataacagctcagctaacacgtattgacaacgatttgcctataaaactagctagatttttctcacggtcctagatggaagaacgaaaggacatttaggaggcagaacataaatgaaaatagccccttgctagcatcaaaccatggatcgattgtatcacggcggtcatcaacgataccagcaaagaacgaaatgcctacctattcactctcaggatagagcagcggctatattttgtgactttaggtgaaaacagatgaaaccgatatgcatgggcattaatgtggactattaagcatatatgaattttatttaggcagcaatgcttaatgtttttaacttataaattgatatttccgcgaccaggccttcaaatatgaaaatttaacttcatgttacgcggagcgtcttgtttcggtgacaaggtaagattgaattaacaatgatatggcaaatggtcccatcgatacttacattttgaatagtggatttataaccgctctaggttgggc

SEQ ID NO: 82428 - DNA, 11201 bp, Oryza sativa
cggtaccctgaaatttcctggttgttgtctttcaatccactatgcttctcacaaactgcatgcaacaaaaatcattgtttattgcatagtaacattaaatatacaaaacaaccagcactgaacaactcgaagtacatttagtggcgtgagtttacttctattttgttacaacgtccatttcaccctatcaacattcagttagttcaggctgttcacgtttttctttcaataaaggttcatcagtacaaatgtggcagtacaggcaagatggaaaaatgaatgccaactacagtctacagtaccaagcgatgttgcaatagctaaaatttgaaatctaggcatgggtattcaatgaacatccccatcacagtaacatgacaatttgcaagagaaactgcattaaattgtagtatcgaaatggttaacagaactagtatatatgtagtgaaaatggcggtacaattaaaacatatgtggcaaagcaatagcaggtgatatttatagccacagatttggtaaaccggaataccatgaatgcaagtttatcagaggaaagagtgccttacattgttgatgatcagcagctaagctctccgtggtttccccatctatctcgcagctgaatccatcctcaatacaatcctgagagaggactaacgcagtaatttcttcgtcgatcatcttactaaccatatcacccaccttgtcatcatcatcagaggacaccgcggatttatcctcactggtgttagccatgttcttcagcaccacattgcgctgcttcgaagttacatgatccattgcatcattcccttcaccacgggattcatatgatactgcactctttctgacatttgacaaatcagctgattcaagaggcaccagctgcaggacattgccaacaatctcggcacattgagctgccaagccagccatggcgccgatcgggtcctcctccaatggcttctcatcgaagagctcgatcacagggccctcctcggacacgaagaccagatcgcgattgagatttgccatgccggcgtctctcctgtggccacagtccacgtcgcacgccgccggcgcggggaacaagaacggcggcgagatgaagccgctctcgagcgcgacgccgcagcacgcgcatgccaggtcccgctcgccgagctcgctccgcctcatccacgacgacgccgccgccgccgcggaggcggacacgcagtcctcgcacatgtccccggcgtccgcgagccgccggtgcgcgcggcagtagccgaggcgcgacacctcggcggcgtgcgagtcgcacagcacgcggcacaggggctccgcgccggcgccctgcccctcgccgcggggctcgaagaggctgtccacgccgaggcgggagcagagggcgcacgcggcgccaggccgaagaaggcggcgaacctcgatatgaggtaggagaagacgccattggcgagaggagagctatcaggatccactcgaggagcgcgtaggcgagcacccgcgcgacccggttgctcctcttgcacagcgccgcggtgacgacgacggcgcccgccgccatgggcgcctccgagaccatctccccagctctcggtgttctcgccagccagggaacaaaatgcgatcaaaagatgccaaattcgcccgcccagaattcgccgtgtaatcgaagaaaagcacagaaattccttccttttggcgctaaatccctcggcgcccgtcgccaatcggattgaaacaaagcaaagaacacgatccaaccacgatttctcctagaacaacaagccactcccacaaactgccgatttcttctcgttcgatgaagagaaacagcaaataaaaacaaaaaacaaagccttgctcctccacttgctccttctaaaaagctgaacaagaacctcctcaagactatcaatccggattgcaacaaagaagactttttttacagatggaatctgggattgcgaacgagatcagagaacctatagagattgaaatctttgataacgcggggaagaagtgggactagtgacagtgacaggatgatatcatctaagtattcacaagaacagtgagaagagggggagaagaggaggaggaaggaaaggggagtttggtgaaaagctcctctataggcagagaaagccggaagccttggaagcagaaaaatatcaccagtggaaaaagaaaaataaaagaaaaacaaagctctgtgtgtgtgtgggtggattgttgagctactaatccgcattattaagccctaatggcgcgtaatcaagccgccctagacgagcacacagtcgaacgttgggggtgacgccataattagctggtaattgctctgtttggaaaaggttaatgacactcttttgactgtgctcgtgacaggattaaggcggtgaattcagacattactacgcagcaaagaaaaaaatgacccgttacaccgtacacgcagtactgcttttcatttttttttcttctcttatcttttcctcacggccacaggtacacagattcagattctgctccgtcgcattcggacggcgacgtcggcgaagtgagtaaccgaccagtaaaaaagaaagaaagaactaaacgaaaactataggccgtttcgtagccgaagacgaccggatcagtggatcgtccgttgttctagcgctgccctgacctgaaggagtcgcgatccggaagaacgtggcggcgattaagggggaaatcctgccgcatttgaccgggctggagcaggaggggcttggacaagccactcctttccttgtgcgacttttggtggtgaggggcgtgcggatcagtggatgggttctgaattctgaaactgtctgaacattccgccagtcttatagatttatcttcagtattgctaaatctctgtcgccacattttgggttcgatttcagtcggatagtctgacccgcatgatgcgcttgcgagcgtcgtgggtgactcacgtccgtagatcacggccggcatgggcagagatatccctcgcttctcttttttagtttaactttttatatatttacacaaatttatacaatagttacattgcacttacacaccacttacatatataattttgtagtttacatatgtaattttaggacttacatatgtaattttgagacttacattataaatgcactaaaattacatatgtactttagagatttacaatgtaaatatatgccgactatttttttttgatgaaaaatatggcgccataaatatagtcactccctttatctttttgtttatgcttcgcttatcagcaaaaaattaaacttcgatcttaaatttaaagaattttggtttttttttcagtcgtagtttattttttttagcattttttttagatcgttaagattatatatatatatattttatttataaaatttttttgtttgtgaatatgtcatttcgcctttttctcaaatcagccaatcgatgtggctgttaagccacgtacatgcatcatgcaagtgtttttggtgggtggattggctgagaactttaggccaagctgaattttgtgctgaaatagcgcaagtgtgcttgaattgaacccactctgaatgataagagttcgtcccggaaagaatgcatgaacattataggatttattagttaattctcaccaaaaccttctgtttcaaagaaggcgttcagccctcaacagctcaatataaaaattttgggttatcaattgatagataatctattttttataactattaaccggtacgaacgaatgaatttaatattaaaaattatatataaaaagcttttgtaaaaaaaaaacatcgcttctaagaggcgtacgaacaaaatccagaatctacaagacatacccttggttaactctccaggtgagcttgcactgaaacgaacaattctcacgcacattcagctcaagcaaaaaatcacacttgggtaatttgggtacaaaggattcaatgttgagtaattcagtgatgagttgcgacaggtcaggtggggcgcgacatttgaatgcattggatcaagcaagcacgtggacgaacggacaaacggaaaatcaaacagtgaagagctggaatcaagtcatctgctgttggcagagacaaaaacagcggggatttcagaacccaagaagctgaactgccctataaaacacacacgtggtagccatttgtgtttgctgcaagttcggcaatctagaggcaagtttggtctgtcttgccgtattgcacgttattttagttacagacgaaaaagaattatttcttgttgcagtttgcagtatatgctatattttaccgtcaaagttttttttttttaactatcactaccaccaccaccattgacatgtgggaccatgaggtacgctacagcagcaccaccattgatatatggggtcatgaggtacactacatgagatcattgtactaagtaacccctaaaaaacaggtggtctacgtttttctttttaatatgaagaatcttatttgaaccaggtagagataagtattccctttttaaccatgagaactacttttttttctatcttctacaatccgttgcaacacacagttatttggctagttcttaaaatatagctaacaaaatgcaccatagagccaaacttgtccattataacttcgtaagtgaaataaaaagggcatatttatgccaaaatatgtcattttgtacatccaaacagtcttcagaatatattccgagcactggttctactataagatattagaaaaaaacatataaaattatagtataatattataaaacacttatataaattttacacataagatgcatttaatcaaaacatttagaaagatattgattctaaaaaaattaaaaataatgatttcaaatatgccccaaatcatatatttttataactgataagcatcttacgatagtaaatccatacgataaaatgtcccgctacaattggcatgtggggagcttcctgtaatttattttaaaatcaaaagcttcctcaaacaacataatccaaaaaaaaaaacgaaggcaaaagcttgtttttttagcttctccaaattccagcccaccagttgcttgttataatctaaatttaaagctcttctaactggcccaatatcttgatgccagccattcctctgacatcatcataagtgagtgaatgggaatgttaatagagaattggtctaatgctatgccattaataaaatggatatttatctaaagaaataaaatggatattgaggtcccctagtatcttttgctttcggctactcatccatcggtgacaattgacgagcgcctaagtgtggctttatctgtagctttccagcgtccagctctctaaagctcatctttactttgctcgcacgtacgtattcccaataatttttttttaaaaaaaaactattaggcgtaacagggaccaaaaagaatccgcattcagattaatttagtatccctggaatttttctgtacttttcaaaacaggatgactcgagaaaaaaatatcacttcatcgaagatgtcgtgatggtgcatcattacaatgttagtgcacgcacgtgtaaagcttggaaaaaaatattaatgctactagtattattggaaacaggaaatgtacatctagaatcatgtcaggggatggtgagagtgtctgttttgttgtccaattcaacaaataacttaaaattatcagtgccaaaaaaagaaaagataattttgtttgcctataccctttcaaaatagagaagcaaatcaaacaaccataattcactaaagtttaatgagtcaatgacccaaccaaatccaatatcttcagctccagcactccagcatcaactggctttgtgatgtttataaaaggaataattaatgctagtattactgaaaacaagaaatatgtacacctagaatcatgtaaagggataatgagagtgtttgttttgttgaccaattaaactataatttagaattaacaatgccgaaaaaaactagatacttacatatcttggttgcctgtacatttccaaaactgatagcaaatcaaataaccataattaactaaaatttaatgagtcaatgacccagccaaaccaatatgtccagctccagcactccagtatcaactggatttgtgatgttcatttgttagaacttagagctaaaatcacattatttgttgaacacaatataatggttcaacacaatcaacaactaaaacaaaacggttttcttagaggaccaagtaaaatggtgaccgcagagcgagcagaacagcccagagcccactagacaaacgatttggacaaacaaattgaccatatcataggtttggatgcaaccggaccgactaccaaggacaaaaacaacggtcaagcacagaagggtagtactattaggattttaaatgagcaaataccaataaaagaggttttaacataggaataaagagtggccaatttcaggatctgatgtaattgtgcatctagtttactagttgtaaatttcattgtcagatgaaattatctatgtcactcagcatagttttttttttccaacatgtgggtcttccgccaccctcttcctccctggtgtcgcctctagcatctatggaaccgccatgccatatttaatcccctatgccgctctctcctcctcataacccaaatgtatcaccactttatcttatctgattccgatacttcaatttcaataacgagtttcactagttgccaacaccaccccaccgcccctcctcctctgccacggctaacgaggtaccaccgtaccacggccgcctcgcagctctgctatggccacctgccatccccctccccctttgcctgacctcaaaacctaacacttgagagctcaaactattacgactaaaaaaaagtgagatttgaagggagagacatccctccaaatatttttttaagaagaaaatgtgagtgcgtcgggattgaacacaagaccttagggttgaaaaccacacacctcttatcacccgcactattaaatgcatctaaaactactattccatctgtcccaaaaaaggtgaatctaagactggatgtggcatattctagtacaacgaatttggacagatgtatgttcagattcatcgtattaggaggtgtcacatccggtactaggtaggtttttttatgggacgaagagagtacgactgaagcatgaatcaaagaataaggggatgtttggttgatgcctaaccttgccataactaagtttaggcatggtggcacaaatgtggcttagaaatagttagccacaagtgtggcatacttagctctaaatttgagagcatgacatgtgggtcccaaagttaagaaagtgtggcataacacaattgcggcagcgaaccaaacacatgcctaaaaaactgtagcatgactaaagtgtggcgtggcaaagtgtggtaaccaaccaaacagcccctaaatcgcaaggttaacgatttcatgtggttttgcccaaaaatgtctgtcgaagcgatgtagagcatttccgatattagatctatcgttgttgtacgccagtttcaggatacatgtattgtgtgacttgtgtccaagtattcactcccaaaaatgaagacaagatttcctaggtaccgagaaataatgctaccaagttatagttcacagcagccgcacacctgacaactcaaaggtaatccatggaatcttcatcgcaccatgacaaattgacagttgacaaaaaatgagatgatctggcaaccttctgccgtatgagaccatttgcattatgcagttctgctcaagatgcaacaaagttacaacaggacattagtggacaatttcataactgggattgacacgcggagatcatttcaaattattctcgaaatgcacggactgcaaatcattttacatttgctacggtcaaacgtataccgaaccttacaggttttgactaacttcagtcatcactgccactcaaacgtatactcgattgatctgtttctttctgttgtcacaggacgggggaaaaacagattaaaactgcaaatggtgcatctttttatctttttgaacacatagcggttctcttatctgagtacatatgtcatgcttgaaattgtaactgtcgttcaagacctttggtcgattgcatggtgtgctgagaccactggaaaccaacagtacttacacaggaaaatacaccagttaggaaccataaaaaatatgaataatacatagtgcaaacaaaaacacattcgattgagagttgagaacatggatgtcccgaccttttgccaggtcaacaggacatttaaagtaaaccactgttcccaatatctcataataactgtacatgagccacaaatctgcctgccaaaaaaaaaaggctgcatggagcaccatcttactgaaaaatcaattcacttgcaaaacattacattaagcatgcacactgatatttagaatggcatgcttgtgtttagcacaaaaacatggaagagaagacagtcctctgacaaggggcctaacggagtgaaaacaaaagaggactgcattgctacacatcctgaaatggcacgcaaatgagatatgaagcttcatataagctaaccatgccaagcttcaattcaaaatagatacttcaaaagcatatcaatttagggactgtaatcagttatcatgagaaggcattctgatgttagtcaaactgggataccaaggcaccaattctacacattatcttcaatctgtgcaaagcaggtaatctgttggccctaatgctttctccacagtaaggcgattaactgctgcaagcacccagagatctatcaactgtgcagaccaatcactaccaagatccactacggaatttctatccgtgaactattggcaaatatataatgttttaactcaaaatacagttcacttcaaaatatcctagtcatggaaatattgttggatagtctgcgaggatggcagagcgattattattggcaaaacaaattctattcagcaatattccaaaaaacatctaactcagtaactcacaaacttgttcggattcaggcaagggttatatgcctctctaccctgttctccacttctcctcttggctctttcactagtataaatgtataatcaatgcaaaaccgtaaaaggcaactggtttaaaatggtcatctgatcgatgtcttaaagaatcaattagactcagcttacagaatgagctagaaaagaaacttttgactgctcctatcagtaccaaaacagaacaatatcattacttcatatgacaaccaaatgaaatgcagagacttcatactaactactcccaaatttctcacactcgtagagctatattatgagcatatttttataatataaaacattttctatgcaatgtcgtcaattgttcatgcttagttagtatagaaagcttaagcaattataggtatagcactgggattgggtaagaaaaaactcttgataaaagtggtttttttccaagggaagaggataaaagtggttgacaaggaaacaaaattctgttatttcacagcttataagtaataagttatggaagcaaaagaaggtgaatggatgaagctacatgaacaagttatcagaaacgtaaattaaaaataaaacgattgcaacagcaggcagctgtatagataacaatgctggaaccatatatattatgctgatgaaataattaaactaaaaggcaatatccgtagacgatgtacataggcataaataataggcatattaggctgactaaggcaaggcccaagctgagtgaggaactacaaaagcatatagcataataatctagattttaatattttatacacatggggtgaagggcggaagcacgtcaccaaaaccaccagtatgtccgcttagcgaccagccgctgcagcatcctcaacaagcaaccttagcctccggctcaacacatcaagctcatcaatcctctgtgctctccatcgccttgcaagttcactgcccccattcacattagcaccgtaggtaatgccattggccttcacctctcgcaagcactcctcaaatatatccagcacggcatttgccatgtgatgctcattgctacgtggcaccacggccttgccgttgccattctcactgtgaaccgcaatgtccccgatactggggagggcaggaagagtctcaggctgcaccttcacaatcccatcaaggcttccgtcagccgcaatcgcgacatctccatgataaccaaagtgcccactttcctgctcaagatacatcatttcctcaccaccgtgcccatccccaaatgcgccgggcgtaccggcgctaataccgccgttgtaatcatgggaattgctgtcccctgagggatccgggggcatgagcggcccggcgcgcggggcggcgcggcggcgcttgttccccgaggaggcgtcaccggcggcggcgaagggcgaggtggcggcgttggcggggtcccagaggcgggagcagaggtggagcacgtcgcggtcgtgcggcgcgaggcgggcggggtcgaggccccgtgcgacgcgggcggacatgccgcggaacttgttcttgaggcggcggagcttctcggagagctgggagcgggtgtagggcgagggcatggactcggagaagcggtcgtagaagacgttgaggtcccgcgggaagacgagcccctgcgcgccgcagccgaggaggccctgcaggaagcggagctcgtcggactcggaccaaatccgctggaacttgaacggcggcggcggctgctgaggctgctgcttggcggcggggtcggaggaggccgggtcggaggaggagggggagaaggggctctgcggcggggagcggcgcttgacggggagcttgcgggcggcggcggcggcggcggggggtgcggaggggtcgtccgcgtgcgggaggaggggtgcggtcgggtcaggagggttgggcgcggcggggggcagctcgaccgagaccgggacggggagggtttggtccgaggccatggcgacctagcgcgcgcgcgcacggatcgagcgagcgacgcaggcgagacgaggccacgagggggttgggttgcggcgcggcgcggccggacgggacggggcggacgggagggggaagggtggt

SEQ ID NO: 82429 - DNA, 14744 bp, Oryza sativa
  unsure (1)..(14744): unsure at all n locations
ccccgcgcgccgccggccactgcgcgcttatgacgaggaggagcccgcggtggcggcggtgtcccaccgcgcgtccccgtgcgccaccgccgaggaggagcccgccgcccaccgcgcgtccccgcgcgcccggtcggcctctacctctgtcgccggccgccgtcatcctcgggccccctccgccacctacaacttgctccgccccctgcgcgccgccgtcctcacctcacctcaccgccgccacgctcctccgccgcctccgcctccgcgccgacgtcctgagcgccaacgtatgcgccatcctcgctgactgcccacgctgaccgcccgtccccgcgccgtcctcgccgacagcccacgcccatcgctcgtccttgccatgtgcgtagcgcgagagagaaaagagcgagagaatagaaatagaggaaaaaagtatgataggtgggtcccacattttttattaaataaaatgctgactggattgccacatgtgcgccacgttggacaaaaccgctctggattgggtcgagggggtaatttgtccggtattaaaagtttaggggtaattcggacgaccccgatagttcggggttaattcgtactttttccaaaaaaaaaaaaaccaagcatccccgtgtacttagcatgtccatttgagatgatggcattagtggcccgtaccgtgcgatgctacattttgtccctgcctccggcggcacttgtcacactcttttcacgcgcgcattcttatatagttgaacctactaatccaaatccaatccaagttgtcacaaaaaaaaaaaacaagttgtcactttgttccgtgccaaattgactggtggaacgccccacggccccagcgaccaaccatcataggtcaagaaaccgtttaacccgcaccctaccaattagcgcgcgcgtacgaacaatcaagaacccagtggcacacgagtacgagtaatctagtaagtacactatggtactcccgatccgcgcgcccgaattaataggctggcagccgtcgccgttcacctcgttggacttggaccgcgtcgtcgtcggcgtctgctgcggcgcaccggcacggcggcacctcgcttagggcacccactataagctctctacaagagatcaatatcagcatatttttctatttagaagatattaaatgaagagatagagcaaagctgtctactaaattagagatagtctatagagaaaaacgaggcaatgcataagagagctatagatacccatgtagatatgctattgaggtggtttactattaatctagtttagaacaccttactttactattacggatgctcttaccgcccatcaattttccgcgccaaccccacgacgccgccgcccgctgccgggcgccggcctcggtggactcgcggcgcgacccaactaaaacggcggcacatggaacaccacgaattgatcgaatggcgaggcgaagcgtggccgcagaggccgaggcgtcgcgtcgcgtcgccgtcgcgctcgcgcaggtgtttggctgtggcctgtggtgcgccgcggtcgccgtcgcggcagattttccacggcctccacgtagaaacccattgattacacactctcccaagtcccaagtgcgtggcgtggtgcagctcctctcgaaatggacggcccattgcggagaacatggccccggactgggcctcttttcccggcacctttttcacggactttctgttattaacaacggcaggatttactcgctactgtagctttcagctggaagtttccaatgcgtaataaacttgactcctatggttgaaatggaatcaatccctccagggaaattgcatccaaattgacactagatttggatagtagtaccacttctcctaccataccccgaatctcccagaccatagtatgctggagccacccaaaaccgtcccgtccatctttgccactagtaaataacgcgcgtttttcttgaagcgttaagttgaaactccgaaacgtcatccacgcagaaggggttgtgtgtactcctacgccgcacggaaacgcaaccacacacttcttcggtcgcgcacctaacaaagtacccgcttctacgtcgtcgagcgtttaatgagtagccctcctcctcggcggcagtgatgacccaatcatccccccgggttcagaagccacgtctcgtcgtgcgtttaagccaagtataaggtagatgtgactaccacctctaaatttatctattttattcactcataaattaagaggcaacacatacaatgtatcacctctaatatacaaataccaatatctctaatactctcacacatttcttgaaatttgtgtggaagttgcctcttaatttaggggtggctcatcttatctctctccacttctctcctccaccttatcacccaatccaatgtagcgtttttagaggcaacatatgagatattatagtacttgccctaaagagaggatattttccactttctctgcgcactatttttaaacggttaaatggtgtattttctaaaaaatattttatagacaattcgtttaaaaacttatattaatcaacttttaaatttaaaataattactacctccgttttaggttataagacgttttaactttgatcaaagtcatactgctctaagtttgataaagtttataggaaaaaatattttcaaccaagataaatttattataaaaatatattaaattattgatttgatgacactaatttagtattatcaatattattatttttttaataaagttagttaaacttagagcagtttgactttaacaaagtcaaaacgttaacctaaaacctcatttttcgtatattccttcccaaacactaaaacgagaaaagtagctcgcggcgttgctgaagtacgtgaacggttcctgcctacccggccgcccaaagaaaaaaaaaatttctgctaatcggctgcgttggtcaacacggaaaacgcaatttcaccggaaaaaccttcaatgcgaggaagaaaaagaaacaaatacactacagtagtagtacgagtaaaatagttctttttttatactgctagtgctgttggtaggagaaaaagaaagatggaactggctgacatgcttgttacagcaggtacaatagcaggtataagccagttataaacatattttaaagagttaaaaaaagaagagaagagcagcgggctacagatctgtagccagctacagcacggactccaagatataatgtgtgtatgacaagtgggaccagatattaatagtatagtaaataactattgtatgaattggctattacattagctataaatgatttggatctagtagtggactatactattaaacttgctcttagagcaaggctaataatacagccgacctgctggctataaggttctttatagccttatcttagcctatccatataatagttagctcttcacaattaatacaggacccacttgtttctctcacagagttttttggttcttgtgtccaagccggctgttagtttacagtccgcttcttctctctctcctctcttctttcctccaactcagcatttaaccggcttatattctacaattatactcgctcttattgccagccagaataataaccgagtgaccggttaacccgggggcgcgggcccacttgtcagcgagccctcccagcacgcgcagcaaggcgcatttgttgtctcggctggatggctggcagagacagtcaatccaacagggcactctcccctaggcgtagcattgccagagtcatcgtacccagtcgcattccccttccccatcccggccaagcaaacgagatcccattaccattcccattcccacccgtgcgggcggcgccacccattcccattccctttcccaaccgcccgccaactcccggaataaatcccggcctcccaaagacggaaaaccccaactccccgaggcccattccgcaaaattcgcacgggagtttttagggtttttccgtttcgcccacctctctctctctctcttctcccccatccaccaccgcccacacacacacccacacacacaaccaaaagcgaaacaaaggcgcgcacgcgccgccctcctcctctcgcttcctcctctgcgcgccgccgggatgcgggcggcgtggcggccggcgagcggccgccgcgtggcgctggcggcgatggtggtgctgtccgtggtggtggcggcggcgatggcggacgacctggcgggggacgcgagggcgctgctggcgttcagggacgcggtggggaggcacgtggcgtggaacgggagcgacccgggcggagcgtgctcgtggacgggggtgacctgcgagggcggcagggtggcggtgctgcggctccccggggcggcgctggcggggcgggtgcccgaggggacgctcgggaacctgacggcgctgcacacgctcagcctccgcctcaacgcgctcgccggcgcgctcccgggcgacctcacctccgccgcggcgctccgcaacgtgttcctcaacgggaacaggctctccggcgagttcccgcgggcgttcctcgcgctccagggcctcgtccgcctcgccatcggcgggaacgacctgtcgggctccatcccacccgcgctgggcaacctcacgcggctcaaggttctcctcctcgagaacaaccgcttctccggcgagattcccgacctcaagcagccgctgcagcagttcaacgtgtcgttcaaccagctgaacggatccatcccggccacgctccgcaccatgccgcgctcggcgttcctggggacggggttgtgcgggggccccttggggccttgtcccggtgaggtctcgccttccccggctccgggcgaacagccggtgtcgccgactccggcgaacaacggcgacaagggcggaaatgggggtgaaagtggcaagaagagcaagaagctctctggtggcgccattgcaggaatcgccataggctccgccgtgggagccgcgcttctcctgttcctccttatttgcctctgctgcaggtcgggacgcaccaagacgcggtctatggagatgccgccgcctccgtcttcggctcctgccgttgtcgccgccggccgtaaaccacctgagatgaccagcgccgcggccgtagcacccatggccaccgtgggcaatcctcacgcccctctcggtcagtcgacttcagggaagaagctgatcttcttcgggtctgcggccgcagtggcgcccttcgacctggaggacctgctgcgtgcatccgccgaggtgcttgggaaaggcgcattcgggacgacgtacaaagctgttcttgaatccggggcgacggtggcagtgaagaggctcaaggatgtgaccctgaccgagccggagttccgtgaccggattgctgacattggcgagctgcagcacgagttcatcgttccccttcgtgcctattactacagcaaagacgagaagctgctcgtctacgacttcatgcccatgggcagcctctctgcggttttgcatggtgagaacttgacagttgtattttgttgtgattcttaattcacaatgaaatgttattcttgtgtttgttagtactatgatgcattgttatttggtggtgatgataagagtggcgcttgattgttttgtggctattactttttcctttcctcgtttgactattcatctgccggttttagactctactccgattctgtcttctctaggagacttagtcaggctcggtgttgatgtaggttttctttatcatgttggtatccaaagtacctgttgtttattgggtagtgattcttaattgatgttactcattcaggattgactacgatttagtttgtgactgtttcttgattcccccctgttctggttaaacttttcaattgttcatacttttcagaaagttcaaacataattgatgacattgcaatccttgaggtgcagaattggttgtcttattttttttatatgcacaaattccttcaatgtgttgactcagcttggttagtgtgatttttctttacattgcttatagtttctggggatggtacatgattaattaggatggtatctgatgtcttgatatcatgctggaactaatatttgcattttaagttatagccatatagttgaatactaatgttttcatcattactgttgtgactcctgctaatcatgatactggtacttagacttgaggatagaaaacttatctcacaccatctttacttatttgctaagcagggaacagaggttctggccgtacaccgcttaactgggagacgagatcaagcattgcgctggctgcagcccgtggcgtcgagtacattcactcaacaagctcatcagcatcccatggcaacatcaagtcatccaatgtcctcctgaacaagtcgtatcaagcacgtttatcagacaacggactttctgctcttgttggtccatcgtccgcaccatcccgtgccagtggataccgtgctcctgaggttactgatccccggagggtgtcccagaaggcagatgtgtacagctttggtgttctcttgcttgagctgctcacaggcaaggcccccagtcaggccgctcttaacgatgagggtgttgacctgcccaggtgggtgcagtcagttgtccgctcggaatggactgcagaggtgtttgatatggagctcctgaggtatcagaatgttgaggaacagatggttcagctactacagcttgctatagactgcgttgcacaagtcccagatgcccgaccttcaatgccacatgttgttttgcggatcgaggagatcaaaaagtcaagcgaaagattagaaggtagagatccgcagcagcaggcctcaaatctcgaagcgggcgatgatcagacttctaagccagaatccgctgaggggctcaatccttttgccccttgatattgaataacatgatggaggaatcggctaactgctgtagcccacatttggttcatggatttgatgaatcctatcttcaattgagtggactactttcatcttttggcaatattgaatttaccattggtgtcaaccatatggttgtctttcgattgcgcatgatgcttggcaccctctgtgctgtggtaggtattctggtggtgtttagggatcaccaccccaagtttgtgattgctttaatcgatctgcttattctagctgatgattaggttggttctttagctatccatgtaattacaccgcaatctagtgcttggaatttcttgcctgagaatcatatttcatgagttcgctccctgatggagttgttgccgattggcatggccgatgtgattgattgctgggtctttctttggatggtttggtgatctgtaaaacatgcatctcctgtggccgcatctggttgacgccttcggttcgtgaaagcaacgtgctctcgatccggtggcacgggtcttgttttcggcgagatgttttttgaatcgcccctgtttgttggtttcgtcctttgaattcaatctgcctgatacgaatagaaatgtgactgttgggctatcattattgatcatggtccataaatagatgccactgttaccctgtacgtagggtggtccaaaggaaaaatatgtacaggaaacgtactggttgagtgatccaaatgggtcgtgccgtttttggcttgggctacatctcatcaaaccacgatctatagcagtgtttccctagctccgtgccttcgttgcatcagcatccataacaaactctggccatattcgtctcaaaaagaaaaaaaaaaaagaaactggccatattctgaatcagtgtaaacatttagtacttcctccttttcatattataaaactttctagcattcccacattcatatatatgttaacgaatctaaatatatatgtgtagttagatttattaacatctatataaatataaacaatgctagaaagtcttataacctgaaacggaggtagtatgtatcaattgaacctttcatgctctggataacggatgaaactaaagtagaggtagctaggaacatggtaaggcggtttaacctccaaatctgcctttttgtttggtgggagctagagtttctggctagcttttcatttccttcccaacgaaaatgacatctaactttgcttcggtgaggggattctacttttcaccatcctaagcctaatgttagaagggcaaaaaatgaaaaaaaaagaaacagaaagagaattaaagtgtttctatattttctctacgattaccaggcaaacgtttattctttgcttcctaaaataaactaacataatataagataatacacatgttaaaaatttgtaatccgacaatgtgtcacactttgaaacggatctggtgtattttgtgaagccttgaggaaacaagccccggttacgcaggaacaggagcgtgtgattatacaagagacgcatgtgtcgtgcacgaaactgagatccggccttttcaacgggtagccgggtaggccacctacgcgtttttgtcccggtgctagtgctacgcctgcggcacacacctggcgtgagtggcgcgggtggcggcacacaccggcgcgcgcgcgccctccaaatccgaagcgagaaggggggtaaacgacggcggcgcgtcacatggcacgagctagtcccacctggcagggccaccaccaccacgccgccacgcccacgcatcggatcggctcgcgctcatgtgatccatggcccgggaccagagacggacggtcgtacgcacgcatctccggtgcaggagccggatggaaaaggttagtactgccgtgtttagttctaaaataatcctttatatttctagcttttctatcacatcgaaacttttctacacacacaaacttttaatttttccgtcacatcattctaatttcaaccaaatttttaattttggtgtaactaaacataggccccgcgcgttcactttttttttacacgtcgtttggtttgatggcaatgcaaggggctgccacgttgaatgttggatgtgttatagggagtagtagtaggtttttcttaggtgaaaggcaaacacatgctacatcttttggccgcattgttctgtagatacgatatttgatagtgattggggttgaaaacagtcatggctattgatgatcaaccgacgctcgtttctggtttttaccgacgtaaccatatagaaaaggtaaccgagataaaattgaaaatgacactaaaacgtattctaccaaccgtttccatattttacccttttctcatgaagatttaccgattctgtgatatagtaattactgtatcatccgacccgcatctgaccatggctcatctaccaatcgtgtgtctaatttttctccatgcaagctagtttttgtccatgtcggaccaggcaagtaacaactagagaactagtcggacaagggttgtacacaccggtcgtatgtatagccattttcatttttgaaacccctaatagttttgctataaatctgtcgtcaaattttttacttacaatttgacgttttttcaacctaccaattagcacctgattaaggcaaggcactgataaccaagtgaggtattgtacgcatctttttatctttgccactgtatagaacgaaagtgattgaacgataatactacttttaatacaggtgagaaatcttctgtgatgtctatttcgtatgaccagcagtgttttaaaagttacattaaagttacactatagtttatatgtaagttacaatgtaattacactataattgtataaagttatagtcctatataactaaaattatatttgtaaattcagttgatatgacatgtaagtatactgtaattttgataaaaaatattgtgtaagtaaatatgcattcgttattttctttaaaatataaaattacagtcatatataactaaaattatatttataaattcagttgatatgacatgtaattatttaaaatataaaattacagtcctatataactaaaattacatatgtaaatttagttgatatgacatgtaagtacactgtaattttgataaaaatgttgtgtaagtaaatttgtattaattattttattttgtagtccgttggatataaatctaagtatagaaaaaaaatatgggtgatttcttgttaaaaatcacccgacaaatgtataggcagttccatccctaatatctattgtctctgtttgacccatagttttgaggtgcaacaaccgctcaaccaaattcctaatttaattattagctagctgggagaaaatttgtaatttacatactgtaattttaatttgatttggtcatatgcagatatattaaattaaataccatgtgattttataatccaatatttctgacattcattacccgtctccaattgataccgacatgatttcatcactatagtttcatttctgatttttcgatattgttccgttttcagatttatcgttttcgaccatgttttgagagaaaaaataaattatgaaaacggttaaggttgttttctgatgtacatattacagcatacatactagactaactttgaattaagttgtgtattttgttgtaacggattgccacaccgataggtatggctgtcgggttgtgcgggtggcacagaccttattatacatacttcgaaattcaaccaccgaatgacatctacttcctccgtttcacaatataagtcattgtagcatttcccacattcatatttatgttaatgaatctagatagatatatatgtctagattcattatcatcaatataaatgtgaaaaatgctagaatggcttatattgtgaaacggagggagtatacttttaagccagtgctaaacatttggtgtagatctgtaaaactccgagcaattcatacgacaacccctcaacttttgcgaggagccaatgagccactcttttcttttttttttttttggaaagaatacactcctgtccccgatgtagatgaaagatactccattcttgttccatacaaggcttcataatgtttgtgcgattttttcttttcttttcttttaaaaaagaaacctgagaatgatttgtggttcgtacatgtgttggtgattgcaacgggccctgcggtttgagtttgattgggcgtaacaataattcatgtataggcgctggaggaacagtggaaggtgagctagatgccatatgtagcattgtagcgtgtcaagcgtgtcaatgcggcgtcccatcggcatatgcaacttgttacttgtaactgccggagacacatcgacaagctaggcagaaatgtgcgcaaaaatgatcaatcaaaggcggccgatcgaggcatatctgattgctcatacaccaggaaaggtttgcattggttcgtggtaatttgccattgcaaggaatgatttcaatgtgtccttggatatctttgcagtcctataattgctaccgcccttgattggatgatgattctcgaataattgaaaatggcactagcatttaagtttataaacttttaaccgcttctctttttacggtaaaaatttataaatccttaaaatatgttatattatttaagtgtattcatcatagcaatttgtgattcaagcgagacacccatagaaagtgtaagttattcaagaacaggaagtatgatgaaagaaagaaaaaagacacatcggattttagtgggggtaaaaacaagatgggtatttctcgcccaccacccgaccatattattttaagataaatttgtttggattataaattcgggtacttgaatttttatatagttattgaaatcatatccgggtgctttttattgatacgggattgaaagatggtatccgacgggtaaataaatattacccggtaaactatccaaatattgccggttagcaggctttttgtttagtccaaaaaaaagccatagcccacgaaacttacatcaactcataaccaccataaatcaagcacaaaacgggagtgctagtgctaaaactagtaatggtgtgatggagtaatagatattatctatgttgctgttgctatgccttaatctagttgcattagggattgaatggcgattgaaaatttaccgtatatgatcgtccctttgactcaatattcggttaccgatatatttcctccgtcccaaaatgtaagtatttttgaggttggcatgggtattaaaaaagtagatgagaatgactgaagaaggtgtgtgattggttgaaaagagaaagtaggtgaaaaagaatggttgtgattggttgagaggagaaggtaggtaaaaaaatagcttcattttggaacaaagtactggctagaaatagctacattttaggacggaggtagtaatacgtacctgcttgcaattgctacatattcatttcatatttataatcgatattatctgtatttgaatccgtatttaataattacttatgtccgatccaattccgatcataaaatatgggttaagatataagaaggatcgaaacccaacccgattcatccctagtttttataccggtcatccatgtaccttttgagtttcaagtcaactgtagtattattcaaaatagtatcaactcttagatgcttcgttttacgagcgactatgaagatgattagagttgctatcgcctactcacaatcgcagtacgtctcagctcacaggttcagcatgacatccttctctgttagtcacgttgagaatgctagtaaccataatatgcttaaatagagtattaacattgaacatatggagcccagcgtttgacgacatacttcgagctttcagattatttatttatttttccttcaatctctttgactctagtaatattaaacaagtgaacttgcatcagattattcttctttcctccagccaccattctttggaaccttgaccctcgacacccccccaccccccaccaatgttttgaacaaccccaacatctttaaacaaaggaacaaactgaaactactcttgtatttttacttctatcactaacagtattcccacggtctttgaacaatcaagtcaaaaataaagggataaccatcactgccagcctgccatgtcaacatcttctagttcctcctcactagagaaaaagagcctccaaacaaaaaatcatttagcaatttgattggactaacagctactatctccgtcccaagacataaaatgttttaaaattagacatgagtattataaacataggtgaaattaaatatgaaaagattgtgattggtgaggatactaaaaggtaaaagatcgtttacattttgaaacaaattttgaatgctataaattgtaatatttaagcacggaagtagatttaacaaacaaattgtaatattttaaatactaaaagtaaaaggtcgttattgattgagaaatgaatagatatataagttgttatattttaaaacaaaatttgaatgctagaaattgtaatatttaaacacgtacggaagtactcctacttgtcaccacctgtaacctcggccccatgtcacatcagctgaaatattttggtcagtcgtggcttatggaagcttcagattgaccagaaagggagcagaggaaactgtgccgagaaaagaaaaatgcttctgatcgcgagaggttttcaggattaattcatgggaacatggcgtgtgtttcatgatgttcacaagccacccaactgtgacgacgttgctgtgtaaaaaagctactctcgcagtcagcaggcgagaagccgagagcgacactgtctcccttttccagcatgccatattggtctgcgtcaaagtctcaaatatgatctaagcgagaaaaaaaaaactccctttttcacccgattttaaaatacatgtaccatatcctcgctccgatcggattccgggtaaatcggtcagatattatttgatctatttttacccaaatttgtgtgtgtgtgtgtgtgtttgggggagggggggagggggctaataaaatttttttagagtacacggtataacgcagacactcacaacacacgcatactcacccctatgaacacacgcacgcaaaccctacccctatgaacatattcaaaggctgaacgaataaatcctggagattgacgaagtcaccacaggcgcattacaatttttatttgttatagtataatcatttttaattaatcaaagtgagacaatcttagtcaacagtgacaattattcaagaacagagagagtaaacagtgctagtgttgtgctccctctgttcttttatacttcatatttattttgctcgctatatggttagtttgaggcacttttgatgaaaaatttaatgcaatttccatatgagaaatttaaatatcatcagtacatacgttgtcaaaatattgatatattaattgcacgcattctagaatgatgatagggtgaaaaaaagaaaagttgaggggtggaatagtatgggttgaaccatgaaaggtggcgactttagtgacggtctcgcaatcgcaaagatgaagtctcagtttctaccttctcgagaaagacgtactagtactccctcttattcgaaatgtttgacgccgttgactttttagcacatgtttgaccgttcgtcttattcaaaaacttttgtaaaatatgtaaaattatannnnnnnnnnnnnnnnnnnnnnntatagtcgtcgatccaccacctgngcacag

SEQ ID NO: 82430 - DNA, 28502 bp, Oryza sativa
gcacctacacggtgggatgtgtgggcgttttgtggctacacggtggtggtggtgccgtgtggctggaggctgggcgggtttctggtagcggctaaccgggtatcggttgcaaaagaagggttacacataggttgattttttgttccaaacttaaaggctggttagctcgattaagagcatcttaataatattattgtaatctagattatttagctatatcactataagctggattataataagcataacctttatgtctcttaattagtagctatttgttagctgttagctatccaataattttttaaaaaatcatctttaaagtggattatcagattatagtagtatggcttatagattgtaataatctatcataataagctatctatttgtttcagtttactcataataatcctaaactaaatcaaacagggtcttagcaggtttttaacttattattgtttaactcgataggtttggagtaaagttgtggaacagtgtaaaatcctgttccatctttattttctgaaagcattttagcttgctctactttcttttcgagtggattgcagctttagaagaggggggcaaacttaaaagaactctaaacatttaatcatgtaaaaagataataaacatagatgcttaggtttaaaataacacaatatgtattctatgctatatcatgaaaatatgaaaaccagactaaaaatattaatgttttcacttaaactaatgttgattgattaaacatgcacactattaatgttgacaaataaaattgtgagaccgactatattggatttgtttgtatgcatgtacgattttagtgtttatataaaccaaattaatagtgaattttacatacgtattacttcctcctccgtttcatattataaaactttctagccttgcccacattcgtatatatggtaataaatcaacacacacatatatattaatatgaaatagagggattattttatatcgtaatttttatatttgaatttggttggataggttccaccataaaaaaaaccaaccagttaagctattgcttaattcatgattgatcgaatatataaggagtataattatatcaatgcatatataagttaatggttgttcgatatgtctaacgcaattgtgctttcaaagtctactttatacacaatactgccatggcttcctcttcctttgataatataatatatagataaattctctaagataatttgcacacaatattgataatttcttttcacattgtaactatgaagataatctctctaaaataacttgcacacaatattagtataaatatagagataattcatatcttatacattataccacttagttttctatctattactctatcttataaatacgtagatgattaatttagaatggagggagtagaagctaagagttgtgtattaaatttaatttgttggctcgtgttaaattacatgaaaatcccgttcgtgaagataatacctttctactgtttttgcatttagaaatttagcttgtataaaacggtgttacaacttgaaaattgaagcaaaaacatgataaattgctagtttcctacggacgctaaacgagaccgcgacatttctaaacccttaaaccctaatcccctcctcgctcccgcctccatccctgctcacctgattccccgacaccatcgcacccagccgccatggcctcctcctccaagctcctagccctcaccctcacctcctccttcctccgctcctccctcctgcccgccccgtcccgccgcctccccaccggcccactcctctccctccgcttctgctccgccgcgggggatgtcgccgacgctcctgccgccgccgcagcaccagatcatccgtggcccgagtggggcgatttcctcgagaagcttcgggccaaggggtacttcgagcagcccaccctcgcgtctcgcgctgatgctgcggagggggaggtggctgcgaccgccgcggcggcggcggcggcggcgggggaggaccctggggcctcggccgacaattacccatccaaggacctgaacaggttgaagaacgcatgcctcaagttcggccgagagcgcttcgatctcctcaggttatttgcccgtgagatggatgccttgcaatttattatcgcctcggttctgtgcatgaactgggctttaattagtttaatactttgcttagtgggtgaggtttttgcgttagtcacgcacttgaaattgttgcggaaatgatcatgtctggtagaaaagcagtaagattcggtaacttggacattcgtgagctgagagtagtcaattgttctccctaatcccaatgtcccgagaatcccattagcatggcatgcagtgttgatttttctgtgtctacattttggttagtaagctaaatggtttgttttgcctttctcctctatgattattgtgcatgtttggtaagaacttgtcgatgatcacgtccctaagcatgaactcatttcatagtgctattttattaaatacaaaatacattttatccagagaagctataatataaatgaaagctggagtcatgtgtgtcagtggtataactgattctttggactgtttgtgcccactacttttgcaagtactcatttctttctatgttggttggatcttaatttgactggattattgggccagtgtccttcccaagcaggatatccgtgctattgttgagtgtggctgtcctaacatcttccggaagcctgtgaattctgcaaaaagactcagagagtttcttcagattgatgaaggagatgtaagttaattgttctgttctgaacatactgtattgccgttcttcctgtagtggactcttgatttttttcacaactgtcacatttctccctgcgatggacttttgacttttcctctatgcgtaacgtgctgcttccttttctcataatttactttgactttgcaaaaaacattcacaatattttgtgctttatacaggcctgtagtgcttgcaaattacgtggatcttgtgataaagcctatgtcattccgaacgctgaagacgaagctcgtactgtcgatgttatgcgcatactgctaaattatgcaatagatccaaccagcctttcaggagaaaactctgttaatggtggtgttcaagaatctgcgagaaagcttctttcagagcttactatgcttagcgacacaacaattgatccatcaattcctaaacctgtattccaaacttctagcaagaccaaaacttttgacaagggcattgcaaagcctaagttctcagctggaaagggtagggaaacaactgaaacagaaatgaagaagggtgattggctttgcccaaagtaagtcttttatggtatagtactatagtaactgggtgttatgcttccatgcctattgttatgaacctttattttatgagtaaattccagaaaaccttacggtttatggtcaaagttgcagaaaaccacaggtgctatgatttgtgacacttaaccacaggtcttatggtcaatgtttcataaaaccccaccttattcaaatcttgattagtttcagcatgtttgaaacatttttttcaatgtagcgaagagttaaactatcagccttagtcaagaacttaataattaaaattttcatatgcaccatgttttagaattttaagtaaatttgtgctcaacatacataggtcataggggtgaggatttgtgaaactttagaaccataatacctgagattatgtgtcaccagtcataatacctagggttttatgcaactttgaccataaaacatggggtttcctgaaatttactcttactttatttatatttaactgtcagattacaccgatacattatcatatgaaatatgtgaggggctaagggcataaattggccttttgatgatcccctcaggtagtttataaaaccaggaatcaataccattgttagcaccagttatttctgaccaggtttatcacattctgatgaattgctttacttttagtgcttgccacaagtaaaacaccatgagtttttagcttttcatcatgttgcagaagggcatctttgactaccattttggatttcattcttattcccatttgaatgctgttaactaattcatctaataagccatgccatgacattggtttgtatgcctgtttgtaccatagaaatgttgctaatcataatataatgttatgactacacttacaaaaacgatactaacctctgtcccaaaatgtaagggattttggcaatgtaaatgcatagctttcccttatatttttgggacggaggtagtacaactcctacatggttctgtttattgagtattgtactatttgatagctaagattttctttggacttagcttctctcaagttattaagctttctgaatttttgtttgagctgtgctgtatgtgtttgattcttgcgtaagctgcgagtgtattctactgtagaatgagaaaaaaaatagtgctaatagacttggtccaatatgcctggccgcttggcaataccatcaagatgtcactgtataatgctgtagcatatgttatctactgttctgtgttaggcattgggccaggaggccacggccgatgaccaggcccaaggagagccctcttcagatgacgtgaacagtacccgcaaggtactgtagcagctgttagagttagttgcttggagataagattagataggattaggtgccagcctatataagggctaagtcttttggaattgagttttataaagaaggttaaactctagtttccctcaagttctctccaacctataatctcctctcatcccaatcaatccgatgccattcggctatcttcccggtggtatttacccaatgaaatcccagcccacaacattctgcattattagcttgaagactatttgtttgtgcagaaacagcctatgtaaatttgaaccagatccagaagtactgattatttaaagtaaggcatgcttggaagtacacgtttgaaaattcatatctaatgttgtgatatgattacctgtttcctactttgtccacaatgctctgattattacaaggtggatactaggagtagaaagaaccatttcatactaatctaggagccttattcccgatgttgtagttaaacctataggattcattgtatgcttggttgtaacagtttctcaatgagtgaatccagataatctgggtttcggcttgtagtcgctctttggtactccctccgtcttaaaatatagcaatctagtactggattagacacaacctagtacacgaatctagacctccctatccaaattcatagtacttggtttctatattttgggatggagggagtacatttatagtgtaaatatgtctttgcttcaacaaagaaaattgcacggtacttaaagtaagtattgagttaaatggttggacaagaaacctctagtattactatggactttacaatatttgtaatgttctttgtggatcatagaggcacacctcttagatgatatcaggttatggttaactatggtgttagaagattatgatattatggtggcctcttttatcgtttacttcactgttattatttttattccccatccacagtgtgtgtgcgtgggcgtgtgtgtgtgtgtgtgctggactgttgatgcctggttatgccttgtgaatgaccctgtcctaacatcctctcattttggcagttgcaacttcttaaattttgctcgaaatcggcactgccttgaatgcaaagcagatggaccaaagaagatagaaacagctaccactgaaatgaaaacgggagactggatctgtccacagtaaccatcgaatgccatatttgttttcttgtactgttcaacattattatatatttgccttgataacttatttatttttgtttcaggtgccacttcatgaactttgcacggaataagatgtgttttaaatgtgaagaatctcgaccaaagaggcagctcatccctggagaatgggagtgcccctcgtatgttatacgactacctcaatctttcttactgttcatctcctcaacacgctaactagacatcatctcctcctatagatgcagctttgtgaactttcgacgcaacaaggtctgcttgaagtgcaagcatgaaggccccgaaaatgatacccatgacagccagcacggacacaataggtggaggaacacgagaggggctgacagaagtagaagttttgatgactctttcgatcgggaggacgatggctctgatccagacgaaggcgagcgcagacgtgccaaagtgcgcactagggcagcatcaaccctggggagatccactggcaagagcaaaatttttgactcgattcatgaggatggtaacggtagggaggatgacagcgaggatgtcctgccgtacgaagggcagcgcaggcatattgtgagcaaaagggcgacaccagcacagaggagattcactgctggtagaagcgaggatatttgatagtctgatagatatatataacttcgatatttttccatgtagcgtatagtttcattatgtactgtgtactatttactcgagcactttatggttagactagcttggttgtaattcatactgcttagttccaaataagttcattttttatcaatcccataaataccactacaaaacaaaaaaaaaactagaatacttctactttatcaaatcttaatgtaattatttcggattttggagctgttcagattgtagccaaaataaaccttattgaattttggcaatttggcaatattgccaaaattttagcagaatttcttatgtatttactaaaatttggtaaaaaaactaaatggatgcacatatttgacaactctaccaaaaaaatagtatggtttgaaatgacatcaatctgaacgagccttttatctacttctaatacagtatgttctactttcacaaacttcaatacaatgattactctaaaattaaatttattttgggacaaatggaaagagctaaaaataaacttactatggagtatggatggagcaagtcattttgatctccatatgctccgctgttgacatctaataaacatattggatgttacctgtagttcaggtctgcaggcaaacaagatttgagtacaagatttttttattttttcacgtcttgacaagttttgtttgtcgttgatgctgtttgtcgacgactccaatgactgccaatctgcctttagcaaatcttggtcgttctaccaaacgttttggactatatggtgtactccgtaactggcgaagttgacgatactctttcacacttgtctttcactagagcgtttgatgttggaatggacgctcaaataggacggaaaataatataaaaaaacgtactgcattgacgttgttaatcatttcccatcgcaggacaagacatgataaacttataaagaaatttacaactgcacttaacactgatgatgtggtgaaaggtaaatcttaacagtacaacccctctacaaaggaagtagagtagaaaggaacagggaagactgcaaatccatctccatgtagtcgtatttttaagatggaactacaaccagccttattaacaccaaaggaaaaacagagactaaaatctagctgactgaagtcacaagacctatacgcctataggcaacatcacaagtcgcaacggaagctctcagctggtcagctcatggatcaactgaagagctcagatggattccctcaggaccaggttgatgccgaacgaagccgtgcagatgatcaacccaaagatcgccaagaagttcagccccctgaagcatttgccaaaaaattaatccgaccaggttagaaccactatgatcgatcagaaaccaagatatgagatggttgacaaagtgataggtgtgccatttggtgcaaattcagatgaaacttcagttcaagtgatcctttctttgctactcaatgcaaaggacaccgatagactagactatcataactgtggtgattggtgcagggttgcaatctgcattacccactgacgtacgagtcaacccataattaatagcgatttagcaacgactcgagcagtctgaagtctgaagtctgaagtctggacacaccttatatatacctcttgaaatgagtaatgaaatactaaatatgtaaactttggaagtttcatcaacgtcgtgccaacaagtagctgcgatctttgacagattataaaatgaagagatggggacatttgcacgatccgtaccatgttgaatagtatactgtatgatccacttcaaagctactccacgttgtcacccactcctcaatcttgacatatcaccaattaaacacgcacctttgacatttttctttggtgtactacacctactgtatcctccacttaattgagcattgaccacctaccccacttaataccatcagtacttggggaaccattcataaatgaagtcaaagttcagacttcagagtgttggctgattggttattgctacccaagaaacgaacaggactagcattctagaaatcaaggttaagtttgaactagctatgcatacgaatcatctttcgttagagcgacagtttaattaccagcacagcacacagaataaatctccagtaggaaaattcgcaaaaagaaacgtacccaatcttgaggcggttgtccgggatgccggtggcgtagcccttgaagtagaagaacctcgcgacggcgtagaacaccccgagccccgcggcgacgagcgggtgctgcagcccgccgaccagcagcgtgacgaagaacagcggcatcatctccagcgagttctggtgcccccgctgcacacaccaccaaaattctcatcggtcagaagaacggatcgaggagcaatctcggggttgggtggggcgacagactgacagacctgcacgcagttgaagagcttggcgtccttgttctccgactcgaccgcgtacatggtggggtagaacaccttgtacctgatggcagcagcatcagccaagaacattcagagaaaatcccaatcgaaaattctctccaaatcaagacgagcgagagcaatgaaccaaatctgggaggggcgtagactcactttctgcgggccttgccgacctggaagctcatccagaagttgaggaacgcgtaggcgaccagcgccagcaccacgtacccgtattccttggtcagctcgatcgacaccgccatggccgtcaaattgttgcgatttcttcttcttctcgagagggaatggagattggagaggaggaggggattgtttgtttatggattataatgggtttttggatttggatttggaggctgtgcggcgtggatgcctatcttatacgggcagcgggtgcgtctagaaggttccagaatcttgttctgtgcctgccctccggcccaagaaagctctgaccaattccttggacctattgggccactgctctttattttttttcacttttttttctttctattaaagatcttttttttttcatgaggacagatgatgctttggttgtgtggaaagaaaaggatcgatcgatttggagatcgtttttgctactgtttgagtaaattttgtccaaagtcaacggtagatccgtttttttcaatacgtcatgcctgatgcgatattgctaacggatcctctctgcaagggatatttcagtgtgtttgaacgagaccagcacccgtaggccgtagcccgcgactccacgacgtggctttccaaaaatcaaagtgaaatgacttctcaagattgccgtcttgaattcatcggcatattggcaattggcatagcatttcgttcttttttggagaccacgagcacggacaactcgaggtttacgtttggaatgtctcgccgcaacgagatgtgctatttctgttcttgttctaaaatatatagttacctaatatcttgttgctacttctgttctaaaatatatagttacataatattgatcgataaggatttgtatatattcataataataagatatgtcacatttgatactaagttgctatatttttaaacagaggtagtaaattatttccatttatttagcagagggagagagtaatagagcctgagattacagatcagaagagcatgcagacgcatagaagctttggaattaataaggtgagtttttctctgatgagttcttcagaaaagataaaagcttgcctgctatatttctgattcatcgattaccagatcaatccatatttcgaaactatatatatgatgaaacagtatagttagtacatcattttcaagtttacgagatagactcgctaatttcgtgcctgcgtcatggctgatcgatgtgtgcttacggtaagacaatggttgttaagtcttccattggtctctcaaaatgtattttccacgcgcagctggtagagcagctagagttattaacaaccaaaccatggtcaatttgatcgtactcttgcagcacaagtcgcaaagagttctgtatgacttaaattttaaattcagaaaagcccaagccagtgtaccaaatgtctactctacatgatgccaaagaaattgacgggacgtcaacagaagatttggatcagatttagtaccaactaatcggctggttagtcatgtgacttacaattattatatctccatgttcagatcatcaaagtcctaagaacattcgtcagtgcgcaatgtccggtgttgcggtgttccctaatcggtaatcggcgttgcgctaacaaaatcaccatatactactccctccgttccataaaatagagaattttaagtttttgcttgcactgtttgaccactcgtcttattcaaaaagtttgtgcaaatataaaaacaaaaaattatgtttaaagtaatttggataataaagtaagtaaaaaaaaataattccaatttttttttgaataagacgagttgtcaaatagtacaaacaaaaactcaaaatcccttatattatgggacggagggagtaatagataacactaaggctgtgtttagttccacactaaaattgaaagtttgaagaaattaaaacaatgtgacagaaaaattgaaagtttacgtgtaggaaagttaaagttaaaagtttgaagaaaaaaatggaatctaaacatagcctaactgctatcttcgctaaagaatttgcagtagatatcatcatcagtggcaaagacagggacttctcttcagatttcagaacaaacgcatcttgtcagcgtcaacaatgcacacacaattggcaaaccgagtcgtgtcacaccggcatagaacagctagagaatcctctaatcaatcatccaaaatgctaaaaactgagaacgaaccggatggaacaagatagagagagtgtgacatttcacagcattttcgctcgatcgagacgtacgaaacagtcttgacatgtttctccctcagtcacacggcggtgacgaccatcttcatgccgaggttgcagtggccgtagcgggtgcagacgaagaagttgtcccccctggcgagcctgacgctgtcggagccggaggtgtagtacctcgagaacggcggcgggttgcagtcggcgtacccgtcttcgtcgacggccaccacgttgtgcatccacggcaagtacctgaacactgccatgtccgcaaaacggtttcagttacagctggctttgtctgatcgatgagaaaaatgttcagagattgatcgaaatgttcagagataagtactcctatgatttaccgaggatgtcgccggcgtggaacttcttgccgctgggccagctcccgctgccgagggaccagccgaggctgtcgccgacgtagtaggtggcggcgtcggcgacgccgcagccggagaggaagatgcagctcacgacgacggcgagaaacgcgacggcgacggcgcctcgcattgcactgcctcttccccgagccatcgatgccactatctcactggtcactcactcactcactgactgcaaccactacactggttgggtcttgagctcttggcctgatgcttctgcctggaaactgggcaaaggaagagaaatctctgcactagctggggcctggaggtaacgatgccattgccgttgccattctatagtgagctgaagtactcctacggaggctggagtgcagtgtcagtgtgtagctggaggctggctggttgccaatgccgggggagaaccaatgccaagtctggatttctgataatcaatgctgtgcagagagggcaagcagcggtgacagaagactgtaaaaagtgtagcagtaaatgtgtatagcttcaatgccgagcataggacacgggcccgtgatcacatgactcacgagttttcacagtcacagctgcagggctatcgggttgtagtccatcgcattgggtgctacggccgcgcagcgctacgagtaaagaagaaagagcaaatcttttcttgttgtcttcaagaaatatatccagtcgccggctcgccgccggccgacggatccgccggaagggcaccatggcaacagccgagcaacaatttgtcatcgcctactattccgtaccggcccgctacagaaacgggccgtgccgaatggcggcccaagcacggcacggcccacgagctcccgtgcccgtgcagtgctgggctgggccgttggggccgtatcctggcccattttgccaccaggatccctagttctctagtccctagtccctactagtggactggaccgtaatttttcagataggtccttgatccaacggctgaaatatgcaaacaggtccctgtggtcggtggtgtgggagtccgacgctctcccagctctccgcgcccctcgccgccggcggccgtttgccgtcgcggatgagatcgccatcggtttccctctccaaatcaagccccaatgccgccttattcttcatgcctaacgcagcccagctcagctacgcccggcacgcaggccactacgattcctcgttgacgacgccctcccttccccttcacgcgtcggcggcccagatccgggcgagtcctcatcgtggcgggcaaggggattcaaaggaaaatttgtaagaggttggagttcttgctagctttaatctaaaatctttataggattgtccatttcagaggagttgataggattcgatctttttctttcaaaggctcacagagaagttttttctatggagctgaaattcttatgttttgttttaagtcaaacggggccttaaaaaaacaacacaccaccctggtaaaaagaacagcacctggatcaacctgacaatgagtcaatgactcaggataaaataagccgatcagctgtaggaatttggactggagtggatgggtacgacttatctgatggtgaaattttcctttttctaaagaagatgggtagcgtacatggtgatggtacaaaaaattacccaaaaaaattatgccttctgaaaaggatccttgaaaacctccatggaaatacgatggatgctgctgcttcatacctcggacaaccaaaggggagaggagtagcaggctagcagccatggcagaaggtgcttttctttctagcctcgttgaccgtctaagcaccacagccttgtcggggatcacctcgttgtggggcgtgaaggagcaggtggattcactgattcacgagctccaggcagtggaatgcttcctcaaggatgccgacctgagggagatccgtcggcaagccacatccaacaacaactggttctggttacactccctcagagatgccgcctacgacgccgaggacctcatcgagagcgtggagctccatgaggggaggtatcacactctgaaccctctcctccagcccttgaactcttacagatttgccaagcaaatcaacgagatcaaatccagattccaatcgatcatagatggttgggccaagaatgcttccatgttacgtgagctaagggatatgagcagcagcagcagtagtgtcacgtctgctgccgattccttgtggaggcgttcttcttgccacctcggcgacgacgtcgttgttggtcgggaggaggaggccggcatgatcatcgatagattgctgcgctgcacagcacaccgtgaagtggttgggatagtggggatgggaggggtcggaaaaaccacacttgcatctctggtttacaataaggtttctgcaatccaaacagggggcacctcattgcgtcctgattcaccgaaaggaacgagctctcgaagtagtgtggagatgtattttgatgcttgtgcttgggttccagttgggcagaacgcagatgctttaggcctcttgaagatcacatcagctcaaattggggttgagttgaactcgacacaggtagctgcagccaaaaatgccatgttcaggtttctgcagcataagaaatacttgattgtactagatgacatatggacgacagaaacttggcttgaattaagcgaagctttccccaaatctacgaatggaagcaaaatcttgctgaccactcgctccaaggaaattgcggtttctgctgacccatcttcccttccctatgagctagatccactgagtgaagaattgagctttcagctattcattaccaaagtttttgggttgaatcatgttgacacaacaagttgtccaccacagctcaaggatgtagggcaccaactttcgaagaaatgcggagggttgcctcttgctcttgtggtattgggaggactattatctgggaaggaaaagcaattcgaagtttggaggaatatattgaagagcatgaagtggagcaactacgaagctgggaatcagtgcttggagatactggccttaagctacagctgcttgccttatcatatgaagctgtgtttcatgtatctaggtgctttcaaagaagaaactgaaatcagtgtctctaaactgataaaactatggatcggagatgactttatacctcagcaagatggaaaaacaagagaggaaacagcaaatgactatttacgcgaactcatacaaaggtgcctagttcaacctttgttgcctgcgcataagcagggtttcaaaagggtccgcattcatggcctattatgtgagctagcaagatcagaagcaagagagagtcgattcttttattgtgaaaatggtgatgcagtctcaagagcagaaggaaaatactatcgtcgtctcgctctccataccaaacttattgcatttcatgaactaagtaacagtgagaagctaagatctctgctaatatttccaggagtaattgaatcttgtgtgattactgttggtcatcaagcattaaggccttttagcagggcattttgtcacgctttctttttgtttcctctgtggggtttccagcacaacatcttggaacagttaacaagcatgcaatacataagagttcttgaacttgaaggacacgagagattggcatgtgatcttaaaagtgtccaaagtaatctgaaccatttgagatacatgagcctgagaaatactaatcttggtgaatttccatttccggaaagcaattttccgttgctacaaacacttgatataagggggacgtttattagaaagcttccaggtatattggagagccttgatactcttcggcacatctacctgaattggagggtatctcttgacataagacgccttaccaatttacaaacattacatggagtcataattctccccaattcacaagctgaaaggaacttaatggcattaacaaatctgaggaaactacgttttaggacctggcggggagttgaatacagaccagagtccccaaatgggtttgatattgatcggtacaatgcacaatcgagtatggggaatgaaaaccacgcactagccgaatctctgaggcagctagggaatctccattcaatatttataatgatgccgtttgcctcatttcaaccaattacttcagatatagttcaagcagtgacgagccatgagcaacttcataagctaaaactacaaggaagagtacatcgcaatctcctgctagaagatccacatttcagttgcatcaaaagcatcacattatctggctcgtggattgttttgagcccgatggaatcactaggctcactcacaactctttatgaactcaagctaaaggatgacgcgctccggtgctcagaggtctcatgtttacaaaacagtttccctgagctgcggtacctgaaaatcagtggactaaagaagcttagggtgttccatgtggggaatggctcatttccgaatctcacccgcttctccatccacgactgtacagaattccttagcacggttgaggttatggagcatgctacaagactgcaagttctgaaaattaaggaaatgccgtcagtcctgcctgatgttacagatttttgccacagcagaaacatcaaccttatcagctgatctggcatcaaagttatgtatagttgacaccattactgcaaacaccgtttatttttttatctcgttcctttttagtaaaattcagctcaggttcttctgagttctgatggcaagaaaaaagaaggcttagctgatctgatgacaagaaaccatacaacgttccaggagaacatgatccaaagccaggagtccagcacatgatagctgtttaatttctttgcttgagctcaatgtaacccaattgtacatggaaaaagagtaatgctagatatttggtgtaaactttgcaatattattgtctactaattattctctggagatagatgatgtcagtaaactgtagtagaattggtgatgagaagtgagagttgtacagttaagtgttgtggccacatgtttttcaggagttcagaaatgaactggtataccgaattggttcagaagttcccactgccgtcttgaataacagaaattgcatacttcacactatgagactcgagaacaaaggcttcattactagaaggcctagcgaatgaatagtaaaaaaaaatgtttcattactagaaggcttactagagcacacccgcgcacactgtagatcgtagtaaaacatacaagtattgtcatcaagcatttgcctgtaatttctaatgcttcgatctacaatgtctggcagagtttgcaagtagtcaatggacttgggttacactaggcctgaactgaacttgtagctatgaaatctgaattctttccagccagaacgagcataactataaaatagaaattgtttgttcttgtgtgaataaaattgctgttattcaagacggcagtgcgagcttctcaatgttgaaactaaacatttgactgttattagcttctgcaccaattagttataccagttcactgaacttcttctctcaactgccacagacgaatgtaggatggtacaaacatgcatgaaccatcgcattcacacaaagcaattttcagaaccttgtactacatatatacggctgggccagaacgcagctgtttggcttttattaaattcttctcaaaatacacatcacataaatcatatattcctctctatacttgccaacaatcaactaacctgcaacaaagcagaggcctaaacacgaagacggtcattcagcaacgtaggacactgacagaattattggatctacttcccggatatttagagattgccactactacattcgatcccgccggactccggcgaccggccggccgatcaggcggcggtgacggcgatcttcatgccggcctggcagtggccggggaagctgcagatgaagtagttggtgccgcgcgccagggtgacgcggtcgctgcccgacttgtacaccttggcacccctcggcgcgctgcacgacttgtaccccgccgcgttcaccgccaccacgttgtgcgccgacgggctgtacttgaacactgcaacacgcatggatacgcacaacattcgtcacattgatgagatcatgagagcgatgcgagatatatgcaatcgtgtcaagattattatctcccgattaacatttgattagcagtaatcatcgatctacagcctaatcacatttgggtattcaggcatgtaaaaaattcctcaagttcgttatgtgaggacactttgggcattcagaaaaaaatggatcggggtaacgacgatggtatatttttctaggataaaggttcgtcaatggcaaaacatcgaacatggcatttgtctgtggccgtgtgcttacaaggggaaaaatacaatgctctgttgcagcctgtagaggcagttttgtgcacgtcacacacagtagacgccgaactcgtcaagcgaaagagatatttacaaaaaccatccataagtcacttaaaacttaacatttcacattataagttattttattaaatacgcattgactactcaattttgttctaaagaccatcccactgcacacatgtttaaccatatcaatatatttttataaattgtgagccgtcaatacgatctttattgaatttaaatacttataggagtatagtcttgacctttttttagagattctacattgaaatatgaataataagtctaatgcaagtacttatccaagattggcttagctagcttaacctttgatggttctacatcagtgatacggggccctttcagttcagtaagtgcacattagtgttttttacaataatttctaggggtgaacagttgcaactaaataatttatggggcggctttctgtaaatttcccccaaaataaaagttgggatagtcgctagtgccaagcaaagcaaccagccaaccatatgcacacgccgagccgcgagtggttgctcgatcgaccaggtccaggtgcaatgcaatcggtcagttggtgactcattcatgagccgcagtgcagtagtcgtacgtgtgtcacgtaaacagttaggtagcgcaccacttacgcgccgcgctagttggcgacacgaaaacggtttaaaaaaagagaaagcgttcaaacgacacgatcgacgagaaactgaatcgatcgatcgaactcaccgagcacgtcgccggcgcggaagcgcttgcccctgagccagccgccggagttgaagccccagccgccgcggtcgccgacggtgtacacggccgactcggcgagctcgccgtggaggagcacgcagaggaggaccatcgccagcacggcggcgttgcgtcgtcctgcagcactgccccttccctgagccatcgccagtagctgatcgctttgcaacaattgactgaccgtttactactgatctcagctagggggtgcaagtagtgctgagcgagtgagtgtgaggcgagtggtggtagtgcccaagttctggcgacgcgagcttccctttataggggagtagtacaccccacccacccaccgatagccatcactgaacacacacttactcctacatgccatgaaataaataggaaattgattaattaaccaaaattagagcttgtggctgtcaattgtacatatgtgtgaaaactgtgaaactgagctcagcgaccgcgtgggaattgggaatgataggatctgcgacgcgccggcgacacagtgcaactagcgagctagcctggcagctgggaggaaaccacgacttagtgggagtgaattttaatccctcgaagagatattcctgtgtttttttcctttcaaattcgatacaaatagttaaaaaaaattataaaaaattgataatataaagtatatagtaaaatcgataggtaataaaaattaagtttaaatactcggctttagtgaaaaattcagatgtgatccgtataatactattcatatgctgatatttttatatctcgatatatgagttgagtttgaacttaatattttgtggggttatatagatatgttgtataagtgttattaaatttttccacaattttttatactccctccattccattatataaggcgcaactattttttttaaatgtttcataatataattaaggaatacatgaatacatgccattaactagcattttctttcgaatcctccatactcaatatatttaattctattggttgcatgagtgatccaaactatgagatgataataattatttcttggtctttagattaagagtggttgagccttttactccctccgtactcataaaggaagtcgttttggacagcgacacggtctctaaaatacaactttgacttcttatttctataaaaatatttattgaaaagtgatatatgtatacttttatgaaagtatttttcaagacaaatctattcatataatttttaaattttcaaactcaacaatttaagagttattcatgatttatatttccaaggtttgacttaaacattgtcctaaacgactatctttattaatacggtgggagtattttggaatggaggaagtaactatttaaataatttttaagcaaatgagggatatcccatcgagtgatcaaaatagtttcccgaactttggtagaccaaccacccacatggcggcaccgagaagtggacataacttttggactaataaaccacgaaagttgagcgcaagctggtcaagggccgatcgagaggaaaaacgacgagcaaaacaccgctgcgatgggaaaacgaagagacgacggtgcggggttggggcaattgagggtacgagtacgacgactaatttgtactacgtacgacgccggtcgcctcgctgtctcccggatgttgtctggtacgtttccattttggtagagacctcgtcgtagccagttaggtcaagtcggttcgctttgactttgtgggacagtcctgcttggttagactgtcagtgcgtggtcagcttacgtacgcgttgggctgcaaggtttgtgaactgaaaattgctcttatacctaaagtttagttaagggtgtgtttaagaggtgtgctcgcatttgtcccaaagtttggctttgtaaatactaaaattgtcccctagcttatgtgtctgcttctgtttaggactagtcgataaatcttcttctaaaaagttattaaacataaatacaatataattataattatagtgtaattatattttttaaactttatataactacattataatttatatatataactttagaaaagggtattagtgatgtggtagtgggttcatggaatcgaagctcttcacctatacatgtgccgtgttttttcctctttgcacgactatcgaagcaaatctaacaattcaaattacgtgaaggttacatacaagtaatattaaagttacatgcaaattataatgttattacattacaattataatatatttatatttgttaaattttaaagaaaatttgtcaacaaacatataacaaaatcattttgttttgccaacacaccatgtaaagcaccaaatttatcctcttcttcatcctttcctagctcatctccattctcttctcactgcctaactctatccatacacatcaccatcctcagttccaaccaattgtacatctcagctgcaggaagctcgttgcacgaggggatggccaggatgcccatccctacagctaaagctcgctataagggcaatagcagtgcgtctggccctcatcaagaagcccaagcttccacgtaggtaaaaagcaaatgaagctcccatctttcagtgtgcgtgtagttttggtgggcatgttaccatttttttctcaggccagccccaccatgaaatcactttccccactcaactctttcctcaatcgaatctcacacacctaccgcaccgcgccgctgctcctttcccaacctctataccgcgacgccactccttccccaaccttagcactgcgccgcttcagatcgatccagtgctgcagcttcctatcgtcctcccggtagcactactcgaggcaggaccgggccgatgagctcccaaagaaggcagagatcaggatgggtgagatcgatgcagccggcaagctcctggcgacacggattgaggcgggacagggccgacgagctacctccagggccgcagatcgggatgggtgaggtcgaggtcgtcgtcgccttcattcgtcggtcttcctagtatgcttcctgcttgcctccatggctccactgctaccaccatctcctgctcgagcttccaatgaattcggtcatggggggaggggccacacgcccctgggaggggggagggggaaccacaacgcggcaaggccatgacctccacaacatggcgcgccattctcttgcctgccctcaagttgttagagagccgtcgaaataacgagtgcccaaactaggctctgcgaactttgtttggtcacacgcgatgtctagctggccgcagatctccaatgtgtcgagggttggccgaatgacacgtcggagcactgtgaatgacctgaaagcttatgcaggctcccaacgaaaaagagggtacgcatgagttcaagtgtgaggtggtgctggtgaagcccatgctcagcatgcgtcagtggtggagcttggtaacggctcgatcagggtggtcagtagaggaataagatgaggaaagggggctttattttaagggttcattagatccatgccattaaaattttaccggttttgaaatataccattactatttgcgtatttgtaacgatgccattgctacttgtttctaatcttagcggtgccactgagatacgcattttgcatgtattggacaaaaataccctcatcttctacctctctctctcttccccatcttctaccgtctctctcttctcactacgccgctcgctccgccgccatcccgctgcgcgcgctgcagcttgctccaccgccgcgccgctgctgctgccgccgccgagccgcgtctcgctgtcgctgccgagccgtgtcgcgccgttgttgctgctgtgccgccgcgccgccgccgacgcaccgtgctgcgttgctgccgctactaccgttgacgcgccgcgtcgcccctgagaaggaagagaggaggaaggagaaaggggaagaagtaagacgaggggaaaatgggtagtttggtccatttttatctggaaatgcatccaaggggtaagtagtggtatcttttgaatatgtgtgaaattataatggcatatttccaaatacatgaatactagtggtatatttcaaaaccataaaaattttaatggcatgtatccaattaacccttatttgaatataggttgtgtttagttcacttcaaacttccaacttttccgtcacatcaaatgtttggacacatgcatggagcattaagtgtagacgaaaaaccaattgcacagtttgcttgtaaattatgataccaatcttttgagcctaattacaccatgatttggcaatgtgacactacagtaagcatttgctaatgatagattaattaggcttaatagatttgtctcgcagtttacaagcggaatctgtaatttgttttgttattagtctatgtttaaatgtgtgtacacatacatcaaaaaaatttggatggggaactaaacacggccatactaccttcgtcttagatataaaaatctaaaatcggatgaaatatattctaatactacaattctggctatgtctttttttttcagattcataatattataaaatgttttctttggatctagattcatatatattttagaatgaagatagtagatggcattgttgatttttggctaagtttaacattcatattttttttaaaaaaataaatataattgattttagtgtgaattatattaatattaattagacgtactttaagcatttcttatatttctacgtatttactaaaaaatttagtaagttgaatagtaaaacgtatatctaaaattcacggtgtcatccattaaaaatcatgaggagcatttcacctggtttctggcaaaagaaaagacgtacagacaccttaactatggagtaattttgcaaaccaatgagttaattatttgcgactcttacaagtggtgattagaatttgtcactggacccatatatcatagacacatgaaggcccacatgtctattgagtgacaaataattaagagcaaattgcaccggctgtacatgaacttgtcgggtgtgtgcaatctagtgtatgaacttgtaaaatactcgttttggtatatgaacttatcttgtgcgtgcgaactaaggtcaaaagtacaataaatgcacgattaattttattgatttaggtgctgattaggatactgcgtaaatatatatacgagaaggttgctacttagacatacacctattcaataaaaagataaaataagataaaatgagatatagcgattgtagagaaagatataaaaaaactgagcaataatacaaggttagaaacatacggaatttaagataaagtagagaataaatttataaatatagtatgttttatgcatactcactgtacgtatgtacgccaccttctaaccaacatcagctaggtaaatttaaccttgccaagccattttggcacggattagataagttcgtgtactaaaataagcattttacaagttcatgtattaaattacaaccacctaataaatttatgtaccaccaatgcaatttactcaataattaattgctacatcttaaatttacgaaaagttaaatttccccaaatgtaagtacacccttcaagtttagagtttagccatgaatgtttggatgtatcttatgcactttgcacctgagataggtctttagttttaggatagcgggtattgtatttgtatcatctcggctggaaacgaaacttccattaattgagtgattatggaggttgccaattcaatactaatgcacatttaattgactggttgcaagctggtagtggtacaccacttgccactgccactacatagtactagtacatatattcgatttttgtaattgttagttagggcatgtctagatcccgcctcaaaattttacaccttatcacattgaacgtttaaatacatgtataaagtattatatataggctaataaaataactaattacacagattgtgattaatttgcgagatgaatcttttaagcctaattgctccatgatttgataatgtggtgctatagtaaacatgtgctaatgacgaattaattaggcttaataaatttgtcttacggtttactgacggattctgtaattagtttttttattattgcccgaacaccccatgcgacaccctatataatacccgatgtgacacgcccaaactttacaaccttatatctaaatacccccttaattaagtggatgttctattgtactacagcatactgcaccctctgcatgcccatacatcataaaaacactatgaagattttgtacagaactaagcagccttattttttcgcttatgcttatgcttttacttattagctatactttaaatttttaaacttaaatttagagttgattttgaggttttctcattaaagtttatttttcagcatttgcttttagattgctaagaacatgtatataaaatttttatttataaattattttttgtttgtaaatatgttgtttggctaaacgatgggagacttcttctgtgcgtgcatgtcactcgccaactactaactgacttgctttggatggactccttccagaatgtttaccattccacgctcaccctattttcttgttacgcttaatgggaaactgccaaagaaagcaggtcaactcgagtccccgaagtccaaaccatttgagtgcagtttccaaatcacattcatgacgaacggttggatcaatgagctcccatactgcaggcctttcgcagcacgtctggtcctgaaaagaactttgaagtggttggctgcacgaaagattggcacagaagaactcggtcgatcgtgtcgtctctgaattgttaggtgtcagataaagtactcatgcgtaagaacacagcatacctaccgcatgagagggggttccattgctccaacgcatactgtagatgttttatttgtacatgttgatcattcaacacttccagtatgtgccacactaatgaagaagtgacctttgctaggtcatgtagaaattaaattagtcccggttcgattagaaatcgggagtaaaaatatctttagttctggttttaaagctcacagatactttttgatttttagtcttagttggtgttaccaactgtaactaaagataatttttagtaccggttcaatagttgtcaggtcccaacgaacttaccaaccaggactaaagatagatctttaatcccgattggtatcaccaaccgggaataaatatctctctcccacatcatccccatctctcgctctctcttccttatctcctcgttgcgcacacgcacgcctcctcttatcttcttatcttctactccttctcctccttccctccactctcctccgatcctctcttcccctccacctctacgtcggcggcaggcagcgccagatggcaggggatgggaggcggggggagacagtggggaggagagggcagcagacgcgcacggatgggaggcggcgggcagcggcggcgcacacggaggggaggtggcaggcggcgggcaagccggagggaaagcgatagccggtgggatgacttttagattttgtgatgtaaatttgtggatgattttagatattttttgaatttgtagatgattttgtgatgcaaatttgtagattatttttagatgcttttgtgaagttgcggatgattttgtgatgtcaatttgtggatgattttattattgagttcggttcaaaatcaatatacaagtagcaaaaaataataaaataaataaaataaaaagcgtaggccacgtggcgctaccatatttagtcccggattcggggtcctggtttgtaaccttggactaaagaccacttctccagtagtgccagttcgatagtactccctccgtcctattttaagtgtaaccataagtttctgttgaccatctgtcttatttgaaaaaattttataattagtatttttattgttacgagatgataaaacatgaataatactttatacatgacttatatttttaattattttaaaaaaaaattcaaataagatgaacggtcaaaattgtgtacgaaaaattatgtctgcacttagaatcgaacggagggagtagctacgaaggtggagatatttaaccatttgccacatttagatgtggcaattaactttttgccactggacccacatgtcatacacacatgtgggtccacatgtcattgagataggggtggcaaatagttaaaagcccccgcccaaatgacacaacatgcatgcaggtctcatcagtcactgtattggatggaggccctgtttagttcccaaaaactttttcccaaaaacatcacatcgaatctttgacacatgtatggagtattaataaatatagataaattaaaaaactaattgcacggttaggggggaaatcgtgagacaaatcttttgagcctaattagtccataattagccataagtgctacagtaacctatatttgctaataacggattaattaggcttaaaagattcgtctcgcggtttccaggcgagttatgaaattagttttttcatttgtgtccgaaaacctcttccgacatgcggtcaaacgtccgatgtgacacccaaaaaatttcttttcgtgaactaaacaggcccggataatgcttcaggaaaggaagaagagaacgacagttcggtacagtgtcaaggcgagaagaaacagaaccatgctgttgtaagagcagtagaaagaagagaaaacacagtacaaacatatcatttcattattccagttgtaatttctactggatactaccagtaataaaccgtcgtaaatgttttaattgtaatacttcctccgtactcgtaaaagaagtcgtttagaacatcgacacggtctccaaaacacaactttaacttcttatttctataaaaatatttattgaaaagtgatatatctatacttttatgaaagtatttttcaagataaatttatacatataatttgttacattttcaaactcaacaacttgagaattatttattgatttatatttccaaagtttgacttaaacattatcctaaacgactttctttatgagtatggagggagtatatggttctattgttgttgaaatgtccttttggatcgatccaatagctagctactatctccttttcagattataatacattctagcattgtccatattcatatagatattactccctctgtaccataatataagggattttgagtttttgtttgcactatttgaccactcgtcttattcaaaaaaatttagaattattatttatttttttatttactttattatccaaagtattttaagtacaactttttgttttttatatttgcataaattttttgaataagacgagtggtcaaacag

SEQ ID NO: 82431 - DNA, 5866 bp, Oryza sativa
cgcgcgccgtgggatccacaggcatggcggccggccaattccttgacctcgccggcgccaccgccctcggcgaggccgaggtcatgaaggttctgacgaagaagttcggcgagatggcggagtgctccgccgcctgcggcgccatgctgggaggcgcggggcccgacgaggaggccgcgctgcggcgctacggccgcaccatcggcgtcctgtaccagctcgtcgacgacatccggagcgcgtcgggcaacggcaagatgaggagcaatgccagcgtcctgcgcgcgctgggcatggatcgagcgctcggcatcgtagaggagctcaaagcgcaggccaagatggaggccgacaggttcggtgacaagtatggcgaaagggtgcttcccttgtacagcttcgtggactatgcggtggagaggggattcgagctgcaggatgcagctacaacgccgtaggcacggaccgcgcagaccaaccttgatgctaccggatatttgaagttctgagcaagtggttatatatggagttatatgctgctgagatttggtgagcaattcatctctgaaattataagtttcaatgagaaatataaagattacgccattgccatctagggcagatgtctggatacttatgctgcggttctgatctttagttagttgctgaaataagacgatgtgactaaatgaagaattcttaggataaactaccacaattgctatgccttggtgttacatgtgcttaatatatataatctgatcacaatttcaaagcctgtattgagcttcccaattgtatcaattgttcatttggaatcatcaaagcataatttcgatcctcataaagtatattactggttcttcgttttcgggtgaaattagccatgatagttagagcatttgtagttttagcttgattgacttaggtttgagttgaaaatcattgccaattgggtcaagcttatactaggaatctcaccttctcaaatcaattcttctggcaagttctattcaggtacgacgcagcacacatcacaccggactgggatcctctaggtcaggtgactttagagtcactccacaccactggtcagataatcccacatctctccacaatccctgaattacttgcacccggacccaacatggatgcagccatggctgccccctctattctagcacgcgatggaaggcgcaaccatttaaacagaaaccagccggtggccggtgcttcatgcgcaccaccagagccggcgccgatctacatctccaccagagtatcagatacaaaaaccagagtatcagactcgacgaacgacgcagcaggccattggcctcgcagcttcacggcaagggtcgttggttgcctgggctagccgtcggaatcagaaataggagttcacccattgaactttttattactgctttcaccatttggaatgaaaactctttatctctgtatctacgttatccatcaactacacagcaccagtaattacatactgcaccaactaccaagtgatgatggcttcaagcacactaacaataacaaccattgctagtttttacatgctatccactacttgctagttgttaccaagctcttgcagcgcagaacacttgctagttgccaccaggatcttgcagctcaaactcgatcaaaggcatttcctcctctctgtaatctcatagctgaatgatctggtgcattcaccgattcagtaatcaggaatagttccatgtcgttggcatcctcgtggactggatagggggcgcgtttcgcacgttcacgtcgagtggcagcatcctgtattctatgtcgaggtccttgagaactttgatcatctcttggagcaccagctccctccttacgaacctcatccccatgtcctgccagttgagtgtgtgccggagccatatggacactttcagcttgttggtgtcatccacatcacggaggacaatcattgcaccaggataccaatggtccttcttgttgtcgatgtaactgaaatttagaagtgaaaatattgattagctcggcgtggtaagatactaacataagcagcaaatgagctcatagatgcctgactgattttataatctgataggaaggctgtaactatgatgaaatgttcttatgccctaatttagtgctaattcataggccttaggtggggcaagagtgcaggcacttctttcggactccagtagacagtattaacagaatcaaattctcatagttgcatttttacattcatagttaatcattcattgttgattagatttcatgaggtcggattgtattgcaacaagataagaacactaatacataccgtaataatctttccttcataagggctaatttctccactggggtggcaacatgaacggagaagtcaattccttctcccatatcaggactcctgtagtaattcataatcggttttgtggcaagtacactgtttggataatagatcttcaggttatcatatcggagaaacactgttgtcattatattcatttcctcaacaaccacctgaaattcaagtagttcaatctttagtaaatgaatgcaaggtaatattcatgaatgaagattaaagaactttcccactacctgacaatcttctatttcgcagcgatcaccaacatcataaggatgcatcacgaacaagaacacaattgcctcaaaaattgtcttcaaagtattcccaaatacaaaaactgccacaagaacttgtgaactgaggaagacaaagaaatgtgttgttgctatacccagaataagtagccagagggcaaacacaattatcccaacaacaacattaaccatctggttgagcttgttcactgcagtctttgtatcattaagtgttagggcaagggctttgcgctctctaaatgcattcacctacagaagaatacatacaacaatattagcaagggcattttcagaactagctacgggaatgtttggattactgccattgttagccttgcccattttttgggggcaatggcaagatttggtcattgccaaaaaattttggtaaggtgcatgtttggattgttgccaaaatatgtaggtactggtatttcgtttggtgccaaagggataacaaaattttagttgcaaaccaaatgagcaccttttttttttggcaacaccaatattttggtatagttgatattggcaaagaaccaaacacaccctgtgactcgttattataaatcaatatcgtgaaagatcattaccacccagttctttagagatctcttgctaaccctgctgtgctcctgtgctccttcgaaaagatccattgttttgatggcttcttcctgcctcatgaaacgcagcaaatctgacaagtatatatacctgcagtattcatatgtttgtgattaggaatttgatcagaaatgtgcaagttcagaatttttgcaatccctgttttcaataagctttaaacacctgtaacttaatactaaagatatataggatgaaatattagcatactagcatctccaatgaaataacactgactgtccgcacgaccaccgcacgaactaacagttcctacattacagataaattgcagttgcttgtctgattatctatattgtaagaactagcaatgatggcacttgcaggagattagggaatctaaccatactatactactgacaatgaagacacttacttggagccaggcttcgccacattgtgaaagatcttcttggcagcaatcttggcttcatattcactacgaatctgtgtcgctgactcatccccctcacccgttgcctgctgtatctgctcatccattgtcgtgagcgtcccaaaccgaacaatcctcatcaaccttttcatgttccaagctgagatatttttctggttgagtttatgaagcttgtcaatggtgatcccctcctcaatctggtgctctcctttctcttttgacagctgcttgctcccttctcccttaggaatcaccccggacatccgaatactcctttgccctgaaagattcttggttggtacagtggaacggagctcagctgggatggttgctcctgcgcgttgaagctcatgcatctcagcaaggaattggttttcgtcaactaggggcggcccggagagcgtctcgatgacaaactggttgaacaatgcctcctgaatccggtcaaagtatgtgttgacatggaaggaggatgccagcaccttgagcagcagcgtcttgacgaggcggatgagcgtggcgacgaggaagcagaacagtatcttctgcacgtagggcagcacaggcgagttcgtctcccgctggacgttcttgtcgaacatgaagtgccaagaggagagtaccaggccgagccagagcgcgttctgcacggcgctgcgcacgccgtacacgaagtagagcacgcgcttgcgcagcaagaagttgcgctcgacgcagaacacggcgatccggatgacccagccggagacaaggcggccgcagatgagcacgaacacgaggagctcccacttccagaggtgcagcccccagaccttcttcccggacagggccttgatggtgagactgcacgccaatgccgcgatgatgagcaccaagctgagccactgaaggatagtgatggcgtccagcttcccgcgcttgaattcgtcggggatgtcctcgtccatgaatgggtcctcctcctcctcttccaacgggcccgacttggcgatttgcccggacttgccggtcatgaggcccgagatgaactggccggacttcgtaggcgtccgcaagacagaggatctcctctcctcgtcgccgacgggagggaccgcggacgccggctggggctgcggcggcgggtccatcagccgggatcgcgttttggctcgcatcaagtgtcccgctgcagtggaactggacgtgcagcgaacaacctcgccgtcgtcgccgccgcgcctacggctacctccggtgtcggagtcggagtcagaggacgaggcgacacgccttttcggttggaaggagactcgcgcctcgcgttccagggagtttgagaaggatggctgcgcatgcagttgcgacggcctcccgagctcctccatgtcgaggtccagcgacagctcggcgccggacgccttctgtttccgaaggaagttcccgatgagacgcgtgggcggatcctcgccgccgtctaccgcacccgcagcgtgtgccggctgcggcgatagcgaaggggacgacgcctgcgacgacgaaggccgcggcggcgcccggttcttgaagctgaacgcctcgcaggcgcgccggccaccgccaccgccaccgccaccgcctctgcctccacccccatcgctgcccccgtccccgccgccatcattcttccaaaactcaacgctcccgtcccgcctcaccttgggcggggatcgcggcgagttggtccagctggaccacgtcctgctcgccccccgcggcgtgctcgccgtggagtcggtgttcgggctcacattccccgccccaccgccatcctggccggggaacgcgaacggctcgcggcaaggcccctccccgtcgatcctcacgaccacctccccttcctcgccgccgtcacgatcggccgccagtccggaccgctcatcgaacacccccgatcccacccgcggcgaggacttgcctgagccatgcgacctcaggctactcttccgccgcacctgctccatcgccgccggccaagaaacgcccactccaaagatagctagtactagtagccactctcctcctcctcctccctctccccccactcctctcggccggcgtctctgctatacttaaccagagtttaactaagggattaatact

SEQ ID NO: 82432 - DNA, 694 bp, Oryza sativa
attttggaatttccgaaaatgtgtatgccgcccaaaacccctctaaaaattttccgacatgtcccaaagttatttttggaattttccaaaatgtctagggggagattttggttctggatattctaacctgtccaaaaagttttcgaattttccaaaaaccttcagtgacctttactattttggtggtctggaaattttttgatttgtcccaaattaatttttggaatttacggaaattggtatttatggtcataacgggtagatctaaagctgtggctataaatagcccactctctctacttgtgtgggttgctggtctgatcggatattttcgtgcccttggcttgttcatcttgagattcacttttgagccttgctttcttgtttcccctctccacctgtgtttgattcggatttggtgtatgtgtgagagttgtggattcgagtttgtgtgagtgcctgttgttggcttcatgaagatttgtgagcacttgcatcatctccaggagatctttgcatcatttgtactcttggaggttgaggactcctaaacggctaggtattactctcaaggccccgatcaatatgtgggtggccgggaaaagtttgggaaggtcggatctccctccggaaagaaaggaattcccctaatggaaggaacagtgctttgggccacctcctgaggaaagggtta

SEQ ID NO: 82433 - DNA, 930 bp, Oryza sativa
tattctggaataatctctagattggattagtaccatgcagagaactttcgtaaatgtgagcctcctcactggagctagtacatagctcagttggcatgtttcttgtttggctggaatggttatcgtcccttctaaagctttgatccttcttaaattccgtactgccagaaacagcataggtgtgcatcattctggtttgcatgggatatatattctgatactttaaataataggcactcccaacatgcacatgtctccatgtagaagagccaccagccatgctgctacatgatgtgagcattaacattttcttcaccaaactaagatcttcaaagattgattttggcgttgataaaaagttttgagagctcagaccagttgagttttcagcacagcaagacatcaatgcatgttccttttgctctttgctgaagcacacaggttcatctttatgcagaatttcatggctctcggatatttgagctgtgccggaagattctggctggccgacaagattccagatcccagtcaatgctgatactaactgtggagtggttaatcttctatctatagatttgcttcctgactgagtacttggcttcgattggttattggcattacgatccttagtaagaaatgcatccagatcaaactgatgaccatctaatggaagacggtggtaattgattgttggttttctaacttttggagctccacattttgagctcatcttttacaagctagcagcaaggtcataaaggaaagctagtaatcaactgactgagatctgctagaggcaagaaatgatagagcaaatttagcacactgaagttcttgtatagtaccagaatttatttttttctcaataaaaatagaatcatctcactagcaaagaccttggggtgggttgataagaacagcagcaaaaac

SEQ ID NO: 82434 - DNA, 618 bp, Oryza sativa
cgttccagtactggctgcttccctccgcgattgtatcgtacaatatctgttcctcatcgcgatcagccatctgttcatacaagaaatagttgctaagtctataggtcatttttgctttaacaatcttatatgctaacaatcatatatgctaagtcatatatgctaagtctaactgtcgtatatgctaagtctaattacaaatctaataatcttatattaaaactataataatcttatactaaaactcaaataatattgtattaaaactgtaatagtcaactatgctaagtctaagtgacgtatattaggaccctagtcaataattatatactaagtctaattacaaatctaataatcttatattaaaactcaaataatcttatactaaaactcaaatagtcatatatgctaagtctaactatcgtatattagaaccctacacaatcttatatgctaagtctaattacaaatctaataatcttatattaaaactataataatcttatattaaaactcaaatagtcatatatgctaagtttaactgtcgtatattagaaccctacacaatcttatatgctaagtctaattacaaatctaataatcttatataaaactcaa

SEQ ID NO: 82435 - DNA, 10801 bp, Oryza sativa
  unsure (1)..(10801): unsure at all n locations
gtctctttaattattgcccacaggaaatggagagtccaagtttgttagtagtactaataaactcccttccctcctcacaatcagagagagagagagatcgcgtgcgatttgacagagatgctgaattgctgatatgcttcgatcatactggatggtacttgttgcatgcacacttgacacggcttcgacggcgctcgcctggtaggtgatccatagcaccacacaatcacaatgcgagcgtttcattcgagttagcctcaccaaacatcccggtagctattaataagcacggctccggccgtcaaataagctaaaaaagtctacccctaaactagccgaaagtgatcgatcttaataatataaagcagtcctttgcttgcctgagcagcctaatgactagatagattgacaaagggcaaccttatcgttaaaagatatacttcgtctggatacataattcttaacgataataacgtgatattcaaaatatatctagactatatttttctattatataatattattatagtattttaaaagacaaaattatatatgttgttctagtgattttaactaaatatttttaaatttattgattagtcgaaattataaaagtttaatcctaacattattcaaatgtcaaagaattttgtaatcggagggaggaagtactagatagtaatacagtggtgactacctatacaactttcaatgaaaacctcaatacaatctttgaaatataacttataatataattatattgtaactttaatataattataatgtaacacatatatgctccctggaaggtaatttatacgagaaacttgcgcggctcggttggcagtgtaatcatgaaagtacttgtttaaaaaagcatatgcaattaatcttggtaagtttatacgtgacaactaagtaataccattgcggaccgtagatattcgacgttgttaatgggcgactggtcgcactggggcacgccctcgtgaccggtgatcccctcctctagtctccttagtatgtactctctccgtttctaaatatttgatatttccttctaaaaaaatatttgatgttgttgatttttttaaacatgtttgaccattcgtcttattaaaaaaattaagtaattattaattttttttattatttgattcattgttaaatatattttcatgtatacatatagttttacatatttcataattttttttaataagacgaacggtcaaacatatgctaaaaagtcaacggtgtcaaatatttagaaacagaaggggagtacgtatgtatatactttacatacatatataaattttatacatatgtatgtaaagcatatacatatgtatataaaattttttatatacatctaaaaaagttatatgtacacatacataaaaatttatacttatacatataaaatatacatgtatacgtatatgtacacagaggtaatatatacacacaaataatatatacgtatatacggacacatacaaaaaatttatacatatatacaaactctatacatatatgcatacaaactttatacgtgtacgtacaatatctatgtgcatacgtataaagtttatataaatacagacgcgtatactacgtacatacggacgctgccgtgcggactgattagcatctgtggcggatgtgtgcacgtatacgaatcttgccaggagcttaatttccttttttctcccgaactcatgtctgtttctgtttgtttgcggttctgcgtgggcagtgggcagagttggctacccaacggtccaagtgaccgtcgcgccaagccgcgaacccaaccggcgaccggcgaccaatcccctccgagactgtctccaatctccggtcctcctccatggctagcgtaggcgcgtagcatctatttatgctctcagattcagagtcctaccactcgtacacacgccggtcagcaacatcacatgcatgctagcaagaggttttcgttagcctacgccctacggagtagtagtagccgtatcacattacatgcgcgctgcggcacacaattgaagtcttcgagttgatctgccggtagatctagctaagctggagtcactttacacttgcatttgcatctgcattgaactgcactgcattgcattgcagttgcactccgtctatctagctagctagccacgcatatgtgtactgcgtgcagatggatccccatttaagcgtctgcgcctccgccaccaccatccccatggccacccttcaatgcggccgtgcattcaatggctcgccccgcggttaggtgcccgtcgatcaccgcggctgatcaagtgatcattgcctcattggccactgatccatccatcgatcggtcggacgcccaacggcccgcgcaggcgccaatttatggtcgaccggctccgtgctcctcgcggccgagcgaccgaaccggtcaccaatcacaaggcaccacaaactatggtgatcaatggatcgactcaccactcgcaaggcaccacaaactctgatcctgatcaatggatcgatgcagaagtcctcgtcgtaggtagtgttcccttcaaactttcaacttttccatcacatcaaatatttagacacatgcatagagcattaaatatagatgaaaaaaccaattacacagtttgcatgtaaattgcgagacgaatcttttaatcctaattacaccatgatttgacaatgtagtgctacagtaaacatttactaatgacggattaattagacttaataaatttgtctcgtagtttacaggcggaatctgtaatttgttttgttattggtttacatttaatattttaaatgtgtattggtatgcgtcaatttttttttttgccaagacaactaagcacggccttagtatatgcgagtgtagcgtacatgcatgtgtgtacgtaggatcggagttgttgcgtgacttgcgtcctgctgctgcatcgttcatgtacactggtacatgcagagagagagagagagagagagagagagagagagagagagagagagagagagagctcgcgcttggtggtagcagctaggagtagcagcgtagcaggaccggtgcgcgacctgcaataaattggcatccatctcgactgtgctccgaccagttctataaaaacctcggtctctccctgctgcactctgccatcctcattgcttgctccatgtggagtcacttagcgcagtgtagctagccatcaccgggcattctcatcggatccatacagccctagctagcagctgtacgtacattacagagtttgttgccagaggaaaatggaggtggggacgtgggcggtggtggtggcggtggcggcggcgtacatgacgtggttctggcggatgtcccgggggctgagcgggccgcgtgtgtggccggtggtcggcagcctgcctgggctggtgcagcacgccgagaacatgcacgagtggatcgccgccaacctgcgccgcgccggcggcacgtaccagacgtgcatcttcgcggtgcccggggtggcgcgccgcggcgggctggtcaccgtcacctgcgacccgcgcaacctggagcacgtcctcaagtcgcggttcgacaactaccccaagggccccttctggcacgccgtcttccgcgacctgctcggcgacggcatcttcaactccgacggcgagacgtgggtcgcgcagcggaagacggcggcgctcgagttcaccacgcgcacgctgcggacggcaatgtccaggtgggtctcgcggtccatccaccaccggctgctgcccatcctggacgacgcggccgccggcaaggcgcacgtcgacctgcaggacctcctcctccgcctcaccttcgacaacatctgcggcctggcgttcggcaaggaccccgagacgctcgccaagggcttgccggagaacgccttcgcctccgcgttcgaccgcgcgaccgaggccacgctcaaccggttcatcttcccggagtacctgtggcgctgcaagaagtggctgggcctcggcatggagaccacgctggccagcagcgtcgcgcacgtcgaccagtacctcgccgccgtcatcaaggcgcgcaagctcgagctcgcgggcaacggcaagtgcgacaccgtggcgatgcatgacgacctgctgtcccggttcatgcggaagggctcctactcggacgagtcgctgcagcacgtggcgctcaacttcatcctcgcgggccgcgacacatcctccgtggcgctctcctggttcttctggctcgtgtccacccaccccgccgtggagcgcaaggtcgtgcacgagctctgcgccgtgctcgcggcgtcccggggcgcccatgacccggcattgtggctggcggcgcccttcaccttcgaggagctcgacagtctggtctacctcaaggcggcgctctcggagacactccgcttgtacccctccgtcccagaggactccaagcacgtcgtcgccgacgactacctcccggacggcacgttcgtgccggccggctcgtcggtcacgtactccatatactcggcggggcgcatgaagacggtgtggggggaggactgcctcgagttcaggccggagcggtggctgtcggccgacggctccaagttcgagccgcacgactcgtacaagttcgtcgcgtnnnnnnnnnnnnnnnnnnnnnnnntcggcaaggacctcgcctacctgcagatgaagaacatcgccgggagcgtgctcctccgccaccgcctcgccgtcgcgcagggacaccgagtcgagcagaagatgtccctcacgctcttcatgaagaacgggctccgaatggaggtacgtccacgcgacctcgcgcccgtcgccgacgagctccgcggcgcggacgtgagggccaccgcaccatgcgcgtagaagatccgagggccccgctcgcgccaagattcgtgctgatggaggcatggaacattcaatgtgtagataaagagagagtacgagacagtaagtaaattaaatgggtttggtgggaacatttaagccgcttcttctctgaatttaccatccggatcagagaaacttggatttttttttttttgcaaagacgagatctacttggatttggatctgagagagcagaagcggagaagcaaaaaagagaactaaagaaagagcaataatttgtgatgtagctaagatgcagagtactttgatagtatttgttcgagttagtttgtgttggtgaccagccaactattatatttattttattctattcttaagagacattttcttcttttccaagcctcgatctatcactatgtgattctattagcgacttgctaattaatttgtcaaatagatctataagtagtagtaaacgtgtacttaaggttgcctacttcttcacgagaagttcctcagttttccgcatgtaaggcacaatcgttttgctagatttccattgcgaaaagcagaaactctgaggttggcatgatgccgttttcgtccgtgcgcatcgtcgccttgatagcgttctgttgcgcaattagatccagtgagggatcggactgcggagaatttcaggcgcgtaacgacgatgtgcagagagcatgcacttgtcacaggggttaatgtgcaataggcgacagcgatatgtgtttgtgttcagttgctcgtgttgccttctgaagagaggatctgagaaaacgattgatgatgatgttggggcaactggtttagactacatgttggctgtcacgtttggttttggttgatgcaactacataatctaaccacgcctaccttcttttcggcaaggatatatggctttttcgtggactttgacatctcattaaaaaaaaaaagaagtataccacactgcaggcgtgtcagtttcacctagatgtcctgagacaataacagtcttgcgttgcagcaatgaggtcagatccagcggtccagcctccagttcacagtcagagtcctcttccatgtagtacatcctgcaagcaccttacctaaccaaactaaccgagtcaagcaaacaactaatcagtcgtgaatacgggatacttgtaaacgaaattctcgacacacaccaataccagtggctgttttcttgtgcgaaacgggcgcaggaaacacgagggcatggccaattccgttcaacaatcagttttgctgatgcaacttgagcatttcggggcagcaaccatacacgtctcatctatcgcgctggtgctagcacatcgcagttactccgctggtgcatgtatatggacagagcagcgggccacaccgtctccacgcagagtgtcggttcgtcggggtgtcacggacgaactcgtttccccgaacgtttttgtttttgtttttttttttttctggaaagagtgctggaggaggcaatggtgcgcctgtgcacaatttagtcgcatttcgcctgacgattttcctctccaccgtctctctccgttcctctcctctgctcatcttatctgttcgtctgaaaaaaaaaaaccgtttccggcggacgcacgggcggaggctcggccagcgttctcctcctccgcgacaccgactcgcctccgtcgcgcgcgcggccggcgagcagggccggaggcgcagtgcggacgggctgctgctccccttccccgaccccctaccgcactagtattctcccctgtgcggccggccggcgagcatctcggttcgaatcgaagtatcgaattgaaggtattccttctagtttcgtagccctcctctctcttcctcttccatgtgctggtgtgggtaagattgggagtcgattcggacttgattgatttgtttccctgtcacctagccgtcccacctcgtcccgatttgatttgtttgttgcgttcgtggtgcggtactaataacagttttgtgtcctaacaaatttgtgggggttcagctcaaccccgatatcccacgttagatccgccccctggagtgtagaactgtgctttggttgttggtttcgcggagaaatgtaggtatggagccaaggggctgtgacagtttggtaccgggatcagttagctagaactggttcggctccgagtatagtaggatcaccgacttggagagtgtagccatcacatcggtacatgccactctgcttgttaagaagggaatttgccggaggttggaggcactggtgggattaaggaggaggtagaagagcgcaattatgccatattgctgctagctcgacaggaggctgataacacttggacagaaatggcatgaaaggttgacaaatgttttgtgatggcagagacagcctatttagtggcaatcggcaaaacagagataggtgaaactttcagtggtataggagttatctctgacttaaatgatgcacggggcaattagtgacagaataagtactttatctccttggcatttcattttagagcaatgggtggcactgtagttatttgctcacagtaggtgatagtgatgtagcaagcttgaaagcttgacatgtgattttgttcattgtggttttaagatgaaccccaaaggtaagcgttctagtaattgctacttctacctccaacttccaggtattattaaatttaattaaatttaacaaacagcacacagtttgcctttatactctcaatggtcatgtacttctccattaaactcaactcttttgcagttgtgtggaactgtaatgatgcacgctgttagtgacttggtcctcattattgttatttgttaactttcagcctttgtggtgaaggcattaaacagaaatcaaagtagcatgagcaagcactaactgggaatctccataatacagcattccagtgagttgaggacttttttttgtcactacagaaactaaggatacctgcgtgatttcaaaatttcaatgtgtgattagctcagtgaaatcctgtccaacttgtttcatattcaatatgccaccatggtgggggaagtcttcatcaaaagaagtaaagaagactgccaaagaaaacctcattgacacatttcatcggttattaagtccaaatgagcaaaaggggagaacaaaatcacgggggaatcgtagacatagtaaagatccaactgctgagaaaggttgctggtctactgcccaatcacgctctgcatccccttcaaaagaggtttctcgttgtcaaagctttgctgcagccagagcacatgcacaaccacttccccttcctagatcccgtgctatggtggcacgtactgcttctgatattaccgaatcaaaggtcgttttggaaaagcgtggcaaaggacaacaactaccgctccctaccacaaattgggttaaagaaagacctgaaactaccgaacctgttgcagaattatcaactgcttctatctccagccatggttctatagatagcgatgatcctggagatttgcgacttcagggacctgtggcaaatgacaccgacaatgtggctaaagttgctacaaccggtaattcaaggtatccttcttaatccatgatttatccaaacacatttttgtttgtgtactttttttaaaaaatattcttatggatattgattgctctgtttgtgaagtgttgtgcataaggagtgttctagtgccatcaccagaaagggcactaaggaagtgacgatgccaaccaatgctttcttgagtaatcaaattctatctacaagtcccagaggtactgttgttgctgacagttaccagtcaaatttacaaaattcacgaaaggttgttctggacagtgctcccaatagtgtgatgtcaagcccttctcgaagcccaagaatattatgccctgatcagattccaagttcagcattttgggcagttaagcctcatacagatgtaacttttgttgggtctgctcagtgctccagtcctggttcagggcaaacatctgggcataattcagtgggaggtgatatgctagcccagctcttttggcaacctagccgaggtagtccagagtgttcaccaattcccagcccaagaatgacaagccctggtccaagttcaagggtacatagtggaagtgtctctccattgcatccaagggctggtgggatggcacctgaatctccaacaaggcgacttgatgaagggaagaggaagcaaacccacagattgccccttccaccactaagcatatgtaacaattccacctttttgccaaacaattccaccccaactagtcctatctcacatagtcctggtagagtagaaaatccaactagtcctggatcacggtggaagaagggaaagcttgtcggccgtgggacatttggccatgtatacattggctttaacaggtatgccctttcgatgctcggaattggttgatgttcatttttaatttcgatgcaaagcacaatatggttttcatcattaataaatcctacaatggtactaactcattcagctcttgtaatctctcccatatacttatttctcatactacatcctgaatcgtaataaatatcatggtttagtgattagtaaactggcatgttttaaacagagtctcattcagaaatatttcaccttcaaagcctaagacatcattattctttgagagtgtaattattgaagtggtcttgtcacaatgttgtttgtaacaagcactctatatatcctttgagtagtgtgccactgactattttattaggactgatcatcctttgtttctcttcaaatttgatataatataattctctgtcatttgtatcagtgataaaggtgaaatgtgtgcaatgaaggaggtcacccttttctcagacgatcctaaatcaaaagaaagtgcaaagcagttgtgtcaggtatgacatttttctccacgtttactgtccttttctttacgctatcttctctgctcttatattattctttatttaccaggaaatattacttctgaatcgtctgcaacatccaaatattgtacgatactatggatctgaaatggtataaatttatgccaccagttgttatcttctgttaataccactcctgttctttttttacttgttgaacatgtgtgatcattccttttctaacaacacattcataaaaaaaaatccttttctaacaatacatttataaaaaaaaattaaaatctaactacgtgaaggtattttccataacaaatctactagtaccattttcacatatcagatcttttttttttttgcatacactccatcgtttgtttctgttaggcgtatagtttttcaaacttttgcaagatatatgggctccatgcaaatttattaactatattccttatatgtccataattattactagtgtctctcctgcatttataagaagcatctcactaaccatctatttagctatttctaaggtatttaagtatggtaggatggtcaatttaactgctctttctcttggttctgtacaattattgttataaaagttagctgatatagagtaacgacgactaaccttctcgatcgcttcaatcattgatcacccaagacatgtcagatgacgactcaggaacacacgatatttgttaacgaggttcagccgaagcctacatccccggggctctgattatgggtgctcctccccaaccaatatagctcctagccgctacgagtccatggccaagccccatcatctccctgcgtgtctacgctacattgtagtcgccatgattacattgtcgtgcccccctctctatttaagagagatgacaggttacagagtccgactctactctacccctaacacctattacaactccaagtccaactgt

SEQ ID NO: 82436 - DNA, 12949 bp, Oryza sativa
gagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttgacagagaacatacccatcacaacgtctggagcatcctgagcggtttcagcttgaatgtgattcacacggcctcgaccaaagttgttggaagcacgtgaaccttgtccacttgcctgagagctaggacgagactgagttgccgctggagtaggagttctggcagtgctgccattagcatgccctgagttggtgttggtaggattctgaggacactgtctagcatagtgacccatctggttgcaccggaaacactgaactgctgacggtccctacggtgacttgaaagaggtaacgctgttaggcgcagtattgccactaggggcacgctgctgtggctgaggtgccggacggtttatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgcgttgttgatcatatgttgaaaagtggggaagtcatgagcaagcaactggagtctcattccaactgcgattcctttcaagaatttcctgatcttcttcttgtctgtgtccacttcctcaggggcgtaccgagccaacttgttgaactgacttaggtactcattgatactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctcttagttggtgagaggcgtagagcgtcttctcaacaggagtacactgcactaagttgagttttctatcaacatctttcaaccaatcgtcagcctcgacgggctcgacggtctgagagaactctggcggacgagacctcaaaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgcggcggggttgctcaacctctgcgttgcgggaaacagtacgatgcgaacggttgctgtggtgagactgctcattagctgattcatgattttcttctggctcaactctaccatcctcaacaccaaagcgggctggtgcacgagctgcacggcggggacggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaatcagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagttggctcctcagtcgaagaaacgtcgatcggctgacgcgaagggaccggcggaacctgtcgagggccggcagcagcacgggccgctggcggtgggggagctgggtagtggaaacggaacacggtggcagaaccaacaacacgcttccgcgcagtgcggataaagcgtgggccacggcgggaggaagcaactggggtgtgtcctggggtgtaggaagggctaactgggtgtgggtagggcgagtacactggtgagtacggcgcacgcgagctgggggagcgcgggccactgggagtgcgggcagagccgcgggagctgtgggaggacaggtggctggcgtggcagaggcggcctgagtcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggcgtggaagctgccggaaggcggaacctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgggggtaaaggtacaccgagagctcacagtgagggggaacacggtccacggagtaccccgtgtactcgggacacgagaagccaaggaaacgggagaggtcacgaagctgagcgacgtggtgaccctcaccaaaaccgtgggaactgaagctggcgttcactgccatctacaattttgaaagagggagaaagatcagtaaccgttttagaaacaaactattgaaaataaagaaaacaaaagaaaccttagcttttcgcaagtagttttgaacttagtatccttagggtcgtcctaagcgtcgggtttcgccctagggccaagcctgtgctctgataccacctcttgtcacgccccgaactagtcccgaccggatctagcccgtgacgctccaaattaacctgttaatcgataccagtcccaggaaatagtgctggtatcacaaggagacagagtatcacagcaacagaggtctctttattatagagtagaagtacagtcatgttgggctgcggacagatcccgagctcacaactgcattacaaaaggaaagcggaagccagtacttggaccaatcatcacaggcgcgacttgggaactaggccgaaaccctaaaactcatcgtagccgacttgctcctggaagaactcctcgtcagcaggatccacttcatcttcttcagcaactaggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgatttttcaaacatcgaacccagtttcacaacagcaatttcacaagcagtagtcaaacaaaactacgctaggaatcacctcacatccgcccatgaccgtgggcacggctgttcgagcagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaacctgccttgcagacgggacaacagattaagtgtgatcctatcaatgcataatatttcgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcggatttacggttgggaagatattgaatttctaagattattggatttttggtctaaaggaaaaaggatttatttaaatcctttttggaaaagaaaaagaaaagaagggagggagggaatatagacttttctcggacggctagggcgcggcccaagagaaatggagcggtctggccgagctaaatgggccggccggcccaaggcggcccaaactcgcgcgcgcgcgggagggaggagagagagagccggtggaccgggctcaccacgcgcggtcccgggtgggacccgcttgtcagcggctcggctcaccgtgcggagggagcacgcgacgcacgcacgcgggcggggaagggacgcggtgcacgtgcgcggttcgcggtggacgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcgaagcgaaccacggcgatacgggcaatagcgagcacaccgggcggttgcacgtgacaagggggggcgagccaacggctcggattcgccggaggttgctcgacggcggcggattgcggcggcgacaaccggcggcgggagaagagggaaacggcgacgaggtcacgagaggtcgattcccggcggtgagagcatctgcgcggcgtcaggaactcgacgctagcgtcggattggacggaactacgccgagcgaggccggcgacgagcgggtgctacggagctcgggcggcgacggcggcgagcacacggcgagcgacggcaacggtcggggcggcgccggctagctacggggaggctactcgtgctaccaccgaaaactaagggggggagatggagcgaggaggaagaacggagagaggcactaccgtgcgggtcggggcgctgtgacgagaggccgacggcgcgggagtaatctctccggcctcgggccggggaagaggaaggagagggcgcggccggagtcctcttccgcgtccttgctcgtgccggctcctccgacacatgcaacgacgatcggcgacggcgaaacagagggcggcaatggcgcggaggcgaaaatgagggagtttggagggggagggcttgggcttaaatggacggcaatgtcggtttgggagaggggaaccgacattggacggttaaggcgcgagctggcgctcggcgcttgtagccaaagcggcggcaggaggatgacgccggcgaggaggaaaaaggggaaaaggagggggagaaaggggcttgcccctttgccgattcgggaaaaagagggggaggggaacgggagcatcgcggcagagggaggaggggcgcggctccgtcccttggcggcttgcgcgcggaggggcgggggccgggcgatgacgacggcgatgacggcggggcgatttggagcggagcggcgacactggcgacaggcgcgtgcagaggctgacggcggcggcgaccgggcggtcggccaccacggcacgcgcgcgcgggaagcaacgggcggcgtccgcgcgggcgcgcacacgctggctcgcgaggacgagcggctgcgcggctgcaggcgcggcagagcgaggggaaagggagggggcgctcggcgcggcggcttacgcgcacgcgcgcgcggcgtgcgggcgaggctgagcgggggaggagagatgggagagcgcgcgagagagagagagagagagagagagagagagagcgcccggggagagagggggccggggaagaggggaagatgggtcgagcgagattcggcccatcgacctcgggggaggcaaaatagacttttgcggaggaatttgattggaaggatttggattcggaattgaactcgatgatagatcggggattgagatcttgagatggcacggacactagacaacaagcaaagaaacaaatttcgcaattagggtttttaagagatgattttcccgctaggcgccacgacggaacgggcgctacaatacacctctccgtgggtggttgatcttgacggtggagatcaaccttattcctgcaagcaaatcgaagaaacaagtaagaacaagataaaagcaatttgaattacagataggaattgaatacaaatgataagttggggctccgtaacgagtaaaccggcaatctaaccgatcacgggattacacggcaaagtagcaaagctaaactttaatctaaacaaaacccaagaaaccctgaaggggtacctaactatttaaagaggtgggaggacgaccaaggggaccctagggtcgtgctccatctggttgggtcgcaccccacataggccccacttgggccggggtcccaaacgaagttacaagcccataggcccattacaggtgacgcaacaccttgtttcttcaattgcggatgattgggatggaatttgacgatgaggctggatccgttggaaagaggactccgagagctttctatcaagtactaggatgtgtcagatccctccgaaatcccgtatattatgggataaatggaatagtatctaagtcacatcttactactcacttggtgaatatatattgtgaatggcctaatgcggctatactggtgtcattgtgtatgtagatccctttctcctactaaggccattcacagtgctccgacatgctgttaggccaaccctcgacgcgtcagagatttgcggctagctaggtgtcgcgcgtgaccaaatgaggtccacggagtctagattgggcattcgttcttctgacaacccaaaggagcacggtgtgggggagaatggcgtggccgcgttgtggaggtcatggccttgccgcttcgagcctccgtgcgtgtgttcccctccccatccctcgagccggcggcagaagaaaaggaagacacaacggtggaggaagaggaggcggtagatcttgtgcctaccttgttgatatcccccctcccaccgtgccgccgctcgtcgtcgtgcctcgctctaagccgccgagcttgtcgtcatcctctgatgtgcgccgctgctcgttgtcgtcgtccactccaagcatggcagcctcctcgacccctccgtagcctcggtggcctccatgacccgtccagatcgaggcgccaccgaggagagtgtaaaggtcgtgccaccactcgttattgttgctctaaactacgggcaccggcgaggagaggggagaagggatttggcgccggcgaggagagtagagaagggagatccggcgagccccgggttggatttggccacgccactactctgcctggtgccgtcgctgcttgggtcatcgctccccgtcgcggcgcggtggactgaggagagcacaagcaacaagcaaggcaacaagcaaccaagaagtcacacatggagaaaatatgaggaaaagtcacaaaagcttgctgcaagcaaccaagaagtcacacccacgtggagaatatcaggtactaccgcacagtagcgtgctacatattaccaacctaaaaaaaatacatcaaaaaagtcaaaaacaatatgaaaaaaaattcgagatgtgaaacactatgacatttgccatcacacaaaacatcaactcaaaatacaatgtgcacaatgagaaaaagaaacaattttgttctccaatagtatttaaacaaatcagttttctattccactgagatttgtcattttttctatgtgtatatgttgtattttgagctgatttttttacatgtcataggtggtgtttggatacagggactgatcctgtcatatcagatgtttgaatactaatttaaaagattaaatataaactaataataaaactaattgcataaataagagctaattcgtgagataatttttttaagcctaattaattcataattagcacatgtttactgtggtatcacatggactaatcatggataaattatgctcaatatattcgtctcgcgaattagttcaggttatggattgtgttttttcattaatctacattttctacttctaatgaatcaaacatccgacggtaactaaaatttagtcctcccatcaaacagccttgcgcttgcacctctcaaaatttttctattctttttttttttgactttttcggtgtatttttcgataaggggactcatctctcaagtgcactgcttctcttcgtctcttcccccatctccggcgagccgtactggtccaactccggcggccaacgacccctcaactaccagctgccccaaaactggatccgtcactgagttagttaccaaggtatatctccccctcattcatatcggcggccggcgacggcgagggtgagaaactgaatctgtacaccctgttcttgcccagcggcggcggtgaagagaaggggcagatggacggagcagcagtgagcgtcgccactggggtgatgggatccctccttgccaagctctctgcattgctgggagaagaacgcgggcttctgaaaggtgtcaagggtgacatcaggttcttgagagatgagctgagcaccatgaacgtctttctgatgaatatggccagtgtggaggagaacatggatgtgcaggtgaaggactggaggaacaaggtccgggaactgagctatgatatcgaggattgcatcgatttattcatgcacaaattgaatcgcggggatgataaggtcaacattgttctcaagatggcaaagaagattagaatgttatggtcaaggcatcagattgctaaccagatccaagaacttaaggctcgtgtcaaggaagagagtgatcgccgtttgaggtactacttcagcgagtgcaatgcacatgtcgacgggactaaaattgatccccgcctaccggcgctttatgttgaagaagagaagcttgttggtatccatggccctatggaagagatcattgaattgttgatgaaagaggatggttcggggcaaaaactcaaagtggtatccattgtgggttttggcggactcggcaaaactactctggctaaccaagtatacaacaaaatcaaggatcaatttgattgctcagcttttatatctgtttcgcagagtcctaacataaagaaaattttatttgatatgcttaaagatgtgaccagccgagacaactctgatgatgataagcaaattaaagttgttggggtcaaaggagataaatccgatgatgagaggcaactcattggtaagctcagagtattcctagagaataagaggtacaaacaaatatcattagctatctctttgattcattgcacgttaatctttagatcctagaaattagtaaatgtgaccctatcatttggtaatgttgtccttttatctatggcataatttttgacatgctagtttaagaccttgcagttataagtattacctgaatttcctgtgcaacagcaaattcttttttggtgcaacagcagatttatatagtcctacatatgtttgttataaatagagcctatttggttgtacaaatgcaataactgtttatggtgattctgctgtagtaaatacgcgggaaaatttaacatacatccgtaacagatcgattatacatcttcatttgcagtgttctttaagtcagagccaacagaacaagttttgtaacttatagatatttcccttttttttcctccaattactgagggagccaatatatattagcatgattttgtattaaaatttctatagatgcaactcagaattaatttataggatgccagtaatgggagggtcagttgtggattagaagtgctgtggccgtgcagcttgaacagttgtcttgtcttggtgtcacagcatcctctgctattggttgtaattagcttcattgcaaataagcattcctttttgatgagcattatgggcttcgtctggtttgaggatgtaaatgaccttttgttctgatctgactaacagaaaggatagaaagaaatagtagggtatggaccagagtgttatttcacaacttcttttgattctaaatggcattctcctaactgtactgttttaacagccccaacagcagtgtacaccatcatttctaatactaagaatgccagttttactcgaaatttacaaagaaaaatggagatccatgcataataaccaaaaaactgtgatagcatctgcagtttggatgtaatgtaaaaggaaaatacatgcaacattgcaattgaatgtaatgaaaaaggaaaatacatgaaacattgaaaatgtttgctggcagagaaatctgaatgtagtgtactagtgtttcatgagtgtgagaggcaccaagtgttagatatagatggctgccctgcacatattatattttctttttaaagttcgaggtgaagaatacttgattaaaattgagcgataaaatgtggtaatattgtatttataacactatatatgtgtattaaatttgtcttccagaagcgttccggataattaaaagtggcataaatatctaatatatacttttagagtggcataatatcttctgcagtacttctcatgagatgtatactgcatttttaagttaaggcagactaataatctcctacatgtacataggtacttcatcattgttgatgatatctggagtgcatctgcatgggaacatgtgaggttagctttgcctgagaacagtctttgtagtagaataattacaaccacacggaatgtcaatgtggcaaaatcatgctgctctggttttcaaggttctgtttacaacattcaacctctaaatgagcaagactctaagaagctatttctgaaaaggcttttccactcagactccaattttcctactcacttggaagaagtttcacatgcaatcattaaaaagtgccatggctttccattagctattatctgtttagctagtctgctagctagtaaatctgatacaaaagaccaatgggagcaagtgcacaattctctcagttctgcgtttagttcacaagggatgagcgatatactgctgcttagctattatgatctaccctatcatctgaagacatgcttgttgtatcttagtgtatttccagaggattataagattgatagagatgaactgatatggagatggatagctgaaggtttcatcactgaagtgaagggtcaaacattggaccaagttggagggagttactttaatgagcttatcaacagaaacatgattcaaccaattgacatcaaatatgatggtaccgcaaatgcttgtcgagtacatgatatggtgcttaaccttatcatatccatttcatctgaggaaaattttctcaccgtagttgacgagcaagggtataaatatttgggtaataagattcgacggctctcattccagtccaactctgttgagaatgatgtgaatgtagttcaaaagatcatggacaacttgtcacaggttcgttcgctaagcttctttgaggtaccagagaaaatacctcctttcttaaaattccattcattgagtgtattggttttagtggattatgatttttgtcttggtaatggacacattaaataccttggaagttttttccaattgaagtatttgagagtcacttcttatggcattacccagctcccagatcaattcgggaacctccattatctacaaactctggatatacgtggcagtggaatcgaaaagtttccgccaaccgtggtccgtttgcataacttggctcgtctacttgttggcaataaagtgcaattgcctgatggtattggagatctgcaatccttacaggtgctgtcttctgctcggttgtataaacccctaaaacttgtggaagatctcaggagattgaccaaactaaggacgcttgagatagttcttcatggcagtgatacacttggtgctcatgagatgggaaggtatgaggaagctttggagtcttctcttactgtgttgggcaaacacaaaattcagtcactcgaaatttcatgttgtgattacttgagagataaattactggatttgttgtgctgcactgttccaaacattcagaagcttgtaatatctggcaattgcataaataggccttctcagcag

SEQ ID NO: 82437 - DNA, 679 bp, Oryza sativa
acccatggatgccgaaaacatatagggtcacgtaaggttttttgttaagaacacaaaggtcacacaagtagcttacttttgttggtgtattcaaagcaccctctattgatatgggatgcataaaattttttgtcggcaaattcacatatcactatagcaaagccagccaactaaaggggtaataaatcaacacatcatgagataaattaaaatttattccaacctcaaagatatgtagatatcaagtaatttcatcaatgcttgaccatgcattcaactgatccaaggaataagaaatacatgctcaaaagcatgaaatctgatgcaaccaacgtagcatatagactggtaaaaaatgaatagaaagagatgcagaggaaatttacttcttgtagctgaggtatgatcttcccatcagcaaacaaatcaacaacaatacctgtacacattaactagatgttgttaggccagaaaactttgagatgcacttgatggtgaagttgcaaggagtgtgtggtttcaaccccgacgttttttgttcaatctccaacacgctcacaatttcttcttaaaaattgtttggagagatgtctcttcctccaaactcttattttttaggccagaaaactttcaaagcctttgaaaactcaaaaagaaaaacattaatctaacagtacat

SEQ ID NO: 82438 - DNA, 2429 bp, Oryza sativa
cctgaaaaggacactaatattatctgcgatatatgctgaaggtttctgacaaaacctcttctcaatattataacggattcatccgattccattcctctgtttacctctgctctgtatacatactccggatagttcaactttatgtacgctaacatatgctaaccgatcacgtggataattaatactactacgtgtctgcatatgcgtaatacctgacggtcgaattaatggcagtgctacagtgttccaccggcaatgtggcgaaaacagtaaggagaacatgccaggggcgctgctgtagctaacaatgtctgtgtcaattgtgccatcctaaccaaatgttcgtagactccacgagtcatcgagtcgtgaggagtgacaacacgttacttgcaaagggcctcccttccgatcgatccaatgatcccggcccccgtctccgcgagagggacggccatgtgaggcgcccatttctctattcaacttcgccatcttgattagtccctgtctcatgattgtttttttgagtgttaattaaaaaaacttcgccctttttattgtcatgtacattaagaagaacttaaccacagaagtggacgtacttttattttttgttagcgtgggggcaggttggggtaggagtcgatggatggcccacctgtcagggagagtgggggtggtacacggttggagttggagacagttgtggctgcgctcaccaaaaggcaaggcaaatgcatcagctcaaggtccccggagtagtatataagtaggttggtgcgtcacattactcggcagcggacacattcactttgccttcgctttagcctttgtgctgtaacttgcaagaaacgtcggagtactcgcttgcgcgcgcccgcggcggcggcggcggcgacgagcgatcgcagcgggtgacgcggagatggcgtccaggtgcttcttccccagggaggccgaggccggcggccggcaccaccaccaccagtccaaggcggctgcggaggcgctcgagcagctgcaccacggcgggcgcgtcctgtcgcgggaggacgtcggcggcgcagtgcgcgtcaagatcgtggtcagcaagcgcgagctcaagcacatggtcgcggcgctcggctcgggcaccggcggcggcggggcggtggcggcggcggcggcggtgacggccgcgggggagcggcaccgtcagcgcgcggcgggcggcgccggcggcccaggcgccgagcagaggctgcagtcgctgcggcggcgcagcatgcggagggcggcggaggcggcgcggcggatgcaggcgaacggggagtgggagcccggcctgcagagcattcccgaagaggtttactgaatattataccagtagatggcgtcgttagtgatggttaatcacttgactaattaaggttgggttttgatcactgcctgctaagtctaagtggtagatgtacttgtacagcgctcttgatttgttcccggttactgttgagggttaaaccgttaatcctcccccaatgagtttgtgcatttttttttcactgtaaaattttggatggaagagaggggaggtggtgtttggactgcaatgcaactgctcctgatggtgtttgagtgactgtgagagtgattcagcgagtggctgaatttcttctcctttttgtttgtggcactgtaaaagtttttactgccactgcagctgatgtaaaatggttaattttgaagaattgacagtttactgtccgtgcttagtgcttactactccagctagtagcattaactaatctgttcctgctttttttgttcttttgcctttgtggtgagcatggaaaattatggaaagtattagttaggaggtgagcatacgagaaccacagtgctgagattccatttgcacatggccagatggtcgtcacattaaacaaacagatcttctcttgtttgttctgttatccactagctggctttgccattctgtgttgtgtggtagctgattagctgttccctttaccgctgtacgtacgggtcgttttctccagaattatttttcgtcaagctataaagtttttttgggctataaaaagatgagcttagctgtttgccgtgacgtcgtgtttgttgtaatctcatgtaaatttgcatccggcctaaacttttaacgtaagatcatgattcttgcagtctcatttagacaaaacttgcaatgcttttcatatttactggttcaattttttttataatggaacaaaatccggtctttactcaacaagctacgaccaattattttcaccagtttttcaagtatactgatcttagtttctcgaacacatgaactaagttataaggttaaattggcatgcaattttgtatatttccacgctttatttactctctcttctaatgtatgccggaaatgagaaagattgcgg

SEQ ID NO: 82439 - DNA, 946 bp, Oryza sativa
ccgtgtaatcggaaaattaactttccaacttcacggctgggggctaggatcagtgctttctcaaccaaggcaggtcaaaggtccaagagccttgtcccccgagaagaatcctccgacgacaaggctgggggctagggagagtgtacgactcaaacgactgccaaagtcgtgaactgaggaaacactcttacacactatatccagaggtacgaatactaccaagaaggccaacgccagtccatagacttgaaaaccttctccgctaacggtgccatcgacttcgccaggtggtctatctccgcaggagtcctccgagaacgagtgaacccttcatgaagaaactcgaggtgcatttgcggacaatgatctcgtatgcaagccaacacatgccctccggcatatcggctcgaccgacggcactcctgtttcagagcttcgtcaatccgcttgccgacgccttcacccgttcagccacgagatgtatccagccgccgactcctcaggttctccgcagaccactcgaagttctctgcaaactctggccatggatgtgcagcagctcttcaaatacgagttaaccacacctcacgacctcggagcgtttccacggcctgctccttttttacttccaacatggctctctcgagttccgccacttcaaatttcgtcttccaatattggatacgacgatcttggccagcaagtgcgtcctcgaggtctgtccaacacggaaacgactacgtcagactgcttctctctctcgagaacacgactgattaatcggaggagcgaaaagtgatgagagaccacaaacctaaggaagtcgtcgttgtccctgtcctcgcgggcaaaatttcacccacgttgtccagcaacgcgtgtcccacagacgcaagatccggagggatcgctgacaatttaggctgcccacgctgctggacatcct

SEQ ID NO: 82440 - DNA, 1798 bp, Oryza sativa
acacagttggcaaccaaactaggagccggtaccgcaccgcatcgcacctagaacgactcaaggggtcgaatacctgtgggctacgattataaatagtcacttcctatggaaagaactcttcacccaaaaaatttcccgtacaatcgctatagttgaaggcaagagacccttgtaatttccaaaaatattctagatgggaaacgatggagaaaaggcatcaaaactatgcaaggaggcaggagggcctagcctagattcaagtaagtgtaaccctgatttattctcagaaatagatgatgaggaactctaacaaatttcaaaggtagttcctcgtagaatacattgactgattaaccacctaaattaactcttgcagatcttgctccaaccatcgggctagcgctcaccaccgtccccatggggtgggataaccgtaggaggaaacacggtattttcttttaatcgggacatctcttatagtctcttttgttgcggaccgatatcaatatggctctatttggcacaactctagatcttagatccacacagaacttgaagagtatattaaattatattgttttcaaaattattttctactctaaaataggaacaaaatgattcatccaagtgttatcaacgtaatcatagatctagatctatggatttgtggagctaccgatacccaggtccaagaaaccttggatctgaagttgtgtgaaaaagggccctaataaaataatacaatagtcctttgctccttgtaaacttttatccaattcaaacgttcggctataacctgtactaaaatatgcctattgtatcaaactcatgggatcaatacccaattctatcacaatgaaaataaacatgattatctctaatcatgagattcaatgaaatttacacttcgttttatacactttcccgagacaaattatgaaaaatatcaatcaacaattgaccattggcttccatgggagagggtaactacggttagttgaaagccataaaaacataatagtttttattagtaactatcccaagtagtaactgaacaaaattttaggtacgacaaaacttgggtgattatttggggtgattgttctccttgcgtagaactttccctgactttggcatacatttatataggaagtacaattttaatttttgaaacttgaccaagttttagcccaaacaaaatgatatttactaggatgatcaaaccagccccaacatcccaatgaggaacccctagagcataattcctcaaaatctacagggtgaagctgccatttcacaacccacataaaggaaacctaattgtgcaattacagcaaactctaggtcatctatgcaaaagcatgctcattcccctcctataagaacatctagaccccatagagcaaacattgtattgcccggctatgagaatttccaacgttatctagagtattttcaaacaaattctttgtagcctaccactataagcttaatccctcacttgacctttctttcatggtctcgagcgcaaggggttactaatcctctatttctttactctagcgagtacgataatgaatgcacgtggccgaggggctaggaatggaaacgggcccaaccgggggcgtgggggtggaagggctcattcagatgtggtggttggagcaaacaccaccgtactagcaacaaggaggtgggttgggttggagatagattccgtgccaggtaatgaggggcaacgtgacattgtgaactactacctccgttgcgccactggcgttggtaatggggagaggga

SEQ ID NO: 82441 - DNA, 683 bp, Oryza sativa
cctgcagcccagcgcaatgcctgcaccttcagtcttagttgttgttgtcgtcgtcgatggtgcgttgccatcgacagcaatgcctaccggagggaggatgaaatcatgactgacatgctcaatggatggtgcatgctcaatccagaggtagtcaaggtaagggagttggcccaagccaccgggcagccggtccagcacgcgtagtcttctagcacagccgcctcaagctccgaaaggcggtcgccgtggccatccactgcggtagccgatgtccaaagtaacctgcaatcgtaagacggtcaattgaaggtggagggcggagatgctcaaaaacgttctcgattctctcgcaatcctcctcgctgataccaccttgcacggtgccgtttgcgctgatcctgctagtgcatctcagctccagttgtgtgagattctgcttgctgctgagctttgatcttgctgccatttggccaagtgttgccttttccagaacctccaaatgtagtgcactgagatttggcaaagatcctagctcttccaagctacaccaatcatgtgtactgtcatccaaatcggttgggaaccccaacatctcaaccaaattttctagctttccgaaacccctaggaactgaagataccattgtgtgtctgatgtccagagatcttagcttccgcagtcga

SEQ ID NO: 82442 - DNA, 1096 bp, Oryza sativa
cttacatgaatatatatatatatacatgtatatatatatacatatatatatatacatgtatatatatacatatatacatgtatatatatacatatacatatatatatacatatatatatacatgtatatatatatatacatatacatatatatatatacatatatatatatacatgtatatatatacacacatacatatacatatatatacacatatacatatatatatatatatatatatatatatatatatatatatatatatatatatatatatatatagagtgcataggactacaagcatttgcaccaaattggtatagggatattaagtctaaaagggatatagaaaaaattattcaaagattagaagatatccaaattataggagaaattcctatgaaatattgggaaaaaaatgctattgagtgcaaaattaatataataaacccagagtatattattaagactagcccaatagaagcaactccgaaagacatagaagaatttaagatgcatatagaagaactgttgaaactaggagccataagagaaagcagaagtccatataggtctgcagcgttcatagtaagaaatcatgcagaagaagttagaggtaaatctaggatggtcataaattataaaagactaaatgataatactatagaagatgcctataatatcccaaataagcaagaatggattaatagaatacaaggtagtaaatatttctcaaaatttgacttgaaagctggattctggcaagtaaaaatggcagaagaatctatagaatggactgcatttacatgtcctcaaggacattatgaatggcttgttatgccattaggattaaaaaatgcaccagcaattttccaaaggaaaatgcagaatatatttaacgaaaaccaagaattcatattagtctacatagatgacctgttagtcttctcaaggacttacaaagaacatattgctcatcttgaaatattttttagaaaggtggaacaaaatgggttaatattatccaaaaagaaaatggaaatatgcaaagaaaaaattaacttccttggacatggaagatacaggattatcttct

SEQ ID NO: 82443 - DNA, 589 bp, Oryza sativa
ttcttctcccctctctcccttcccctcatgttgctcagccacgacagcgatgccaaccttcatcgccaccccacatctccaacctctcatcgacccaaaaactttgttaccatgatccataccatctaaatacataaagccaattatggtcacattttccatcttcttcccaattcttttttcttcttctcccctctctcccttccctcatgttggtctgccacggcaacggtgccaacctccatcgccacccccacatctccaacctctctctctctcctgtggagcagatgacgatagtgcttgccaactcaggcgatactaggtgcctcatgcacatagctctgtccgccaattttgatggtagccccaaggaaacggtcttgagtcgccaaatctccggcgccgggcttgggtctctcatcctcccaccggcagtcgtgaagacgacgacacgatgaggacgagtggaacttgtgaagacgaggagggtgtcaacctaaatctggcgagaaccgtcttcttcggcaccgggagcaagcggggccattgggaggagcttgggacgggtggcagcttatcggcgagc

SEQ ID NO: 82444 - DNA, 43119 bp, Oryza sativa
ggggggtggtgtttggttagaggagatcgcacggagggggactgaccgctctgtcggtttttttggtaattttgggtgcgtctgagccaaccgttcgggcaagagctcgtaaaccctccctgccctaaaaatattttcagctcactgtactaaaaataaatttatttttaataattattatattagagtagagtactagacagatctatattgtttattggaatttaacgaaatagggtaatctagttcttttgtttttttaaagtatggaatagataaaattgaatttattttaggacggtggaggtagtacttcggttcaaaactactccaatgctatggctcatattgatatatgaattttgaactagtaaacaattgaaatgttacgtaagcatgatcaatagataatatgcccaatagtagcatgaccccgcctcctttccttcacagcgttcggcgtcctatgcatccaaagtcattgtgttttggcggtggaatacataagtaaacaataagtaaacaatatgttagtatttagttatgcaaaacattgttgccaagacttactcaactcacgactttcacctgcttccggtgataattaccactatcatataaatgggagagtagagtaccaagatatagggattagctagcagatacggtttatttattacctttacttgataaaacatgagaggtgtaccaccttttgcctaaagtaaagaattcaaacgtttgcgacccaatttaatagcgccagggatgatttaaacacatccttagtggaacaacggcttcactcctaaaatgaaatcattaagaacccacgctcaatctctccacattgttagtccctcatgcagctttgaattaaatatatgatgtggcctcgctcattttttaagggttgtgtatgggctcttccctatatccgcaaagagtttagtttaaaactattgtgtctgtttgatcctaagctgcaaatgagtggaatttgatgttgaatttcaatcataaacttttgagagcaggaggttttgcctcaactcaatccatgaatgttatttcatttccgctgaattcaactcagtcttcatcctaccctagagttatctctcaaagttgaagctaggaggtatttgatttattggatttcgagccccttttcttgctccttgccattagcgcaaccctttttattttcttagctttatttgaagtatggtttgttacctgaaaagatactcatcatattgctgcggtacattgggcatattagcgggcctattccatcttagtatccgtccacctcaacgtctatacaaaggattacgtatggacaatattgaaactgtactttccagtagtatcgctgctgtttttttgcagctttcgtagttgccggaactatgtgatatgggtcagctctcgcaagcttattagagcattgaattgagctctactaagagtaagatggcttttattctactaaatccaaagaatgctggctagggtgacgctcgtgcttctttcgagtaaggcaaacttagtaaggggacttgtcttgtatagtgggcagcggatctcttctgttcagttctttccctgctacgctactttgtgatgtatcctgcctgccatcacttcctatcgtcaagtaagctgattgagtgattccaggtggtagtcatccttgtaatacctcatgaagaagcaaggctgcgctctgcgcatattgttcttcagatcgattgtgtcacaaggcagacagatagactcctttcccgctgctaagggagagcaagaaactaaatcaaatgattgtttttttcaccagcgccctttttttgcgggtactaagagtcctctcactaccaatctgcagacatcatcatttggttgggtcttgccggtatcaacatataataagcactcttatcaataaattaggttaggtattgtgcggttacctaaagatacctgctcaacgtagatgcaggggtagaaaggctgattcaaatttagcgccaactcttttgtagtgaccacagagtcccgggttgctttggtgcacccaacccgtaagtattgtgttgtacaactctcccccaacgtagattggtggcaatcaaccatgaacaaagcactacggtattgactcccaactgaatcttctatacctttaaaaataagcaaccataaaaccatcctctcagcataacaatctataataggcagataaaaaaatatctagttaaggtaatcaacatatcaaactgttatatttatctcggaatgaatacctcaatactatacaattaccacatcatgcatttgatatatacataggcaaaacaatacatgtgtaaataccaggtgaaaaatgggcacgcatagcactcttgtagtctcagtgaaatctgactacggtcaatatgaaatagattatgaagcagattatttctacggattatctacttcattataggaataaattaaatattttaataaataaacctaacaaaatcaagtggtctcattaatataataaaagaaagttttggtagaaactgtacttttttagtgtggagcaaataatcccattcaacaatccagtaaataattaaaaacaaagcctcaaatccaaggttagtcataacaagagaatgaaccattcaaattttcaaaaccatctgtgtaaataagcatatgtactgcattattataccaataaaattgctatggtagtccctggcaaactaatttttgttggaccaaatgcaacgggccggtaagccaaacatgtagatttatgcacctgtttttatctccttgggacttttctttaccaaagaagaggacaactgatccatttcttatcctcaataactgcaaaattcactaatctataaactgttcttgcccgagcacaatccacacacgtctggattgaaatttacaacactaagcgtaatttgttaacttggtcattggcaactgttacattcatagttactaatgaatgtaactaacacgacgccgaatgtttacatgagtgaaacaaacattggtacataacgtccgagcatagcatttgcatgagctgatcagaagtcctcaagcatgtatcaagtgtaacaacagcctcgaggcaaacaaaaatcaagggaaatggagaaaaagtgaaacaaaaactcaaccatgtataacactacttattccttacaatcagtaaacatcctggtaaaatatatcatagcgaagtcttaagagagactagaaagaatataagggagcatatctaccgacgcttatctcgactgcgtaggggagcagaggaggcctgaagcatctgcaccaaccacggcaagctcacatatggtacaaagctgcccttcgatcgaaggaacaaaccgggagccacagtacgggcaggaaacatccttctggccacggtagattggaacatacgtggcgccacagacaacaaatggatttctgtagtcatagttcagctcagagctatccttcttgccactgcactgctgctgcacctgtcgagccctccttgcttgggcctcattagggttgttctccagaagcatccttgcaaagtgctctgcagtagcgaagttcttttgcttgtagcacagacccatagcgcttccaagcacaagcctcatatgaactctctgaagcttgcagttagtgaaataagcagccaattcttgttggcggttgacatcatctctcaactccttcctcttaagttccatcctcaggccaagaacatactccctcacaatctcgatcaactctttcacttcatccacttccctcctcgagtctaccacgataagagggatggtatgcaagatgctaaggaactgcctcagggcttctgggaacttaccatctgtggtggccttataggcagccttgagtctgtcttccatttgtgggaaggtgaaaacaagtgcaggagggcctctcacgttaggacttgcagactcgctccaacctttctcaacagcgattggtattatgggggcagttgcaagtgcacgaagatatgagtggctgcccatgtgcagatcaacaaacaggggcttgaggggagcaaagttttttatgcccaactggcggctaagcaacctcattgcagtgtcaaagttccctgctgcggcatgctccccagcaagagaagatttctgagtccaaatcaggctgacaggcatgcctggtggaggagcaacgaagaccgctgagcgtgcattgccagcattttttggggtctctgcttcaggcagaagttccagatcttctaggtcccaaccaccttcctcgccatcctcctcatttgcttcaccctcctcagcatcaaaaccgtcaccaccattcgccatcgcttcgcttgcatcaacaatatccaggtcctcatcaccccagtcagcaccagcagcttcatcgtcttcctcaagttcagccttcccagtagcatccagtccaccctcaaagataccatgcatcacccgaagcaatggccaatcaccactggctgtaagaggagcaggggggatcaaaagagagcgagcttttccttcaggaagagaaggaatattttcacccagctcagcggcaagcctatcagcaatttctgtgagcccatgggtggtagcagtaatataagcaagaggtagctgtccagcattctctaggatctcaactctcttcaacgcatcaccaagatacagagcattgtggaattgacccatcaggttattgttctgtccagcaattttgcacatgaaacccaccttgtccatgtaaccagtaataagatataggaaagcaagcctctcaaaattcttcgtacgttggtatgcatattccacaataccaacatttccctgcctcagggcctcaattcccaacctgtaccagtgatccttgtcatcaatctcttttgcagaagcaactgcgatttggatgttaccactctcaagagcaaggttaaatcttgtcttctcatctttcacaaagtggagggcaacttctggaaagcctttctgttgtaaataagaaatcacagcttgcccacacagctgggaattcttgatcatactcatcacatgatcataccgtttgcgtagaagggccagcttgaaaatgtactcagatgcatcaactgtgaccagcttgttcttaccatcacgatctagacagaatatattgttcccaataacccttgttatgtatataggaacatcgagggttttaataatcccactatctccattgggaaggcaatacttgatatgattcagggtagtgtaaataaacacaccattctcatcccaggcaccacttttcacacgaatggtttcgtgcagtgtacagcgatggacgagcttcttgtttgctataaccactgcatgcttgctcagcagtgcgacagattccatatcactagaccaaacaacatatttaacagaaggtgcctggagctcaccaagaattaacctttgctgcagatcaaagatggtcactcggtcttcggctttgcacagcaagttaccagtcccagcataataaattgcatccgtggcaataggaagagggcttttctttacgatttcattcttaagattcttcaccaaaacttgattgctactcttctcaaggactgcaaacctgttgcgtgccacgaaaacagctgacccaccagctcccttctttgcatcctgcaaatagtcagccctgccagcagaatccttgggaacaatgtagagttcgtatgagcctccatccacatcagagcaaatcaggacagcattttcagttggactgtaagatagtgtcttgggtgactggttcaagctcactgatccaggtcttcttattggagcaagctgaacttccttctgtgtggtgaattcaaaaaaacgaagaaaacggtccttcacatagaaaacagtatctccactcacagagaaagctggacgttccctctccaatttaaacacaatcataccactgtcatgaccagcggcaagaagattcatctcagggtgagcagaaagaatccagaaacgatcatgctcccgcctgaacgtttgaataccggttcgctttgtggcatcccagatgcgaatgcttttgtcctctgagttggacactatgatgtcttgctttgcatggaacatcacacaggacacgttattcatgtgcccccgcaaagtatcaacttcccaagccttggtgtctgtcaaaaaacagcacatttagattgcatcacctattatccctttaaataatgcaatggtgatagtggaagtgaatgttccacaccccacaaagtttgcagcacatcttttttacttccttgaagttctttagtttgttaatatcttattctcatctctaaatcaagtttatcacagaaaggtctacggtggtaaaactgacacatatatatgtagagtaatgtaaaaatcattagtgctacttgtacctagaataacaaagatgaagggtgtgttgaatgaaaaagtcataattcatttgtttcaaacaatattagcacatgtacaattcatcttgcctgttgcaagtagcaatgcatggttatttagctagttcaaatattttgattgctggcatgcatatactttttattttttttaagtttgaacaatatacagaaaagtaaagtgctatacagcaacaataaccacctttagtcctactggcactagtttactaactggaaacatctcttgcattctgcttgtttgctgacaagttagttcagattaatgtagacatgggggaaacgctaattagttcttctgtcaaagaaagacaaatcaaggaacacaaaataattcataataaaagcagatgcataattctgtagctctgttctatgaaaaatgatggatgcaaacaaaaataatgaagttgtttatctaaggaaaaaaaaggatgtagtagcagtattaccattcattctccatatcttcacttgccgatcatctgccccagaaacaattagtggcaacgtgggatgaaatgaagcccagttgaccccacgatcatgcccttccaacacatattttacaaccgcgtcaacacctccaaacagatctgtgttcatctgggtgagacgcaggatgtcatccgcaggtgacactgacttcttcctcaaagcactaatatcccagacacggacagtctgatcaagagatgctgaaacaaccagatcctccttagggtggaaagatgcacacatgacataatggttatgcccagtgagcacagccacacatgtgcgtgactgccagttccagatccggattgtctggtcatcactggcacttacgatccacgggcactcgtggtggaattgcaccgtgcgaatgtagtcaaggtggccatgaagcgtgaagaggcaacggtgtgtcttgtaattccataccttaatcttgtaatcatcacctgcaatgcatcacggaaaacttagaagagttcaggagttgttcgatcttattttatgacagttccaaatcatatgggccactgttatgccaacaatacagatgaaactggtgtgtgacttagtttcaagttccaacaatccaaatgttccatgattgccaaccccaccattgctatggtatcagaaatacaaccatggaagctgctactcttcagttaaagctatagatcgactctcatgtttgaaaagattgtaaaatcgatggagatcctgccatcctgctggtcataaacatgaaccaaatggcccctgaaggttacaaaccaacaatccaccgaacagttcagcgtaagcagatatgataaagctcgcaagcactagatccgactaacccaacccaccaaccaggatccttgacaaccaaccaccactccaaatcaaacgcgatctaatcggatcacagagacaactagaggcctcgagacgtcctccgatccagggcaggatccgagcgaaacaagcaacacgccacgaagcccatgcccgccgccccgcgagggagagagatctagcgggtctactcacctccggagacgaagagcggctgcgtggcgtggaagtggacgccgcggacggggccgtcgtgctcgtcgaagcggtcgaggagggtgcccatgcggtagtcccacatctggatcaccccgctgtggaggctggccaggatccatggccgccgcgggtggaagctcagccccttcacccggttgctcttcgtctcgaacttggtcagcatcttcgcttggccctcccgcccctgatcgtcgtctccggcgacggcgggcgcggcggcggaggcgaacccctagccccggaggcggagacgagcggaggagaggggaggcgctggatctggggcggggtggagggaggagagagagagagaggatggcatggttgtgagattgccacttaagcagtcacttccgatcttagccgttcaaggtgcaatcaacggcggatgcatttccctgttttcctaaacaccagaaccgagagaacggacaatatgccactctatacgtggggattcgataaaatgccactcaatatgatgcaccggataaaatgtcactcagtatgttggtatcaggtgaaataccactttgaacctatgttgatttatttttggatgaaaagaatgcttgttgtatcaatcaaattggccagacgcccattttgatttgatatcagcgtagttggcccattttgatttgatattagtgtagttggcccattttgatttgatattattgtagttcaaccggctaaatttcttgtggtaaaaccaaccccctaagtttaagtcctagtcttgacgttagtgcttataattatggctagttattattttccagtgatagataatgaacccgccaacaatgaaatgctcgtggtgacttcgtcaatcttaccgacccaatctttcggaggtgctcatagaggtaaggtgagtgccgtgtgcacgttataaatgcttgtgtttgtactgtgtttcaaaaaaatatatgccttaccaaattattgataccttaaaagtactttagttcctattaaaaagcactttggttagtgtttggtttgctattaaagtgttccaataacacatgtctatattgcttttttaaaaaagttagtgctcgtagtgaacttgccacatcacctactctcattataaattttacaaaataccctttattaaatgtattaatattaagaaacaatcaaatctaaatgaatatctgtcaggattacggataagacatatctcgtatcctacaattaaccaagtatattagatcggtatacctcatatcccaagatatgtttctatatgcgataaggacatatataaaatattataggaaatatccttatgagctggagactactagagtcctactcgggaaggactaggactattctatatcgtgcagggttcattgtttccgagttcaacttggagactaaggcaatccacggtataaaaggcatacccctggaggggttctggattatcgaatcatagcgccaacacgccgaccatagttttcgaagccgaaggacccaagctgaagccgccgggagatctcatcgaacaatctcgactagggtctcgtcggtctcaacgagttcgtatgttctctctgtattctgtggtcttccatatcaatcccatataaactgaattagggttattattttacgaggggccttaaccaatataatcattgtattttgtctattttaatgtcgtatcgtatagatcatcgtaccaacataccctaataccctatttatctggtctacgggtatcccccgttgacaatatccatatataaaatcaaaataaggggaatatttcctatagaaaaggaatgagtaacacatttcatgaaaaatttattttagaaaatattgtaatgtattttcttttatccgtagcaaaacatatatattcaattagtagataaaaacaaattggcagtactgaaatttgcatgtgttgacattgctaatattttgtcatggtagcaaactaaataagcccaccatcttgccaaaattttgtttaaagagtggccacgtcttaggcaagatagtaaatattaaaccatggcatgattgaatagctgcttttaaaaagttaggaaagtatagtagaaattaagcaaacaccctatgcttctgttgtgtcaatgatttcttaagacagatttttgatggtacaccaaagcttcagtgtagaggattaggattagtgactttaattagacatgttgttttgcgtcgtgacggaggttcaaacgtcccaacgtcaagaaaactaacttcccaactttagcaattgattgcatgctgctctctttgaagtttggaccatacatacatacatacatacatacatacatacatacatatatatatatatatatatatatatatatatatatatatatataataagctaaaattggaacgatgtgatgaaaaagttgaaagtttatgtgtagaaagttttgatgtgatgtaaaagttggaagtttgaagaaaaaagttgggaactaaactaggccttaggtttaaaaaaattgcaagtcaagatttaaaacttttaacttagttttaaaaactttcaagtgaagattttaaaccttaactcaaatttaaaaacttttaactaaaattttgaaagctttttggatttgaaacaaaatcagatcaatatttgaaaaatatcaactcaggtatgaaaacttttaaatcaaaattaaaaactttcatcttaaaattcagaacgttcaaataaaatttgaaaactttcataccaaaattcaaaatattcaactcaaatttaaaaaaactatcaactgaaattggagatgagaatatttaatttctaaactaaaaaaatagtgaaaaaagtcaaaaaccgcgtctggtcaattagctttggaaagagtacgaattaccccctcacccaccccgtactatcgtggttgaccgaattaccccctaaactcaaaaaccagatatctctcaccatgaacttttaataccggataagttacccccctcgatccaatccattgtaagcaaagaagtcatctaaactcgaatattggatttcaaatcccgtctggttttcgcgcctcgatcaatgaaatctcactctaatactgaaactttcaggctctcgaaacactcacttcatagcacataatatgctatggtccttcaacccttcacaaccaagactatcgacgactcaacaagaaaagaaattgacaacattaaatattttttacataataacaaattttattgaagttaatcaattacataaaaacgataaccatcaatacccttttacagtatcatatgtcatacactacccgaattcccgaaaccatgttcaacgttcctttccattcagacagatccagcaggctcagcctcctctcggttgcacagcacaacactaggcataaaatctcatcatcttcttctcgttttccacacgcatgcttttcaaactgctaaacggtgttttttttaaaaaaagcttcaatacgaaagttgcttaaaaaatcatattgattcgttttttaaaaaattaacaaatacttaattaaccacacgctaatggacggttcgatgaacgcatcaggttgggaagccaggcttccgaacgcagcctaatccagcggcggagtactgcccaggagaagcgttctgaacacatgccccctcctgaaacggcaggaacatggacgtgggcacgtaacagcctgtgaatgcagccaaacaccgctgaaaattcccaacaaacttcgcccgtttccaaaggctgctacgacttcaccataaacaaaagtcacctacccacagcaagaagcactcactgatgactaatccctgagagaacttatcagctaaacacaatcaagtagtgtaatcaacagctggaacagattttgcccagcactccatccatccgttccgaaataaactacactaaaataaataatgtgttatttatatgacagtaccttgtcgcaaaataaagatatttctccacatatctcctcctatcaaccagtcacaaccattttctttcacccatttttatcttcttaaccaattacacccttcctctaatcattcttacatattttcttaatatctatattaaccctataaatacttattttttgaaatagagaaagtataacaaatattgatatatccttagtttaatttattttaaaacggagatatatcttagtttttttttttgcgtgacagcctgacaggcaagcgtgagacagaccccgtgaatgtgtgatgccccccgagtgcccagggaccctacctacctccacctgcgacagctgctgctgctgcgtgaaggcacgcccatgacgaacctaggacctcgtcttcagtgtcgccatcacccggcagcacatgagcacacaacaactttgatcatcatcatcaccattgttatgcatcttatccggtggagattggagaaactgattgagatcctcctcgttgtcgtcgtggatggaaggaggccttctttctttctccgcgtcagcaggctgatcgctcagtttcggtccaaaagcaaaagagagagagacatcgcattctcagattctccgcatcgtctgtggtacaggaaatttgcgtggaaaaattggtcgccgagcaggtgagcgagcgagtgaccgcgatttcggtcgtgttcttgtccgtaagtctgtccgaatttatcagattgatgctgcagattgcgttcaggtctttcgacagtccaactgtaacatccgcggttcatcacactgtaacttcacacgccaacagctcagacatttctaccaggagacgaaacgaatagattgacagctcaagacacgctaagcaacgatattggaacacttcatcaacaaaactcgggtcacctttggaagctagtaactgtacaggattttcaccggaactagttcaattcccgtgagaaaatcctccgaaaatccttattccataggagggatcaagctgaagacgatgggcattgatcatccttatggatcaagctgaagacaatgagcattgaccatcatcaattttgcagcaggaacaacagcaaacaacagggaagcagtgagtcctttgcagttcttgcttgaaatcaaccactacaatgtcaaaagatctaggcagaagctaaaatgatcaatgatcaatacagtcatacactgaaacaagaagcacaaacccggacagtatctcccccgaatcaaaacgatcaactaaaaattgcattgcaatttctgggcgtgcgtgacaacagatacaggatacaccaccgggaagcaaaggctgctccggcgacaaaagggtagcagcaacaccacgaactgaaaacacaccacctccggcggcaaccggcaatcgccgtcgtcgtcgccgtcatcgtcatcgtccagcacctacacacgctcctccctgaattagaacaacacgaacggagaaagaactccacatgaaacaacagcagcagcagcaggaaacttgagtgaaatgttagcgattcctctttcggccttgggcttgggcgtcgtcgtctcacacgaagccgacctcggcgaactgcgggcgcggcttggccgtcgcgccggggcgcgtcggcggcggcggcaccatcccttccgggagagggttcttgcgcgggcgccctcgcgggcgtgggatcttgggcggcgcgtgcgggtcccgcggcttgggcgggcggccacgccggcgcggcacggcgggggcggcggcggcgacggagccgtcgaccggcgcaccgacggggacggggacgggtgcggcggcggcgggtacggccgggtagcccggggggcgcaccttcgggggacggccgcggcctcgcttgggcggaggaggcggcggtaagtcgtcggccgagtcatcatcggcgaggaactcctcctcctcctcctcctcctccgccaccgccgccgccgccgccggatccgccggcggcggcggcggaggagtcgggcggagcgcgtacttcccacccgcgacggcgacgagctccccggcggctgacatccgggagaggtgcgccgcgacgagcgcggggtgcgacggcgggaggaggccgccgccgccgcgggccgcctcgatgcggcgcgcgatggcggcctggctagacccgttctcctccgccagcgacgcgatcgcctccacgatcatctgcagcaaagagaaggagaagacaacccaagaaacccggtcaattccgccacagatctgggcatctggccaggaacagctagggtttagaaagagagcgtgcctcggggtaggaggggaggacgaggtcggcggcgcggtggccagtggaagtggaggtggccatgcctggctggctggctggctggctccctccctctcgtagggttggggtggcgggggcgaggggcgctgtctccttccggcgttggtgctgcgctgtgcgcgtgtgggatttggggccgccgcgacgcggatctgagaggagaaggggggttgtggttgtggtcttgtggatgtgggggggaatggaatgcaagtacagtttagacaaggaatctgtcgggtggtaccgggccggacgaccggtcgcggctgcacgctctactcctcctgtgactccggtccggtttagggggtgtttgggataggaacttcttttttttttagagagagagagagagagtttagcccctctctcccaaacagccccttagtctattcgcaagcttaaattctactccctatgtactaaaaaaaactcaatttaaaagagagaaaaaaacagctaatgagaagctcctttgtcgtgcagtcttgtacctagctttgatcgcttgtcttatttattttttaaaaaaattaaaaacataagtcatgcataaagtactattcatattttattatcttataataataaaaatactaattataaaaagttaggtacggaaacttatggttgcatttaaaatatgacggatgtagtagttggtaataatttggataagctaggaaactcagcttcttctagtttctaattcattttatgaattctacaactataatttcttaaaatctaaataagaacctaaattgtttaagagagcctctagcagctgaggattttagaagaaactgcagctacgaaaacttctgcaaacataccctctcagtccggtcttagtctccggtcttactccggtctgatcgggctggttcggccggctcggttcagtgagctggtgattagtatactagtaggattaatatatacagtgataagcattgtttgagtggtaaagtggtttggctaattggctcgtatggtcgcatctggtttgtggtttgtgaaagtgtcaactgggcaaaggatagtctcatcagatgctggcgagtttggcggtcgttttcacgtgacttgtgacggtggtggtgttgcgtggtagcaacagctggttgatcctttttttgttactagtttggctaatagtggattttatttaatctctggtttctttattaaaaaaacttttaagctctgaaggggtcaatatcgtttgagtgcctatttactttgatcagcggaggctcataatttgcggtaactggtgctctctttgtacagctttaaattcaaaaaaattttgagttagattttcctaagagcaagtactagaagcctctaaacacaagcccaatatatcatgtaaacttagataataacgtggaggagagaaaaagaatagagagatgactagagtatccacttcttatgcaaggaacaacctccatagaaactctaaaaataatagagaaagagataaattgattggtgaaaaatatattgggactagtgtcctacaggcaatatactgtatatgttagtttttaaatttaagagtatataatatcgataaataagagctgatcactgcctctactataaaacttgatctaacttaataaatccatagatctagaactatgattacgttgataacatttgaataaaacattctgctttcatttcaaatgaaatttaaaattttaaatatctataacatgcaaacttatttttttctgtggatctgagatatgaatctataccaaacatgatataggtagccgaatgtccatgatatttactataactaaaaccttgaatgttcatgccaagtgtaagaacatctttagaccttttcaactctgttcataccgttttatatatagatactcgcacacaatttgcgtttttaatagtattttactcacattagggattagggatttatggttagtctttgtctattatgcaaagaatgtgttagagaacgcatatccatgttacatgtgcgtattattataaaaaaaactttagtcatttcattttttttaaatccccgtttgctctttccaaataaatgcttctactcatttattggaaacaaatgctaattctgtcacaaattagaataactcattttcccgatgcagtataaaaatgatgcgcttatttactggggttattttcttcatttttttaaacaactatgcgcatgtaaaaagataaaaagagatttatttaacgtgcagtccattacttcagtgggccgcgttctgcgcgagaaaaggattggaaaaagtacaccgaaggtccctcaacttggcaatgggatacaaaacatccttgaaccgtaaaaccaaatatgctgggtccgttaactatacaaaactagtcatcagaggcccttccgcggtttttatccgtgttttagtctacttgacggctgagtcagcgtgggacctacgtggaccccacatatcagctgggcacgtcatcaccctctccctttctcctctctctctctctctcactcttctcttatcttctggcgactgggcaagccggccggaggcgacggcgcagggcggcccaaggggcacctcttcaaccgggcgccgtcgccgcaccagaatggcggccagagcaggcgaagcggcgacggtggcgggcgagcacggttgcggagaggcggcgtcggcgggcgagagcggtgcggcatcggcgggctggaacgatgcgacgtcggcaggcgagagcggtggcggcggagggagcgtgcctgctcattggcgacgtcacgggcgcgcagctcccggatctcgtcctcccacctctccaccctctcctctccttgtggatcctgcacacgccaaattcacaaacaaaccagattgcatcgattgattatgctgctcgtcatcaagcaaccaaccaaaccaattattttattagcgggtgtgtgtgtccatggccatggctatggatggtggtcttacgagcagaggcgatcctcgaagtcggcggcgaggttcttgaacagctcatgccccgcctccagcatctccgacacctgcattggcattgcaatctcatcgatcgatgaaaaattcagaatgacaaatagcgaaatcaatgaatggagagaggtggacctggcgagtgaaggcgtcaatggcgaggaggatgcgctgcacgtgctcctccgtctccgccgacgccgccaccacctcctcctcctcggcgacggccatgtcgtcctccgtctccgtcatgggcccggtggtgatgttgacggcgaccccggaggaggccgccactccccctcccgcgctcccctggctcaaccatctcctcctctccctgtcctccgttgccctgcacgcatccatccatccatccatcccaaaactcagatcagattgagccatcaaattttcgacccaaatcaaaaatcaaatgcgcctcaacaactgaactgattgagacagtagatgaaatggaacaagtcgatcggaacggaatcgcgtggccttggttcgatcaaagcaacgaacgcagctgacgaccgaatccaatcccccagaacgaacgcagctgcatggactcgcggaccacgaccgccgccgcctctgctccatcgattcccgggtgcactcgccgccaacacctcacccgccgccaaccacgaccgcgcggccagcccagccccgcgtgagcgccgcatccacgaccgcctgccgctggtctcccgcgcggtccgccgcctgcgccatcctttccccatgccggagagtgtgatcggggaggacgagcccgccaccgcgttcacccgccgccgccgccttgcccttccgccaccctccccttctcccgtgctgcatcgtcggccgtcggagagaagagtgtgtgagagagagaaacagcagaaaagggagaggagggaaaagatattctgacatgtgggacccacgtgggtcccacgctaactcagccaccacgtaggccaaatccgggatcaaaaccgccgaagcacctctggttctgtacagttaagagaccctgtatatctggttttgcggttaagatgtttttttatcccgttgacaagttgagggaccttcggtgtacttttcccaaaaggattcggcgagaaaaacaagagttcgtaggcccatcagcccatcccatgagcccacctagaaaaaaaaaaccctaaaacacgcctgccgttttgatcggcccaagccaccatcgccagccaaccacagactagaggagaaggaacacttcgccggcgacggcggcggcggcggcatggccttctggcaggcgcgggacttcctcttctgcggcgtgtgcggcaccctcctcaaattcgactccgtccgctccgcctcctgccccctctgcggcttcaagcgcaaggccaaaggtcgtcgtcttccccatctctctccctgcaaagccctgggctgtgttcttcttgcggctgatgccttcgttctctttttttacggcgcagatatcgaagggaaggagacgcggtacacggtcacggctgaggtgcggccgattgctctaccctctagctcgcgcgaaaccctgggctcgtctgtttcagtcgcgaccgattttgtttcccctcaagtatctaaaatccataatgcgattcattcagtgtagtaatcctaggagatatagtttagtttgatttacgcgaggagtatatatggttgtgcggtggagcaatccagtcttgtggtttaggtaaaaggacggtttcactgtgtcgtgcttcagtatcgtatttcatatagaggaatggcttggtgattattgaatctacatggcagtgcactttagtagatttttagttttacaaatatccatgctgccttccttgggataatgcaatgcatctcttgggagctactccctctgttccaaaatataaggatttctaggttgtttagcaagtactctactaagattaggtcaaaagattttttttttctttattcattgcagttgtcaatttttgaactttgattttcttagattcccttctgaagcatctgattggctctgcgatcattgaagtgatgggaatcagtgcagaaatgcttatattgtggtacaacatttgaatcctagaaatccttatattttgaaacggagggagtattggtctgagattttattttatgtgctgagatgactcaaatggcaatatcctcatgctttcacatgcatgaatcaactgtggtaatggaatagtatgagttgtaggcaaacatcttatggagcagcaaggtaagatgtatagtgattttctggcttggcatttgtaggctactctgagtctctgattaagtcctatgctccatacttgtacacttctagtacttaacaaagacatagcacctaaaaggtgccaaatgaacattttaattttatggaccacaggtcctgcctttttaatgaactgtgcggtttcttgaatcttgtcccaaccatttatatcagatatgaaagaagatttccatggctatttatatgtagttgacattttgcatgctgttgacaggatattagaagagagctaaaacttgatccatatgtgattcttgaaacaacactgaaggaggaagacgtaattgtcgaaagagctacagtaagttaagctttttcatcaatatatagtctgatagtattttgtagttctgcacatattcataaatccttttctgcattaggtaaataaagagtgtgaaaaatgcaaaaatcctgaacttcagtattacaccaagcaggtcagctatcgatccttgaacatttgatgttcaataagcttaattttcctttttctagctttgatgcttaactactttatgaaaaatgtgtaattgcagttacggtcagcagatgaggggcaaactgttttctataagtgcgcaaactgcaggcatgagttcaatgagaaccagtagtcaccttagaatgagctttttgatcacttctacgattgtggtctaaaaaatggccatgctttgacatgacaagtgattttgaaatattttttttatgcctttgcttgaattatgacaagtaatggtgtgttcgggagaagggtttaggaacctcttccccgtgcatggaaaacggggtggcttattagtgcattattaattaagtactttaacgcatggtttagcagtttgccaaaaacattgtatgtgcttggaaaacgagggagaagaagttggtaaagtgtagtatagaacataccctaaagaatcacattactttgggccacatgtccaatcctcaatcatgctgtttttcgcgggtgctaattgcacataaccgaagtgtttctgttttctaaagattattaacctgaaactgcattttggaccttacggtgctcatatgagctctcttacttccctcaaatcctttatgccctcaacctatgccatttcaacctgttccataaatcatacatgttcagcttctaggagatatggcattgtttgctaactgcaaaaatgaaaaggtgtataagaaaggctcgtatggtttgaggggtgtactcttgtcagcaccaggattccaaattttgcgataaatgggtgcgtatcagtagcgctgtgactcccggtaagagctcatcttgagaggttttctgttgtcgtttcaaatcattttctgttgggactttcaggttatgaccaagttatcaaatccagtgattagtttttttaaggagaattttttcttaactagttcgagatgaagctgggacaaattcgcagtcccaattcctggtctaatggtctatatgaatttctggctatcttgttcttgagctcgagactgcagcttgtttggttcacgttctggttgctcatgccgtgccgagcactcgtgctacctccgtcccaaaataagtgcagccattgatattcgtgcccaatatttgaccgtccgtcttatttgaaaattttaaaaatatttagtcacaaagtactattcatgttttatcatctaatagcaataaaaatactaattataaaaaaaatttaaataaggcaaacggttaaacattaaacgtgaatagtataaaattgcacttattttggaacggagggagtagtattagctaaagctgattgtggtaaagagccaaagaggtcagatgagcagtcatgctcatgcgtgatcagaattcagaaggatttgaaatcctttgctcagtttgttccccttttcccaactcctatttctcgttttccgcgcgcacgcttttcaaactgctattttggtgcgttttttttaaaagtttctatatgaaagttgtttaaaaaaaatcatattattctatttttttaaaaaaactaataactaaataatcacgtgctaattgattgctatgtttttcgcgcggaggagtttggttcccaaccatccgaaacgaacacaaggtccgcaaaatgaacacttgtacactaaaattttggcgaggcatactcatttcagattgccgtagggatgcgaaatgcatcgcgagacccagcatttgtgtacgtgtatgagaatctcctacgtggatggtcactgtgaaaggccttagaggcaaggggttgtatgtcagttttttacttgcaacgtttaaccacttgttttatttaaattctttttgcaaatataaaaaacgaaaaattgtgcttaaagtactttagataatcaagtaagtcacaaataaaataattaataatttcaaaaaaatttaaataagacaagttgtcaaacgttgcaagcaaaaactcaaaatcccttatattattatatgacagagggagtagtagcaaacctacattatacatattacctcataatttattggttgttaacaggaatgaaattagacgtaatagccacctccactgcaaaacttaggcattcaccattctctacgagaaaagaactcaagaccgcgcagtctcccgagttccctcgattggtaaagatacagtgaatccattgactaaccaagcgaaccaaacagagcagtatacttgccccgagaaaatttgagcactgctatttaaccagatttatacccagtgaatggtattttgaagtgttgatagttccgagtacagggatacctccgagatgacaggaacttcattcggtcattcccaatcacatgccacaatgaaaaattgctcagaccatctacatcttcaagggttctatttgcatacagtaaccttgaccaaatcttggtggcacccaaggccgatgaagtgcggtaagagaagggaaaaaaacagcgctcctaggtgacgcattccaacttatggtcaaggatgtttcatcgatgatgacacgggaattgttcgaaaacaagcaacatcaaaactgtactcggctccgcgaaatgtaggaacaacctcaataggaacaagcccatgcctcacactttcatctgcaacatttgtagttactactggattaaaccatgaaacagcatcacaatatgacatttgactgctcatagaagaactggaaatacttacatgtacaagatctacaccacgcgagcaccttgtaaattgtttggttacttcaaatgaataaattccgatataacacgaactgctacgtctcagatttcgttggtggatcatccttcaatcctttggtgagcaaatcgtaattgatagagacaagttgtgatagattctgcagcaaaagaagttagaacggtgtgcagaatataggcacaaatgggctaacaataagttttctacccctacttttaaggattgatactgtcaatgaaacgtgacaatcacaaatttaatgagaataaaaaagaatatgtatttgttttgttggactgctagacactaagaactttggtttgtctttgtcgacactttgcccaattccttttttccactcattgtctcgctggcccacatgtcagtgagccatcagtgataaaatattcagtggatttttagattatgtatcacaaggatctaggtgctattttataatgaacattgtactatcgtttactgtgtggaacaattttgccacattcaagggaatcatcaaactacattttacaaagcacgtgcttgtgaagttgtgagcatataagttgactgacggattactagtatgattcataccaatagcattaaatatctagcgaagttattccaatggtttgagctatattacagtactgtgtctagcgaagtagagatgtgactactatgatttgaagcatattgtaactgaaaaaggtgttattactgcttggtaatgcaaatactgaggacctgttcgtgagtaaatacaagggaaatgtaaggagctgtgggtaaacttttctgcccgtaagtgaaggacatgcattacacattacacgttcattttaaaaaaggatccatcatggttactcatgcttcaatcaatcacattatgaacatgaaacaaaataggtggactgtgaagccgtaggcttactttgactgagaaattgtaaagaaaaaaaggaataggttatccaccgtgataacaccatcatgcttcaattattttaaggatataaatatgtgaaactgtaggattaccttgaatgagaaattgctgaaagaatagttgacatttgagctagattcaaactcagtgaagccactagactcatccccctatttgcacaatttgcacaattgtttagtaaaatgactgaagaataaaaaggcagacaaacaaattgtagttttcttttcctctacttatataaatgctgatgattcataccatatcatcttggtgattgctcacacagctactgctgccactaaggcttccattatcactggaatcctcaaattcgtatgcttcatagatgttttcgtccgatggattccaagaataacggctggtgaagtagctcgtgtcaaatgcactatctgaggaggggacaaaggcagcctgcatatgattccgtgttatcctcggtacacctttacaatggagatgcaactatgtttaaagaataaatagttaaccatatcccaccttttgcctagcaagggtatcccagctaatgtctttaaaaaattgatgctgcttaacctgaagggaataggattataagcatcaatcatttatgtatcataagaagttttgaataatccatacaacggatgaaggtttctaaaaccctcaaaagtcaaaatacctcagaggcgccatttgcacctagccgttggtgagggtcttctgtcaataatctgggtaaagcagtcataatatcacattagttacataaaaaacataaccacaataaacttcacaaaggattttgaaattgagcatgaagtagatagggagtattgtaataatatgcttaaattgcatgcgtaaagattccaaaaatacaaatcatattgaatagttctacctttgagcaaacagatgctataaaccatagaacacaactgaacacatataatatagcagtgtgctactgttaccctataagctgaaactggaaaaaagatagggactgacctatggcaatataaaatatagcgagtaccaagttatcaagcaagaaaatgtaatattttagagcagatgtgtccctgcctagtttgacccaaaatcctaattaaccccaacattcatttgtgttatttggaacctgaataatacagctaacaatctgacgtacattaattcacaatgctgatacgagcaacttttgggtggtgattttacagtacaaatgagggagctcacttcaattgttattgatggtgatgatcatggcaaaaaccctattgactttagtatagaaatttcatgcttgtcattgggataacacaaaggaaaatgcagtataaagacaacaatttattatataattggtccattgaccctaaaagtgacgtaaaagctgtgcaatctagcataatcatctatcacattaaaacttggaagcaagaaatagtaacatgcaatcctgtaagactgaaacatgagttactgtgtattcagaatactcgaaacatttcttacttgtcaattagatcctgagcttcagaactcatctcttctgggacatgtggccaaggtattttgcggttcagaatgttgtcgaaaattgtctacaccaaatacaacaagaatgtcaagttgccacagtttcaatacagcaaaaaacaacattgacttatatagcgacattttgcattaaatagatgaaaacccatgtgttttctagcagaccaaaacccatgtattttctagaagacctctttctctcatattctcaagagatctgaacgggagctttgcatgcttaatgaaagaactttactcaacgtcacataaatggcagagaaatattcagtacatgaaagtctgatacctgggggtgttctgcgttgaatggaggtattccaacaattaattcaaaaagtataacacccacagaccaccaatcagcactagtacctgcaaggacaatcagtactcaagagagtcaaaacgagaagacaatgcagaggttgaaagaaaactatgtcgggcattttaccatgtcctgtccccaaaaggatttccggtgctaaataatcaggagttccgacagcagagcgcttttgtctccgtgctcggtgatccatttcctcaaattcgctcatctgaggttcatcatctccatacaacgaagacccgctaacagcaggaccagatagatcatccgtgctgttgatcagaccaaccttggacaacccaaaatctgtcaactggagaattaagattgataagcaggacatatagaaggcattaaaaaggaacatattcgaaaaagaacgaaaacaatatttattgctgaattacaggttaaatgaaatgaaaactcagaaggaaatatgtgtagcattatcatcaattcattaagatatggattcacttaattagaaaagagctagctgaaatcagcatatatttgatttatgtggaaaccaacatgtcatgacatgaaagtttttatgcattgcctgattgtcatgtggggacgtcactactcactaagtccggcgccggcgacgacagcaagatacggaacagtagtttgttagcatcctttttcttagctaaattggtttgttagtttagccctatgatttgttatgatcttatctcttagatgggtatattaagctgtaaggaagttgattaatgcaagcagaatttgagatcaatctcatttcattgttcctgcctcaagggcgcgtcgcggatcacggcaccgccgcgccgtcgaggtccagggccacgtccgatcacctctttcaaatacaatcttcgccgagttcctccttccaatttgctaactcgtgacattgatacaacacagtttgaaacctcaaaaagtttcaaaactccaaaaactgattctcctcagaactctcataggatatgtgtttattttatctctcactagatgatgccattgtggcaattgctatgaactgctacatcactatctcatttggttgctggaaccaaaaataggaatatatcttctagtcatcagagaacagaaaagcgcttacctttgagaggcatgtgaatgattttttagtttatcatgtactccctccttccaaaagtctaagtcctatttcattctttggtttttccaaaagtctaagtcctatttgtagtcattatatgctatattaatttttttatcggaacccaagaagtcattttagtactttataggttgcatgttcattggttttgtcacatgatgaatgagttaactacatattggtcttggtgcaaaaagaaataggacttagacttttggaaggagggagtatctaacattgaacataaaacaagaaaaatggagagaaaacttaacgatcatgcgcacacataaatacctttatatgcccgtcatgagctatcaataagttgtcaggtttaagatctctatgaactatgtgcatagagtgcaaatattccaaagctagcacctgcagaataaaatgattatcagacaaaggaaaagtgaaaatggaagaaataaattgttagtaaaagaaacttacaacttctgcaaggtatatacgagcaacatcttcatccaagcaccctaaatttctcagtagagaatacaggtcccctccattcaggtactccatgactagatacaaattttcccgggaggtaaaagaatagaagaaacgaaccttaaaagaacataaccaattcagaaccacagtatagctttcaatgatgaagggtcgcatttgcaagttcactcaccacaaaaggattcctcactgtaatcaagatatcacgttcagccaatatactctcaacagcatttttccgaatcatatctgccttccttaatacctgtttcaaaagtaagcaactattgttagaccacatggatgccccatccatcccaaaccgaaaaacaaaagctaataataaagggagtttagcagtcaagcccccaaactattgctttacatcttagagctatcatgctgagcagaggcaaggtgttgtgtgctcagcaaaaccaaaattactataccaatttatcattacttccttttttgtgaggagtcaattcatcattcatgtgaactaaagtcacttcaatctaaaacctatgatggtcaagttgtcacaagtaaagcatgaacatgatgggccgctccactgtcattctgatcccatttttataagtaagctatgactatcaaggagactaatgcaggtaaaaataactacttagagtccaatatcatgtccagtctacaccatagtctagaaaacaaaaactaccaaaccaaacaggcaaacacaccatcaaaattttgccactaccaaaactttggcattgcccatatatttgtctcttgttggcacaaattggcaccaaaccaaacctaccaactctaccctaccaaaatgtgatagtgccaaaagttgccaaagatacggcattaccaaacttttggtagggtatcgaaccaaaatgtgatagtgccaaaacagcataatgatttaacgggagcaactaaatggatcccattggaaccgactccatattagttaactttttaaaagcaaacagtcatataattttaacatatcctgtaatcacataagttacttatctaacaagacgcagatttgattaaaaaacaagggatgcctaactaatgaaatcgagtgcagtttctttctcgaatgaattttagaacaagtgatataattcgtaacattgaccacatgtaccaaatgaaccagcggaacaagtggtacagccaggtttttgtagtatggatagtgtactacagtactataaatatgaagaggtgtactacaaatatgaagatgtgtactataaacatcaaggtgttaatcttttttgtggtcaactagtcaaactgggagcaaattaaaaaagcaaacgcgagaaataccatctctctaatcttccttctctgaacattgaaggtccacaggtatttcctttcttttgcaaaagttttcaatccaataatttgaccatgtcatgttgatcacaaggggtccttgataataaataatgaatgacttccagctggtggttctcatagaaatgtgttgtttagaaaggtatgcataaatgtacgaaaaacctcaaggccctttctaaagtatcattgcaataatatcacaatggcaggggttatcaactgaacaaaactaccgccgagtatcgacaagaacaaatattcttgagtgtgttttattgagttttggggaagaagactggcaagtcaacatatttacatcaaaagcaatttcctttccccttttttgcatgctaaaattctggtttgcgtctgaaagatagtcatatagcaatatttttggtttttggtcaagaatgcctacaacattacaggtacaaccaaggaaagcaagtctgggtacataagggaacaaatatatggcaacaaatacctttatagcaaagaggtctcctgtagttcttttcttggccaagaaaacacgtccaaatgctccacggctgataggtttaatgatttcgaagtcatcaatcgaagtacgatccttgactgggtgaacaggactagctcgtaagctacggacaacatcatcttcttcatccattacagtactcgctgaatcaactttgtccatatcaaccgaatcacaaagcagtaggtacttctccctaagaaattatataaatgtgaagggaaattacaaatggaaactaatataagtgctaaaagtgacctgcaagaattattttcatgtgcttatttagtataatgtcaactaagataagccacttgtgtagtgaactcagcagagactcaccggtggagtttttctatacgtgtgccaaatgtctgcaccgtgagagcctcatgcttcctacgattgacaatttcttgcagatcttctatgcaggtaaccaatagggagagtgccctttcttcatctagaggagtagttgcaatgcaccgcgcaatatcagcaagttcaacaatctgcacagattgaaggacactgttaatcagcacttcttgcattatattacattacaaaatcatttactactggtagatgatgcatagtgatcctaacctagattattatatggtaaataccacactgaggaccagtgtgaaggggggagtccgcttggaaagggaggtaaacatgacaggagtgaactttttaatctttcttcttgcttaattcttaaaagaaaacaaatccccttgagctcccaaaggtgcagctaagacattggagatagtagatgccatctaatcagcaccatctctaggtatacttggtaacaaagcaaactaaccaactaacagcatctctaatgaagggcttgattggtatagcttgctgcagctgcagctgtaactacagtaccaataacaggttttgtgatgaagctgctatagtgctgcggctgtgcagcagcagcaaagctgaaccaatccggcccgacatctaacgtgtggcagtggcagctaagcccacaatcatacatggcacattcgttccagccacccaaccatcatatatacgcatgacacagtggttgattggaaaaatagtggcattattaccattccttttcaacaaacgtattctgcacaagagaaactaaattttcataaacaaacaaaatattttaccatggccatagctttgctcactttgcacattgtaccttgtacaaaaataaacaccgactattttctatagtttagcctagcaaaataatcaactatctaatatatgtatgtgtgattgagagagcttacctgaggaagatcatcgctctcattaattgcacttcggccagctaaaagcatgtctatgtgattagatcttggagttgttagtggagatctaggggtcatacttcctgctgaagatgtagccattccatgatcagattttggcccaaaacgagtcttacatgtcatggaaggaaggttttttatgtcatccagtgaaatagtgctatcagcctcctggaggtagtcaagcatatcagctgagcctcttctagaccaatcagagagttttggagaggggccatcagattcttcattgatgcttgaatttgatacttttgcaacatctggactgccaacagcatttggaaggtctttttgtgtataagattctaccaacttttcaagtgcttcagcaactctaattagacgttcatcaacgcttacacctttttgatcacatctgtcagcacttgcacatattgctgagtgattttctacataatgagtagggacatattcttcacatatgcgacacattattgaaccttcttcagaaatatttggctggtcagaccagtgaccccatgaagttttgtgttgatgcttgggaggaagagattgatgtgatgtagattccactggactgttcaattcagcctggctactaactgcagggggtgtatctgttttcttattaggtgattcctctttaataggggtagggtctttagggggttttgggacaggtgatggaaaaggtttccaggaagatatacgctccctggttggagactcaacctcctttttaacatctgttgtatcaagcggtgaaagaaacttaacaggctttatctcctggcttctcttccattttaaattatgttgctcttgactgtacgattttggtacatcacttttgctgcctctggttgtagtgtcatcacctggttgagccaatatctgcctatcagcagattgtatgatcttatcacgttgatccataacaacttcatcctccgcaaagccactctctttgtgaaattgaagcaatcttgtacatctggtaaggataaaaagcatccgagtgtacagtttcttcagcacacccattgggagctcctgacgatgatcatctaaatcttgcactatgccttcacattgaagccaaaactcccccggtgtcattacacagcagctacgtgcaagtatgagcaaatcttccaaagtttccttccactcaggatgagaatctgcgtacttttccattacaccaaccaagtctcctgcaaatactgccaaatctgaatttacctcctcctttgctttctcaaatctcacctgaataacttttaacacctcctgtgttgatgacagaaaacaagattaattttgctccataaatagcaatatgaaggtcattaatcactatccacgaagaccatgaattgagaataccttcaagttgtaaatgccccgaggcttccaaaaagggaatggtcggacccccttggagttcaactcatgcgaaaaactttttatatctgcagggactctcttccttggagcactggtagcctgcatgatggccttaaagcgtggagattccgattcctttggtgtttcacagggatcatatgcacactgtggattaagatgacagtacagataggaggagtaagaaaagagcaaaagatggttttgtcattgcttgtttaatttaaaaatgtgaaatgggcttgtagaagcatcagtaccacattatctggtatgtgagttggagtcctcaaatctccagaatggttccgcaatgcattcggtttaactgtgtatgagatagattgggcacacacatatcagattttcaagttacaaaaagacacacagattatacattgttagctattgttatatgggataaagtagaatgtgctatggacaaggctacaaaaagaaatgcattttcatatgagaggagcagaaactattaaacaccggaagcacatattatagaataaattcagccagttgtagcaacaatatgaatctttatagtaaaacatttctcagcaaactactacagagtttgctgcggactccaagaagttcgttttttttaagaactagcaaattaaactgaaggatatagctccgatagacataaacaggtatttaagtaagtaatctgccacaagtcaaatgaacacctcactccagtcatatatccaatgagctgtgtatatagaattagaagctgtgcgcacaattacattaacttcaatcatgaaatcgcaggaatagcttatgatcaactgctaaaaatagcaaccaattactagctttgaatttaaattgtctacaccttttaataactaggcgggcattccttacttaaatggtaagaatcattcttacgttagcaccggtggttccaagtttagcatctagacaccatgcggcaaaatgaaaatcatgggcgccaatctccttataactcaacacatctaagttgaaattattatgtttttactgtttttaacaactaccgtcgacacggtaagctctgaagggagcttgaattgaattgcttaatgctgttctccccttactatcaatgcaagagcttggcaatgataagctaatccccctatcttccaaaaacctgtagccggcttgcaggatcatgatgcaaaaacctggaaaacaagtttaaaggatgttcagcttgcaggatcaacaaccttttgcagagctctttccttccaggctcgttgctgtggcgccccgcgctggatgttcggccgctttccctttcccccggctgccactggtcgaatctgcccatgagcttccagccttcctcccgccgccgccgccgccgccagccgatgcagccgacgggtccgcctgcgcctgcccacgcgatagattactgctcccgagcgcggcagcgatgcggtgcccctcctgcggcaggggcccggatctcgtcttaatccggttgaggcccagcgaggacgccaggatgggcgacagcgccgccgccgacgccccgcccgcgcccccatcccgaagctgcgccgcggcggccttcctcccgtccgccgacgggctcgacgaggccgacgcaggcgccgcccccgcgccgcccttggaggcggcggacccggacgcggagccgccgaagagcttgtcgcgcttcctgggggtctccgatttgggcttcttcttgtcggatctggacgacgacgacgacgacgccgccgccggcgaccccgccgcgggcggcgcggaggtgggcgtccgcgggctgttgctcccgtccgtggggctcgacgactccgacgacttgtgccgggacgagaagaacctccccttgaacaccatctcctcgccgcccgccggggaggcgttcggtcgaacaggtggtgggggcggccgagcgagcgagactgcgagtccccaaggagagagagagagagagagggagagcgtggtagtggggacaaggccgcagatgtagagagaggagagaggagaggagccgaggaggaggaggactcggccggtcggtcggggcgcgcggcgcgtgctctccctcctcatccccttcccttgcggctcacggctcgggcctctgggtgggacggtacgagagagagaccgcggcttgactggggcagtagtgggtcagctacagtgctactggctatgctaatgctacagcagctccactggggtcagcgagggagtgtggtggctttggtgggccggaggagagggggttcgttgcagcggggaaataagtccactttgactcccttcggccttgtttggtttggagggagttgaaggggactggagaggtttgaggagaattattccacatcacaataggtgtagaataaatgtttttggcttggttatcaggttgggtaatgaaagttgtctgttgtaaaaaaaaagccgtggaataaatcacttccaatctctcactcttatgcattaaccgaacatggacttaactagtgaccaaatctgattcgtatccttgaaacataatacaggatatctcgacccccaactattaaaacaggtgcagtttaactctctcggcagttttggagggcgttttcactaacgtggtagtattgacctagtctgtggcgtcgacatggcgctttggttctattataattaaaaaaatatatatgtgggatccatttgtcattcaaaaaaaataggacccacatatcatcctctctctcctctttcctccttcctctctctcctcttcgaccgtctgcaaggggcaggagttggagcagccggtggactttcgtccgcagcacacgtatgctgcatccggcctacttgacctcgccatcacgctcctccgcctcacgctggacccaaccaccatgttctacagctccgccatccacgtccacacctcccacagtctccagctcgccacactcgcgctgctctctgagatgctgggtagggggctcctcccaacctcgcacacctgcgccgccgccgctgctccagccctgctcctcgcatacggccaaaggtggaaaaggggagacaaagggagagataatggagagagagggaggaggaagaagggggaggagagagatgatggcatgtggcccgatagggttaatggactcttctgtcagatatggatcatgtttgaggagacgaagattctaaaagctagctggtttggtaggtagctatagcctctaaaaacatgaaaaaaaatggttcctcagcttgtaattttcagttattttctaaatagattgtatagttatacatcacataaaatatgtacgctttaaattggatcatgctttaaattgtaagtgagtttctagtaatggtaacttctcttacaatttctagctcttaaattggatcatgttttttttaaatattttcagcttctctatataattcaaattgtcaatcatactctattacaatgtcaaaaatctaaaacgacagagtagtagtaatattgaataaaatatgatacatttgaaagggtatagttcgaaatgtacatttgaatccaactcgggacaattcgtcggtatgctgtgtggacgggattgagagagacctgacgagtgggtttgctgttccggcgtgggggccgggggagtttctggtttccagcatcgaggattcgagatgctgccattgtgccatgctgctggtagcctgtgctagtcagcctgttcactggtgcagtggtgctgctgatgctcagctcagggcccggtctgggagagtcaaagattcccggtccatggtttgaatttggaaagagagaatttctcttttacttttctagtagatctgaaaattattttaattttgctaaggtgaaccggtgtgagctgagatctactccctccgtcccaggaagaagggattctggaagcccaaggtagttttagaataaagagtaaaagactaaactaaccttagtactagtacatccaattattagttacaaataaagtattactactgccacacattaataaaatataattagtactccatactcaaacacacatggagatacagggcgccaaggtgccaaataatttgaatgaagagttaagcgccactttattggcgggatgtaatacaaatttagcacaccccaccacaacaaaccctacaagtttcaaatctgaagtttccctcccactttatcacttcataactctgcaaaaacacaagtttccctcccactttatcccttcataactctgcaaaaacacatccatggctttagatctaaatatagcattagatgatggagatgaacatgctatacctaacctcaatgaagcagtggctgaagaaacagcagcggctgatcaggaggatgaccaggttggaggtgatctccatggaggtgccaaccgtgagcttcctggaggtgatttccaaggaggtgccaaccatgtgcttccttttgatctcaacttgcatgcatctgaccaaaggagaaatacatctaggtaaccttgtaaacatgaatagaaaataaatgatctttgtagatatggcttgcataaatcactctaaaatctttgccatttctctgtaaaaatgatctataacatgtgcattgatgcaattgctatcttcttggaacaaaattggtctttgataagcttgagaaaacaattaggacttgattttttttctttgatatttaccaactcaattctgtcaagagttgagcataatgaaatttattcccttccataatatcagaggttatactagattctagatatgctagattctgcatggatagtttggttaggccatgtttatttcaaggtgaaaagtttttaagtgtcatatcatatatacgaacacatatttaaagtattaaacatagtataataacaaaacaaattacagattccgtctgtaaactgcaagacgaatttattaagcctaattaatccgccactagtaaatgtttactgtagcaccacattgctaaattatggcgcagttaggcttaaaaaattcgtctcgcaatttacacgcaatctgtgtaattattattttttctatatttaatactccatatatgtgtccaaaattcgatatgatagggtgaaaagtttttctttgtaaactaaacagggccttagccaagctctgtggatttggttgcccgatggccaataatgaagcccataagtaaggccatgtttagatcatttagtccctggatattaaacttgtcccttactgttttgatctaggaacttcagtaaaaaggactaaaagcacgtagaccgagggagaaaaaagagagtggttatcattttagtccttataaatacctctaagagggtctaatagattttagttccaatatacacctttaatcccttttagtcatccctatttagattcttaaggattaaaagtgactaaaatggagggattaatagattactccatgaccaaacatgacctaagaaaacatgaatgcagtttacatttaactatccttcgagatagtcacgtctacaaactaaacctatttttgaacggaggatgtataatgaataaaaactgaactactttctatgaaactgaactagtgatctaagggcgaggtcagcgaaggtgaatagactcatctgcctaaggcttttttaagtatacagacacacatttaaagtattaaacgtagattaataacaaaacaaattacagattctgtctgtaaaccgcgagatgaatttattaagcttaattaaaccgtcattagtaaatttttactgtagcatcacattgtcaaatcatgtcgtaattaggctcagaagatttgtctcgtgatttacatgtaaattatgtaattggttttttttccacatttaatgctccatgcatgtatccaaacatttggttttgatgtgatggaaaagttgaaagtttgaagaaaaaattgtgaatctaaaggcctaattttaatagaaacgttcgcccaacatatgtttgcatctcgagcctcataactgtagtgggagtatttgatacacacgtatacgactgttccatcttgttttaattttcgacaaaaatattgataaattttttgatctttaagcctgaggaacaaaaccgtatagtcgtgcgattttactttcaaaatgacgataaaaattcaacgaatgtcaaatgtcaaaccttgatttctcccttccagaagtcgagagtttttgaattcctcaacttgccgtcggcttgtccctcttcccgcgtgttgaaatcatcttcccttccagaaagccaacgccttcatctgatcatctccttggccaccaagaaatgccttcgtcgaacacctcgccacgccacgccgcgcgcgcgcccatggccctctcctgcgccgccgagtgcgcgctctccctcgcctgcgcgcgctgggcgctccgccgcctctccctgtccggcgccgacgacagcgcgtcctggcccgcggcctcgccctcctccttcgcgcccgtcccgcgcgcgtgccgctccgcgctcgcggcctggcagcaggggcacgacgaggcggagcaggcgccgacgccggcgccgtcgcggctgtgcccgccgtaccgcctctcccacgaccgcgcgcgcggggaggtcgtgctcgccgtgcgcgggctgggactcgcgcggctcgaggactaccgcgtgctcctcgacgccggcgggcccgagccgttcgcgggcgggcacgcgcaccgcgggctcctccgcgccgccgtgtggctgctcgaccgggagggccccgcgatccggcggatggtggcggaggccgggccggcggggtgcaggctcgtgttcgtcggccactcgctcggcgccggggtcgccgcgctcgcggccgtcgtggcggtgaggtgctggctggagcggctcggcctccgccgcggcgacgtgaggtgctacgcgatggcgccgccgcggtgcatgtcgctcggtctcgccgtcgagtacgccgacgtcgtccactccgtcgtgctacaggcaagcctagcctcccaacaacattgttgcctctttccccttagctgatatcgcgtccatttctagcattgtttatcgaacattctgcaataagaacggaatccgacctcgattcatttcgttgcaatgattttggaattcgaatcgcacactcaattcttgaatttggatgcaggacgatttcttgccaagaactccagcgcctctgcaacacatcttcggatcaattttctggtaattaaaacagctaaaaatactcttgttatccatgtgttccaacggcgttgattactggttgttccagctgttgattcaccaatttttttagaacaagtgattcaccattttttctgtttcttgcattgcagtttgccgtgcctgctgtgtttcatttgcatgagagacacgtttgtgtcagaagagaagcttaaggatgcatctaaactctacgctccaggaagagtctttcatatcgtggagagggagaactgcaggttaagggccaaaattccaaaaattaaaacttttttaaaattaaaaaaacaaaatccttgtgtgctagtatggcattagacattagttagaagcttccgaagattagctgttatatttacacttgattttaattggcattgtatccacattggctgctatgcagatgtgggagacttccgccgcaggtcagaacggcagtgccagcagagggcagatttgagcatgtggtgttgtcatgcaacgccacttctgaccacgggattatttggatcgaaaaggaggctcaaaaggctttggatgtgagtaatttcgtctttgcacatgcctgcctgtcaatagtaaaaaaaaattatccctctttgtaaccgatcaattattctttcttccctttttacgaatcggcacaagacaatacccgtttcattgtatagagtaggagaaaaagtggtataaccaacatgttgcatggctttctttaccaagttgttgttcatccttagcaacatgatttcattaatcattttacctgatgtttaatttcttcgcatgttcctttttttcttttctttcgtttgctgtcctgcatgttctggttgccaatcagttaatggagcaagaagaattgacactacccccatcccagcaaaagatgctcagagtgaaagaaacggaatcactcgcagaccaccaaaagctcagtgcagggaatccacaagaagacgacaccctctcctcctcgtcaccgttcagtagccctagaacttcgacgacatcatcattgcgcagcgaatcgtcgtcgacgaggagcgagtgggatgagctcgtggagatatttctgagtgaccatgaagaagacggtgatggtaggacaaacatgtgtaaccgggcaggttgtttgccttgctgtaaataaaagattgttgcatagaaattttagagtgtaaatgaactatattgaaattagagtgtaaatgaactagaagatggttaaattttattccaattcgacctcacgatcaactcgattgaatgttaatatacagaggctccaataatccatccgtaccagtgtactattgtcccagatactagtaaggctaagttatactcctatttctcaacttgaaactttaacttcctcgttgtttttcaaactgttaaatgatatgtttttttaaaaaaattctatatagaagttatttaaaagattcaaatagttattaatcttaattaatcacgtgctaatgggatttttcgttttacgtgtgtcaaaaatctctctcaaaaacaaagagatcgaacgcagcctaagtagtactccatagtattgatccaccatatgggtactagtagtaatttttctcttcacaaaaattattcagttaccttatcactatatatatttctaatttctatcaagcttgtatggggtaaaatgggtaaaagaaaaacatcatattgaaaaaaaagaataaagacaacattattcatcgtttcgcccacaaataattgtaatattgtgacacttatttctaactaaaatttaattatatgaattcatattttatatatgtgttcttaatgacttgaaatccaatattgaaaaataaattatgatgaaaacaaatattaaaaacaactttcaagttagaatttaaaatttgattgtgtttactctccctgtttcagattataagtcattttgactttggttaaaatcaaacagttccaagtttgattagttttgtagaaaaaaatgtaatatttttaactcaagacaaatatattataaaaatatattcaattattgatttaaagaaactaatttgatgtcgtaaatattacaatatttatctacaaacttaattaaatttaaagtagtttaactttgatgaaagttaaaacgaattataacgagggattaataaactgaagagcagctgaaaaatttgtcatcacttatcaccatgacacggccggtgaccacatttcgccggtgaacacacagacacaaaaactagccgttactctatatcgtagtagcattcaaactaaccagccacgcgaagccaccacgacaaccgcagcaaaatctccggaagccgccccgccaccgaaccgaagagcgccgccaccgccatggggagtctcggcggcaagtccgactacgagagcgtccgcgacgcccgcatctccgagaacctggtaagcatccttctcctcgatcatcaactttcgggtttcctctctggatgaggaatctctcgcgcgcggacgcgatggcaatggctcgcccgccgcgctgattcttgggcgagtccccgcaggcacggatggagatgctcggcctgcgccgctgcgccggggagttcagtgccatcgcctccgcctccgcgtccgcctcggcagcagccagccgccgcgccgggatcggcggcacaaccccgaggaggaaccccaagccgccgcgtgtcctcaccccgctccgccgctccggccgattggtcgccatcgccgccgcggcgccggccggatccgcgtcgggtccccgccgttccgcccggcttaacgggcagacgacggagcacaaggcgctgcctctgaaaggttggtccctctcgctgccgcgttcgctgaaatgctgaatctccatggcatctggctgcctgagatgggaacaaattcttgtgctctctctctcttaggatctttgagtaagtttgccgcggaggaagcagaggaggaggaggaggaggaggagcaagaagagaagaaggcgatggtggtgatcgacaaggagagggtgcggatcctgcaggagcggaggtgtgacagcaaggggaggggcgccgtgtacgaccctgttcttgggatttgctgccatttctgcaggtagattctccccactgtcaacatttacgaccgattagtgctcctcatcttgttcttaatcaagaatgctaggtaccatagttttcatactgtgacttgttgagaaaatttcttcatagttttcgtatgatttgttgagaagtctcttctcgtgtgatcttaggcagaagaaattgtgcggcgaggagggctgcaagcgctgcggggaaggagac

SEQ ID NO: 82445 - DNA, 4218 bp, Oryza sativa
ttgatcacccaagacatgtcagatgacgactcaggaacacacgatatttgttaacgaggttcagccgaagcctacatccccggggctctgattatgggtgctcctccccaaccaatatagctcctagccgctacgagtccatggccaagccgccatcatctccctgcgtgtctacgctacattgtagtcgccatgattacattgtcgtgcccccctctctatttaagagagatgacaggttacagagtccgactctaactctacccctaacacctattacaactccaagtccaactgtaaccaaataggactagtatattcgacacctattctaacaaactccaccttggcgaatataagccacctagaagtagtagaatcaccatgccgatccacctatcctctagacttgggttgtcttcttcgcagcttcaccgcaagccgcccgacgagtctgcgccagacccgccgccaccaaaagcaattgctatcccagcaaccgcttcctcctggactccacctgcaatagtgcaccctcgcagcttgtaaagttgcgactccaccttctctccagtcatcacagtcgtcttgcccttcatgatctccatggtcttcttattccgattaccgcgaaatattaacccttcttcatgcaaggttccaagcgaaatcagattcctctttagccctggtacatgcctgacaccctgaagaacatgttcacctccatcttctagcttgattttgacttcacctactcccacggctggataacttgtgtcatcgcctaagtagacaaaaccaaactcactagacttgtatgaaaagaaccactccttccttggcgtcacgtgaaacgagctagctgaatctaatatccacgcttctgcatccttagactgtgcacttgacattttgagaagatcacaaccatcgctatctgagtcatttgaagaagtcgctgcattagccttagcttttcccttcagtattgggcacttcttgcttatatgcccccactcatcacatctgaagcactgcaccaccttcttctttttgttcttctttaccttatgcccagcatgatcttctttgactagcaaaccctccgcttgagatgtttcaccctctttgttctttctcatctgatcacgagccaacaacgcagaagtgatctttagttttgatggtctccttgccgtacgtcaaagtagtcaccacatgctcatacgattcaggtaacgaacacaaaagaactatggccttgtcttcatcgtcaacttccacatccatcttcacaagatctgtgactagttgattgaaaacgttcacatgtgctgtcagatccaccccttcctgcatctttagcccatacaacttctgcttcagatacagtttattgtcagagtcttggacataaactgagcttccaacttttcccaaattatctttggtgaggtctcctccatcacatggtacatgacctgatctgaaagacatagccttattgtcgcagccacctgcaactgcatctcctcccaatcgtcatcctccatcttggccggtttgacacccttcaaagcctttgaagcaccttgttgagctaacaaatctttgaccctagtttgccacaagccaaaatttccagagccgtcaaacttcaccaaatcaaatttcatacctgtcggcgccatcttgccaacccgcgacctgactggtctgtcgccaccagaatactcgcccttctcagaaccgtccgtattcgtcttcacaatcccgtcttgtgatccgatctcagacattcaacagcaaaccacctgtccgccgccgcaccgatccaactaatctgcttcacggtttttctccgtcctgcttttggttctgtccggtttgcacacacctgtacgcctgctgtacgatcttgccttgagcccagatttgtgccttccgtggtaagcttacgagtgtctcgatcaattgcccgtcgccttttctgccataggttcacgtcctgaccgctccttaaatagcatcagccaccgggataccgagtccagatcgacttcgagtccggatggacacgtcaagccgagtccgcgtcgatgacataatttcgtgccttatcagaaacggtctcctgaccagctcccacacggaattaggcctttgatgtttgacttctcctcacatcttctctcacggcagcaatccacgtcgtctgttctgcatgcccatgcatgcacgcagcttgtacgtgtcccacacaaatccaattgaaatcgtatgcactcatgcattaagatgcaactaattaatccatgcatggaattaatatcctgcatgcttgcaacaactcgtgcatatctcttgctcttggccaccatctgtacgcgtactgtatgcatgtgacacgtacacatacgtgtcgttcgtgcctctgcacgcaccgcagtcgcagccctcatgttttccgtccacgatcccgtcgtcatcggccttgcacgtccgccgcgccgtgccacgctcgccggcttcgcccttccgtcactggcctccctgccgcgttcgccgcgtgcgtcgggcgcgccgtccatggcgctacccctccgatctctccggtcgccttcggccacgctcggccccgtcttccggtcaagttccgccatcgccggtctgatcgcgagcgaggttgtcacctccgcaacgtcctcgttgtcgccatcgatctcatcgccacggctgacgatctcctgtcgatgcgcgacccccacctcgtgtttcctcctccacatgtcttcttgatccaatgttgaaaccttctgctctgataccacttgttataaaagttagccgatatagcggaacgacgactaaccttctcgatcgcttcaatcattaatcacccaagacatgccagatgacgacacaggaacacacgatatttgttaacgaggttcagccgaagcctacatccccggggctctgattatgggcgctcctccccaaccaatatagctcctagccgctacgagtccatggccatgccgccatcatctccctgcgtgtctacgctacattgtagtcgccatgattacattgtggtgccccctctctatttaagagagatgacaggttacagagtccgactctaactctacccctaacacctattacaactccaagtccaaccgtaaccaaataggactagtatattcgacacctattctaacaattcttaatctttgtgccctcaaaataagccttatattttgaaacagttggggggggggtactagctaaatgcaggtggctttgcaacagataaaaataaatgcatgtcttattggtacaaaatgtagttcatagttggtgggtggcagattcactgtcaccaccgctacactgtcttccttcagaaggagtacagatttgtgggttagtttcaaggtttgactgcatgaccaatgtgcgtacccgcattattatttcttgcactgcactgtactctctgatgatgacatatgccactgaactataatatttctctgaacacttctctgtaaggaaacgtagcaaaaaagttcatgccacattctgcagaattttacgaacttcacttttgcttgcactcctgactcctctgtttactttaaaaataactatacactatccatttattcaaaacaggttgatgataaactttatatatacctggagtatgtttctggtggatccatccataaactactccaggagtatgggcaatttggtgaacctgctatccgcagttataccaagcaaatacttttaggcttggcttatctgcatgcaaaaaatacggttcacaggtaacattccatttccttttgtcgttagttcagcacttcagttccttagatgtaagctaccaagttgtagattattttattatttgtcatgttccataatttgcagggacattaaaggtgcaaacatactggtagatcctaatggtcgtgtaaagcttgctgacttcggaatggcaaaacatgtaaattctctgtttcaaattgtaaaaaaaaaaatctttctcatttgtcaggaataactaaaatttaaagcaaaagcattattagatgtaattccttgtatcatcttcataggaagaaatggtgtattgtgctttaccctttccctcgtgttctcttgcacttgaggactaccacttgtgctagatca

SEQ ID NO: 82446 - DNA, 2972 bp, Oryza sativa
gcatgcaattttgtatatttccacgctttatttactctctcttctaatgtatgccggaaatgagaaagattgcgagatatttgctgatgataacgtgggcattcagaaaatgtataacaggaacagaacagagacgacaaagtatgactaaaatgatttacatatgtatagttggagggattagcacatcttagtccttatctccttgaaaggcagtgggtgccactctgaaatacaccaaagccattcttgattatagctattaatgcataatatttggccagtcctgtgaatcatatttgctcatcatgttcgaaatttggacgctgtcccgtcatgaccccacgatgcataaaagattgatagtgaaatctgaatctatttttcaacaacggtccatgtttaaaccaccaaccctcttgttttgacagaactttcaggcttggtcactccacgaaccaccggtctgtctgctcggcaagggaagaacaataattcagcatttaatctgcttttgccttttgtacttttctattgacatagaagccatgcataattcatcgctcatcctcttgctgcaacaactaaccattgcttccgcttcacgctcccgataatgcctggactgaactaataagctgacagacgacggcaattgcagcacagcgatctcgctctggtaaagaaaatcaaaacaacaaaacaaaacgtagaattcagaaacttcatctgatggttagatctccctcgtgcttgcgatatcccaggaggggtgaagttgaaaacgcatagatttatgcaaccaggcgtgtgtgggagatcgaaagatctgtactgcttttctcgagagaggtagctgatggcccgggactgctgcgaacaagaacatttgggacttgtaaaatgggcagcgtaagggttactcgcgttgacatttgacgaacctgccactgctgcatcttccaaagctccccctacaggttaattaacctgacgacccttgcaagtagcttcaacgaccctatgctgtagacttgcagtttacatgcagtaggtcaataggattagtagagaattagagaatcatcactacacctaagtcctaatctatatactgtagtcatttgagacagaatactgcaactgaagtatgttcataaccaatggtaaaagagaaaatactgcaactgaagtacgttaagagaattagaaaactggaaaattttatgtacgtaaagagaaaattttatcctcgcagcctgaacctccgaggcgccgacaacgttctccacaatggagtaaaactacctgaggtaaaaccactgcagatcttcgtgctacacctttgacctagggctttctgaaactttatgcaaaagcgactagtaacacacagggctggggtaatgtcttgtaaaagattacgcataattttaataacggtagaatttggtgtcataaaaatttgtgcacaatttacgaacagccgttttgtttccacaaattcagctcgctgcaactattgaatagtcttatattggttgtgaaagggcaagtgacctagtatataagtgggggagtctctcacctcattggttaatttttgaggtgggaaagaccatttacgattctacaattgctatctgagtctggttagttcaatatctctaacctgagtggcaaagtgtgcgaaggcatgatggaccgtggatgcttgtggagcctgtatacctgagggaccgtagagaaacagtgaatggacggtgaaaggccgagggacaccaacgtatacctgagagaccataaggaaacggtgaaggggtggtgaacggctgagggacaccaatatatgaaggggggagattattgaatagtccacattggttatagaaggacaagaaacttaatatataagtgggggagcccatccctcattggctagcttttgaggtgggaaagatcatttacgatcctacagcagcagcgtgaccttgcctcacgagctgggctgcaaacccgaaaaggggaagcttagtgtgatctctcccttgtgttatgaaaactctgggctatacagacaatatccatcacaatacagagtttgggcttggctaggctgccattcaagtcatccaaggctaggttgaacggttgatgctagcctggcgtgacaagaccagtcgtttggaatcataaaagaagttactatagaactttcgaaagaaaatttctctaaaatctttcaaatataattacagtgtaactagaatgtatgtaatgtaacttgtctaaatctttcaaaatcttatggcaactcaagtggctagcatggtttgcggaaacgaggtcctgagtttgatcctgtgcaagtgcacaagtaaattttcacacgaatttttccctccacacgctagcacgaatcttaatgcaaatccgacgaccgaaaaatcaagagtctttctccctattttctatcgacaaaaatctagcaaatccataaaaagaaaatcatcacttccggtggcaacctatcccggaggggcaagaaaaagatagcttgctcgggagagtcaactccgctctccttcgagagcaaacgtctctcatgcaatcatccaaatcgttcactaaggcaagcccaacaaagtagcaagttgagtttgccttaccgaacaacggaacatactgaaaatccatactggcagccaactttctgtccttctcatgcttgcccgacgacaggtatcaaccattttacctgcagccttagataatggagtaagaggggtgagattgggatagggatatgagtggggggttgagatgagatatgaagaatggatggttaagattaaaaattaccattttagaaggtgggaaaagattttaccatcccattatccaaagttcggaaattgcttcccatgtgtcgtccgagcaaaagagaaaaatcgaacccgcttcatgcaagc

SEQ ID NO: 82447 - DNA, 6555 bp, Oryza sativa
ctgtttttattgtgtttcataaaattatcaaaaataattgctactaccctccatcaatgcttgcatgcatgcattttatcggtctttaaaatgatttttcttctaaactacttatccaatctatgattcgattacaccgttgtattcgttgtaattaaatctttataataaaatatcacacgattaaattttgatgaaagaaaaatatatgtttcaatctattaactcttattgtttcataagtgatagcaatatgtttcaacgtgtatcttcactgtgtttcataaattttttaaatgttttagttgctgtttttttgtttcaccatatataaattaatgtttcacttgttggtcagctgcaacattttgaccgaccgatgttttttttgatatatcggacgttcgattggtagtattctccccaaagttccaaacacaccctagttgtttttttgtttcaaccgggctggggttgggaggagatggaacagatggagaccgagccaccaaaaagcccaaacctgtaacaacaccccactgacccagcagcgtaataggcctcttgcctccttgcgttgcgacccagccccctgtcccctggcctcccctcctccagcacccgttccgtctccttcgcccgccgcctacgccgtcgcgccgatctccatcaccgcgagtagcggcgccggcgtcgtgctgcttccggcttccgccgcatattctcgcctctgactccttgcgcgcaagccagtctccacgtcacatcagcctcgactcccgtctcctcgcgagttcgtcggccgcctgcgtcgacctcttatacatcgcgcgagcagcggtgccgtcgccctgctgcttccgcctccggtgagtacccgtgccgaagcacatcctctttctttctcatccattactaccttcacattttctctttgcccttaccttatctttctcttctagatctagaagcttaggtttttctttgtcttaaccttagtactaactttttttttagaagatagaacatatttgatccgacttttgtaagaaagccaaagaaacttactgtagttcatcatccaacgaaaagaaaaaaaacagattcctaccaacgacactagacaccacaaacagactactgggttgcaagtttcagaagtaacatcagggccataggcaacgacatcagaccctgtttagatgagactaaaactgttaagtccctatcacatcggatgtttggaaactaattataaatattaaacgtagactattaataaaacccatccataatcttggactaattcgcgagacaaatctattgagcctaattaatccatgattagcttatgtgatgctacagtaaacattctctaattatggattaattaggcttaaaaaaattatctcggaaattagcttttatttatgtaattagtttcgtaagtagtctatatttaatactctaaattagtgtctaaatatagagactaaagttaagtccctcgatccaaacaccacctcaaacacctccaaaaacactcaaaacagaaagtgacaggattacagttctcatagctaaacttcagacattcagctatccatcaatctccattggcagcacgtcaggagacttcagcacttgaatattatgctccataattcgatcacaccacacctgcagcatactgtgctcctattcattttacaggaccatccatctctgaatctgcgcaatcattttatacaagattgtctagggtgattttaacacaatgatttggaaaacaaagccattcctagtaagccacaaaacacaagccccaacaaccttattactgactaagagtaccccacacgatgttgtgggtttgtttgtgattatgcatatttatgttcatggtaaaatgaggatgcgggtacagtaactaaattttactatcgacgtacaatatcacaatagatcttttacctatcaatggaagcatatgaccattgatggatgagatatcatcagcaaaatggaatttttgaagcatggcatctttgcaactgaattttattactctcaccattgatcagcatggatccaggcctagggcagctagagctcaagccctagttctgggatccaaaccccatgcaaattccatattaattttagaaagaatgcttgaatttatagagagctaggacaaggtaatagaactaagccctggtgtggcttcaagctgtctccgcccctgaaattgatctcaacgttaactcatggttctgatgtttttttcttgaacgtttttggtagtatgactaagccttggaaggtttttatgtgtaccttggaagtgcttttgctgtacagaaagaaaaggagattatgaggagggttttagaggaaattaacgtgttctttatatgcactgcaaacggcttgtcaaactgttgtggttaattactgacaattggcaagagtcgcaacatattttgcttcaatttttttccggacaacactgttgttttggcttctttacctttttacggacaacagtgttggtttggctgctttgccttgacagttaatcacgtagcaaacttcctcaacaaaggcagttgcaattcatatatctaatggtcattatcccttttcctttgatccaagagcttctactttttttaatggtgtgtcttaacagggaggcgctgtgtgtggtcaaaaattaaaggagagggagggagaggtagcatatttctcccccaaaacgtttgggggttcagctgaacccccatgccccaccggtaggtctcacagaattgtacatcatgcaaccttttctcctgaatttccagggttacgggacagtttgcatggcatgatcatattttgctaaggttctattagagtgtcattcgatggcccatttcatggacttaagggctttcatcctgcgtgcacgtgttttaaagctttataggcaggccttgcgcatgactcgccgagctcctgtgcatgcacgcggtcagacatttttaaacctcgctttcctatcttttctgtctaatgtttactcttgaagttacaactaaatattcttgaatgttctttgtccagatgagttgaggcaaactgtaagagctgagattgaaaaaaatcgccgttgtgacgataaacagaagattaagttcttgatcagtgaaggtctgcaacgattaaaaggtcttgatgagatgcttgacatgacaggaaatagttaacttgagtttcatgtgggaatctactgttgtattcaattctctcatggatccatgtagttatataacacactttaccctttacaaagggcaagacatttgttgttctctagtttcatctgcggaacctgtacaatatttggggctggattggggttaggttggctcagaactacagatcatggaccttttctagaagtcagctggtttccacaccaagatattttggttaattgttttctgtaactttcttatcaagggatgtaaagtcgaggatagttctgtattttttttctcacacttaacatagaacaggactgaaggtttttccagttttgagctaattggttttcaattgtactatcctttcatgtgaaattacgaacagaattgatgccattgaaattacttcttttgatcactgaaatttctagtatcgacgaagaactaacaatcaagaaagtctgcctgcttattacgcccatgtaaccattcttccatcaaactttttgtcaacatagaacgagctattaaatggtgctactttaagaaagaggaaataactaatactacaatacgtaaagggcagaaacagatctgctgctgtgtctaaaattttaagcttcaatccctaaagctcttccggtactgacaaaatcataaacatttgacaaaaaaggaagaaagatgaaactttggatcgtttcagcagagattcatagcaacaagttaacctcaaggaactgacccagaaacacataagtagtacatcagaacttgacttcaagcagcatcaggtaacataacccagaaattcacaagtacagcacaacaacagaactgaacccagatttactagcatcaggacttcaggattcaacagttcaaaagccaaatctggatttcccccacacaaggatgtaaaattttacagctgcaggccttggatattcgtcaaagatatctcaaagcaacataaagattgtcatctaaattggaaaaatgtcttctgaaaaacatgaatgtgttatcaacaacaagtttggtctattcacagtattagctattccattcattcatcacctagaataaatccgggcaaaattgttgacctgtcagagtaggaaagggctgaaacctgcataagcctactgatttctaccaacaattagagcaccaaggcaatttacacgcagccccgaatcctccaaaaaaaaacacaagatagccaacaagaaatcgccaagaaccgctctccagagcctagaaactgacgatgacgatcgacgagaactcatcaagaactcgtcaagaaccaagaactgacccatgatcgggagggcggcgacgctgccatctcaagaattcagagcaggcttggtgcgcggcggcgaggtccccggcgactgcgtggtgacccaggcgttgcagacggggcagcgcggcgagatggtgagccaccggtcgacgcagtcctggtgaaaggcgcggctgcatccggggaggacgcgcacggcgcgcccggcctccatgccgtcgaggcagatcgggcagagctgctcctcctcctcttcctcgccatccccggccaccgccacgcagatcccgcccagcatcctcagctcctcctccgagagcccgttcttgtcgtcctcctccgtctccggcgtgcagggcggcgtcggcggcggcggcgggtccggaggcggcccccgcgccacggcctggaacaggtagcagagccagacgcccagcaccccgagcatcccgatggccagcgacgccacgcccacgtacagcgcccagagctcctggctctccatcccccctctctctctctctctctctctctctctctctctctctctctctctctctctccccctctgcacagagcaattcgttggtttgatcggaggcgaggcagttgctagccgtagcgatggcgatggcggtggcgcgctggacgttttataggtgaggccgtcgcggtgccgatctaatgggcctcagaggccgggaaagtctaggcccacaagctctcagtcaaggcccatttagaggtccagttctagaaccattggggaggaagaatcagtatcggagagtgaatttggagcgaggcaataagatctcagcggaggaggagacgagggggagggagacccagcgagggaggagaggaggattccgagcgctgcagccagccatggcgaagcaaggggtgaagaagacgagggacgcgaacaagaagcggatggacctcatcctgcgcctaatcctcgcggccaacgtgagcggtccccgtgattccctcccccccttctgttttcagatccgtgaattgcttaggacgctgctagatggttggtttttggttagattttatttttggcagtggtcgtgtgatacatgagtttgggggtggtaattttggtgaagaattgaattggactagctgatcttgcctggtccctggagtagttgtctgggctatggtagttatcgtgttcagtcttcttcttttatttatttattatttttttgggaaggtttgagtcttgcatgtcaaggtactcagtgagagggaggaaagctctagcgtagttttgtcttgtagaatcaccttcccttctgacctcaacatgttctgtgatggattctaagtttgtttgtggaacatgtcatgttttggtcatatcatgggaaaatttatgatcacaaaagttcatgatagaaaggttataatcttgccttggcggcgattaggtgcttggtgccatcttgcctccatgcattgcattgatgcattttattttgttcaacaaggttatgtatacatggttctctttggtacttcttttcataaaaattgaagtaaatttagggtaattagaaggttataaagatcactaaaccccaagtcctcactctgataagatcaaacttatgctctttattcttgactaccggagtaataatcacttgaattttatgccctttgtgtcgtacttaaaccagaaagaaattaggagtatcacttaccaggagtatctcagggcatctttcactggcttctagcctactgcatctgcgaaagttgctaatgcaatcgaataaattagagaaagaaaagaagatgaaatcatctcatatccaatattcctgtggggggttttggtttgtaaggttggaatttggatattggtgggtctattctggatctcaaatttagttttataacctattatcttaaacactatatagctttggcaatattaatatttctcctaaaaatgccagt

SEQ ID NO: 82448 - DNA, 644 bp, Oryza sativa
cctgcagccctgttcaatcattctctctgtgagaatagaactactgcagagatccaataagagcgggtgagcaatcgatgcttatttagtcgctcgctttcactctctttccattcattcctactccagctcgtcaatttctccagcatggatgcagtgtagccaacaaaaacgatctattgtacctgctgtatcactctatccaccatccctccccctctccgtagccagttctgcatctcgccttgcagctactcaaggttatatgaggtatcaaaacgagccgaggggaaaatagaagaaaggccaaaccagttgtttttaaaacagagcacagatggcatgtaggagtagctaccaagaagcacaggagaatggagtctacttatccttcagttttgctatgtcaacttatgtgtcaatgagaatcggaggcatcgagaacaagaaatccagagggaccaatcacatatgtaagggagcatctatttagtatctttttcttctagaattccacatttcgcagctggatcagtaaataaattaatgtttatgatattagttcctttctttgaaaaaaaactgtgtttgttcttaacaagctgaattctatgttcaatggcttcttttgttgacatctcacc

SEQ ID NO: 82449 - DNA, 522 bp, Oryza sativa
gaaaagaataaaaaaaatgatgtacttcatggatagatttgtcatcagcatacctgtaaaaaaggtgcgttttttttcgtagctagatgcaaaatatatttcatcatgtcctagcttctttcttgacagtattagcagttcaacaataacagcaactataaagttgcaattaatcagatgaactcactttaaccctgccagttttaccaagggagcatgatcattgatcagattcttcagtcctgtactggtaaaattctgcttcagctgaaccaaaagcctcttcgcaacttcctttgcttcttttttcatttactgctaggcgtaaatggtggatcccaagtaaattggagatcgtgaacataatgaaaaactatatttcatcgaggttattcacatcaatcgatcacacagaatgtctaaaaaattggacctgaaacgctgctgctgctaaaagccatacctggcggttcacggtgtcgaggtaagggcagtcccggcgcagctccacttgcctcggcc

SEQ ID NO: 82450 - DNA, 724 bp, Oryza sativa
ctgcagcccggatatggagtactcaagtgctaacattcaaatatttaattgacaatagtggctaaattatcggtagagcaaagtaggcgaacttaagtccacccaaaaagaatattgcaaagaaactgagagatcactcgtgtccagtacagattaagggacctagttgctataagacaaaacatttggggacaaaccgcaaaagcaaccacatgaggggacctcaagtactggtatccacaaagaaaagatgcagaataaattggtatccacaaagattcacggatgtctcgccataaaatatttcgaaaaagcaattttttttaccaaaaagaagaaaatttatcgtatgcaattccatccacccatccactgatccacatgacaagcttcaatcgcacacccgtttccacttttgcaaattgatcgaacaaagaaagagaaacggcttggaaaaaaaaatctcgcgtacctcgaattctccaaatgcacggagcctctcaagaatctgctccataggagagcagaacacctgctgagaaaaacaaaaaaaaaatcaagagattgattagaccatatcataatcatagtcaagaaccagcggcgcgactagaaacctcattcctcaagaaccggccaaatcaatcaataggcacccgcagtaacggcaacaaggcgaatcaaatcaagaaccagaaacgcacggcaacagcacgaatcgatc

SEQ ID NO: 82451 - DNA, 13933 bp, Oryza sativa
aactcaacaggtatggcgtacaaaaaactagctgaatggaaggttttattggtagtacaggggtgaacaggtagagaagaaaagagttcaggactacaagttttctggctacaagttttccataaactgcagaaaatatgatgcaacagctgctaacaaaaagagcacatacactgtgaagaaaagccttccttgcaatgtctgaaatagttagctgactctggctgacaaaaggaaaacaaatgaaatcaaagttaaaccatcaataaaattttcatgacattaatcaagaatgtatcttgacatagtcaaaaatttctaagccaaaaaagattcgaattttaccccttcaagtgctgctcttgcagctgagcctggagctggtgctcagctaaaattccagatgaacccagggctaaaagtttctccttcagaacagcagctgcaataccaaaaacaaattttaaaggatgtatgggctgctcaaatataatcgtttgttaataatatatataccaattatgctatatgaaatcataatcaagagtgacataattaccctgctagaattgttcaaagttcaaattaaggaaaagcaaataaaattcctcttccattttcaaccaatggtcacatgaactaaataagaattttgaatatatacaacaaagtaagaacgaacaatcatttacttaccagtcgatcccctggctccctgaagaacagcaaaaagttgtctcctcccttctcttgtgtatgcagccttgttctttgcagcttctgtcccagacatatcctgcaagtcaaatataaactgtttctataattactgccattaagtaccaaacttatatatggcctggagttaatgcgacctaactgcaaaaattactgcagccaaattaaacttggggtgcactgccaagtttcttattcgaggtaaagggtacactgcttctccaccttgaagagtgagtatcttcgtgatatccattgtttcaatagctgcatagttaaaacagaaacagttgtaaaacttattctcagaagaaaaaaaggtagaatatgcaatcggcaagtaacactgctaaataaacaagatcttgtgtgatcagcatatgaaataaaatagcttagaagctagtatgctattagcccatgacgcagatggcaaacatcaaatggaggttgcacttacaccaacaccaggaggccacagcagcaggggccaaaccaacccaactcagatataagctgattatttttatttgtttgttatctccttaattaggtaactagagaaaagattggtttgaatcagacattttttggcattgcctatctgtcttctctaatgctcccatgtgtgctcttcccccatgttttgcttttcccctgcagcaccactttctcctgaagtcccaacacattcaggtccaaccagtaagacccagggccaaagaagtccactaaacatggcagcccattctgttgcaatccccaggatgtggcataaaatcaaccaggtacatattaaccagggaaatagcaattgaatctgaattataagggaggaaagcagcttgagaagaaaagcataagtagcatggaaacaaactaacctgcatgctcaaagaaatgagtttccataggttgtctgttaggattaattataactcgtgttttccatacttgaagtgccccatcctttgaaattgtaacaagtaaccgtagtgtcggaagccaggaaacagatgtgataggctgggaaccagcctgtgtactgagtagaagtaaaagacacaaatcagataatatgaaacaggaaaaataaaagaggtaaaagacaagcagaagtgcagaaccagaacaatcaaaagtacatggaatagtatccatccaaacagagacatacaaagagttattaagttagctgcactaaggctgagttctttcaccaaatttcccaactcacctccctcgtttccgcacgcacgcttttcaaactgctaaagggtttgttttttgcaaaagttttctatacaaaagttgctttaaaaaatcatattaatccatttttcaaaaaaaatagtaaatacttaattaatcataagaaaatgcgtcgctccgttttgcgtgcgcggaaggtgagttcccaacctcacctcccgaacacagcctaagaatatgtgttctaacatttctcaatcaaattcgtgccaaggaattgcaagtataatatcaaaacttatattgaaggtacatcaaaatagatctgcaggctaatgtatcctatgggggcacaggaccacactgaaactttggtcccaagacagtgcctaaagcccattagacctattttgattaaataataaaaaaagggaggtagcccctcgaatgcttgtgcacatagtcaacagtcaacactgtgaaactttaatcgagatatttaactatttgccactcttagaagtggcatttaacaatttgctacctggactctacatgtcatagacacatgagggcccatatgtcatagacatatgagtggcaagttattaaaagccacatcgaaactgttaaatgcgccccactggtgcttcaagcaactcaatgcctcacctcaaagtatttccaacaattaaaaccttactggcttgtccagataatgaatatcaaaataatagaatacattggaaaagaaagaaacaaaggaaaatggtcttgtttttacaacctgaacaatatataatgtaaaaatatacttacattccaatcatacttggtctctccgttgatacatcccatgccaagagagtgccacctctatcaccaataaatatccactctagggttggatgaaatccaaaagcacccgctccgacaagcttaattgtactgtcaacagcaactaaggaaagtacaatctaagagtcatacaaaaggctaaacatacttaaatatatgaaaataaagtactgcatcttacgttgcaaggtgtagtgaacaacatatgtctggatgttataagcgcgtatcaatccttcagcgtaagctacatactgaaattataattttgcacatcaacatatgacaaatacagatacacaacaacaagacaaccttgtgtaggactgcagtgcaatcaccagccaaaaggtaaagctctgattgtatttaccaggacaggaaggcgaggatggcaagccaggttaacaacaggctttttaagatcagtctttatttttgttggcggcctccctccttcaacagtcccaacaactggaagagaggaaaatacatagttgttagcataaataagtgaaacttttaaaagtatagtcaaatagaggaccatttaagcctcagaagcaaaaaagagagagagagagagagagagactaagtaacgaggaataacctgtcacactcattcttttgtgaaaaccgaaaaatacaataggctcaagaggtgtcaatgcaagatgaacttccgtgtctattgaaacatgatcggtttttttctctggtgagtgcagcacaagcgtctgctcagtggcaaaatcacaggatctgattgtagcatcctgaacaagatatataaaggaacaaaatacatgagttattaacataaattgaaagctaaacatatccagactacagcatcacatgaactaagaatatgatataaaataatgttctcattggaataaaatatcattgaacactatactggaagctcataatgaaaaatccacaagaccatgcttactgatgaagctgaaccattataaactttctacacctaacatcggaagcactaaggccaatatttcagtgctaggtgataaaaagtgttttgtattttcatatagtgaaatattcaaacctacctcaagaatagcaatgacaatgtgactagcagtagggctatatgccatacgaacaacacgagctccaaggtcaatcgaagctatcttgcttccagtcaatgcatcaaattctgcaaacaaatgagaagatgtggataataaagaagacaacaatgcatcatatgcaagaaaataacaactaactacagtagcctttattgtgttaatactactctgtaccacaatcaccttttacaagaataagtaatttggtcaaataatgaaagcagcaagtaggtgatttttccagcaaaaagtacataaagggatgaaatgaatcaatgagttcatactgacatttcaataattatgtcatgaagtggagcatggtgcaatgtattggaaatttaggaacaaataatctactggtactatttttcagaacaatcataagctagacaattgctattactccacagataccatgactacatagcacagcaactaaactctgaaaggactcttgcacagcatttcaagccaacagtgtttcaataccaacatttccactcatcaaactattattacttacagcaactatgtaagtgatctgcagactaacgactccattattaccggctcattatactcttgaagaaaggtggacggtggacatgctaaatcaacacgaattcacacagatatctatagaaatgctcaattgctcatcaaggtcaaatcggcactactgttagccactgagatcatcccagctgcacagtaacagcgacactagtgcagaattctaactccacttccattcctaccaccccacccacccagggcgaatcaaactccagcgccctcctcctcctcagagcggcaccagactcaactcccccacggagctccaccctccccccaccctgcctacaaactcctcgacccccgaaccagtcgagacgggcggagccacacacacgtaccgacgacgtgcgtgccgatggcgacggcgacgatggcctgcgacgcgcggaaggcggcagcgtgcggctgcagcgggcgggcggaggccccccggcggccccccgcgtggcggagatccaggtgctgcaccgtcgcccactccatcgccggcggcggcggatctgggcgctccggcgtcagatctggtggggcgggtgatcgccggtcggtggatttgtgctggggaggcagtggcccggcaggctggactagcttcgaagaggagacgatctgaagcatccaacaagggggaggttgcagatccggcccgttaaggctcactttgccaggtgggcctagaatcctcgatacaacagttggtttgtctgacaggtgggacacgtactcaattagattgtgcctatctcaaaaaaaaaaatagattgtgccaaattgtcaatgacaggtgggccaagattacatttggactaatacacaagcacgattgatttttatttcccctagtaacatcattagctggttggggcatcttagcattaagcattaaaaaaaagctatgtggtgagagaaactacgtaaaagttaagttcatatagaggattgtcaggggtgggcattcggttaagaccgaaacttcggtccgggtagttcggtcttttagaaaattggttattgagaaaggaaaaccgaagtgcttagtaaaaaatcgtggaccgatagatcaggtaaccgaacttttagtccggtcttcggtatccaccgatttgaccgaacacggaaggatcggagaggcaggcggcgcatcgaggcgtagactggtgacgagggaagcgtcagggctagtggcgagagcgacggcatcggaactatcgctgcaggatctcgttcccacctccggcgacctcatcgacccgactgtcgattccgttctctccgcatcgtgccctcctagcctcccctgcgtggctgacagagctcaccgccccgccaccgacggcgccccctccacagacaatagaatgagaggatgggagggagagaaagaaacgaagagtgctcgccggcaggatctagtccacatcttcactgatctcacgatagtgcaacagtcggggatcagaagatgggcgatacggtgataggtggcgctgtggcggtcgtcataacgagtggcagctaggttagggttgtacctgtagcactagatggggatgagtgatagtagactattgtggtagacttgttgggcttaacctctcgttgagtggatgtgctgagagtattggcccaagaccaagatcggtctgattgggtaactgaggaataagactgaagcctgacaaaaggattggtcttttgaaacacatgaccgatcaagagaccgatgatcgatagatcggtttcttcggtctcgatttcggtttttccagtctcggtcttcgatctcagttttttatgcccacccctaaggatcgatgagagatgatacgcatgactaagtgatactgatcaaaacaacgaactcaagagcaaagagcttgatagcgacacagtgagagaggcaagctcattaatgggggtggaagcttcaaactcgagagcgaagacctgttcgaaggtagcttggcgtcttctatagtccatatgactcaaaggatttcgatcaagccatctactaatccatatggccagatttggttgttgaacctatgccaacaacaacttgttgttggtgcatggactacacaccaagattttgtcgtggctccgatcgggggctggccaagaccaagctcttagatgaccagcgctagcaagtaaataacaaacggatgggagtgagatgaggatgaccacgggaagaagacaatagtgtaggcatcggtgcagggaaaaatgaatcaaaaaattgataaaagtaaatttagtggagttcgtggctatagctagctactgtacatataccatgcaggatttgtcttaccctatgagtttgccgaaaaccaacgaaaattgatgaaaactaataacttttgtatggatatcagctaaaaccgctcggttttcacaaaccaattcctagcgccacaagcggttttcatgaaaaccgattgaaaatgtaaacccacgtgccatctattggttacctcccaccgacgtatgttttttttacagccggtgccattaaacttgctctaagcaaagataatacgtctagtgggttttcttgtttcgactcaggcctctttgttaggattagcttaggcccttagtttaaaggtgacttatcggctttgtggtttagttagtactagtgtatgtgcaacatatgtatagataatacgaattaaatcaaacatatttcatgcaactaatacctatgtttgacatattataataggacaacatttttatcatgttacaaactatattaataatggtaatataaaatactaatctgaagccctagattttcttttatgaaattaaattccaagtaaacataatacgttactaaaataccaacctagttcttatttttctccatcgatggaacccatagatatctatcagcatcatcttttcccttataattatgctaattagccaaaatttgaattttctaccttaaatatggagttgattttagggtttttgtcatcgtagtttattttttggtctttacttttagatcattaactatcagcatcatcttttcccttatgcttatgctaattagccaaaatttgaattttctaccttaaatatggagttgattttagggtttttgtcatcgtagtttatttttcagtctttgcttttagatcattaagaacatgtatataaaaattttattcataaattatttttcatttgcaaatacgttgtttcattttttttcctcaaatatcctaaatgataggcctgtatgtatcctatatggttgggcccaaaagcttgacatgcattgagccacaccatctagaaaatagtagcatttggatcattctcatggtttgatctaaaccattcatttaccatatgcatttatagcccacttaatgtagttattggcatttaatgtgtatcgaaccatgacacctagaaaactaatagtcattggattgctcttatgcttgatacataacaatcaaagtgtcatgtagaattgcaatttcacatcaactactacaaaacaaatattgtccatttagatattacgtgtgtgtttggttgcaaaccacactttgccacacataaggttaggaaaaaatgataggtgtttggttgtagccacaattgtggcaagattctcttctaacaatttgggtcccacttgtcaatgactcaagaaagtgtggcaagattcttttaggcttagtaagttgtggctaagaatttgatcacctcaccttacacaaggtgtggcaacttttattggcaagtaatgacaaaatgtggccaccaaacagcccttacgtgtgcacgatttacatattgttttctttgagttttctttgaaatatttttaaattttccgctgcaacatgcaggttatccactagtatctctaaattagtccaacaaagaatttgtgaggcgcacaaaattattgtgtttactagtatataccttaaccgtgcccgcttgagtttgttaagtgcaaaaggcttcaaaactaataccttagcctacatcatatttttctattcattgcaacaaactcatcactttttaagatctaaagccatcactcgaggtacctgcatatatttaggcaacaagatttttatcaatatttgtaagaaaatcgtcaagtgtttagaaactcagagaagagcatataaacttatatacttttttcaagatagtttttgctcttggacaagacaaacttgtagccatcatgctcatgtcactagatttggctcctgcagccatgtgtatggcattcataatactaagaaaggaatattgttacaaaggctaccttaggatgtgttctttagcctagttttccaacttcacctactcgttttgcttcccaaattgctaaacaatgagtttttgcaaaaaaaaaatagaaaagttgtttttagggaaaaaatcatattattctatttttaaagttttttgctaatacttaattaatcacgtgctaaaacgtcctttgttttgcgtgcaatgttggaagtgttcccaactccacctagggaacacagttataattttagcatagccaaaagcttgatactacctttgaggacttatgtaaatcaatagaatatattaaatacgctggttacaaagttggtgctggaaataaagcttaaaacataaattaaatagagacacaacaatactaactaatccctccgttttaaatataagcacttctagcatttgaaagctactcatgtaacaccgatttaatcaaataaacatgcatcattgatagtcgcatggacatgctcatcaatatctttgtaaacctttattattatgatatttccaaatattctgaatcgttggaatatggatcatctcatagagtcaagaatcgccacacacacaagtgaataaagcttagggtttagcaccgattgaaatttgttcatgatagttgctaccttggagtagcgaaggaagatacatttcaatgtcttatgttttagagaaagaagctattgcaggacaaatccgaaacaagtttgtagtggtaggggcagctcctgggtaggtcggggcgattgcccaagcttcgccacagccgcctccattactgattgtggttaataagtataaagtttggtcgaccgccatgaaacactattaattgtccgggttcaacgatgatgctggctctatcattgcaagtttttttttatcatcaacttattttacttgtagtatatgaattgaaaaaattattttggtttagtgcttaaattaacagtattaaccttttcatgaagcaaaaatgtcaggagaacaaagttcaaataattatcaaagcatagatatggcccctttgaatcgaaagaatgtaaaaatgtagaaataggaaaacgtaggattcatctcattcatacaagtgtaaaacggatgatcacaaaataaaaaaagaacgtataaataaccatttgattggatcccagaaaacgtgaatcggacaagagatataggctcaaaggaccttttgctaactatcttctaaaatccctatagaattaacaattctatagaattattttcatacgattgaagtccttcgaatttctttcccttttcctagaaaatcaaaggccgtttaactttgtgcgacgaacctggcataccggcctggcccgacgaaacccacaaagaagaaccgacatccccatccgggcccaaaccccgtctccgtccacacgcacggcacggcgatcctcacggcctaaccgtcgctccatcctcgcccacctctcctccttccccaaaccctagaatctcgccgcgcgggcgcagctccgcccttcgctcgccgtcatttcccggcttccccgcgcaggggctagctagctagctagctagggttccggcgcacgacgacgatggccgcggacgatctctcatccccggcgcggaagcgcggccgcgacgaggaggaggaggaggaggaggaggtcatcgacggggaggccgcccagaagcgcgcgcgcggggaggatccggagggcggggcgctgctggggctcgccaactacgaggaggacgaggaggacgaggaggcggcggctgctgcggggaggcgccgcgcgaatggccgacacgaggaagaggaggaggaggacgacgacgacgacgaggttgacaacgacgtgaggagggctccggagcggaggccgaggcaagtggagctgcgccgggactgcccttacctcgacaccgtgaaccgccaggtatggcttttagcagcagcagcgtttcaggtgccaattttttagacattctgtgtgattcgattgatgtgaataacctcgatgaaatatagtttttcattatgttcacgatctccaatttacttgggatccaccatttacgcctagtattttgattatcaattgctggtattgtgatagaagttcctttttttgtgtgtatgtttgatttaatagagctgaacaacatatacagatgctaaagggaaacttaatgttcatggtgttattatatcttcatagtgaattccaattgattttatttttgttgtagtgtgcaacatgtgagcctgttcatttgaagtaatatattatttttttgtcatatgtctgtcttggtactttatcttttttttttttttgttcgagagcactgttctactgctactctactgtgtacattactataataactgaacggaacatatttatcaaataattatgtttagttcttccttgctctggtggctattgggtttatgggtgtattgggttgaacgctggtccattccactatggactgtttcttaactgagacacggtcccttaggacatatcagaaagcctcttatgtttgctgcaattttaaaaagaactgtaggcttttcccttcaagttcttatccgttcaacttgtgtatccctttatttcctcgttctcactggccggtacataaaagctttaattaaactaaacagtatcttgtgagctgtggttggcttttttctaaaatagatccttaaaatagctttaaactaaacaattgtaagctcttgtaggatctttaaatctatccttctgttttagatggccagtgtgatgtgattgtttgtacaattaaaatctatggaatcacttccacgctatattctatatatgttttacactcttctggcagaatgtgtgctggactgtatcattgatgggctatttcacatgttcattgattgttgtatatattttgtctacattgtaggtccttgattttgattttgagaagttctgctcaatctccttatcaaacttgaacgtgtatgcatgtttggtttgtggaaagtattaccaaggaagaggcttgaaatcacatgcatatactcacagccttgaagcaggccaccatgtgttcattaaccttcaaactgagaaagcttactgtcttcctgatggatatgagataaatgatccatcattggaagatattcgacatgttctcaacccaaggtgcttttctatcgtcgcccatgttaactctagtaatgagctcagagctatgcagttttttgattggtgtgctttggcaggtttacaacagagcaggttcgtaatcttgataggaacaagcagtggtctagagctcttgatggctccaattatctacctggaatggtatgtatacgtgaaactaatacaatggttcttaaatgtataaatgattcttttcctagggacataacctgtttgctgttccctgttaattaagggaattctttgcagttgtagcaaaaaaaaaaatgtatccctccctaaaacaagggttttgtttagttggtctatctggagaaattacaaaaatgaaaaagcatcttctggaaaaaaatcacaatgacagtgaaagcctaaaaaattgtggacttgaatagaagcagccaacttggtcatgagctttttttagccaggttatttcattctatattaagttattattataatggtgttatatgaccatcaccatgtcacaacttaaaaacattgcagatttcctattgcacctcaatatttgcaattctctctgctttgaccattattatcctatggcagtagtcacttctctatgcttaaatttgcaggttggtctaaacaacatcaaggagacagattttgtgaatgtcacaatacagtcattaatgagaattactcctttaagaaatttctttctcatccctgaaaattatcggcatagcaaatccccattggttcatcgatttggagaactaactcgcaaaatctggcatgcaaggaacttcaagggccaggttggttttttagtgagatagctgcatgccagcatatttgtgctgttcctctacctccacaaatactcaaaagttaacatgttgctttttgtgcaggttagtccacatgagtttctgcaagcagttatgaaggccagtgataagaggttccagattggtgttcagtctgatccagtggaatttatgtcatggctcttgaacacaatgcactcgaaactaaaaagtaggaagagaaacagaagcatcatacatgattgctttcaggtatagtttttgtctataccaacaatttgattaataaaattgcgtgcaacttcttacagcattgtttttgttagggagaacttgaagtagttaaggaatttcacaagaagcatattgtggaaaagaaagaggacggcgatgaacagaatggtgatgcaggttcagatattgttactgaaacatctagggtcccatttttgatgcttggccttgacctaccacctccacctcttttcaaggacgccatggagaaaaatatcattccacaggtttgttatatcccaaatatatatattagtatcttctggttaaaatttcgcagcacacgttttgcatgtataagtgatactagtatgatgatgttcggtgaggttcttttgatgataatgtgaaaaccaactaaatgattattacagtttgctcagaactttgatagcagtaaaggcttaactctgcagcatgagtcgtaagaattatttggacaatcttctcaagatttctgttactgtaacatttatttgaaaccacctttttgttatataaaatttcctgcttagaactgcaaacctgacctcattttcttttcccttttttggcttatgttcttatagacgtagatagttgcacaacttagccgtcttataagttcattttctttatccgttttgtatatttgcatgtgtctgcatgttaacactttgaccattccatttacttggtggagtggaaccatattgggtgaggcgatatatttgaaatcttgacattcaacttttatgttttttgaactctaaact

SEQ ID NO: 82452 - DNA, 685 bp, Oryza sativa
gcaggaacctcttctgcctcacggcatgcttcaacgtgtcctcgagcagggccttgtccccggcgcagccatggtagcttcccccaaacgcggcgatcacgccgtgcaggaggtgaacctcgttgacctcctgattcacgctcagccataccttcttgtcgaagtggctctccaacacggcgtcgttgaagaccatcctggcaagcgtggtcttgcctatcccccagcgccggtgatagcgacggcgatgacatcgcctgacgatcttgcgcgcgtgcgaccatccgccagcttgttgccaatcagcagatcaacgaggttccttgtgtgaagatctatcttgtcgccgacaacatcggatcgaatgatggatggtcccgtcttgcggttgcggctgctttctgacgagcaagaacacatgggtctatcggttagacgaagggccgaggaggagtggattacttgggagacaaatccaagcgggagctcctcttcgcgatctcctccaccctccggttgagctcctggatcttcctcccgatcttgcgcgtagcggcagggctgcggcggcagagggcgctccagcacgccgacggcgccggagcagctctcggcgctgagccggggtcttctccgccctccatggcgcggaagaggtcaaggatgtcgtcggcgtcgtacatgg

SEQ ID NO: 82453 - DNA, 7905 bp, Oryza sativa
cccccgcggcgtgctcgccgtggagtcggtgttcgggctcacattccccgccccaccgccatcctggccggggaacgcgaacggctcgcggcaaggcccctccccgtcgatcctcacgaccacctccccttcctcgccgccgtcacgatcggccgccagtccggaccgctcatcgaacacccccgatcccacccgcggcgaggacttgcctgagccatgcgacctcaggctactcttccgccgcacctgctccatcgccgccggccaagaaacgcccactccaaagatagctagtactagtagccactctcctcctcctcctccctctccccccactcctctcggccggcgtctctgctatacttagccagagtttaactaggggattaatactgcctctcgtttcagttaacgatgcgatggaacgttccggaacaacgtggaggcgcgcagctagctgccaacgcttgtcctcctttccgccacccccgcatcggggcgcgcacggaagccgcgtcttccgtgtaccggcacagccactcgcgccggcggcaacgagcggcgcggggtttggtggccactccacgtacgtggcatggcatggcaggtgttcggtacatgatcaggaacaggatcaattagaatatgtgattagtggtaaccaaacgattgtggtccgtgtaattctgtatgtgttcgaatcttctgtgggcgagactagcggcggggattcgggagtgcgtgtcgcaattagcattttgtaaagaaataaaaatgattgtaagtggaattagcattcggtaactaagatttagaaactgtgattaacgaggaagattatataatcagggcactaaaaaggctgtgtggtgagaacgtgaactgctgtggctagtggccatttttgtattgggtaacggcgacgggaaaagtttagcatcttggtgatggatctcagggttgtggtgatttgtgggtggcagtggcactgtggtgctgactgatctcaaggtcttggtaattgtggaactcacggtcgtgattgtgggattgctgtgatggatctcacggtcttggtgaatgtggatcacacggtcgtggcggttgtgtttgtgccggccatgtttcagagaaaagtttcgctccatagacgcaaaaaaacgatccatatacacgagcaacatgtgatctctgctttcagttccgtctcttgcctaaacactccattggcatgtccgtttcttggttactgtcatataatctcgtgatttagatagatggtcatcatttcgtcataaagacatgcactggcatgggagcacggccaagatttggaatggactgtgcaaacagctatctttgttctgtttggcaggcatgtaggaaacgaacaaaaaaacgtttagtcggtccaaatcagggtgcagcgattagcaccatatctgatcaggccaccagctaagtaacatgttagggtgggcctcaaaagcaaacagaagcaagacagcaagtacagaacatatggcatgcgaatgggattctatatatctggaggcgacgcgacgtggagcaacacaacaaatgaaactcgtgtgtcctatgttagcttcggttccgtttgcatcccgttcgtgggaaaccaggtatgatggattcgttgtacaatattggacagatcaccaattcaccatcgctttcgtcaaccgagcatcatgtgtgtgtgctccctttctactccctagtagcttgacttgagacctaaaaaaagcacagttcctacctcgcatatgttcctagatatgctcaccacatcaataccggtaaagaagaacgatacgtgtacgtgcgaaatctcgcgacagacagataagtgcggtcatacgcaagagagacgacctgcaggcaacgaaaagctgctgcaattttttttttcgtctgtatatttactgttcagtaaacgcgcacggcctgagctggctcgtagcaggtcaatccaacgaccgcgacgaggccctgagatttcagttcacaccacggtgccagctactttacgcctcggccggctatgcagcctccctccggcaactgcaaggatgtacagtacgtgcgctgctagattgcgccttcgtctcgtttcataccggccggtgacgcggcagcgcgagcggccatggcgctctgcatgcgcaaggggaggacggtacagttgtatgggccaaaccagagtaccagacacgcgccggctgtcgcgtggcgtgtttccgcggaaatcgtagtagtaggtgtgcgtgttcggctgttcggttttggcggcttgccgtcgacagtgatgtgcccatgcactgcgcgacgcgcctggtgttttcagatgtattttctgtcctccgtttttttggcctctcgtggcgtcgtctatcacgtaaactaggctcgcgcgttacgtcgtgagttgttacttgttagcttcgcgtttgtagagttcaacgagaggacaacacgaacttgcaagcagttaaggcagaccaaaaagaaggataggcatgcgggcagtcgggcacgcacaccagtcgggagtatttatcaagtatcatgcaaatgaaaaggaggtatatgcttcgtcagagccaggtgagcccggtcaggtagaaaggagattagcactttaactactgtgataggattggacgaatgtaaaagaataattaaagggataccctctccgttgtaggttacaacacgctttgactttgattaaaatcaaactactttaaattcgactaaatttataaataagtagtttcattaaatcgataattaaatatatttttataataaatttatcttaggttgaaaatattttttttacaagtttagtcaagcttgaatcagtttgactttaactaaagttaaaacatcttataacctgaaatagaggtagtaattatttacatgatgaaaaatttaaaagtaatccatagttacagtttagagtgttgtttcggtccttctttttgtaccacgtggtactagtaccatgagatactaaaatcctgaccgttgttggtcattggtgtggttagcgcgagagagccacggtggaagggtataatcgtaaatggagggatttttggatcggtgcaaggtttggctgagttggggaagcgcggcagagtagcagaaccctaggtggcggcggtggtatcccgttcgcggcggcggcggcggcggcggcgcatccttggttctctgggaagagctgcagaaggcaaaccatcggtttgccattctccccttcgcggcggcgcctcatccattcctctcgacaccgcctttttccccttgtccaaatcgtcgcgggacttcgatgtatgcgtgcgtgttcggccatggatgagtgaagcttacaatttcaggaaagtacaagaagatgtttgagatggatatgaagtacaagcacacaatttgttctagacgtttgataaatttgtcatgctcttgtccgttcctgtagtattggaggcattttataatggagtcattggactgtaatcaatcttgatgtgttttcctgtaatattacgttttcaagctgtgttttggtattggttacttctggaattgaagagatgagtttaatgacatggttgcagctagttttatatttctgtatgttttatggtacatgcaatgcttggtgatttctggaattgaagatatgatggatgtattgcaatttggagttgtactgacatggctgaagctaactattttatctgtatgtgaacatggtatatgtgaatctgaaaatgatgtacttcactcatgcatgagactgacagccacattcataattttgatgtcatttcagatgtgagaaatccgaaaagcattgttaaaattgatatgttaaattgcaggtagcaaagtacagctcagacataatatagtcaacagtgatacatatactctgaaatcttgtacataagaattacaataacaactagggaacccatgaaccaacttctagcgtggtctgcctcttttttgagctttgaaatttttttcttatatgttgcttcggtagccaaaatcctggcagccatctcaaattcaagtttcattttgtcttcctcaactttcgctctatcaatatagttagaccattcatattgccgcctggttggatttgtcatgctagtacgatccaatgcaagccaaagcttctcgaatgccttctgcactcttggatgccatcttggtctacccagattaaagtatcgcattggtcaacctcctgtaacattggttatttcatagtattattatgcaaattttcttgcagcgaaacaatggtgaacatactcaaatccggtcaaacaaaaaacgaacagcagaataaaatcaaacaaaagcttactggccactgcggcggatggcgcagaggatggcgccggccttgcagctgctgcgccggccacggcggcggcgaaccttgaagcgtatggcaccggcccttgcagctgcaccgccggccactgcggcggcggaccttgcagcggcggcggcgacgactcctgcggccgcggcgctgccaggatgtcaccacccgtacggcgacggttacagaagcgctcgccctcctcctcagatgaacacccgtgcggcggcgctagcgtgagatgcgatgggcgacggtatcgtgagatgcgatggggatgacctaaacgaagccgcacgtagctagaaacgttgggaccccacaccggagcgaacctcgcgcatactcccatccccatcgtacccctcagcaatcaacggccggatgaagactggtacctcatggtactggtaccgtgcggtacaaaacgatggacgagagaaaatctatacagtttaagggcatgttcactttgatgtcattttcaaccataccattatttgtcaaagttgcaaaaaaaatatatacgtttagtttgttgccaaatttgaccaatacataagaaatcctgccaaaattttggcaatattgccgtcttgctataattttggtattgccaaaacttgtaaggttcattttggctacaatctgaatatgccataaatcagaaagctaaaattgtcaaatattaagaaagatattgccgctagcctgctacactccttcctatccatacattatcgtacttataccaatttgttccttaagagaatagagaattgaagtaggaacaacttgagattggatgccaaaaaagcttacgctggaggatctatttgactagaggcggaaaaccctaatgcaccggcgcatgcaaccaaccacattggattttttacaatttggtccttttcaaaaactaattttacaaataaactcctagaaaaacttatcccataaatgatcctttttgggacgtcagagttgctggtgccatggttcaataggacagcgcgacgccaaaagggtcctcgccaaggcggtgcaagatgggcagcgtgaacgcagtgtcttctcgctccccgtctccgcgatccccaacacgtccctcccctcaagcacccgcgggatgcactgccgctgcacgaccatggggctatgcatcccctagtaaatcgcacacatccactagccattgcgatagcccaagttcgacgaaggtggacagcaccatagcggattccgcggcggcggtggtggccacgacagtagggcctagttggagtcacaatgttcgggctccatgacgcggagctagggtttaggggttctagctggggctcagcttcttgcttgggtttcttcttgctggacttgggcttggagaagaggaggaaggggcgggctacgccgtcgacctccatggattgcaggcttcgtggtgatggaggcggaagagggtttctggaagggaggaagcaaagcacgcagggtaagacggggacgcacgcacgcgaatttgggaaaagcactaagaaatggtagcctccctgcccacctagaagaggcagctagcggcggtgaaggcggagttgccgccggatgcgctgggtgcgctccacgtcgaagtcctcgacaacatcatcgaccgccttcacatctacgaggtggttcgcacctcggtgctctcatgtgcatggtggggctgctgggagtcgctgcccttcgtcgacctaacctggagccccgacgtcgcggcatccgacgtcgacgtgatcctcctccgacgctctgccaccgatggccgttacgcgccattcctttcccgccagccgcagcgttcatcggcgggttcgactcactcgggcaagccgagggcctcacgcaccggtcgaatgtcgtagactcaccatcaccgatgaagagaggggagaggaggaaagagggagcccccgtgggccccaccatttttatttttttttgggtgtaactaactatcatggttaaaaataaagtattcctcaaatcctacgacttatcgaatatgcggatacggcatacctttgtatatatgatgtatttccgtatacaataaggaaattcacaagctgttatggaaattatcctcacaagaagaggaatgttagagtcctactcaaagaggattgggttgatactatatagtgtagggtctgttgtcttcgagttctactttgagactaagatgactcagggtataaaaggcacaccacttagaggggttcagatcattgaatcatagtgccaaacacaatcgccatagcctacaatccggaggacgtgaagcctacttgccgggagatctcatcgaaaccatctcgacaagggatctcgccggtaatatcaggatcgtcggttctttattgtaatatgtggtatttccatatctatctcatataaactagattaaggcttctaccttacgaaggcccgaattagtataatccttgttttcttgtttgcttgatgtcatatcgtataaatccttgtaccaacgtaccccaatactctattcatctggtctacgagtatccccatcgacactaacatgtagggtcacgattatattatttgccaaaccaaactgccacgtaagcgccatgtcaatgccacgtcagatgaagaccgagtcaaattagccacatagacatcacgtcagctgaaaccgccgtccaaaccatcattggaacttattttgcactagttttgatagttgagggacccgttacgtattgttttccgattgaaggatcaaaatcggattcttgataagttaagggccctcagatgaacttattcgcccgcaataatcttaacaggctataccgtgtgatgagatgggccgtggaaggtctattgtggcttaagctcaaaatagtgtaattggttcgaccattcctgacatctccattgcggccgaggtgctgagcaggccttcaatgcagtgggtctctccgctcatacgggaccagctcaaagcttcagtctcgcggtctcgccagtagtagctagccagccacgagccagagtgagccagccgcccccacattactccgcggtcgcccaacggccgccaccctcgcggcgcacacagctccaaactttggaaacgaaaacccctcgcgttccacttaaaaacctcgccacaatccgttgcgcttactatcaacgaagaggctcccagacctgttgcgctttgcgcctcgccacaatccaccactgtgccctctatcgctcacgcggtcacgcccatcgcgccgcgcggctcccgagatggcacggcacgcgaagacggactccgacgtgacgagcctggcgccgtcctcgccgccgcggtcgccgcgccggtcggcctactacgtgctcagccccgccgcctcccacccggacgtcgtggtggcctcgggcggcgcaggcggcggcggcgg

SEQ ID NO: 82454 - DNA, 1534 bp, Oryza sativa
cctgcagccctcccctgtgtttagcttactcggtcagtgagttcgtcaacctaccacaaagctgaatttcttttttaattaacgatagtagaaaagaatataaaagtataacctgaatatttttattttgaaaaaaaatggattggaaaaccatgtgtttatatctagaccgaatatacgcagccacgaaaaacagtgattaaaaaagagaacaaaacaccaccacacgccgagttttttttttccatagttgcgtccagactgttaagaggtcgtggtcggcagcagattgctgtcaagatcttaattaagataagcaagatcggtgtcaaggatcttacgataatagacgactcgctcttgttgagtcctcaggggagaaaaaaactgtcactcttgttcttaattattgttcctctttgatgttgcatggccgaatagattgagctggacagatcatttcagaatacagtcaactcgtaccgttattgcttggaatgtaagaatggtggtaaaacatatgaatagcaaataagcagagttttaatataaatacatttgcataacaaaggatccgtataataaaagaagtacaagaattggatcagagagacgggggttgttttaaccttactccaaaatattaatgcattgagcagtccaaaggaatttcatgagatttttagatctccaatcctttcctcaaataaatggaaagattgaattttacaaaactccttgacaagttctttgttattaaacagaggctctccattttgcacattcatgttcaagcaaaaaaaaaagacattttgcacattgacatgatctttcaaacataatattgaccatcactttgcatcataatatatacagtgataaaattccagtgtattttgcttatccatcttgaacgtttaaaatggatttttatttataccttaagtctaaatgcatatctaaagcatcaaaatatggggttaagtatacatttgtggataaatttgtactaaccacagtacaatatttgtgacgagatagagcctagtgagagtgtgactctgagatgggccggcctacatgcaatctgtgcagataggcccagtagatttcatacggcccatgtttcaaatccagccttttcttcaacctcaccaaaaaactagttatacatttgttgtcaaagatgtaattatagcacaattgtgttgtaactatattataatttagtatcatgtaacttgtaagtaactttcaaaaatcaataggcgacatgttatttccatgaaatggaggtaatggaaccgaattcccttacagcgtgtgcaatgtgattttttcttatctaccttgcatgaattttaaagcaaaatcgaacggtttaaaagtatgtgaaagttacgtacaaattacattatagttacatgtgtgattacacatatttacatttgttaaatttttatgagaaaatttgccgataaatatccagaaaaaaaagagaaaaaaaactgacttggcaagtgaagggctgcag

SEQ ID NO: 82455 - DNA, 1472 bp, Oryza sativa
atagatccaactcagtaaaggagcaatattgttatagattaaaccagagtaaaattgggtattacaaagtactgtaattacagatccaactcagtaaaggttttcaaactttggttctggttattctgaagttcagaattttggagcacgcctgaggtccaaaactccaaattactttggaggacaaaatttgaaatgcatctaaactatttcagtatttggttgagatcaatatgttgtcctggatgaaagtcatgacccttgtaaagcatagagaaattatttaatcaaaatcatttcaaacaaatatttgcagttgagacatcaggacaagatggtatcctgtttcagaaaaaaaaatagagagcatagttgaccatactttatgcatgcatatcccaactcccggaaacgctggaacagatgagaagttggagggcattgaggataatctctggaacgcaggaactcatctttcaagatcgaaagagcagtagagaaccggagggctttgattgcgtaattgcaccgcatgatctaaacaatatggaagaaagtattagatcaagcaaaagagaacaaaaggatgattatgagcacagattaagcttacttgggtaaactgagggcctgcttgggatagtgatacagcaagatctccacaaacagggggtcctttagctaatatgtccagtgaccttggagtgacacgtaaactatcaaacctgtataaacgcaaaccaatacaagcatcagaatatgatgatccatctattaacccttctgcagtaggtaggaagaaacaacatgctttgaagaaaaagaataataaaatggtgacaagaagccagagcatgatgatcattttgtcacaaggtgcaaagctcaaggaactgcatagccagttctccatgaagatcaagtgattcctctaaatgatctatcaaaggaatttttccacaaagagatgtgcatccaaattgaataaaacggtgtattgaagcttaaactatagccaagagtttgaatgaagcatgcagtgtatttatttatgagagaaatctcgtcatgcttcctatcaaacttcaatctgtgattcataacttcttggcttcctgcaggtcataagcatattgaattaagttgtacgacttcaatgacaaagctgagaatgaaaaatgattttgctcggagtgaagctgatgagggtgaggacaatatattctaatacacgatgcaaaacctgatcatttgctggaagatctaatgcagcagcagcactaacaaatgcagatgaaactgagaatatgaagacttgtactaatcgagtaatgcactgaaatactgaatatcatattttgctgtctagatactgtgtaaagagccttgataattgcgactaggttgttcaatgtatcaattacaagatcttctttgtaaaagacaaaatcactaactcgggctgcaggaat

SEQ ID NO: 82456 - DNA, 613 bp, Oryza sativa
ctttcataaatatgtaaagctatatgtatacatataattatatttaataatgaatcaaatgataagaaaagaattaataattactttttttaataagatgaacagtcaaacatatttaaaaaaattaaatatttagaaacggatggagtattaatcaagtcagggccatcgaggaatgagatcacgcgcgccggaggtgatcggtgaacaggaggtagcttgccggcggcgggcgtctcgccgtcgccggagcttgctctgatcagtgccacccacctaatcccggacttgtgaattccggcccatccacagggcatggcctgggaagcctcaagccgctccgtgacggcccaccaggctctcgttgatagtcttcggtgcttcaccggcacggccagagcacgatcggacccgggctgaaatcagtcgggttggcacgacccgacctacacggtgggccgggccatgcccacctacttgctgcaccatcagcccaagcacgatccaataagactcgggtcgtgccggaccgacccgaagacacgaaaacccaccgtgctcctccttaaataaagtatatcttgcctccctaatctcgttgggtcatctctta

SEQ ID NO: 82457 - DNA, 2183 bp, Oryza sativa
tgtcgagctacggatacccaactccaagaaaccttggttctgaagttgtgcaaaaagggtcataataaaataatagtcatttgcatgttgtacacttttatcaaattcaagtgtttggctagaacttacgattagaggtgggtattcggtttttccggtttaatcgcctcggtttgatggctccctaaaagatcggtttctgtagaatgacaaccgaagagcgtacgaataaaacaaaaaccgagaaaaaaaaagaccaaacaaaattggtttggatttttcggggttcagtttttaccgactaaatgtatgcctcgatctcccatcctcccatcatgcaaagctagccatgggcccaaaggtcgtgggctccaccacccacgcccacaagataaagcaaaattacgtgaaacaatgaggcagattcactcagagcctcagaaaccaatcctgtgcatgtggacttcaatttacttcggtttctttggtgagattggttgacagtaggcggaggccaaagaaactaccaaccactaaactgtattaaaacgaaaaccgcgccaccagctgaacactgaaaaaaaccaacacttcagtttggttcggttcagttcggtggtcggttttcgagaaatttctgcccacccctacttgtgctaaaatatgcctaatggatcaaactcatgggatcaattcccagttccatcgcaatgaaaataaacttgactatctctaatcatgagattcaatgaaatttacacttctttttatacactttcacgagacaaaacattttcaccaacaactggccattggcttccatgggaaagagtaattgtggttaattgaaagccataaaaatagaattatttttattagtaactatcccacatagtaactgaacaaaattttaggtatgacaaaactcgggtgattatttggggtgattattctccttgcgtagaactttcccttactttgtcatacatttatatagggagtacaatttgaatttttgaaacttgacccaagttatggcccaaacaaaatgatatttactatgcatgtgaaattgtattggcaaatttcttgaggctgatcaaagcagccccaacatcccacatgaggaacccttagagcataattcctcaaaactacatggtgaagctgccatttcacaacccacataaagaaacctaattgtgcaattacagcaaactctagggtcctctatgcaaaaaaaatattcattcccctcctataagaacccctacaagattaaagtcttcatatggctgcttttttgtggcagactaaacacgagagatatattggatagaaggaattgtgctcctttgatctcacttgcgttctttgttcgttgcagcaaagagaaactccgtttcatctgtttttctagtgtccatttagtagaaagtgttggcataagcttggaatatcatggaacacctctttggaattctttcagatgttggtgctggcaagattgaggttcaggaggaagggctttttggaaatttgctttattgcgtgctgtcacatttgggaacaacgaaataggaagatttttcagaatatggatccttcttttgatagattcttctacatatgtgtagaatgaatgatccacttaggcaatcggtctctgattggttacaaactttatagttctttagggaggctgtagccttttgtaatttttcttttttgctgtaaatactttttctccttttttataaaatacactactgggcaaatgcctggtagttttcctttcaaaaaaaaagaacccctacaacccatagcccaaacattgtattgcctggctgtgagaatttccaacgttgtctagagtatttttcaaatttcaaataaatatttgtagcctaccactataagcttaatccctcacttgaactttttttcattatctcgagcataaggtggtcactaatcttctcttcctctactatagcaagtacgatgatgaatgtatgtgggccgaggggctaggaatgggaaagagcgcaaccatgggcgtgggggtagaggggctcgctcagatgtggtggttgaagcgaacacctccgtactagcaacaaggagatgtaagggcttctaaacacatttcatcttattatccaatgcgctgcaatttcatg

SEQ ID NO: 82458 - DNA, 2411 bp, Oryza sativa
agaaccgaatcgaatgcaacaagttttgcatttgttctgtttggttccatgtgcatctctttcctatgaggccaaggagcgtgatatatgtgtttgaacttattgtacactgctgttgattgtcattttattccctacaaacggttagtggacagtaaatacccgagagactataaataattgaaaagattttatcatagcctcaagattagttgttcacatccacgctaaagagaaattgtattcaaaacttaagaagcgtcgagcccaaaagtttgccatttatttttttttgagagacacttcttttgttcttgaaaacatttttttttaattttttttgttcaccaaatttttgtttaagcaaaatctcatacagggctgatgtaaaattgcatgaacataatcaaaagatggtgtgctcctcctttgcatgttagcaatttactgatttgtttcccgggccctgacttacctccaatgagaattgaacttgaggactcacctgtcagtttgaaaactttcctgtaggggttagtccacagaagatatatatccaatgtcgatgaacatattaactctgatggttcattaatcaatctcaactccatgtctaatttgattaaagcaaacaattttaacctaagcaccatgcttaatttaaaaagtctatggaaatacccaaaccagagtatatgaaaatagacaaggtaaacataatcatgtatgatcaagccatattcacatggtgatattattgagtaaatgcttggtgaaccttgttttatctttcgcatacctgagtgtacttaccgccaacatgatggatatattggaatctttggggcagttgcatggtcacatttgattgtagatttctcctccatctcgttgcggattatagcggaggaaggcacctcgaccatgccaactcaggcgagcggtttagtcatgcacacacgtcgggtgcaagaaccttttgccttgaaggtatgatccgttggcacaatattgtagagatgtaggaagcatctcttttttattggcaaatgtgcaactgcgaactggagcaaacgccgcctagaaaaagaagagggcatctcctcttgcttgtataagtgtagatgctgcgggagcgagaagttgtgcaccactaggagtggatgaaagctaaaccaaggcgacacataagctcaagagagagactgggtgtagctagatacagcctgtaacaccctagaaatctccacaagtctgggatgccactaaagaaccctataaaagtgccaaaacaaagaaatttcagcagcatctcttttttaaaaacaatatagcggaagcatcaatatatagattaaggttatgatacaacaactgactgacttatagggatagcctcgaaaaaaaaagttaatcaatggtcgataactctattatttaattaacccattatgtctaaacacaagtaatcttatcaacatattacaataatcatgactaagtgagatcatattgtgcaacagtgtagctaatcccatcccttcatgcaaacatgtcacaacaagtacctgaaaagactataaggggtgagaataaatctcagcaagcaaacggctttaacaacctatttaaaccacaggtttattatatagctgattaaataccaagttatgattcacataaagacaagttcaatatccaaggactaaaacatcatgacatcaccaatcaaatccatatattcacaactccgagagaagaaaacacttctcaaagacatcttcgatcgatagttttcataacatcctgcaatatgtgcatatgcaatgcaatggtatgtactcctgccttcgcacccaacaaggtgtgaagctgcatcgtattacgacaatatacgatgatgtaccggtacggtcgcaaccataggttcacagcataacttcaaatgcaatgcaagtgtgatgcaaatgcagtatgaattccagagtataacatcgaaaccacattccttagatggagaccagtataaggttattataaccaagagcataaagtataaccataaacagtgcaataacgataagcaatgattcagataggtaaaaccttgctacgacctgtaatactatcttgattattggttattgatatataattttaaagtgaaggtaggaaaataacaggttaaagctgtagcaaaccaccgctacatttacttgcctttaccgatgacgagatgaactctagttgcattccgaagtggtatcacctgaataaacaccgactcagcctcaaacaacacacatataatcattcaagaatcacacattcactttctatgctgggaacccaccccaaacaacataaagcaaatcaccgataatcttcctataaaagcagcatagattaac

SEQ ID NO: 82459 - DNA, 22162 bp, Oryza sativa
agacacacatgtatcttgattcattaacatatatatatatatatatatatatatatatagacaatgttagaaagtgttatgatatgaaacggagggagtaatatttgcactctggccgtccgacgtggcacactgtccacacggtgaatctgtgacgagtgacgacacgcttccatatgagactattagaatacagacggtgtttctcctgtgatgatgtgaacggtgttgttgaactgtttggacgaggtacctaaaagtaggaggaaaacggtgcgctatcaagccaatatatagtgcttccagggtcctgtttggttccataggctaaacattagcccccaccttttagccatgaattagccctcaaggatccaaacaagtgggctaatttttggctaaagtgaattagcctcctcaaaacattagcctctccaaggggtgctaatggggctaattttgtaaggggaccataaaaaggcagccctctctctccttctctcacctctctttctactctctctctccaccttttagtcttgaattagcccatggatccaaacttaccactctaggctaatgtttagcctaccaattcatgactaaacaatagctctcaaaattagccatgagctaatctttcaaacagggcccagatgtatggctagaattaatgcgacacggggacagggagctaattaaacaacagttcttaggccctctttgtttaggcttataagccaacttataagtcaaaaagtctaagcctaaacaaacaagcagcttttccgtttagcttttttgaagccataagccactctaacactattaagccaaaagctaggttggagaagcttttttggcttatgtgaggtagatgtatgactcaaccactaaacttaggacattaaatccaccggcttataaatcatataagccaataagctgacttaaaagtttaagccaataagtctaagcctaaacaaagagggcctttaagtgtgcaattaaagttcatgtgtttcggtgtgctcgatcgattaatctggcccacaaacacaaaggaaattaagatgagaaagctaaactggactgcgcattcgtatagttctttttttaggagggttaagaaattaagagcacattcatatagtaaaacacagttgcttggacctgggctgagctgaaatccaatgtgcgatttcattagtactacctataccaattacggtcctcccgttcctcacacctacctggctacccctacttacaatactctctccgtctgtcttattttaaatgcaactatgaattataaattttagtgctcaactttagtcgcttatcttatttaattttttttaattagtactaccttttgttgttatgagatggtaaaacataaataatactttatacgtgacttatatttttattttttaaaaaaaatttaaataagatggacgatcaaaattgggcacggaaatccatggctgcacttcatatgagacggagggagtagaatacattagcattgagccccaggtcaacagataaacatctacttcctccgtttcacaatgtaagtcattctagcattacccacattcatattgatgttaatgaatctagacacatcttgatgttaatgaatctagatagatatatatgtctagattcattaacattaatatgaatgtgagaaatgctagaatgacttacattatgaaactgagggagtactatttttgtctcaaaatataagaatggaacatatcctgtagtacgaatctggttagagtatgtttaaatttacagtgataggatgttgtgttaaaaatagtgataggatatatcctatatatatatatatatatatatatatatatatatatatatataattctagtttcttagtacattttaaaactgatgcagtaggtattatatagtagactcataaaaccgtgcaactcctcgagcccatcttacgcatcattagcatcaagagcggctgctatatatatacttattgcatgcatgattagttacctctgctaattaatctccacactagctgtgatgcactgctggtagatgcttcctgatgcaccggttgatcatcgatgtagcgcactagccgagcaagcaggacgttccacgacgtccacgcatccgtgatttgtcccggcccgacgcaaagtacacgccccaggtgcgcccacttggctaaccatgagtttattacttgctcgcgcgcgcgcgcactaccaccaccgccgtgcgtggcggggccggcgggcatgcgtcgccgtcgtcgtcgatcggccttttgcccggagaagatgggagagggggcagagcgcgacgcggtgcgcgatcatatcggtggtggtggatgggagtcggtgtgtgacggtgcgtgcatggcgcgcgggcgtggtgcgtgtgtcggcgtctcgcgcggtgccggtgcgcacacatgtggcatctcggcgagccgaagcgaatagctagcatgcgcagcgcaggaggcgccgcgcgagcgagtgtagcccgtactgccgtcgcttcgcggcgttgcgggttgcccccgcgtgcgtcatgatcacgtacagcctgctaacgactactgactagggtgtacttagttcacgtcaaaattaaaatttacattgaaattggaatgatgtgatgaaaaatttagaagtttatatgtgtaaaaaagttttgatgtgataaaaaagttaaaagtttaaagaaaaagtttgaaactaaacatggcctgcagagtgctcgcgagtgtcaatgtgtcatgtacaagtcaacgggggcgaggccgagtatacgggtcaaactaggcccatgtagaaagtttaaaccgtgagcggaagcaaaggaatagtttacttcgaatccctcaaattatagtttaaacctgattcatttctctaaccatcatactggatttcttgatgcttaactattaaggccatgtttctttcagctcagaattattataatccagattattgggagtaagctgaaagaaacagacaacttattaaagtagcttattataatctggagcccagcttattataatctgataagctcatttaggtgagctttttccagattattggatgaaaaattatccaccatgccaccccactccctctttagacttgcaaacctaataatctaggctctaataatctagaaaagaaacaactaaccacttattctactacagattataacaatctagcttatactaatctgactcaataatctagattataataatcccaagctgaaagaaacagggcctaaaacatgtataattggactcccgcatcagcagttttcactgacgtgacgtgttgacttggtccgcatgtgttgacgtggtagcccaatcacaaaatagaagttcggcccacatgtaagtgatgggaaaaataagaaaaaatgtagggcctacttgcagtgcccttctcctctctctatcctttttctccaaccactccacacctggcacagcttaggtccgacccgtggtggccatcgtcggacaacacagcgacaacaaggctggtgaacgccgtggtggccacctccatgccgccggatgtgttacactacttctgaagtctatcctatcctccacgtcaatcacatgcaaccacgtgcgatcatgatctgcagttagagatagagttcctattatctagttaatcttgttttgcatgcgatgtaatctcttccaggttgttaggtagctccctggtgatcgctcccaggttgttgggcaacttcctggcgcacatgtatagccacaatcggggctgttccgatctaattaacacgaacgctccgcacagcgtgagtgcgagagtttccatccaatagagaaaactcacatggtatcagagcgttgatccaatctaccgaaaaatcaatcccttccacctttccctgccatggcgtcttcctctagtaataccggcaattccttcctaggccaccccgtgagtgagaaacttgggaagaacaactacgcgttatggagagtttagatcagcgctgcagttcgtggtgctcgcctccaagggcacctgacaggcgcgacgaagaaacctcaagcgcagatcgtcgtcacaagcagcgacggcaagacaacagagaagaaaaacaatccggagtttgatgattgggaggcctcggatcaacaggtccttggctacctcctgtcgtctctctcacgagatgttctcatgcaagtcgcgacgtgtgaaactgcggcagaagcatggacaatcatcgagcaaatgttctcgacgcaaacgagggcgcgttgcatcaacacaagattcgcgctctccaacaccaagaaaggcaatctctcgctcccggagttcttcgggaagatgagagctctaggagatgagatggccaccgcatccggcaagcggttgacgatgaggaactaatccagtacatcatcactgggttgggcgaagactaaagcgaagtgatctccgccgtgtgcgcacggctagaacccatgacggtgggtgacctctacaatcaagtcctcaattttgaggcccgcaggtctctctatcgggggactcaagaaaacaccgtcaacgtcgccaacaaaggaggtggccgcggcagctttcctggccgcggcggaggagctccacgcggcggtcgtgcctttcctagccgcggcacaagcaatggagcgcgcggtcgaggacgcgcgcaaagtggggcggatcgcagaccgatctgtcaagtttgcttcaagaggggacacaccgccgtagattgctggtacaggtatgacaaggattatattcctgacagtaagaatattgctgcagtagcaacaagctcctatggcgttgataccaactggtatatcaacactagagccactgatcacatcacaggagaactggagaaactcactgtgaatgacaagtataatgggggagaacagatccacaccgccagcgaagcaggtatggatctaagtcatattggcaatactattgttcatacccctagtaatcgtgatatccatcttaaaaatgttctatatgttccacaagccaaaaggaatcttatatctgtacaccgtttagttgatgataattctgcttttcttgaacttcaccgtgattatttctttcttaaggatctggcaaccaagagaactcttcttaaaggaacatcacaccgcaggctttatccccttcccaggtcatccttgaagcaagcctgcagtgccactaagttgtccttgactcgatagcatagtcgtcttgggcatccctcctcctcagtcgttagacaagtggtcaataagaataatctcccatgtttagattctattaatgagtcagtttgtaatgcttgccaacaagctaagagtcatcagttaccttttcctgtttcatcaagtgtctctcattatcctttggaacttattttttctgatgtttagggcccagctccagagtctgtaggacgaaagaagtactatgtcagttttattgatgattttagcaagtttacttagatttatctcttgcaaaataaatcccaagtttttgagaaatttaaagagttccaagttatggtagagcgcttgtttgatagaaaaattttagccatgcaaactgactggggaggggagtaccaagctttaaataatttcttctccaaaattggcattgttcatcatgtgtcttgccctcacactcaccaacaaaatgggtctgctgagcgcaaatatagacatattgtagaagttggtctctccttattatctcatgccacaatgccattaaaattttgggatgaagcctttcaagcagcaacctatttgattaatagggttcctagcagagttatacaaaatatcagtcctttggaaaaattattccaacaaaaacctgattattcctctttgcgtatttttgggtgtgcttgttggcccaatttacgtccctataataagcacaagttggaattcatgtctaaacggtgtgttttccttggttttagcaatatgcacaaaggattcaaatgcctataaatttctttaggtcggatctatatttctcgggatgttgtttttgatgaaacggtattccctttctctgagcttcatgcaaatgcaggcgctcggcttcggtctgaaatactcttgtttccgtctttgtttactagtggggatgacaatgtattacaccatttgactaatcctataaatcctgctgctaatgagtttgctgatgcaaatattgagattgatacagcacattccgtggccacagaagatcccgcagggattgattttgatgcagattcggcagaacaggagcctgacaccttcctgtcgccagggtctgttcacacgcattcgcctggacctcaccattcaggcgctgacacgcggcagcatcaggagacacatgctggcgacagaattattcttccaggaacagctcgtcaggaggcacagggggagcagcggtcatctccctccgccgatctgtcctctgctgatccatcatcatcgctgtcaggtactgatgaatattactccctccgtccataataggtgacgtttttgactttttatttgcaacgtttgatcattcgttttatttgaacaattagtataaatataaaaaaagataagtcatatgtaaagtacttttgataatagagcaaatgacaaacaaaataaataataattccaaaattttttaaataagacgaatgatcaaacattgacaaataaaaacttaaaaagacaagtgatatgggacggaggtagtataacactaacagtgatcatcccgagcaggagataacacaggaacaggagcttgcaccgcaagtccgacccagaacaagattacaaagcggcatttggaaggagaagatatatactgatggtacagttaaagtactcttgttttaccaattctggagaacctagtaatctagtaatgatatagaggctcttaaagataaaaattggaaaaatgctatggaatctgaatatgatgccttaatcagaaataatacctggcacttagtcccacctcagagagggaagaatgtcataggatgtaagtgggtctataaaattaaaaggaaagctgatggttctttaggtatgtaatagattatgaggatactttcagtctagtggtcaaggctgctacaattagaatcattttatctatagctgtgtctagaggttggagccttagacagttagatgtgcaaaatgcttttcttcatggtcatctagaagaagaagtttatatggaccaaccaccaggatttgaggatgtcactaagccacactatatatgcaaactagataagtccttatatggtttgaaacaagctccaagagcttggtttgccagattaagcaacaaactgattgatcttgggtttagtgcctcaaaagctgacacatcattattctttctgcataaaggagatattgctatttttatcttggtatatgtagatgatataattgtagtaagttcctcagagagggcaacaacagcattgttacaggatctgaaggtagaatttgctctaaaagatcttggtgagttacactattttcttggcattgaggtaaacaagacacacaatggcattgttcttactcaggataagtatgctactgatttactaaagaaggtagggatgttgaattgtaaacctgctaccactcctttatctgttagtgagaagttgtctttacatgagggatctctcttaggacctaatgatgcaacacagtatataagtatagttggtgcattacagtatttaactctcactaggccagatatagctttctctgttaataaggtgtgttagttccttcatgctcctacaacagtgcattggacagcagtaaaaagaatattgagatatataaaacagtgtactagtatggggcttaatatagacaggtctgggtccacacttgtgagtggattctcagatgcagattgggctggcagtgtagatgacagaaagtccactggaggttttgctgtgttcataggctcaaatctagtgtcatggaatgctagaaaacaagccactgtctcaaggtcaagtacagagtcagagtacaaagccatagcaaatgcaacagcagaaataatgtgggtacaaaccttattagcagagttggggatcaagagtcctcgagcagcaaagatttgatgtgataatcttggagccaaatacttgtcagcaaattcagtttttcatgctagaacaaagcatatagaggttgattatcactttgtcagagaacgggtgagtcagaaattactagaaattgattttgtttcttcaggtgatcaagttgcagatgggtttactaaaccgttgtcagttcgactactggagaattttaaaagcaatcttaaccttaaacggttatgattgagagagggtgttacactacttctgaagtctatcctatcctccacgtcaatcacatgcaaccacgtgcgatcatgatctgcaggggaaactattctaatccctcgaggggatgttccctcgtttgtttaaaaaccatccaaacggttatgaaaaattctggaaaaatttgacaacattcatacaacacatatatacaactctataaaatcttaagttcaaattcaactcacacgtcgagatataaaaaagacaaattcagcatatgaatagtagcgtactgtttatatctaaatttgtcgtttttgtttctagatgtgtagatcgagtttgaacatgaattttggtggactagtaggtatcattatactctacattattaatttttttcagatttttttacaactatttgtattgaatttggaagaaaaatgtatacgagaggatatcccctcgagggatcagaatccactccctgatctgcagttagagatagagttcctattatctagttaatcttgttttgcatgcgatgtaatctcttccaggttgttaggcagctccctggtgatcgctcccaggttgttgggcaacttcctggcgcacatgtaaagccacgatcggggctgttccgatctaattaacgcgaacgctccgcacagcgtgagtgcgagagtttccatccaatagagaaaactcacaggatggaaccgtggcagagagcacgtccaaggagctgtccgccataagcctgacgcgtgcgtccgtcgaggttgtcgcaacattagtggggagaggagcggatggagcggacaagttaaacatggagacaagaggcattgagggagaagctagcgagttctctagcttgagcggggcaacgatttggagacaacggagctctctagcttgagcggcgtttgtatgcgtcgcgtgaagggggacggcggtcggtggcttcgacaggccaggagcttggcggtgccgcggtggcgcgcgtggatgtagcatctttagcggttctccagtggaacagaagagatgactctaacaacgagatgaacacagcaagcaaaaactccacctccatgcttcagagcctcgatctgccccactgtcgggaagccagctgctccaatcttgttggccacacctgcaccgcttccacccctattgaattcgagctatgcgggaagggaggcagtggcatcggcagtcaacgagcccagtcgaggtcgagctcgccctcccttctatgacggcgcctcgctcagcaagaagagcatgcggcgggcacgccgcggtcatcccctcaaccaccaccgccattacgactgtcgccgagacaactgcaaagatcgatggcacaacgaactggtcaaaaagctcatcttcttcagcctcatggcgctggcctcaccattcgacctggaatacttgctacatgcgttcgcctcccgtctcctccattgccctcctaccgaatgccgatgcatgagtctccctgtcgttccccgccattgctcttctgctgccgcgcatcactcttgtttttgtcgctcaatccaaagaaataaataggaatacgaaccctcgtccccaaagcccgggtcctagactactacgaatagaaagatttctacggatattcttcgtatcaattttataatgcttatcacctccttctgagctattcccacggtgccttcgggtcaaagcttaatccttaatagccaaccgatgcctggcaccaccgctaagcacaagggcaagaaaaagattggctttaaaagatccaaatacttccttgtgggtttataaaaaaccatatcatatcgaagaacttgatggtctttctccacccgttcgattacttcttaaaaggattagatatagaaaaaaagtagtctactcaggagaatgagataatgctcataatatcgctagtaaccaaccacaaaagtaaaccaccgtgcaaaggaaatatgggaaagagtgaagtaaggaaggaaaggagtcactgacatgtggactttatatgttaacttacgtggttggactaggtcaatgaaaaacaccttcaaaaccactgagggagtcattttgcattggttttaaaagtttggggatcaagatatccacggttacggttgagggatataaatagaattggatctatattttgagggattagaagtggactaattctgaaagcaaactagtgtactccgataacaaagttcacacctattttggggaaatctgtgcatctagaaacctattttggtccacacttgagacgccggaaaagctaaatcgcgcacgtttccgggagcagcctaactaattgaattagttttagactcctaactaactgaattagttttagataatgacgataattaagataagatttttcttttttggaagattttttttactaacagattaaaaacttttatgttagatttaaaaactttcgacttaagatttaaactttgaagttgaattttaaaaactttcaactgaaactttgaaaattttcaaatcaaaatttaaatttatacgaaaaattttgaaaactttaaaattagatttgaaaattttcaactcgagatttgaaagtttcttcaaaatgaaaaacttgtaagttaacatttggaaactttcggctcaaatatttttgaaaacacgtgtgctaacgattaaaagtataaggaaaaaaaaggaaatacgcgtgaggggaggaagcgaaaaagatggcaaaaaaatgcgtggggagagtgagctcgagcgccaattagcaacccctagacgctgtgagtaacggcctaaggccattcacagtgcaagcacctcatttgcgttacctcgtatgccacgtaggatagatacacaacgaatccatacctctcacagtgcagggtacgatccccaaaccaaccaccccaacctattctctctcccgctttcccctttctctccttttccctttccctctcctactttcactcccaccgacccgacagagccggagcgcgcggcggtacaggtcgtcgtcgcccacgggggcgcgtgccgtccccgcgaatctctcggtggcgaccagaaggcggagcgaggaggacggcggcggcgcggatctggagcggcggcggcgcgaggggacaacggcggctggcggattctggagtggagcggcgcgcgcgtcctcgtgctcatgctcgtggtcgtcgtccttggagtggtcatcggagtggtcatggcgggcggcggcggcgcgtcgtcctcggagcggtcatggcgggcggcggtcctcgtgctcgtcgtcgccgtcctcggagcggtcatggcgggcggcggcggcacatcctcgccccgctctcctcaccgcctgccccaacgccaagcggcggcggcatcctcgggacctggcggcgcggatctggagcgtcctcgccgtcctcctcaacgacggcggcggtggtggcgcgtcctcgcccgccctcaccggtgacagtggcgcggattggagctggagccggagtcgtcggagtggaaggagttcctgctcgggaatcaaggtcggccttctgcacggcgcgcgttctcgtcctcgcatctctgatcggtgggccccgcgctcgactttttgagcgaggctctcattccttcgctaggaaccgaagaagctagtgaagctatgggccccaccaacttttttcaccacgtaggacgaagtaacgctccagctagatggaggaacgcccactgtgaagggcctaagcaggggagcattcagcccaaagggtggaggggaccagatctttagtgggccaactacgaggccattttagcgcagtagtgtcagacccaaagcccccagatacatctcgaatagccgtaaattgaggccagtattggaattttccgcttcccgtggttgctgaatgcggcatgccgccattgcacagcagcagaggcaggcagcccaagtgccagtatacactctactctgctgagggccacgaacgtagaactgaatttgtatcgggtgggtagtgccattattcttctggtttatatcacaaccgtcgtgaaatgtaagcaagtatttctagctcttcctgtcgcagtgtacaactatacgagcgatttcaatatggagtattctactcagcattagcataatggatgatttggtgcgacacagctgagtagattgtcggggatgcggaatctagatgcatgcagacatgcagtcctccgaaatggaaaaaagttgacacgagaacttccgtgcagaaatcagcctcgtctttgccattaaaatgcgaataggtatgagcttttcttctttcgatggtcatcaacttaccgcgaactttccacttttcctgcgctgcctctgtttttagtgggtttttcattctcagcttgctctgttgtccaattgggtttgctgaaattccgtatcacgtccatttttttatgttcagaatgaactttaaccgaaagcacacggagcgcgtccatggaggacgaagaaaagcaccaattagctggcatcaccaacaccaagtccggagagacggcaatgccatattgctaatcatatattcctacatctcttactataaaccagcggctaaaaacgcagttagcgagcggagcgtaaaggtgggtgtgcctcgcttccgtgcagcgagcgccgtccgccgccgaggcgtcggctgcgcggttgcgtggcgccgtcgcgcctcgcgttctggaagacgtgagctgtggcatgctggcaatcgcccgctatccgtggtaaccccatttcattggtaatctgggcttacggttaccacatgaaagtgagggcccctttgaaacgcaggattgagaaaacacagggatagaaaaaacgtaggaatagaatgtcatgcttattggattcctataggattttgaaaacacaggaaagtctctaaactatcatttgattagcgcacaggaaaaacgcaggaattttagacacatgaagaggaaaacatgaggtgagacctcatgcttattttcctccaaaattgatctagcaagatccattccataggaatttttaaggaattggtaagaaataatcctttgtatcaaaggactctatacaataaaatcctataggataaaatcctctaaaattcttatgatttttcctttgtttaaagggggcctgagtattttcccgcgggggacgcacacgacttgcgacttgacccggagaccagggcaccctgaatccgttgagaaggtcagctttgacatgtggcacatgggctcccaaggtgcgatcgtttcagcttttcaggattagattctcctcgttttccgttagcattgttaaacggtatatttcgtgtgaaaatttttttataacgaagttattaaaaaaatccaacaaatttattcataaaaatattatacattaatacttaattaattatatattaatcgtatttctttctcgttttaagtgataaacacagtgataaaccgttggatctagagatttttagacgcgtgtctgtgctgttcgtggaagggcacgagaagaggcgacctgtacggaccaaagaaacgtgcaattgcgcgtactgcggccattgacatggtaactgatggggaatggtcaggtacacaggtgtgccaactgaacgatcaagtggcgcacggaacaaaccactgtactgtgtcttcgaaagggacacttccgacgcattatttatggatcgatcgctagcgtagccttaactgagttggctcgttttttcaactttgaaaggtaaccaggattgcatatctcatgaagcattcaaaaatgacaatgacattgaaattgaagtagagtttcctaaatagtttagaaaagtagaaatgagtgtgtagcggggacgtgcaatcagttgttcttttcttgactttaatcgatcgccagtgtgcataataacagtcgttcatactgaacaagacgtacttatctgctagtcctggcctcctggcatcgactcgaacaaggagcaaagttaataacaacctccaatttcggggcatacgtgatccgaatcaaaaacctacaggatgctgatgcataactcatcttctgtttgaagtgtctccgtacaaccaagatcatatcaccgatgaaattattcacacgactctaattaagattcgacttatgtattttagttttttttccggtgatgaaaagttgtcatttgaatgtgtaccagtaccaaatcagtcctctaaacattagcatatactccctccttcccaaaatataacaatttatccaccaatattctcttcccaaccaatcacaatcctccaccattcactttttccacctatcttcactactcattcaatcacaatcttccaccactcacttctacctattttttttaataattgtgtataaccctaaaacttcttttatattcgggtaggaagggagtataagcaaatcatcgacgtacgtaacccagacaaacgatttatcccggtcactcaacagcccagtgtgtcatgagtcatgacacagccgtaccccgcgcccttagagtagcaaacacgccagcctcaaattgtactaagtgtaacagcatcaatgacgaagaccgtacgaaacagtagtcatccgttttccctgatgccaaccacaagcagtgctagcatgaatggcgttccaaccacccaaaaaaaaagggtaattacgaatttactactgatttaaattattattgtaagaatatcgctagaaaattacaaaatgcaattagaatggtcattcgattcgagtggcattttacaaatttgcaaatgccccgcaaaaaaagcagtaatagtaacaggaaacgaaccttgctagaccgttgactcccaattttctggcgcgcttttcagatttttcaaccacagccgctccaacgtcgttttccgcccaccagtccgttttactgttgccaatcgatcgattacccggtcaaactcaaaaccgagacgaaggaaatcagaatcacgcgccaccacacgacgtgccggcgcccggcggtttggcgtccggctgcgtcgactcgcgcaccacgcacgcccccaacaccgcacggaccacacggtcacccgaggtcccgagcggctgcctctgacccgcgaaatctccgctcggacaaaacccgcgggccgcgccgcgcgttgcatgcatgcgccccgtgctgcgcgagaccaacgggctggatggcatctcggcatctcctgcgcgcgggaggccgcgtggtgcgagcgagccgcggggacgtggtccatgggagattgtgaaccagttctgtgcgaggacggctgcacctgcagctgcacgggtcatacgactcacgagcgcgagcgggggccgcctggccccagtggccccgcacgcgtcttgcttactcggaacggctttaaatacacgtcgcgctcgacgtcgacgtcgacaccgaaatcggacggacgccttcgccacaaagcaaacccgatctaatcaaccgtgacatcccctcgcctcgggtccttcgttccctcgcattttcccttccattttcacactttcacacacccgcgccacacgagggggtacataagaccgagctcgaagtctcaggagagcgtggaagaggaggcagttgctcgtttttgtgtgtgagagaggggagaggccggcggcgatggggaggacgctggacgtgttgctggggcggacgacgaagcagacggcgaggctcaagtcgatgctggggctggcggtgacgcggctcggcgtgctgcgcgggcacaggcaggtgcggtgcgcgcaggcgcgcggcgacgtggagcagctgctccgcttcggccaccccgaccgcgccctgctccgcgccgagcaggtcatccgcgagcagaacacgctcgacgccttcctcatgctcgagtcctactgcaatctcatcaccgagcgcgccgccctcgtggactcgcacaggtgagggacatcaccggaacacgccaaaaaacaaaaaagaaaatcaaacgctagccatgtccgtgatgtcatcgcgtctgttggctatgctttgcgccgtgctgatcaccggtgttttttttgtctctttcgagcagggagtgtcccgaggagctgcgtgaggcggcagcgggtttgatctacgcggcggcgaggtgcggtgacgtgccggagctgcaggaggtgaagcgcctcatggcggccaagttcggcagggagttcgtctcctccgcggccgagctccgcagcggctgcgggatcaatgccaaggtgaggagcacgagactgatcagaattttctgtctgatcctactagccgagtgtaactgacgccctgaacgaacgaacgggttgttgcagatcgtgcagaagctgtcgaccaagcagccgagcctggagagcaggcagatggtgctccaggagatcgcggcggagaaagggatcgccggcgtcgtggtgcacgtcgtccacgagccttcttcccacgacgaggactcgggcctcagccacaggaggcggcggtgcgacggcgagaggcggcacagggtccatcaaccccaggtcgacctggaggaggacggctcttcgaggtacaggaacgtggaggccgcggcgcaggccgcgttcgagtcggcggccaccgcagcggccgccgcgaaggccgccatggagctctcgcgaggcgaatccgggggccgcgacgacgacaggagacggccgggaggcgcgcagttcgacagggccgacgaagagacgctcgccggcggcgaggtttcgggtgatggcaagaaatctggcaggatcagacgtgccagcctcggccggaactacagttcagagatcgaggattcagctgaggatgatgaagtggtccgccatgagatcactgcagagagcgaggtgaaaccgcggggtctgaccaggagcgtgccggtatcagtcagaacaaagagggtgagttagctgcaaccagatggcaacaagagtgatgggagatgatttcttgaattcgtgatattagcagctgctattatatttttgcagattcatcgttcgttagatcctaggcctgtaggccattgcatgcatgtaattaaatggagccaaacaaaaaaaaaggaaaaaaaaacttgattcagattttgttcatcggttagtaggagggagcaaaagtcagcattgtatattgatggcaggtttcatcattgattgtagatatattagaggatggattgattttatattacaacaactgggaccaaaatattcctctaatctcgttacctctggggaaataaactaatgcagcgatactactaacttatatgcattaactagaaatttcaacagcagatatgaccgggtctggactacgagtattcatgaactgtaggcctgtagctggtaaaacttctctcatgtaacctacatttgatttgagaaactcccatgctggatgatcagcgggatactttccttcttttactgagactcgtcagcatgtcactgtaagactgcaagttaacaccgacatcttcatcatactcgagaccaagctcttcctgcacagatacatattattcattaaaatgatgaccgtgctggatgctagcaattggtaacttttcaatctttttttgcagggcagaaatgagaaaatctgacaactaaaaattatctttcctgttgtattaagagaagcatctagtgtgtattaactactaagtgcaggtaaatgtaaaagaaagaagtgcatcaaaaccttaaattccttctggtctttagggctattctcagtgatattatcccatagctccttgaacatcctctttcgctttctccactggttaactttctcagagaagctctcttcaataatcttcttgtcctcaggtttcaccaagataacaccattcctcaatttatttagtttctcttccatttcctggacctgcaaaaatacaagacagccattcttaaaagttaatacaaggaagacattgaaaccataaaagataaaaaaaatcgcatatatacataacggaacacgtttatgcacatacttctctttgcaatttagcttcctttgacttgatctctgctaaagtcaagtttgactgcagacctcgtacctctgcaatagggtttgtattagacatttccatactatgataatggcactcagcattgaaataaaccaccaataagatcatagcatgaaatggaacctaccagattctacctcactaattgctttcttttgatccgcaagttcttcctgtagcttgatatttgctttcttcatctcctcaagttcttccccatttgggatgttgaattgatcttgacgagcaagatatattttctgcttgccatactccttgaaggaaatctgtccactgtcagccaatgcatccaatgccttttgcactgcggtcttcttgaggctaaacttttgcaacgcatcggctacattctgagaattcaatggcctattttgctgaagagtcaaggcaataatcaacttgacagtatacaaagtttataaagaaacaattggacttattttacaacaatactagaaagagtttgaaatcctctaatttgatcacattgtactcttactcaaatcttcttttttatttcataaagtccaagtgctgcaaacttattagtcatacaagtaaaacagggttaattgtgaacaaatcatggtaagagtggtatacaaaagatgccaaatatagtttctctgtcctatctctactcaaaaggaggaaaaaatctgctgtcctgctcaggaaatggatgatatgttaagcaaacatactggcgatacacagggttattgcttcctaaagcaagtgacaccctgtgaacctgtgacaggaacagtctacatgaggagtgaagactaaaaactcacctaaaaaagctcacatgccagagattcgatttataagcacctcagtgccttctttctatgcacaatcttatacacaacctcgcacaaaagtttccacacaaggatgctgccgagtagagaggatactattgaaaaacttgaacctttttgaaatcaacaaaaaaggaaataaacaaagttggccttatttggtaacaacaaaacattactcttcaatcttatcaaagaacatgcagattttagtcctagcaatgagcatgcgaaccatatcatggctgaacagtggactagttaagttactacgatgtttcacatctgaacacatagtagaaagcagattatcatgggtttcaacaaatccgtactctgaagtagtagatcatcaatttgcatctcacagagctaacatggatcagaagattcagaaccaacatacagtaactcagtagaaacaacccctcaaaacacaaaccaatacggagtatgcgttactctctctgtccctcccaaaacaaaaacgtctccgtcccttccaaaatttagcaacttcttcgcctacttactcatctcaactaatcctaaccatctctcgtttaatttatttatcttactttctcaactcgaccaatcacaaccatccctcatttaacttcacatctccttaatctccacacacacacacacacaaaaaaaaaaaaaacctctagagtgttctattttgggatggaaggtgtagcaatttattaattattattactatcatgcagcgcagggcaccagataaaacttgaaacaaacccatcaccgtcgcataacaatatgacatgttagccgagtccataaaatatctaatcaggcaagggcaagcgcagggcaggaccagagcagccaaattagccggtggtcatgtggggttttggaggaggggggccgttacctcattgacgaagctgaggacgattcctgcaaaggagagaagaggatgaacaggggcgtcagggatcgtcagatgcaatcgatggaattgagcaggcgaaatcgatgcgagttttgttgcaaaatcgggggagctagaactcgagcccgtttcggttagaatggggagatggattgtacgagcggggcacgtaccttcgacgctatcagatttgggaggcatcgccgcctcgctgcgccgccgccgccgccgccgccggcgaagggcgaaaaggtttgggggagaaatgaaaaggagagggtctttgcgactcctttgctattgttgatgagagtcactgcacggtggggcctaccgaaatcggtgaccttggggttttcccgccaaaggacaacgctggtgcgcttgggcgcggcgcggggttccagaagcagctacatttggtgaaagcccatcaaagcccacgcaccatggagcggtccatggtcgacggcccaatgctaacaattttcttaccgttgtgtttcatttagtattttttttaaaacttagtatcaaccgttaacagcttgtttggcaacttaagagaagatgatttttttatacgtaaagtgagtatctttgtattaggattgaggatatgaccagcaaagcgcatatacctatgtattaggattgaagattgaccaatatctcagttatgcacaaacggaatttaaagagagaaagcagatgagagggaggaagagaagggtcaaggggtgctgaaggcaatatctcccaaagtctatgctacttttcatcaatgtcttgttttctcttcccaacaaatcacaattctctatcattcaatttttccacctatctgcacttttcaaccaatcacaaactctctccatttaattttacctactttcttaataatcgtatccactcctaaaacttattatattttaggacggaggtagtagcatttgctcgtctttgtaacatacatgtgtatcaatagtttatggaaaaagtacaaattacccccgaactattatgggcgatcgaattaccccccccccccccaaactcgaatacggatattttacacacttaattatgcaaaccggacaaataacccccccctggctcaatccgggatggtttcagtcctacgtggtagtccagtcagcaatttttttaaaaaaaatagtgtgggcctcacctgtaaggctctcgtctctctttcccctctaacctctcaatctctctctactctctcttcctaaatccccatcccctctctctcccctccctccctgctgcagcgagcaacggtgattgcttggttttttcctcgccatggcggtttcttggccatggctgtttgatttcttggttggcccgcgcgtgcgcaccaacttcccccatgacgatgtcaacgaggccgcgcagccgccgtcgcctcctttcgttcctctccacggcgctcgtcgccaagctccaccgttccaacctcgccttcgtccaagccgcgcagcgcgataacagcaatgactcctccttcttcttccttgcttcaccgggctgccgctcaccagccatggctgcacaccgtcgttcaccaggcgccgccgttcgctgcatcaggggagggaagagagaggggatggggatttaggaagagagagtagagagagattgagaggtt

SEQ ID NO: 82460 - DNA, 29800 bp, Oryza sativa
cttccagattcattgtctaggtgatgtcaaatcaccacctatgttaccctttttaggagagggagtaaaaattaacaacgccatctattaaaaaacagatgtagtattcgagtggaggcaatgtgttatatgcattaccccttaattaataactactccataagattattggtgattatagctccgatatatgagtttttttcttttattcgctgatggatgagtcaccaacccaagaagatcacagagttgacaacacgaacctcctctcgtagtaatcctctctcgcctcgtgcccatcccctcgggtggcccccaccggaaatcccacggcgtgacagcccgcccaatggcattccgcccctccggattccgcgccccccgccagccaatcaccttccagataaccgtcctcccgggccccacctcctccccccgtcccgccacgtggcgcaaaagcgtgttcacgggccccacctccctgtcagccgacccgcactgtcgctgacgtgtgggcccgggggtcaggacccgagtccgcgattttataaaggaaacggctcgggcgctcgcccttacactactgttcccatttttttttgttaaccgcgaaaagtgttgtgttgtttgggtaggcagggtgttcgacggaatggcgagcgccgccgcggcgacgggcgcggcgctgggggcgcgcacggcgcgggcgtgcgacgggtgcatgcggcggcgggcgcggtggcactgccccgcggacgacgcgttcctgtgccaggcgtgcgacgcgtccgtgcactcggcgaacccgctggcgcggcggcaccaccgcgtgcgcctcccgtcggcgtcctcctcgccggcatcctcccctcgctcggcggccgctccacgtgccggatcagacgaccccgacgcgccggcgtggctgcatgggctcaagcggcggccgcgcacgccccggaccaagcccgggggaggcggcaagcacgacgcctccgccgcgacggtggccgcggcggcggcgtcggcggtcccggacctcgaggcggaggagtccgggatcgtgggcgacaccgaccacgacgtcggggaagaggacgacgaggacctgctgtaccgcgtccccgtgttcgaccccatgctcgccgagctctacaaccccgtggcggccgacgacgaggagcagcagatcgagcagaagcctgctgcacgcgtcgtgccgttctcggagccgtcgccggagttcgcctccggctcggtggaggcggacggcctctccggcttcgacgtgccggacatggagctcgccagcttcgcggcggacatggagagcctcctcatgggagtcgacgaggggttcgacgatctgggcttcttggacgacgagaagcctcacgtgaaactggacctggacatggacatggacttcgcctccatctcgccggcgccggcgccggagcgggaggagaggaagaggaagcggccggagatgatactcaagctcgactacgagggcgtcatcgactcgtgggcccgcgacggagcctcgccgtggttccacggcgagcgccctcgcttcgatcccagcgagtcatggccggacttcccggtaagctctcacgcagagatctgtagctttctgccggaattggattttcatctctcgatggacatctccatcttagctcctttattccgtattacctactccctccggctaaaaaatataagcatttttaaaatagtgttaagtcaacatttttaaaatttaactatttatagtaaaaaaataataataaaaaaagattaatcctgtaaatttgatgttactggatgtattattgaacaaactgtcataatatgtaactctttttatttataatatcttagctttgtagatattgttggtcgaagtagtatctcgacgaccgtgtcgaagtataaaaatacttatattttaaaatggatggagtaaatagttattatttttttaagaaaaatgataacatagattaatatgaaatgtatcacctccgcaagcatacaaggcttaacttttacaattgcaacgaaaggaaccaatcaaactgaaaatagttcgtacatctgcaattatattttttcatgtttgttaaaatttatagaagctgaatttaaaactgtatgtttataaagtgaaatatttaaattaatctattttatttatattttttataactatttattagatgatgaaagcactttcctctttctgccattttcttcacgacctagcttgtgtactgttctgagctatcctatgcgtgcgtgcaggcgggaagccggggagggctcggcgcggcggtgacggcggtgaccggcggcgagagggaggcgcgggtgtcgcggtacagggagaagcggcggacgcggctgttcgccaagaagatccggtacgaggtgcgcaagctcaacgccgagaagcggccgcggatgaagggccggttcgtcaagcgcgccgccgcgctgccgccgctcccgctgcccaggcaccagcatccgccgccgccgccgccgcgcgctctgccgccggtgccgatgatgctcgcgccgcgcggcgcgcacgggcgctaccgtttttgagagctaccgctctcgatcggcttccgatgcgcatgcgcgcgtcgtctagctacatgcatgcatgcatgctagcgatagccgtttgcgtgatccaacaataagtacaaaaatactactatatatatatacaaacatacaaactcgtcgaatcatcgatcgtagcatgttggtttcaggtttaattgtttgggggtagtgttagttttgagcagaattaatctttgtgaattagggcgccctaccactctactatacgtaccaaatgtaccatgcatgtgtgcactgaagcagccggcaggttgtgtacttgtgcacaatttcatgtgcaaattaagtaggtaagttatgtgtgtggtagctaggctaggatgtgtactttcttggttttctgtaagaaagatcctgctaattataaaggttgttgtagattttgatcccggatcaatgtatgtaaaggcctatatgtatatactggtatatatatacagtgtttaagatcaaagtagagaaattacaatgggagcttgtatagttataagcatgtaagtatgtaactagaggatgttgaagcggaaatggctagtgttcttctatttgtatgcatgccttccaatgctttgttagtttgttgggtgatctcaagagcactaactgttgtaatcacgtgttaaatatttttggataaaaaaactatagacatgtttatagtgtatactttctatctatatttgaatacttgatcttgtctgttacctcctccatccctaaatgtttgacaccgttgacttttttaaatatgtttgactgttcgtcttattaaaaaaataagtaattattattatttttttctatcatttgattcattgttaaatatacttttatgtatacatatagttttacatatttcacaaaagtttttgaataagacgaatggttaaatatgttttaaaaagtcaacagcgtcaaacatttagggaaggagggagtatattatttgctatccttatgttctgtatggtagattcgtagttggttagtcgtaacaatatttacatatctgggatcagggaagacactgagcatgacgttttcactttgccattcaccaagtggagtagttatatagtatgatttaggaattacgactcgcaacacattttatatttgcatcgttacagatatcaccacagtgatgatgtggtgtacgaacgtacattcttctccattacctggcaaatctatcgtgaggctgtatttaaaacaaacaatatacaggactccgcccatgctaacattgcataataccgtctcatagtgaaaaagatgttcacatattcgcgaaaagaagataacaatacatccacatgccaatacaaagacccattcgttctgtaagacgcgatccaatagaattactagctcggctgtcttacaaaaggaacaaaaaaatgaataggcactgtttaacttacactgatacaccctctgttagtcgcttgaaatcaccgttcttaccatacaatgaaccgctcaacaacataattctacataaaagaattagtggctacatacaattgatgtacacgaccccccatttacaaaaggagaaatagactatttctcaataccctgctgcaagtattgaatcaagtcgtaccctgcggtagtccatttgttgtaggcatccacacatgttctgaccataaaattagcagcctcacgctcgttcatctctggatgaaaacgttttcgcagattagcgataggttctcccctgctaaagcaaggcaggccactgtccaccatcaaattaacggtagtaataatcccattcatgtgtctccttcctgctaggtaccctttgacacacaatctgaaagaacaatgcttgactcagagcatgtgcaacaactccaattctagttaattagaagaaaatgcatggaaaatatttacctcagaaactgattccaagtgtcactcttcattgttccagatggatcaagcaattgagtcatctcatggcttaacttgaaatgtgcactttcaaaccccatgtttcctccaggcgaaatctccaaaataaatccaaaatcaatatggactagtctcccgtggctgcacaagcaagatgatgattaaccaggtaattccaggtttactcattacaattaggacagaaaagtaaatcgtacctatcaaagagaagattgccattatgccgatcctttggctgaagaagcaagctagcaacagcatatccagcactactgatcatgaacatttcgcgagcagcttcgaaagaaggtgaacctacagggccatagtcttgctgaaatatctctaataaaccaccatcagttgtttcacccatttgatttctactccgagtatttggtaccacctgcagtgtggtcagatcaagaaggttgacaagaggaaaccaatagaacaggtaaacaacaaatacacaacgacaattgctcagtcatgaaagacgtagacttgactcattacttaggtgtcaacttgtcataaaaatggtagctccaaatatttcatttaaaataaaccagagttagagttgtttttttaaaatatcttagggcctgttcagattgtagccaaaataaaccttaccaaattttggcaggatttcttatgtatttaccaaatttggcaacaaactaaatatagacattttttttgggcaattttgccaaaaataatggtatagttgaaaatggcatcaaagtgaacaggcccttagacattagagatcacttgattaaatttggagaaaagagtccagagcatgttttgaaccatgctcattttagttgttctattgtcaaatataacatactcctaatttgaactagaaaggtagctatattatgggacggagggagtaataacaaagtaaagttttcttgttgaattcactattcacatttgcagggatattatactgctaaacatgacataacggtgtaataaaatgtcgattaactgctgttcaagatcagtaataagtgatccctagtccatatagatacaaggaactaaataactacagatggatgcttacctcaattatgcctcgctctggtccagtgggtaaaacaccatatgggaagagataaaggtttaatccaacagcttgaaatatgtcccttagaagagcaataacttggagtgccagcacatcctgtctacaatcatcaccaacctgttgtaacatagaaaatgctcatgtcaactgtgaagcacgttggatgctagacactaagatggttcctgccacatttgctgcatccttcaatagatttacttatccaatgcaagttttaatttatgttcagttaatttatgaactgaaattccatagtaaacatgaattgagacttatagctccataactcgttatatccataggttacaaccatgagatttcactgcaaaagatatatttaccttaaaaatgcaagcctgtggcttcacatcgtttgggtccccatcacgatcaaccacattgaaagtaatcattattggaactttagcagcagactggagaggaatgccactgtctacttgaatgccccgtacaaacttgtttgttgcagtaggtaggtacagatcatcacctggcacagtaatcttctccagctccctgcaaggacaagtttaggataatgagatactaataaggacatatttaattggaacccgcatgagaagattgaaattatatcagtagaaagctcttgatcttcaatgaaacattacagtggtttttactttgtaccttttaatacccgctcgccgctcttctttgggaagaggaaaaagaacaccagaaatcgaggtgaccttgtcaaaaaattcgaactctctttcaaacatgtcacgagcttctggagtaaaaccgtcaacaattttctccctaacggcaggaagcaaggaatggaatgcagtggcctgaaaaataattggagctattaacaccacattgcatatcttcgagcttgaaggagggcaggaaacaaaactgtatgacattgccacagttttataaaacatctcatatgaacaaattacaagtcaaagttaccattttagtcagaaaagcatcacattggaagggcaagaagcacaaggacaaataatctcatgtttcaaatgcatcatgcctaccgcaagtctaaatgtaatactacgatatgaggttcttcatacgcacaagaataatgcataatgaattgttcaagccctttattaatgaactaatacaaacagaaacaatagtacagttccatgaagggctagaaaacttctggaaactcagattatcaattaccatcacaaaaaaaaaaagagttccaaaagaaagaaaaatggtgcttcaccgtgaggttaaaaaatggggtaaaaactaaaaaggcataaaggcttcaacaagtaattgccatgtgccttatcaaacaaacataactcatttttaacttatgaagatatatgactttgtctttaaaaagcaccactcttctcaataaactttcagacaagggatataatagaatgacatgtttggtcaagaaaaaaaaagacatggtttctttttcaaggtggtgttgatgatgcaacagaatatgaaagtcgaagcaaaggtacataaatcttaaaacatggatacctttggtgcagctgcttccttcccaggttcatcgggaacacattctccctgcaatttacatttcctaactcaattagatattcaaataactcagttatcgaacatcgcactaggcatatattgaagaatgaaacatgtttttttatatttgaatagagtagaatatgataacatggtataacagaataaaaataaaataaaatttacctgcagatgccatattaaaatatgagcaaatatattacttctccgagcagctccaagcaagtatccttcaaccaatttctgatgagttcaaaggcaagaaaaaatgagacgaatgcattacattctttacgagtaataaagtaagggcgcagattgaagcaataaatgttttcctagggtgcattcataacataataaatatatatcactggaagaaattctcacatcatcatcatatctgagagactgtaccaactgtggcataaagaaggtaacagtctcaggtgggtaagtctccaggacacgaagaacatatgccataacacggggatgtcctttataaggaggggtaagaaactccaatgcttgtgtaacagagcatggagcccaatgtggaagttgctgtaacaatgatgaattttcatctactgcctttggagtgatgaaaaagggtaatgcttcaggaattgtacggagttccaatatatgtgtctacagggacaagagagcattgtaagacataacagcatatggcacccttcttactgaaagaaaatagcagttgaacaatttacgaaatacacgaaaaaaaatcaaacacaaaacactatcactcagtcagcagatacacctactacctcgactctaacaaaataagccaggagaaaatctgacttttactacactcagatactgtttatttggttacatgagttcaagtggaagttcaagtgttcaacacagtgagagcatccgctagttccaaaattccagtatttaaggtaagacatagcagaaacaaaaaataaacaaacattgcacaacacactgttgtcaaaagaagatttggttctacccttacattctgaaaatatcactaaaaaaaaattaaactggcaatatcggaaagcaatagtatgttacattagctaccgttcttaacaatagactgaattactatttaactctcgtagctgcaccagttgtcatatcattcttcgacttaccagtagacatgcccataggggtaaaatataccgtaatagcaccctaaaattattttaatttttgacacctccaattactgtcctcaatgtggttgcatggttgctttaaggggatttatgatgctatatcttttagattactttataatattcttgaagatggcatcttaatatattctaaatataaacaaatatgccatattgaattaaagttaattgaagaaatgcaccaagagttctcttgctgtagctgaaagcctgaaaacacccctaaagataaacaagaataaatagattttgaaacagaacttgcatgacaaggaaaaatgggtagaaactgttgtctgagaaggtagcagctgaacgcagcaagaaccatacctgtaccaattgtgtaatttctgatgataatgccgagtttgtgggaaacctcataatcattgagaatgcaattcgaggatcaacagcaaaagcagttctggcatgatcaatccatttatctgagctaattttaccacgaaatgttgctgcatctctgccatatataacatgctatacatgtaaatttgaactcaaagcagagtcaagaataaataaaaaaaaatcacgacgatagttactttgtatttatcggttgtgcccacacttcaagtctgtctgcctcattctgagaaagcataagaagtaattgtttacgcttttcccgtacagttgtatagttatccactgagccccagacagggtggttctgatccagctgcaaataaatgaatgaagcgacaaggtgagaaaagttttaaaagtagttagtgaagatggatgagaagtgattttcatggcaattattttaggtcaatgcacacggagggcagcgacagcagcattaggcatcagcatgtgtcagcagactaggcatattcatcccttaggttacctgttagttctctattagttggattcaataatcaactagttatcaggactctcctatgaatcaagccattatccttcagtttaaaccatagaagaacaaactaaatgccatttatctccatctctctccgtctcacttgtgcatcttcccctcttgccaagccctgtttatcttgttctctatctgcctgttactcatctcttctttatctcctcaccatgggttcacggcaccaggccacaacatacttggacctcatccacataccaatgacagtcatcactagtggtctgtactgtaagcagtcaacaagtggcgataaattatacggagtattatggtagctggtactgcgcatgaaaaataccagcatactacatttcctatttccttgaataaataaataagtttcctaacaaaggggttagttaaattagtactctatcaattacttaggaaaattatcagtttaatatgaagttagtctttgagatatggcttgtaagggaagttgaaattgtattcttaagtgtactgttatcacgggaatctcccataaaaggaatgtactcccattgtggtttaagcaatgagacctgaagttgaactaagcccgacaacctctctaccacgtcagcaagaagctttgccagaagctagatgtgaggcaagccctatggccccttacccatggtctttgaaccatacccaaccagctacgccatacaattgatagttatttaggtgggtaagtgcaaagaaacaaaaagggaacaaagatgcaagttgcaccataccatattgggttcaccttcacgtccctgtgacttcggagcagaatcagcagaaccactggggcgctcattttgtagacaatggacaaatattgacacggattgggcctctctctgagcaaaacttttgttttgagattcataccactcaggtgcataagcaaaccatcccaaagcagcactgaaacaaaacatgtactactaaaatatattaacaagtaataacatattatagctggcacaaaaaaaatgaagatgcaagcaaataaagtgtaaagcaaaaatgcatatacatgcattccttcttaatgatatagatgaataaccaaaaaaaatcattggttgatgcatattatcatgcttgacaataagaaattgatttcgagcatccatattctaccttaattttcagtacaacctgtaactcttattttgttttttcctgaagtatcaacatttcttaagtaacaaataattgtacaaatatagttcagaagtatggaaagagagcattgtattaaatatgaaaaatatgtattggagtgattattaccggtataccctgtcctctaataactgaagtcccatattacatttctgcaagttagactgagactggcatgagcaaaatttcagccccaggagcattgcagtgaagaaagtgccagttgcagcaggatggtgagaaaaatgagtagcagatttcattgtcccttgcaacatccgacccagaagtagaagctgctcaatgctatcatgccgaaccacctaagtaaaaaattgttgcagagtaatcgtaagttagacatgttgtctatcctggaggcaaaagtgccttaaaaaccagcctagggttcaatgcactgatcttaaacgttcagggagtaaagtggacagttttgtggtctagggtgttaagtagaggcaaacataaattgtacaagctaggttgcatgcatgccaatatcctagaaaagcagaaagaaattgcatgagatccataaaataaacaaagtgtgattatcacctcaaaccgatcgatgaagaagccaagccagagcctatgggctattattgcttcaactggatccttttctggtggtgcctcaggctcaccagaaatgagatgtggcctcaattttgcatcagggccacagtaattcatatctgacgcaaacagaccacattttgtatctattgtccacagccatgcatcaacaagttctgcaagcacaagaggacctaaggaaggtgctgcagatactagccaggtccagataaatatcccagtctccattgcatcaggagtgcatatataagcaggacaccagcatagaagacgtataagctgagaaaatccatctagatttgctctagagtcagacacctgtgtgttacatcattagcaaatgcaatcataaccaataataaggtattatgaaatatgttcaaacaatttaccatatgatcaagaagtaatgctgtagactgagaacaagtttcacggaacactgtattatctatttgatttttctctgccgtaacaacgaagtcctgaagaagacgaacaaatcttgacagaaaaacttcgtcaaatgattgattgggctgtgcagactgcataccaaggggggacatgcccgtgttcatgcctcccatagaactgaacaaccttctcataccagcaatctcccctgcatggttgcatttaacagttgcagtcactactgcagttgacagcacttccagggtgatgtcaggtgcttcttttttggcccctgatgctgctgcagcagaatccataactgcaggtacattggctgtcctgatgccattccaatcattctttccactacaaatacgtatttcagatagaagtgatacaacatctgctgtatgttgtgatctttgtgctccacttggcttgcaaaaattttcctaagcattacaattaaaacccctatcaatcattatgggacttgggtgaaaataaaacaaatagtataacttttgatgccaacaggaaggtgcctatggaacaaagtttgtgcaataaacaattacagaaagatcagcagttgctgctgtctcagagccttttttaagtcaaccatttaaatgtgtgtatcatttgaccactggatgacaacgatggacatgctttcattaatatatgttatgaatatgagcctactggccagtgacgcagtcgttacaaacttacaacagtagacactcctagaggattttttttttcggtaatttctttctggtggtacaactgaatggttagtttataccatactgactctcattagtattcccgtataaaaaactgctaatcagacatttaaatcctttcaagtttggttgggaactctgaagaacctatgactactatgcaaaaatctaatggaagttaaaaataacctatgagatagcaatctcaatcttaaccggacaagcgaagcgataggtatatcattaacatgacaataaccatctactaacaagaaatgcatcaccataatcatctttagtattcctgtagaaaaactgccaatcagacatttaaatcttttcaagtttggttgtgaactctgaagaacctgtgaccactgtgcaaacatctaatcgaagttaaaaagaacctatgagatagcaatctcaatcttaatcagacaagcgaaataggcaaccttatcattgacaggacaataaccatctactaacaagaaatgcatcatcatacaacaatgctactagacaaaataagacaaaataatattatatttgctaaacctgtataaggccttgagttgtacatggagcatatgaaagagcactcgttatccattccctggcaatcttctgatatagtgagcgtacagtggcaacccaagcaggatcgctaactggaccagaagtcaactcattatgaacagatattagaagtaaatctacacatgatgagttccagaggacctgaaaatttagtatactaggtgtcagtgtctcaaatcaataaaaaataacacatgagacaccaaatcaagcagccaagcaaacctgtggaaacttttcctttagctgagttaacagcttgacactcacatcacgaacattttcatccctctgtgacatgctctttataaggaagcaagcatgaacagaaataacagattcccttatatcagctccttctcctatgtcacatatacgatcctcctgggcacaaaaagggtaattgttccagtgcacatctacaagttagaagtttatcatgtgctctagaaaaataagacaatacaaacaataatcaccaaactgactacaatgcaaagtcaaaaaaaaaaaggatgatgaagtaactcgagattacacaaaacagaatttaaagcactcctaaagtatgaaataagatgcaaagcagattccaattattggacataaaattgctattgttggttgatgcttcattaatattgctcaggggaaaacaaaaacatcccaccatcaatgcatgaggcctttccttgtgggagacaatatctttatttgcagatcaagaaagcagctgtttgtacacttctaatgaatatatgttcgctacaatttatagcttactcaacaatagtcctatgtacaaacaggcatatctgaagcaaaaggagatattagtgctgccataagagatcaaggctgcaaaacaatggaaagaatgtgtggttcatcacaataggaagttgtgtatcttttttacacaaggagttgaattaacaaaaaagggaactattgtagagataatggactacagtactacatagctaaacaccataatgaaaggacaaaaaaatacatgacttatatcctcaaaaaattgatgaagtgtgagttgtaccatccatgacaacactgtttcaaaagctctatgcacaactgcagtcaaacactgagatactgctggtgtcaagttcggggttagcaggtattcgaacacacaactgaatgcactatttgatttattcaatgtagaggtggctgaaagtatgccgccattgcagctaaagcgcaatatctcaaggaaagcaactgcgaggagatatgtagctttaacccctgaaaataaagcaaaaagaaaatcagtttcatacttaaagaattcaatttatctaatgtaacatttcataaagaaagccactggtatgtgagtccaataatccagttaagttaaacttctaatgatgaaaatgaaaattgaacatttttctcataatctcatccttctctcttcaaaaactgcagattctagcttttacaaattaatccttgcacaaggccaaaaagaactaccgccagtcacaaatacatgtcggcttgggcatagatgcactcaaacttttaacttttgagtatcaatgtctttttaaatatttaggttgatatatgaagatcttacatgtaaatctctcgataaaaactttcataaaattagcattttctggtaagtggactaggcactattatgtagacatgcacaagacattttgctagtggactgtccagatgattgtgaattttaaggacctaaatgcaattctacattaattttactatattggaggttaatattttatttgtgcgagacaaaataaacaaatgcataagcagcgaatgactcgacagagaataaatgttgacctgaaattgtagtcattgctgctacctcaactcgacttcctaaagccgcagaaagtgcagttctctgtccaacagcagccttttcattactattgccacggcgactacctgggttatggagagcatttaactctagctcatcttcaagccatttcactgaactgacaacctgaaatgagaaaagcaaacatggtagatacaaggtattaaagaaagtaagacagccaaccgtcagcataggatgatcaacagggggttaagaatcctaactgttaacttctccatgaaaggagagacaaacatatgtgaatgactgaggacagtagttatcagactattctaatccattgttatgtaaaacatcaataggctttaaaactaataacactcaataatatgttataagtacctcttcaataataagatatgctctctagtaccaggaaatgaatgaaaacaagtttgaatttacttattgcataagaaacgatctgttttccatccctatggacccaaacaacctaccagtggtggagttccttgtgcaatacgttgcactgctacacaccattcgctattccacatgtagggtccagaaacagcctgaagagctatagcactgatgctctccatagtgttcaatgaagtggaaactggttttgcaggtgtctgattgctttgtattggaggagctagtccaaacaagacaatgtagaaccacaaattacggaacaatttcaataatgatggctcaacagttgaaactgggtcaaaatcagaacatatttcagcaactgcaggaagtaatggacccatcaaatcagcaccactcctgcagtaaaggaaatattatgttaagcacacagtactgcagttaattagttaagacataaaaatacatcattcaagtttgaacatcaaaactcatgaaatcgatatatatcaacaatatggcaagttacctcccacttttagactcagcagctaagcccacatctgagcatagagataatagcctatgacggtaatcagacctgagttttgtgctggtgagattagtagcaacaagcaaaaaccctgcaggaagagtctagaattttgtagacacagttagcatggaaattggaacacaagttgtaaaataagtttcttatgtagtacacacctctattctctcagttgttgcttctgatggcactgtgttgttttctgcagatcctacagctttagccttatcgagatagcttcttgtcatcaagacaatgctctcacgatatgacttttcaaaacccaagcatgccacacgagatattgcatctaacaactgcagtagagtacaaaaagggtgcttttgtttaagagtcacaagcaatgccactaaatttgaacacaggtaagagcaagagatatggaacaaaaataaatatggtagtgggtacaatacagaagttccatacccgaagtcgcaataaacttggagatgaagcatcaccctcttctaaatgttcaatgaaaagaggcaaaatcatgtctacaacttcccattttttcaagcatacacataactcagcaagaaggcggataacattaagtcgcatcaccggaactgcgtctttttctttgccatcctgaaaggattcacggtcaagaaaacgaccagcaattaaaatctaattaaaaaaatattgtctttgtatgcaggcaggcaaaagcaagtttaacttgaacattagcatatattcataaacaactagaattccgcaagaaaatgatgccagcatatttgtagccagaaatgctctctgataatcaaactccatttttttttactacaataaaataaaaggatgttaacagtcagaattttattttggagaatgtgaaaaggaaaagaaacactccgattttaacctgaatctctggtttcacagtataatcatgagtttaccacagcatcatggatgaaaattgcttatagaaagaccaagctaatcttctcttacacccttacagccttactcatatgaaattaaaaagcaaacctataaggctaccaatgatgcatcatggtgtatgaactatttggctttttaatgaaagctgggcgtaaagccttttctctaaaaatgatgcatcatggtaacttagcatgttgaaagactgctgaagtgacaattgttggaataattggggcatgttccattcaacaattgtaaggtagataataactgcttttatgttgaagctttttcagtgtggtggcaactgtactaactatcaagtaccagtatatattaaaaaaacttagctataactttcatacgttaactggcagttatttttttaaaaaaaacagtaacagtgttttcataaaacatgcatgaataacacatagtgagattgctcatataatgcttattaacatatggtacaacatgttcatctagtgcccagcataatgacacttgtgttgtagcaaatcttatttaactagaaaatttccaaaaggataaaggaatacctcctcctcataatcatttcgttcacggacatatgcagctaaccgcataatgaatgtgtcgaccagagccctatcctttgtccagccaaactctataatttcacagctcaacttaaccactgcatcgaacaaagccccagggctactacctgtcatgtcagcctataccaacgtggccggtttcacatcagaaagcatctctataaacacataaatttcaggagtccaagcgacagtggtgcaaaagaacatgcctgggaacaagtgctgacgacgagaggtttcaaagggatcagcagcactggcaggagttggccccctcgtgagacagttatctggctgataccattgagcagcgtgcaaaatagctcctcgcagatcttcagtttgcgccaggatgagaggatgcatgacttagtggcctcgataaaccaagctagagtctgctggagcatatccttggaagccttgctatcaacatccatggcagaaacgctccgaaccagcaccactaccgcagcctggcaacagagtaatttggtatttatccttgtctttagctgtgccccctgctctctccagtcccgtttcctaatctgcggagtgcaaaccatcacatcaatcatgaagtaacagcaagtaagcatacatgatacacccaactcgccagcatgtacacggcgaatgcaaatgcaggaacctccgttgtgcacatgaaccgcgaagggtcatccacattctagtctcaccttcaggaattcggagagcgaccggacctgctttgcggcggcattcctgaccttggcaacattatcggactccagaccaccctcgccccccaacacatgcacgatgagcctgaaggcgacctccttccgctccagctcctccacctcctcctcctcgaacttctgcaccacctccctgacccctccattttcctctcccgccgcgtactcccccttccccttggccttgggcggcgcctcctcagagcccgcgaactcgaggagcagccgggaggcgacgggcgcggcatccgcggggaggagcgtcggtgggctggccgccgcggcggagaggaacgcgcgggcgaggggcgcggacgccgggtcagcgacgtcgagcgcggcgaggagcgccgcggagagcgccgacgagagcgccgggcaggtcggcgccgcggcgagcaaggggaggagcctggagaggaagggcgccggggcgaacgactgcggccagaacgacggcgagaggaaggcgtgggaggcgaggaacgcgaggagcggcgcgggcagggaggatccggccccggcgccggcggggaggaggcgcgcgagggcgaggagggagtggaggtgcgcccgcgacgcgcgctgcgcggacgccgacgccgacgccgggggggcgccgcagcgggaggcgagccaggcgagcttgtcggcgaggaggagatccgggtgcgccgccaccaggtcgcagagctcgttgagcgcctccatgggggttccgcggcggcaatggcgggggtcagatcatggggggaggtcgtcgccgctgcagcagcagatcggattggggggggggggggggaggctaggccatggggacaggcggaaaatcggatactgacataggacaggaggggagggtctccccgtcctttttccgacgcgagagtaattcgcggagccagagggggggagaggacaaaggtgagggtaatttgggtgagtaatttattttattttgtttaattttcttttggttgactctactccgcggaatgttgggacagggtgagaggggccgagggccgcgagagacaagcaggcaaggccaacgtgcaaatgccgggttttctctggagccagactggttgcctgtttgccctcggtgaaaacgggacatttaggctttgtttagttcgcgaaatgtaaatttttaagtttcacgtcggacgtttgaccgaatgtcggaagaagttttcggacacgaatgaaaaaactaatttcatagctcgtccttctcctctcgaaattgcttttttccttttcttattcttcctttcctttcgaccatcttactttgaatccggttggagcttttctagagagggaagaagagaagttgtgtgctccctacaaaacccgttagacccactcatgatagatcaccttaccttcgaaggcagccaaacatgccttctcgtttcactaaacaggcctctcaatccgttttgacggtggtacccattctgctagtgcgaaagttgttcccgtttcttcgtgatccgatccggtatcagcggatactttaattttaccgggaagggttgaaacagcgcacttcgaaagatgatggtgtattctgaggatcagtccgttttttattgaattcgcaaattgatagatctggatgattcaaagaatgattcttccctgggcccggtaccattatttaaattggagcttttcaattccattttggagattgagggttcgattctacctcagaacgatcttcatgaaagtgaaaaatcttcgtcttaccaaaaccggatcttaaaaagtgttcagtgcccaacaagcaacgggggcccctttgtttctgtatgaatctcttaccgcacaaaatctccatagccaattttacaaattagatttttaaatcagaggcagcttttggtactatggcatggagcaagaaaatggattgaagcagagagccagcacaccttagtgaatatcattatttaggacaagcacgaagaggaagagctttgtccttcggccttgaatcagcataaagcccctcgccgagccacttctttgacaatacatcatgatgaatagggttcgactcattcatgtctccacacccaggttgtgccgcagccgcccttctgcccgcagccctattctataaatttggctggctacgttacttataatcgcagaacgagcaatgaatccccaacgacaaacgaacaaggggcgaggcattttcggggagtagccgcgaatccgagtaaggtctaaaggcatcagattgaggaaggaaatagagaatgttttcatagaagctttctttttcataggtcaactctgagatgaggtatgctgaaatcgcaagacgaatttattaagcctaattaatctgtcattagcacatgtgggttactgtagcacttatggctaatcgtagactaattatactcataagatacgtctcgtgatttccatgcaaactatgcaattatttttttatttatatttaatacttcatgcatgtgtcaaagattcaatataatgtttttggaaaaaaaataggaactaaacaaggccttaactatttgcaattttaaatttaatgtttaatcatttgtcacacacgtgttgatatatgaggacgagtctacggctcgggcacccgattggtttggaaaaaaatcgggcgctgacgtcagcgtatgatttacgtgcaaaactattttaaactgatttttctcttaaattacttatccaaatcatgatccgattgcaccattaaatttattgcaattaaatcttcaaaacaagaccatacatggatatatttcgacgggaaaaaaatagtttattattgaattatttttaaatgttgcacgatgttccaccagatatatcggaatgtttcactcatttaaattgggtgttgtttcaccttatataaaaacaatgtttcagcaaatagcgaaagaatgtttcagtttactacaacatttgatccatacatagtgaaatattataagtacacaagatgaaatatttttcggtggaacaaaaaataaataaattgaattcccttaatagggggtttcaaaatatgtaggttttttttgttgcaatggagtatttcagtttactgtaacattagacctatacattgtgaaacattgtgagtatactaggtgaaacattttttatgaaacaaaaaataaaccaaatttccttaatagagggtttctaaaatatgtaggtgatttgttgcaatggagttgcgtgtgtggataagtggccggtggggacaggggatatgtggtggggacccaggtgcgcacgtgatggggggagggggaagcgaccgattttttcccctccccccgcacgccccacgttgagcattctcggatatatgacgtctggttttagttaattgttacagacttacatgtaagagtgaaaaatagtttaaatattccggtgaaaactggtaaaagcagacagtagctacgatattttcgtagcattttttctagtttacaattacattgttcatggctcttcattcgcaacacacatctataattatatctgcttgacatatgtctaaataaacgaaagccagcagtaaatccttaaccgtatatgtaattatggatttgttgataaatttatactgcagattttgtttgaacatatataaaatctatacgtgagttgtaaagcagatcttgctcgtttccttgtagtatcatcgatgtcttagatagagcaattgttccaagtaatttcagtagatcctttgaaccttaaaaatcgatcggtagatcttctttactcctattgcatataagaggaagccaaagcaacaaagctcgttctcatcgatttaaacttgggtttcaactttgaaaaggctgatctcttggcgttgatgccaccattctgcgtgtattgtatgccgtcttacctctccattaactggtgtatactgtgtataatacataattacacacataaacacatcaactgctgtaagcctgtaattgcagtaagcttccttacggaaaatatgcagtaacttacagcaatttccgttgacaagagattcactcaccatgaatggatgagtcttaagtaaaatctaatataggatggtgctggccacatcttccaacccaccatagttcaactaaaactaaaataaactaaatctcacttttaagggtacccgcagatcagcctgcacccatctgtactcggtgctcatgaattgctaacaccgactacagccttcacaaagaattttgcactatattttctatgaatggttgctatactggattcaacaaccaaatgaaaaaagcttacatgttgcagcagccaaaattgatctacagaaaaatggaaacaggggctccctcggttaggcaacaaaacttgcagaggtggtgaggcgagcaaccaacaggtcaatcggtaaagggaggaagaacacaaaaaagagtaacacggtttgtcgatcatctcactttctttgtttagccacactcatcgcctatctacagtaaaccatcggatgataaactgtgaacaagcctttgctattgtacttctcccttaagatcatctctctttcttcggccaaacccacatctacagaagtattcaacaactggcccctggtccccagcaacccaaggatgctcacctacagcctgcagggtgatacgatttgctggatctgcaagacaaccacatgtggaaacacaagagaatgttcattagtagaataatatatctggcactaagacacaaaatgtgccagaatcataaggcggtgaaacagtttattttgaaaaaagaacctttgcagagaagcctttccagcaaatcagcaagttgggggttcatgttgtcaggtatttgcaccggatcattgacaatctattccacagcaatgtcttgaatgagttgaatgaaaaggtaaagcaaaaggaaatggaaggggggtatttttgtaccttatcataagtttcctgtaaggtatctcctagaaatggatagtgaccagtaatcatacaatacagagtaacgccaactgcccatgtatcagctgcccgaccatggtaggctgaacctgaagtgaattagattgaaaggttggtcatatttagccagcctgcaccaatggccaaagactatatgtcgcaatttgagccaacggcaaaagagtcatggtctttgccctctttagtttttaatcattggcataacattcatagccatgctttggccgcttaaagttgcagtatctaagtaattcgtttatgtcatattctaaatctaaattgcatatttatgttggactcattccgtttgcagttgggtgttctgtcgagaacagattactttatctgctattctgcaatcaagtaaaaggggaacatctacagctgctgtctatctagcaattgttgaacttcatacacataatttggtgactaactgattctgcacgcagtaaatactagtactcaaatataaaaggtaggcagttgtaccttgacagcattctggtgcagtgaaaacaggagtacctggagacctccaaagcagatcatcatcatcctgcaatacaatcacataacactttatcagtaaagtactaagccattagactccacaattgtacgaagaaattgcctaaaaacacttactccctccgtcccataatataagaagttttagagttagacacggttattaagaaagtaggtagaaatgaatggtggagggttgcgattggatgagtagtggaggtaggtgggaaaagtgaatggtggagggttgtgattggttgggaagagaatgttggtggagaagttgttatattttgggacaaatcctgagggctaaaagttgttatattttgggacggagggagtacatgttaataggcatttctacattagcacacaataaaaaagatcatgtatcaagttaaagataatcaaatgtggtatgaaaccatcctgttttactatataaagtcatgggcctgcttaactaaaaaaggtggcatgcaatcatctacttgagtaatcttaaaaatattcaggatggaaggaaatgaacaatatcttttgaggtttttgaattaaaaaatgcttgtcttagaaattgagccccaaaattgcatttttgatacagtctacagtctaaatcatgatgcacacaattttctggggatccattcaactgaaagccctttatgccatgacaaggaaaatagcattcattactacaatacagaggttagaggataaaggcccacctcaaaaatctgactaacactgaaatcccctatcttcacactgccagtgcttgtgaccaacaaattgtctggtttgatatcaccatgaataatattctgcgtataatgacaggaagcattcagtgacatgatgagttaggaagcacataacacagtgcagactgcataacgtagataaatgtgtgactagagcaacatgtatctgattataatatagaagtatgtacaaattggggaaatagaaacatcaacaaggaccaacttaagaagtaatgaattgccagatgttaaggaatcaagtaacatgttaccaagatacattatgcacataagagcatggataaattaagatttcttatatgcatatcactgtcctaatcagtgttctaaaagtcgtctctaggcgccgggtagccgccgccattaggcattcgatggtgtattaggcagctgagctaacttggctagtgttttttttttttttgctattttagtgttatatagtctaatttctatgcaatatgcgtgctatttttttggatttgactagttgacctgacctaggcgccgccttggcgccaattaggcactaggcgccccccagccacccaactagcgcctagtgctttcttgaaccatggtcctaatgattgaagtttaactagtatcatatttctagctaaatttaaccatggtcctaatgaactcaatttccaatacaatcaaacaatggataagagaagaaatgtgtgtgtaggcacaaataatcctaatctagaactaaaatgggatttaatattttctttatgaaaccataaccattcaaatagtaccacttagctgggcccaaaaaagttggcatatgcaaatgcaataattacctcaaagacagaaagttaagtagctaaaggaacaaggaaagtaacatgcaattagaacttcagcctacaagcatagactaagactatagtacaaataacgataacttaacagtggatctcaacctctgctcaacctggtcaccgatttaaccaagtttaagcaagacttttttagaaaatgtggaagttaaaatatgttgcttgcattaatctgcacaatacaaacttgaagctgcttaaatatatttgtacagagaaactatcattatatgaccagttgatatgactgctagtggaacacactggcaaatttgaatttcctttgatatgaccagttgatatgactgctagtggatcaaactattcatggtaccatgaatagtttgatccatatacaattggtgtttataggctgtagattctgatatatggcatggcgttcaccacaatttaacagatcttttagtgaaggaaatttgaatcttacatgagaatgaagatacataacaccagagattatgtcgcgcaagtaatttctggaggtagcttctcctaaaccattgtcacagaccatttttccttcaacatactcaagaactggcaataccaatggacaatgttaggtagaataatatggagaattaaataaagatgctcaaaagttagcaagaaaaatctcatgctacaattaaacaaaaggaaactattttttttaaaaaaaatgagaatgtcattacatacccatgtagaatttatctgcatttgggtcatcaatcacttcaatgagatttactatattaggatgatccaacattttcatgatggatacctgtcaccaatacaaaaggtgatgctgtcagataattgagacgttaaacagtacatagagattctttaagcaagcaaagtttattccagttattttattgtgttcatgtcctgaacagagcaaaatcagtgagcacactcaacttgtatcaactcaacttgggtattgggctcagggccaaggccctaggccaaggaggaggaagaggtgcacatggacatgtccagtatcgcatggttattgttcacatgggtgtatagaatagattgatttgctagctatttataaaatcttagagataaactccttcaaggtcaagccatcctatttaaataaggatgggctgtatgtccattcgttaatagtctctccctaatgttcatcatctaagtctaagttctctcctcatctgcagcaaccatcgccgccccagctatcctctggtggtgtttacccaccatgatttcggaccatgacaacttggttactatgtatgtggttggcccgatagtgtcagtgttatggtagcgatgcatcctcaaagtgcacacaaccaaggttatcataccaagcccagcccaatagtttgaccaaaaaggacctgaagtgagcctcccggtagactgtttttccttagacaattctataatcatccatttcgatcaggagaaaccatgtttgaactggctagtttaagagtgaacaagtcaacatgagccagacgataaacccagcttaagaaatagccaaaaataatgcacaatgcattgtgcatgaactaagtgggcttgttggtttgttatttattgtactgagaaacttatgtaagtccatattgagtgcaagagctatgctaattatatcaccacatttacatattacccatttaaatagaatgtgcagacactgacccaaatcctaactgggtcaagggctgaatgggcagcactacttttccagagcacttaagtcgtgtcatgacaaaaaagaaaaaaaaacatgtattacaatcacaagtaaactgagaaagttactcacttcccgaagaacatctgtcatggcagtttctgatcgcacaacacgtactttcatcatgtaagatttattcaaaacctacaatagaagggcaaaggctacagttccatcagttagatgcagacactgtgcacgcaacataaatttaaccttgtaaccataagaataatggtgctgaacgagtaaaaccaactactcagactagcagctagttattaatgagttcagatgcaagaaataaaaattagtaactaacataaagaaatcagcacataaggacagcgaaaaaccctaccttcactgcgtaaagctttccatctttcatgcttcggtataagacctttaagccaaaaaaaaaaagatttagacatttaccgtgggaagtcacttcataacataatgtgagctatcttaccactttgccatagcttccagaaccaatcttccccaggtggacatattggttgaccatcttgctgccattttcatcctaaatgtgccgaaaggaaaaaagttattgtactgtttaatgcaaaaaggtaatagatcgcatacagctttatggatttgcaaaggtcacgacaacactgattgaaacagtagatcatctgagcatggcgccttaaacaattaaagtttacatcttatacgtataatgcaaaagatgttttaaccgatcatttataacacagttataattttctataataagttaaacaatgttactctactaaataatataacgacaaggatagattaattaccaatcattccaaaatcgtatactacatagcaacaaccaaataatctagactttccatgattggttagtgggcttcaggttgtcactttcctagcaggaggtcccacattctaatcctagcagacgcacaaaattaggacaaatggcagttattctacaaggatggattaattattaattgttccaaaaggaaagtggcataatgtgcggcattagcattgatgttgtcgtagaagatgccacgttcaaaacctagcagaggcgccaaaatttgcattcctgcatgatggagattcaatcactcgaacaagactgaactacgacatttacctatttcgcagtctaaccgctgagctaaccttgtctttaatacaatggtccatgtgtgacagtttctcatgcacgggctagcttgtaaaagaagtctgcactagataagactatacctctatatatgggcatgaaaaatggaaatgaaaatagaataacagtggtaaagaattcaaatctaagaggatagtacctctgagcgaaatacttttttagtctccttaactaggctttctctacatgcaaagccattctgagcccttgacagtataatatcttcagatctcttccttggctgcccatcatcacttccataaagatgatcaggatcatctccatcatagaagcttctgtcagggtcatcgccattgtagaagcttctatcgagatcatccctgtcgtagaagcttctatcaggatcatccccggtgtagaagcttccatcaggatcctccgcagatttatggttcaacaagtcttcagataggatgccatcagcgtcgcgaggtcgacttacagacaccctaggcttccttaaaaagccaaaacaactacagcagcccatgtcggtcaggtcagccattcagaccaagtaggcaccaggaaccctagtagaacaaaaacaggtgaagtagcaagaaacaccatcagagtaggaattgagaagtatgtcggttaatagggttcggcgtgaaaccaaacaaaaatgggaagtgcctactcctcttctacttagcatcatttggctatcgcaacaccaacctactgtaccagatcacacatcacagtaaaacaataggcttattcccttacaaataagtcaagactacaacacaaattcctcgcgggaaaactcacttgatcacagactttagtatattcaaagttaagaggtgataaacacatccctgggatttcacatcagatgaacacggagatgaaatcacctaagcaacacgactacgcaggtatctgctggtaccacccgcacgcgggctaaaaacaccagctccacgcccccgaggcacccaggtgaccagatccccgcccaaaaccgtcccgactcccggttgatcctagggcagaacagaataatcaccggaatagtgaatcgcccagcctacccccaccttgctccccccgcgaccaaaccaacgccttcccttccctactctaacccaaacccccgcacccggcgagcgtgaatgtacgacggcgggtgtgtggggcgcagatcggacgaacctcgtgggtggcaggggactccacggcggcgttgctcccccccccccccccccccggcggagctgcgggtgcgtcgcggcggggtctcctcgtcgcggttttgtggggtttggatgggaaaggggagggaggga

SEQ ID NO: 82461 - DNA, 102394 bp, Oryza sativa
gtctgtacatagtcgagaagtgaaatttagtataattttaaggtgagaaaaaaatcctcatagcaaggatttctaactgtatacatcaataaaagactaaactgaaaaacggattcgctacatatgcttttgtaacaataattgcgtaagagaacatgcatcaaaacgtaaaacaaaacgtgctccagatctattcaatgtttcacaacatggctgatttgacttagataagtttttcaaaaattgaagtttgaccataagaattatttcgcaatgctgttccacatgttgatgaccagtatatagtttataatctgtgaaattgttcaagcatgtacggaaagcagagcataaacatccatacctctcgttgttgttccgggttcgcagaagccaaggaagtctgaaggttattgcttggagcttgcaattcccccacgggcaccacatgcttgacagcttgttgcattggctgcattgggctagagaagcgatggtgctgatgcaacattgctgggttggccacaccattcctacgatttggcatgtgtctgaagccctggttggcattttggtgaaacatctacaaagtaacaagcaacgatgttaagtgaagtgaatcctagttaattattaattgctccctccattttaaattagtacttctctttctagacttattctaagtcaaacattttagtttttgacaatcattttttctaaactcatgtagtttgacatcatgatattcatggatttagattcaataccttcataatatataatttacttgtcaaagtacactgttttttaaaaattaatggtaaaaaataaacatgtttgactaagagacacctagaatgataagtaattttaaacgggggagtagctgaagttgcgagtaattgacaacattagcaaaaataagtagatatgataattggatacaattagatgctggatctattgtgttaaaaaagaaaaaaaatatgacaatgatttagccaacaggaatacctggtgaggattatgcagatgtctaggcattcctccatgcggaggaccactcctctggccaggctgcctttgcatgttatatggcatcatcatgtttggaacaaaatttggttggaacccaaagcctgcaggtggtggtggtgggaacaaggcaggcacaccatggccaaaattgaactgatggggagcaatgtttggccctaatgtaggtgccattgttgctagggctctaacacgagcaaaatgtgcctggcaaacaaagaagatatgaatatcaagcttaacaaacgacctttgtaacatggaaaagttcaatgttagcatagcacacttagtatcaagtgtcaatgttaagaaacaaaatgtactttcagttttttttttcatgaattacaaaactcacaagaaaagataacaagatgtacaaaacctaccctaaaaatcaaattcaaatgtaatagagttagtacataccgctaaaaatgcctttctctcctccttccgttgagctacggcaacatataatggctttttcccaaccattttcccgttcatttttaaaatctataatatttttaaaaatattaattgcataatactgaaaaatatttagaactatggaattgggagtatgaggatagcacaaaagaatcattttttaacatacagcattgttagcgtcttcaacagttgcaaaagatacaaatccacaacccttgctccttccatgcgaatcaagcatgacctacaacaattgtaacttggcattatatatggaagcgtaaaacaaatgacaactcactaacagtaagcataacatcaaacaaagtaaaacaaatagagaacataccttgcatgatgctacctcaccaaaacattcaaacaacttcctaagatgctcatcattgatgtcatcatccaaattcttcaagtatagattgactgtttgaagcttctcaaatttctgatttttgtcatgctcaaatttcgcttttaactcagcttgtctttctgattttttctgagcccttgcaacatataacaccatatcaccaatggacttcccattgagatttttaactgcatttctagcacattctgatttctcaaagtttacaaacccaaagcatctcgacaatccatttgcatctctcatgacaatagcactagtaattgcaccaaatgatgaaaactcatttagcaaatcgttatcactaaaatgttttggtaaatttttcacatatacattagtaaagttgttagcgtctccagtgtgttctctctcctgccggcggatgaacaatccaacaaatattttttgtccattagccaacatgccatttaggccattgatagcatccttagcagacgactcgctctcaaattgtataaatccataacccttagactttccattgaaatctgtggcaaccttactggagaggattgtgccaaaagacgaaaacatttcatacaaactcttgttgtcaatattcggttcaagattttttataaacacattggcaagtccactttttcgcagagttggatccctattcgaaaacatgactctgattggcttcccattgacaacggtgaagtttagattttccatggcacgggtagctgcaatcaatcaaactaaattaaagagttgataataaattaataagttgatattagcgggtgtcaaactctcgaaatacaaaatacaacgaaaacaaacaaagatgcatagtataaaactaaacaaaatagaatttcccttctattcaaattaaggtatcacaacacatagtttcataaaaaaaaaatccaatgctcacaattaacatggaaccattgtactccactatataatacatcgttgccaacagccctacactcaaaagtgatcaccccattaaaaaattaaaataaatataacagattaattaaacttacaatattatcataacaacagtaataagtatatgctactccaaacgaactaatttaaacaaacaaaatttacagcatctcgcacacagataattaataggtacaatatatagcagatcgactacacacaaactagtaataataaccaaagagataggcctccgtaagctaaacaaagcgataaacctccataatgaacagttgatcgacccgtgcccatacgaagtgatcacgtaaattaaccgaaagcttttatcatcaggaaaaataaatcttcaagttaaggccgatcactacacccagaccatcagaattctgaacccacgatcgaatcgaagccgatcacccgacaaaatgagaagtaaaaggaagaggaggaaaaaactaaccgtcttcacgcgacatgaagttgacgtagccgtatcccaaggactttctgccgccggcgatgtcgcggcacacataggcggacgcgacgggcgccacctgggagaagagcgccacgagctggtcctccccgacgctcgcctccaggtctcccacgtacagcgacgcgccggtggcggcggcggccgccggggccgtctgatcaccccccgccccctccgccgccgccgccgcctcgggagccggatcgccggctagcggctgagacgccgccgcggcggcggaagcaggcgcgggaggggacggctgatctacgaccgatggcgaaggcgtggggatcgccattgcgaaggaaccgcggatcggcggtggcggcgggtctagggtttgggccgacgcgtcgccgacttcttccgttacgacgctcttctctccgttttttttttcctttattttttttttcaccccgggtggggatttttctggggattgcagagccctcgccgccggtttatatatatcggcggcggagtggtaggtgggcccacggctcagtgtcagagtcggtagtccggtacgaccgcgtacggaggcaggtggggcccaggtatcagtgagacactaggactccggttgtttcttttcttttttttttttttccggctaaccgggcgcatgcattgcatggttcgggggacgggttcgggtgcggtgcggtgcggaggcggggtgcagttatttcgtgttccgctctcgtttgtttgccggagtcgttttagagatttcaagatgagacgactcagacgagtagggggtgaaaatgggtcgggttcggtcagatctcactcctcctatatcctaatccatattttataatcggaatcgggtcggaaacggatagtgtcgaatacggattcaaactcagataatgtccgacaaaaatacggaacgaataagtaccaaaacggatacgtacactatcggttacggatatttattcggatatcaagtcgaaccaacaatcttatatatcacgtactatctccgtcctaaaatataacaactttcgtctataaatctggacatatggttatccagattcattgataaaattgcttatattttgggatggaaggagtagacaataaccatttaacaattccatatatccgtaatacgattatattaggccattaggaccttaggaaataaacatggtataatacatcatagtagaaccaatacatagtacaaaaaggtgcttcacaaaaacataatatgggtaatatccgggaaataccagaattttttaccgaataatccgtattcgtcagatactatgttaccgaacccgatctcgtatccataaaaaaggacccgtatttggacccgatatccgtgaaaagtcccgtacccgaatttgtcacgaaataatgtggccggacgtgtgggcgggaaatacctaccctgttttcacccctacagacgagcgtataatttacaaaccatgtgttgttttctctccgaaacacgctgttctgctttatagattggtgttattttgaactaggaaaaggctataaggactaactttttcttactagattcttgtatgctaataacactgatgtttatgctatgagtgtatctagatttgtttttttaacttctatctacctaaatcaaacaatttgacgattgttagtaaagtaagaaaaatttagtacgtgcagcagtgctctatgaattataccattttttaaacgggtcttgatttttacaagcggtggtttctctcctctatcgatctctagtctgtgtatcaatcatattacgcaaaaactaattggcgaaacctctcgttattgtcttatcgcgtgacactgcttagattcattcgatcgcgcacgttgtgtcatagctgttcgatcgtgcgagcagtggagaagtatactacgcacacatgcatgtctttttccccttataaagttttctctcgaattacttatccgatctacaatccgattacaccatcgtgttcattgcaattaaaatctttacaacaagatcttacatgattatattacgatgaaaaaaatatttatatttgtaaattgtttttattatatacgtaagttacttttatcatatatataaattgcttttagatttaactaaattactttttatacattcataatgctctgtgttgattatttttattattgtttttagtcaattctataatttatggactttaaatttaatttttagatagaccatatttttctccctacaacgaatttaattctaatgttgtaataatttacttctattttatgctaagttacttttatgatttatgtaattacttttaggctttattgaatttaatttcataaatatatttacttgaaaatcttctctacactttgcttgtgaatttactcaacataatttcttatttcaactcagttataacgtaattacttttcatgctatagagagttacttccattacatagctaagttgcttataaattacttttaaattaataaaatattttatatatattcaacattgatctcgtttttaaataacatattatttttaagaataatatgctatttaaaagatataagtcattagagaggttaaaaacgaaatgcatcattgtagtttttaaggcggatgaaaaacaatcgagatttgaggaaagtgttaaaaattgaaatgggctaaactttaggtgctattaaagtgaaccagtacctttaagtgctataaaaaccaaaaacgttaacattcgatactatataaccaatctataaattatgtatgaaaatatattataaagccatctacaaacatgataaaaagattggttaatcattcttttacgagctcacatgtaatactgtatattttttctgttgatgtatttttttaatactttaatcaccttattatatttattatatatgaattagagatagatatctgttcctgaactcgtctgggtaattaagttttcttttggatggggaagtatgtgtgtgtgcgtggaaaaaaatagttgctccactagtcaactgttgcttgaatgcaaatttgttgccgccttacttcccagcccgtggccgctctcaatatcgacaggggccgtcagcggtgctgtaaatggaataaattcatctaaggtatcttaacttgtcaacaaatccgattttcatcctttaaccgcaaaaccagatacaacgggtccctcaactgtcaaaactagtgcagatcaggtccctcggcggttcggacaacggttttggctgacgtggcgtctacgtggctaatttgacttggtcttgtggacacctgacatgtggggcccacgtgggtcccacgctgactcagccgccacgtagatcaaaaccggggtcaaaaccaccgagggacgttgggtgaccggttttgtatagttggggggaccgccggtgtctggtattgcgtttcaaggacgttttttaatctcggtgacaagttcagggacctccggtatacttttcccattcaagtcccttggtacagcccataacacagttggccttaggcccatacggcccattagtcaacaacctaccaagtaaccaacccacgcaactccagcttaccgtggccgccgccacccgcagatcagatgcaacacgcgcctcttcggccgctacagcgcctagcaattcggcgagtgactggtcgaatgacagcagtatggccatgccaagccaccaaccgcgctcgacgagaggggcccagcccagccaacggcgagtgtttgacgcgtctccgcttccggctcgatccgtagatgccggcgtcgagggagcaccgggtcatgcatgggcgatgggccttgtctgtactctctctactttccacctctatccgccttccagctactgttgcaactgttcttctcacagtcacaggctcacagcaatctgtattgtactctgtaggcaactgttcagctgaagcgatcagattctgatgttaattcttcgcatcatattcatcatacccaagatagatttgagattttgtgatgtattgcaggagcaaacaaaataaccgcggaatttttccccattcaaagttcaccaaaatgagctgcaacgcaacgccatttggagctgtacaagaaattttttttccacccccctaacccaagctaagctaggctgcatcttatcaaaatcctactccttgaaccccttgctgagccactgaatcaactgctacaccagcagcaatgttcatgttccatgttcttgatgttcatgtcaaccttgctggctcccgggcttgatgagcggctgctgggagatcttcccccactcctcgggagagcacttcacctccttgaggaaggccaccacctccttcatggtgggccgctccgcgggcgccgggttcacgcagaagatggcgatccccagcgtctgcagcatctcctggaccagctggtccggcatgccgcgcagcttcgggtccaggatgttcaccgctggctcgtagctccccatcttcttcttcgcccactccacgatgtggagggagtcgcccaccaccgcctccaccgcgctccgcccgctcaggatctccaggagcaccaccccgtagctgtacacgtcgctcttctcggtgatcttcgtggtgtagccatactctgaaaatgaggaaatgtatgtcaggataaatttcttggatgttttaagcatatcaacataatcttgggccaggcatttcaacaaacagtatataagtcaacaagcttcaatggacattgatgcttgtgatttcagaaacttgtgcaatggcagttaatagatagccagactgatcggtttcacctgcttaagctacaagcaatcaactagtcatggtcatggtcatggtcatggaatcagagcaaggttaagattactagaagcaactgcaggtcaaagattctttcttagataacagcattacccaaagagtcattaacctatggcattaactgttgctggtcttgtacactacattctactactactatatttctagattttgaagaaaaaatagcatgcagataaatacttgaagtaggaatcacttgcctggagcaatgtatccataagaaccggcgatgcgtgacatagcatgatgatagttgggggagttcatcagcttggccagcccaaagtcagccaagtatgcctcatacttcgtatcaagcagtatattattgcacttgacatcgcggtggagtatcgccgggacgcaatcatggtgcagataggccagcccttgtgctgcgccgacggcgatcttgtaccgggtatcccagtccaggctcctgttatccttcaggagctgttgcagattgccattggggatgtagttgtagagcaagagcttaacatacttgtttgagcagtaaccaagcagcttgacgatgttccggtgcctgatgtgccccaatatctgaatctcagcagcgaacgcgtcgattggctcctccttcgatgtcttccacagcttcttcacggcgatgatctccccattcggcatctcagctctgtacacaacacctgagcaacctttgccgatcacattctcatctctcaggcactccaagatgttatcgacgcagaagttcagcttctggaacggcgtgaacgtccacgggtgcgagaagtcatcgccacccgcaaccgacatgctcatcgccttcttgcccgcgagtgttctgcttctgttgatcaggatccagaccacaacaagcaacagagtgattgagcccagaacagcacagacaaggatcacggtcttgacggtcttcagtgccgtcctgcgaaccatgtctgatgcacaagtgtgcccgtcgtaggactcgcagaggttgggattgttgatgtaggagctcgatgacaatgtcttgaagaacggtgtcaccgggatcgcgccggagaaattgttgtacgaaatgttgagagatgtcaagctggtgagcccactcaacactgagatgctgccatacaagccattgctggagaggtcgagcgactgcagctgcgtcaagctggacatctcatccggcagctcgccggtgaacctgttcgagctgaggtcaaggctaatgctcaggctcgagagcgcgccaatctccggcggtatcggaccggagaagctgttgttgctcagctccagcatggtcagcttctgcaggttgcgaatcgacttgggcaatgtcccggagagcatgttgccgctgaggatgagcttgttgaggtagctgaagttgccgaagctcgccggtatctcgccggtgagcttgttcatgctcaggtcaagctgctccaggttcatgagctcgccgaactgcggcgggatggcacccgtgaagctgttgttgtggacgtcgagcagctcgagcaccgtgatgttggcgagctcgccggggagcgcgccggtgaacttgttggagtagaggtccaggaacaccaggttcggcagcttgccgatctccctgggtatctcgccggcgagctggttctcgccgagccggaggcgcaccagcgacgagcagtcggcgacgctcggcgggagcctcccggagagcgcgttcccgaggaggagcagcttgctgagcttctgcagcgcgaacacctcgtcggggatgccgccggcgaggcggttcctggacaggtcgagcgcgtacagctcggtgcagttgccgagcgacggcggtatcgcgccggagagcgcgttgccccagaggaacagcacctgcagcgccctgagctcgccgagctgcggcgggatggcgccggtcaggccgttcttgtcgagctggagcgccgtgaggctgctgcagttgctcagctccgccgggatgcgccccgcgagctggttgtccgacaggtgcagctgctcgagcgcggcgaggcggccgagcgccccgggcacctcgccggcgagccggttgccggagaggtcgagcacgacgagcgccgagcagttggagagctccggcgggatcctcccggacagggcgttgccccagagcagcaggctggtgagcttttgcagccgcccgagctccggaggtatcgggccggtgagcttgttcatgtggaggtacaggttgcgcagctcggcgcagccgccgagcgcggcggggatcgggccggacacgccggtgtcgtacaatgccagcgtctggaggttggcgaggttgccgagctcctccgggatggcgccggacagcgcggtggcggcggcgccgaagacggtgaggttggagagcgcgccaagggaggccgggatggggcccgacagccccgggttgccgccgacgcggaactgctggagcgcggtgagcgcgccgagcgacgctgggatggtgccgttgaggaggttgtcctggacgcagagcacctggagcgcggcgaggctggcgagggagcgcgggatggcgccggtgaggcggttggagttgaggagcaggtactggagccccgacagcgcgccgagcgacgccgggatgtcgccgtagagcgcgttcgacgagaggtccagcacgcggagcgcggcgagcgacgcgtacgccggcgggatggcgccggagatgttgcaggtggagaggttgagcagctggagcgacgacagcgacgcgagctgcggcggcagcgacgacaggttgaggaaggtgttcggcagcgacagcgacaccacccggctctgcggcgagcacgtcaccccctgccacgagcacggcgtcgcggcggtggggtcccacgacggcagcaccggcgacggcgccgccgccggcagcagcgacagcagcgccttcccgtccgcggacagggccggcgccgggcgaaccaccacccccaacaccaccaccaccaccaccaccaccaagaaccggtcgccccggtgcgccattaccccccaaaacgatcaagaaaccacaaaaaaaaccagaccaaaaaagaagaacaaatctcccccctaatctacacctcacgacatgagagagagcttgcttgctagtgagaagattactttgagctggagttgcttaagccgcaccccagctcgcatatggagctagacgaggagatggatcgatcgatcgatcgagcgagcggaggcgttgctgctgctactgtcgccgctgctacacactcgctcactctccggtagtagtggtattaatgtgtttttggctaaaaccccggttgattagggttaaaacctcggtcgatttggtcttatctgcgcgtctcgggggttggaggaggagtatatttaatggagcctatgaacttatgatatgagaggtcgtctcaagctaggtcggggggctattgctaatttgctactgctgctgatgggatgagtgtgtttagtgttcacttgttgtttaatagttggggtcttggtcacttgctgcttggacttttactgccactgtgtgagttttcttttcttttcttgcgagaacaagtaagccaagccaccctcgtgagtgtggtttggatggatttataaaggcgtcagcaaaatgaggatgaaaaacttcagatgaaggttgtggttttttttttactgccagtgtttttccttagcagttgcgattttttttaaaatttgaataaaaagagtttaaaggtaataaaaattcaggaaaaaggatatgcatgcagttgagagggtttttttcatgttcataacgaagagtggattttatcatttagaagtcacatgctcgctagaataaaatgtggtgatcacggagtttccctcgagcaatatgaccacggttggtatttttgggagaatgcggtattcatgttatgagaaaatatagcacaagatacatcttggaatgaggattacacaaaatttcaggttttcgtaatgcttaaagtatccttaggttttgtgaagacaaaagttttaggtcatcgaatatgttttgtaaagacaaaagtccataaaggtgcaagttattgactacggataaaaagacgtagctcgatacacaatgggtagcctatgtatataagcagtttagacctagtaggagtacgactgatgttggtgtatgtagggagaatataccatcgagaagatttatgagatggattatggagacttcttgtttaaaaattctcccaaaattttcttatattttttcttcataacaatgcatcgtaacaataacgataaaccatcataacgaagcatgatttcagagcatctagctagtaatgatgtgacgagccgtgccaatctacgacaggatgatcactgcggggatgcaaacggactgacttacaaatctagcttcttatatgtcaaataagtggtaacccatgggttttcgcgtcgtggccctatttaccgcacctagagatgcaagcgggtcgacccataaactcatttacaggttgaattagtaggtaacccgtgagtcaatctacgggttaccccgcgggttggcccgcttgcatccgcggtgcctattgagagccttgttaacatatggcaaggtcgataggtgcttatgacggaacttcttgtcttacagaaactcaataggtctcatggatggccctattaacctagacaagccgatagacctacgtatcgtttcccgcatgtttgaaatgttcatcttgtttcaatataaacacttaggcttgaagaggtatcaaagatacctctagttcattctcattttttttcctttcttcttactaaacctttcctaaaactagcaataatgaattacatatatcggagagaattatcccgtaaatatgatatagaccttgtaattgtagtttacacgaaagaatagtgagatcatcacgacaactcgacaagcatgtgaaaaccgcaccactgacaaaaggcattgggggattgtatccgggataaaatcttactcgagcaaacctaggagagccgtcagccgtgccatgtgactgggggttagccgcactcccttgtccattctccaacagtagggcccacaagtcagcgtctctacgataatctccctaatcgaaaaaaaaaatgtctttcctgttctgtttaggcattgaggaaagtttcagtttcgcataataaaaagaagagaaaagcttcttgtttggtcatactagactcctccccattctattcatggccggccaatcactagcgagcataggtcaaactggggtacgttgcttagatatcacgagtgaatgagtgattattggcgattgtttgatgaaagaaaagtagaaaacatggggtcctactaatactgtcttctaaactctattcatcttaaaaaaacgttcaccttttacgggtagtattgtagccgagaaagccccggaaaataggggttgcatctgctaattaagcagcacgctttctctagattgcttttaataattatcattacaaactgcatttgtttgtaggctaaaaagatattcggttagccaaattttgtaaggtgtgatcatatataaaaagatcaaagtttgcaaaattcgatcaactagcaaaattgtaaatgcacccaaggcagtagtatggagtattctctccgtccaaaaaaaaaacctaatcctaaagaatactccctccgtcccaaaaaaatcaaatctagaactggatgtgacatatcatattacaatgaatctggacaccaatatgtctaaatccgtagtaataggatatgtcacatccagtacaaggttggtttttgatgggacggagggagtagtccaaatttttctttaaaattagattcttaatggaacagagagagtacggagttgcatagtggtatcctacgaaattgtaaattaggacggttgatatatcctccaaagtaataaatgtgtcctccaatggctataaacgacataccactagtacgaacctaggcacactagctagacaatatattccctccgtccaaaaaaaactcaacttagggtgtgtttagttcacgacaaaattgaaagtttggttgaaatttgaacgatgtgatggaaaagttgaaagtttgtgtgtgtaggaaagttttgatgtgatggaaaagttggaagtttgaagaaaaagtttggaactaaactcggccttagaagagaatgtgtttagattcattgtactagaaggggacacattggtcacatccactcttagggtaagcttttttgggacggagagagtataagtatatttggaaggatggtttactctttgttagttgtccaggcatattcgacgaagatttgcaagagaaattagctactccatttaataagagcaagtataatagtggactacaagccgactataaaaacatatggagaagataagaaaggagagagaagagaagcacgctatatatttgtagtcagttacaacactgattctaagatgttttgtatatcttagaggtataccaaatattaatggtgtaatatatatttataaataactattatatgaattagatattggattgactatatatgatttggagctggtagttggctatactattaaacttcttgtaataagtttatttttcgctcacttaatttattccaaaacaaatttatttttaagtaattattacatcgaagtttatgaaagtatgaaagaagtatataaagtgaggaataattgtattgtgatttgataaattaggggtatgttagttttctttattgatatgtgtggaatagggaaaactggaaaacgaactaattttgtaacggatggagtatgttctacgtatcgcgtcctaaaataagttaatttcttatttccaatcttgacgcacttgtttagatttgtatctagaaaataacttattttagatagtgggagtaattttgaagaccacattgcattaaaataccccccatagaattaaatgtaggaagtaaggattacagctctcgagtttaaaagacaattatgttattatttaatataacatggagaaatgatcttaaaagatgccgttattgtcagcaagaaacaatgatcattctcacgcaatgcacatgattgaacaatatacttaaacaccaattgaatttctttataatctatctattatatattataacgatagctcgaaaaggagggaccaacttcacatatatgtatgggatataaattcttggattataagaaaaagagaaatattttgatcgttacacatggtaactacatgttttaatgatatagattaatcgatgtagttgtatataatataattgtatatttaaaacagaaggcaagaattgtactctgaccatttgaaattacttatcgttttattagttcctatgtcaaacacatctatctttgataattaatttttaaaactccgtatagtttaacaacaattatatattataaaattatttattataataaatctaaaatataaattgtattatgttaaactatatgagtttatacaaatcgatggtcaaagactaaaatatttgatttaggataaacctaaaacgacgtgcaatttaaaacagaggtatcaaatctaacaccacttcaaaattctattatatataaaacacagttgtaggtatggaacataagctaagagaaatatatcaaatctaatcatacttttaaaatctattggatagaaaatacaatcatatttatgaaaaagaaaaatatgtcgattgtatataaaatctaattctgaacgtggaaaaacccgccagtttctttttaaaggatgaaagagaaaaaacgaagtggcattgggcttttgggttaatggacccaaggaccaagcaaaagcccatggatacccgttgggattgacagcaaacagcccatacccccccaaccaataacctaaaaccgcttattgctaatcccaaccttgcaaatccctaaatacccactagttaccatatttaccctccaaaccctaggtcatgttcacaacctctccacccaagccctggggcattgtagccaatccagagcatcttgggtaagattccttgggaagggcaaaaatttgatgatattgggagctaggcaagcaagcaggctgctggctgctggctgctgcctgctcatctcatgggggagtgtgtttaaagtaaaagaggttaatgagagagagatgggaggcaagcaaagcgcccatttctaagttttgggattcttaaacggtgattaaaattttcctaatacacccctccctctctcatgggttatcaggcacagcaccactggtttaatttggtctaaagtcacacatggggctgtggtggatgcctttgtttttatttactgtgctttccttttttttactctgttctttctcttttcttttttttttaccgtggtgtgtgtgaagaggggtgaaaggagaagaggagtgataattgtgcacaggagactatgggggtaaaaaaaaactgggtgagctttccaagagggtggaggtgggtgggtttggggaattgggttaaagaaaagaaaaaaatgcagcaatttgtacttgcatcatgttgcctcttgtgtgatgctttgtgtgtgaagttggtgctaatttatgaaaaaaaatgatctgcaaaatacttatctgattaattgactaaactaataattcaacttaatttacgaatatttagtcaccaaaacataaaactgcaaaatgtgaaaaacttggatgaatatcaagagtgttattgactagtggaacaatatttaacatggtaagaaccacataatgaattattttgttacaaactactccctccgtccaaaaaaagacaaaccctgatttctgtgtccaacgtttgaccgttcgtcttatttgcaaaaattatgaaaaaaatttaaaaagacaagtcacgcataaaatattaatcatgttttatcatctaacaacaatgaaaatacgaattataaaaaaatttcatataagacggacagtcaaagttggacacgaaaacccagagtttgcctttttttgcaattttattaccaaacttcgtgtcaaacatatggtatcatcttttcgtttatgcttatacttattagctaaaatttaaattttcaactttaaatttagagttgattttagggtttttcatcgaagtttatttttcagtttttgttttcagatcgctaataacacgtatataaaagttttaatcataaactatttttcatttgcaaatatagcgtttcgcttattccccgaataaacgaatcgatgggccgataagtatatattgaatatgacatgtgggccttaatcaaatcaaatggtggtactactgatagcggtagtttcagcaaacacaataatgtccataagatggaggacatgtactcccagaaaagaacatgatgggggaaaaatagggaagggtaaaataatttagatcgaatggacgttgaaagaaactaatttctggacaggacctagctcgtagcccggcgtgtctggcatctgagagaaatattttatttggaagtgacattttttaaggttgtttttatactttttctgactgtacccgcacgggacaaaatcccggggcacgggatgagttccggtccatccgattactgggctgaattgttgtttctaatggaacaagacccgacccgttaatgctttttttttttactcccctcattctctccgtcttgtaaaagacgaatataaaactagatcttataaaagacgaacataaaactagatgttacaaattccagtacaattgatcgtccagattcattatagtaaaatgtgtcacattccgttctagattcgttttttggtggagtgagtacgccccataatataacaaactataatagaataagacgtattatattactacaaatctagataggtctatatccagattcatcatattaggatacgtttcatccaatcataggttgctatatcctgggacggatgaagtactccttccgtccatattgattactacatccgtcccaaaatataacaacttttagctatgaatctggacacacggttatccagattcatagcaaacgttttttctgtacgagaacccttttaggttccatgcggaccatctggacgcttatatatcactactatttgcgcatgaagaatcgctccaccaagaaatagttcaggggccgcatgcgagataatgcattttcgcatgtaaccccttaagagattcatctagttattttcacaaacgaacctcttaagcggccgtacgtgaaaatatattttcgcaagcgggcctcttaaaggcccgcttagatgtctaaattccctcctcttaaagcttgtccgcatccccttttcctcctcttccctctttctctcggtaactttccttctcctcctcctccactttccccggccacctcctccttcctccactttccttctccttctcctacatttttcccggtctcgtcctccttcctccatttcccggcctacacatggcggggacggtggctcgggagtgggtggcgcagatgcgcggagatgaccgtctcgactcggggggcgcatggagacggcgtccttgggggcaggcaatgctagcgcgtggatacggccgctggctcggggggcgcgtggatccaacgacctcggggcggatccgccgccagcttggggcggatacgacatccccgtccttgggtgcggcggcggtagcctcggactgggtagatcaaccactgaagttgacaaaagcgacagatttgctcttaggagcggtggcggtggccttgggacagcggcgacacccatggaagcgacagatttgcggtggcgacgacgacgatgatggtggcgatggccattgcgaggatgacgactgtagtgatggctgcgacgacgatggcttcgggagctaggttttagggatgaattgagggctagagctttgattttcggaatttttatatttttttggcgatttttcatttttgcatgcgggcagcttaagcgcccgcccgcgaaaatcggattttcgcgtgcgattgctctacccgcatgcaaaaatcctatttttacataccctgggtacatgcgggccactcatccgcatgcaaaaatcgattaataaacgatatgtagtagtgtctgaaacggaaggaccagtgtacacaacagaagtaggaagctgtgttattccataattggtagcatttaatcttaatcacgaaaacatgtatataattgttctgcgcagtagtataatacaattagagaaaaacactaatgttacttcaacaattatagacacaatatagagcaaaaaaaagcacaatcccgttttataagtatctaacctcttcacttattatatttagctattccattcgtcccaaaatttaaaaacctagaattggtccatccgtcccaaaatatataagaacctagaattggatgaaatatttcctagtactacgaatctgaatagacactaagaaatgtctcatccagttcttggttcttatattttggaacagggggagtagctttctattgtcggtgtgattgagtagagtagcccttaatttgtactcaaaatttctccttcgtatttggcaaaacccttcctcttttgttcgacaaaaatcatatttaagtttactgattatgagtgtgtttggagtagcttctagcagctacaaattcttctaggatcaaaatcttcccaaacagtaaggttttttaaaagattacaagaagctgctgttataaaatccagaaaatgaattagagaccaatttctacatattctcactagttgaattcctacaagctgcttctcagaatcatgtccatgccctccgccggccctcccctccttcctccctccctccctctcgccgtcagtggagccgaccaccaaaaatcgtgcggcagtaaggatggggactatagtgattccctccttttcgtggatccaagaagcacgacggatctgctggaggttgctgattgggccaaggcatggatgcatcctaagggcaaccagggacgtggaggtgacagctcgatgtggcaagaaaggttggatccaggcaagatccgatcttttaggttggatctaggcaagatccgatcttttaggccctagatatcgttgcccctcccttgcttcgtccaacccgttgacaccgaagtgagctagtgatccacgatggcaacagcgaggagttttaggtgtgggagacccaggaggtgtgtgagcaatggtggtggtttgtggcttgcggcttgtcaggcaaacattgaagacaataatttcctggtagcgacgagtggatctggccaccctcctggagtggttggaatctagggggttggcggttgttggtgacagtagcttggggtgaggttgtggtgtcgtctggagcagcttggggatagtaacaagcagcgctgtctttgatggctggtagttgtgtgtgctagtgcaagaagtagagttggagctgtctctaatggtgcacaagtcagagtttgagttgaaaagctgtcactcaagtcgtctggcactgttgctaggcggtgttggtgtagggagactgcaggagttggtgtgggggatggctgcacggggtggcctaaaactatagatgctgctcaccgcaaggctgttgggtggcttggtggtgagatcacggttggcgtgggaatatatgctggtggtggcttgaaggatagcaagtagaacccctagggtagctgggtgattcccctcaccttggatctcatccccctcttccggatggtctgcttccagacttcggccgtggggagccccatggcacgaaggaaggtggtggtttggtcaagttggtgcctgcttggtggaggataagtgaccttcagcatcgacaatgctctcttgaagtttgcagcacaaagggcttgtgctaggttccgtgcagggaggtggcggtgtttggaagtatccaccacgctagcaagcatttgtgagctatggtagagtcgaagttgcttggccaggtggcaagctcagcaatgataacctttatcttcttactttcaggtaccgtggtttggagtggatggagtagtgttgtttgcctatggagtggtggagacgcgcgccaccatttccttcaagttttcttccgtgacatcggaaggagcccattgactctcaaagctttctctctcctccgccatggatgcaaaatggatgatgaaatctagcgtgagggtggtggtgattggaaagggaactgatgcggtggttgtgcgggagatctttgcaaaagcacgaagccttgagaaggtggattggtgcagattggcaaaccctagttttcgccagtgcagtcttgtactgtagcagagaatagggaaagtggcggaggtctcggcggggaagacgaagcggcgcttggttagcgttttttgttagggtatcgggaggtactaatgggcctaggcctgcacagtgctttcagcccaacttcactattggtgtggctggttgtgttccttagggatttaagcatatatttttgccttgataaaaattgctcacaacataatagcccaatgtcgttaaaatcctttttgatgcagttagataattctttggaattgctacaatgcgaaataaaaaggtgcccggcagaaaagtgtaatactaattttgttgacctttttaggttgcaaagctgcttgggttttgttgagttggctaatttcagatggctatcctctcagcatgttatatgcttattttgatattgacataagtcacaacttaggctattttgacttgtcatttgtcattctttatacaacagttgatgaattctttaagggttttttactcagattcttgtcatatatgttggtttatagatctttagagtgcttttcactcgggtctctttatgccttttttgggcgtattatggctaaagcagtcagctgggtattttatcaactgctgcttgagcttaaatatataattcccaaagtgattcggttgtaatgtaccttgaaccactcggatagatgtttaatgtgccttgactatatgtttagtttttattcaactaatcacatagtcaggggctacacctaattaggtgcatctagtcgatgcacctgatttttttattttcagcccttcacagtctttgatttcagtactcgggagaccaatgcagaagaagttaaagtactcggattatccttttgaattacaagaaaagactatttcgtcgactgtaaaggtctcaggggctactgtgaagattatggataccctatacccacacggcatgtatatccgactgggtatgggggtaccatgtatagatagaatatctttaaagggtttcgggttaaattcctaaacttgtatatcaaggaagcacccaggattttagtcagttacgattgtatcttatctataactacctattccgttagggatatgggctgtactttgtaatacggaccccttcccctatataaggaggggtccgggtgcctcttggggcacaactttttctcccagatcatacgatcaataatacactcagcggattaatccccggacatgagtaggttattacttcttattaagaaggcctgaacctgtataaaattcattgtctctaaacccatccactttttcagcttgatagccacccccttttattattgccaaaatcttgtttcgacagagttgctgccgggtgacgagttgagagctggggtggtgccctatggagcttggcaatgataactcacaacatgtttcgtcctattcacaaagatgatcggcgattgagagtgtccaaggcgaaagccgtatccaatctctgactggccttggtgacgtcgacgcttgtgggcaatgtcttccctcttgggagcattgttaaagtagctctctctttcttcatatgaaaaacatgtccggtgtttcggacatgcgttggcagcattatggatgttgtttccttcttgaaggcttcgcccagaaagtcttgctctttggtgggattgcactaggtggtcttgagagttgttcaaactggaagccgaaccttggagttgcttgcctgtgatgagcttagtaacgatgacttttgccgtgcctcagttcttatgttgccacatgatttttctttttcgctctccgggtggtttgctaggtatttcgtattctaaccatgcaataaggtttttcgacccaatctcccttataaatcggactaactcttcttaatattttcattcagtagagctcctatcattaggtttttttttacttcttacgtttcacaatgtaagactttctagcattgctcacattcatttagatgttaatgaatctagacatatatatgtgtttagattcattaacatctatatatatgtggaaaatgctagaaagtcttacattatgaaacggagggagtaacaattagaaaaaaaaaccagataatgataaatactccctccgtttcacaatgtaagtcattctagcatttcccacattcatattgatgttaatgaatctagacatatatatctatctagattcattaacaacaaaataaatttcccacattcatattgatgttaatgaatctagatatatatctatctagattcattaacaacaatatgaatgtgggaaatgctagaataaaatagagaaagtagcacaaaacttttttttttccaagagcagcaaccttttcaattttctcaaccacgttgataaaactcaggcaatcaaaacccccatcagacttcaaagtccacggaaagctttgcattggcaacaactccacgaaccccagagaaattttcatttgggcaatacttggacgaggcagagacgctgtcggtgaccccagccgatggaagcccaaatctatccccggccggccatgcatcctgacgacgagctttaaacatttggccatggtcgtacggcgaaagccttgggaaatccggaggcgcacgtgaggcccgcgtgtgctcctgctcgtcggcagctgctagttactgttacttactgcgctcttgcccagcgaaagaggaacagctgcgcctcgcccccatcctcccagcacgagatttcacgcagtttttaccgtgacctccgtggttaattaaccttcccgtacttgtacttaattaccctctaatgctacttctggtacggttcggtcaagctgctgtcacagtaattaatcaattactcactccattctaaattgatctacatattttataggtacatattttattagtcgttttggctcggttagctgtggataagaaaatttgttattggagcatttttgccacgcatgagacgagattgcccttgtgcattcatggtgttattgctctcagattatctccttgttactccttttaacgcttcttttccatctcatttaattttcgcatgccctcgagcgctatctgtactgaagctgcatgggctgcatgcatgcatggtgcgatgcaaaatcgccaagacagaaaaaaaaggtatgtatctagaccaggaatcgaactcaggtcccaagacaacaacatgaaagctctaaaccaactgatcaactgagagagcagttgttgcttgcttgcatgctacatctaaccatatttaatagggatatgacttcttggtttttaaaatcgtgtccgaaacgactaataaacccagcccgaagggagtattatatttacctagcaacaaactcaatgcatgtaacatccctactattttttagccaatagcaaatcaaaatattgcatgtgggttataaatagttgtgtgcatggatgcatgtatcaatgtccatttactctaatataaaaataacgaatagacttaatgaatgaatataaatatgtaaatcatttagaaataaccttaaaaaatattatatatagattaatttagaatggagggagtagcatcaagagatgatgctgaactgtggatttgagatagtcatccatgaagaagtatgaacataagaggctgtttcaatttgtaccagtaccatgtcatggcgtgttaacacggcgatatgagtggcacctatgaacaggacacggagcatggatgccgcagctggctagcctgttaccctgcacaaatctcggcacggctaattaatcaagcttaagtcgttcgtcgatcgatgcaaatgcaactgcatttgcctcgatcccttgtgtttgtgtgccggacaatgcaatattgcaatatatatatatatatatatatatatatatatatatatatatatatatatatgttcaccgtgcagttagtccacgacgcagccaggtgtaagccaatgcaacacatcgcttctcttctacggtaggaatcaatccaagtccacacctacaaaacgcacaagttggtagcttcgcgggtctttttgacacagcttaagtttcagccccggttttatttttccttagagtttaaccaaatgatgatcttagcttcactaaaaataagagtgaaactggttgagtgcttttataaaataaactagaaatgtgaaactgggtttagacgactctataacttaactcctaaagtttaaattaggagttggagtcctaccaaacctaaatcactcctaattaattaccgctggattaggattaattagagcaagtttaatagtatagctcactactagctctagtttatctatagccaatctaatagttaatttatacaatagttgcttactatactattaacatatggtaccacctatcatatataaattttgtcttagagtccgtgctgcagctagctacagatctgtaaccctccgttctctcttattttttatcttattataatatgtttatagctggttaatagtatgctcttagtgcgtaaatacaaggggttaacaccaacgagcggcgctaacagtaattatccggcgagtttagcaagcaggcacaataattaactccactttctcctcgtctcccgataccggcgcagtgctgtgccgacgtggcagcgcctgttttttctatacagattgggaggaaaccaacgatggccaattaattaattgtttgattgattttttgcttatctaaagcagcagcataaaaaaatgattagtgggagtacttgaggcatcagcgagagcaaaccaagaatccaaccctattaatatacaggacagtagcattagtaaattggtggtaatagttaagctaggttaattatgctaagcagatatagtgagctgcttaattgggccctctaagctaagctagcaaagtatcagttaccagtatccacttggcttcatgtgtagctagtttgctagctaattaagctaagctttggttgtgtggattaagaaatggccaagaatatagatagctagtgctccatcattggttacacatctagccatggacacagcatggagccccaaacccaaatgtacgttcttgcctgtaattatgcagccagtttgaaacggagcagcatcatatcccccggcaagattttggttgcttttcctgaagtttatgcatcgatttcacaaacaatcacgctggccggagcagcaaccgggtacacgcactaattaatggagaaatattgatcacaaatattgatctttcacactaataaatggagaagtattgatcacaaatattgatctttcacaaaaaagatatactccacttcagtggattgtatagtctaaaaatcatcagattaactgattaaggacaagaatttaggcaatttggtgtattagttggtcgatcgatgcaacgagggtatcagggtaattaggcccatatatgtgctgggcccatataggttcctaattcggcccggttttgtaccttctgccaagacgaaatatgggccagtagagttggtgactaaatttgctctagctaacaatggcagatttcggcattaaaaaagtttggttatgttggctgttgatgttagacaacataatggtgtagaacaaaattttaggtttcgaaccaaaggaacgccaaaactcatagaaagtacgccttttgggcacctgtctttcaagcaaaaatgattgtaatagaagatttactttttaaatggaatatatagaaagaactgatgagttaattttaatgagtacatagcttgaaatattttgttgacaaagctaagtcatcacattaaagttaagcctttcatttctttttgaaagaagctttggtttttctactaaaactgtacaatattgttaggagtaggacatccaagtcgcatgagtggaagaaataatatgagagcaattccactacacagtaagtaaaaaaactacagggcaatcagattcatttaccagaagatgtgatataccaatcaactggcatatcgtgtgatataccaatcaactgaacaagttctggatgaggtgcagaccttcagtacagaagacatccttataattctctcctgattcctctcaaccctagcataaatttgttcgctaagcaaaaccgatgcatgagaatacattgtcgctgtagaaaggtgttgaaaataagtttcgatgatttattgtcgctgtagaaaggtgttgaaaaacaagtgttgtgatggtttgtgtgttacgagcaccggcgagggaacggattggatatgaatgggacactagaggacgaggcttcggcagcctctttaccctgcccgtgacggcgagtgggaggaacagaggaagggaacagagaaaatgggatgagaagtgtagattgaatcttgcttagattaaccataaattcgtggctctaaatagccttacattgaactaatcttgctaaaagaaagggataacaaaacagtaaaacaaactgaaactaatcgctagcaattcgcgtggtactgtttctcatctgacacgctgctcgtccgtcttcaccgcgcgccgtctgcgctcatacgtgatgccgaccatgacatctctcccctccttcgtaaatagctcgtcctcgagctggaacgcaggatacatgtgcctgaattctgtctcgtcttcccatgtcgcgtctgcagccggcttgccttcccgctggatgagaacctggcgcacaccgcgtgccaaacgagcacgaatagctttcgccagcattggcaaaacacggccattggacaatgcaggcagagcaggcggttggtccggcggtgtacccttgaattccttgagcaggccaacgtggaagacgtcgtggatccgtgcgccggccggtagcttgagacgataagccacatcgcctatgcggtcgctaacctggtacgacccgtaatattttggtgccagcttgccacgacggaacctgggcagggacgcagcctgacggtgaagaaggcgcacccacgcccagtcgccaacctggaacgcgagttcccgatgcttgtcgtcgtagtacagcttggagtagtcttgtgcttggagtagacgctccctgatttcccccaaaaagtcatcccgctcgatgagggcttggtcgactgcgcagacgcgtgccgagcctcggtcatattcccgcagcgctggaggcggcctgccatagacaacctggaacggcgtcgaacgcagggaactctggaatgccgtgttgaagcaatattccgcccagggcagccaacgtagccaatgccggggacgatcaccagtcaagcaccatagatacatgccgatgacgtggttggctgcctccgactggccgtcgctctgggggtggaaggctgagctcaagttgagcttgacattcgccaggtggaagagctccgtccagaatgagctggtgaagcccgggtcgcgatcgctgacgattgagcttgggatgccgtggagacggaccacctcgtcgatgaaggcacgcgccacagtcgtcgctatgtaggggtgcccgagcggaatgaaatgggcgtacttggagaggcggtcgacgacggtgaagatcactgtcttgccgtggacgcgaggaagaccttcgataaaatccatggcgatgtcttcccagacctgcgtcagcaccggaagcgactggagtaggcccaccgggtgcaggtgttcggtcttgttccgctggtaagtggcgcatgtgcgtacgaactcctggacagcttgcttggcatggggtgtgaagaagtccgcccggaatcggtggagtgtgtgtttgactccttcgtggccagtgtgggcatgagcgagcaatgccggcagtgtcggggaagacgccgagacgtagacgcggttgtcccggaggatgaggccatcacggagtgcccaaggcgcgctcagcttgccgctggtgatgtcggcggcgatcttgatgaggtcgccgtcggtagccacctcattccgaaggtcgtcgaatgccgagaatgttgggccggagagcgccagggcggcgatttcggcgtcttctgtgcgacgcgacagggcgttggccacaacattcgtgcaccctgggcgatattccacagtgaaatcaaagccaatcaacttgcttacccatcgatgttgtggaattgtcgagaggcgctgatccaggagaaatttcaagctgtagtggtcggtgcggacgaggaacgccctcccccacaggtacgcgcgtcaatggcggatcgcttggacgaggccgatcagttcccgctcgtaggcggcgagtccggcgtggcgtggcgcaagtgcccggctgaagaaagtgagtggacccgccccctggtgcagaacggcgccgatgccagaccccgacgcgtcgcattcgacgatgaacggcagggcgaagtccggcagttgcagtacgggcgccgtcgatagggcctgcttgagctcggtgaaggcgcgggctgcatccggcgtccactggaatgcgtcgcgcttgaggagggctgtcagaggagccgcgatcgtgccgtagttgcggatgaatttgcggtagtacccggcgaggccgagaaacccgcgtacggcgcgaacagaacgcggacgcggccagtcggccaccgtgcaaaccttctgcgcgtccatggccactccgtcggcagagacgacgtgacccaagtagctgatctggcgttcaccgaagtggcacttcgagcgcttgaggacgaggttgttggcgcggacgacagtgagcactgcttggatgtgctgaaggtgttcggcccatgtccttctgtaaattagaatgtcgtcgaaaaacacaaggacgaaccttcgtaagaacggcgcgaggacagtgttcatcagtgcctggaacgtcgcgggtgcgttcatcaggccgaatggcatgaccaagaactcgaagtggccccggtgagtgcggaacgccgtcttgtggacgtcatcggcgtgcatgcggacttgatggtaccccgaacgaaggtccaacttggagaagaagtgcgcgccgtggagctcgtcaagtaactcgtcgacgactggaatgggaaatttgtccttggcggtgaccgtgttgagcacgcggtagtccatgcagaagcgccaagaaccgtcatgcttgcggaggagtaggactagcgacgagaacggggatgtgctgggacgaatgatgccctgggccagcatctcagcacattgcttctccagctcgtccttctgtagctggggatagcggtacggccgaaccgcgacaggggacacaccagtcttgaggtgaatacggtggtcgacggcccgggccggcggcaaaccggttggaagcgcgaagaggtcgtcgaattccgccaatagggacagaaggagatcgtcagcgtggatcgcagcgcatgtggacgcgaggcgttcgtcgaggacgccgtatagcatgacctcccggcagccgcgccaaattgccatccgcatgttgacgaagtcccacagtatcggtccaagagtgcgtagccactgtgtccccaggatgatgttgacgcatccaaggtggagcgcgtagcagtcgacgtcgaatacctcgtcggcaacacgcaggttcaggccacgcgcaatgccggggctggtgaggcgatctccgtttgccactaccacacggacaccatcgcggaccagcgacagcggaatgccgaggcggaacgcaaggtcagcgtggatgaagttgtgggtggagccggagtcgacgagggccaccacctgttcgttcgcgaggcgggttgccaagcgcattgtgttggcgccatcaacacccaagattgcgttcagcgatatgtgtggctcagtgtcctcatctttgtcggccgagtcgtcgtcgagatcatccgccgtgtcgtcgtactcgatgtagaagagccgtgcgcaccggtggccgcggacgaatttctcgtcgcagttgtagcagagcccttgtttgcggcgctccgcgagttccgccggtgtcagacgacgaaactagcgagagttcacgttgggcacggcggccactgccgtcggagccggggaggcgctagcggccggagtcgacgcagccgtgcgcacgaactgcttgctgacggtgcgcgatgggctgaagttggctttgcgttcatacgcacgtgccaaccccatggcttcctgaagatcttcaggctgatggagctccacgtcgatgcagatgtcatcgcggaggcccaccgtgaacagttggacttgctgccgttcggtgaggagatccgtcacacggctggacaaggcgaggaagcgctgctggtaggtggccaccgtggtcgactgtgagaggcgcttgagttcacccaacgggttgttgcggattggtggaccatattgggcatagcatagctccttgaacgtgtcccaatcaggcggccctttgtgttgctcgtagtggaaataccactcctgagcggcaccagtgagatggtatgtggccaaccaaacgcgatccccatccggcgaacgctgtgcacgaaagaactgttcacagtgattaagccaattgagaggatcgtcggagccatcgaacttgggaaattcgagcttgtaaaagcgaggaactgcgttgccggagttggcatcgtgatgtgcgccgtgtctggcatgtggcggcggaggtggtggtgggggtggtgggggaggtggtgggggtggtggtggtggtgatttaaggaggccaccgccggtcagacgtggaccagaggaagtggaggaagactgctccaaggcggtgatgctggaggtcgcgacagcgacagaacggctgagatcggcgaggtcacttttggaggccaaaagcgaaatgccgctcaacaccgtcgccatggattcctgaagctttgccagtgcgtcggcatcagtggatggctgcgtggaggaggaggattgatctggtgccatggtctctgataccaagttgttacgagcaccggcgagggaacggattggatatgaatgggtcactggagggcgaggcttcggcagcctctttaccctgcccatgacggcgagtgggaggaacagaggaagggaacagagaaaatgggatgagaagtgtagattgaatcttgcttagattaaccataaattcgtggctctaaatagccttacattgaactaatcttgctaaaagaaagggataacaaaacagcaaaacaaactgaaactaatcgctagcaattcgcgcggtactgtttctcatccgacacgctgctcgtccgtcttcgccgcgcgccgtctgcgctcatacgtgatgccgaccatgacattgtgagtgtggaatcatctcacatgttgggtatatatggatatggttgttcttcttagtggctgatactaggcctttctcatgtgagttgtgatatttcaattggcacccacttttgatttcctaccttattactctagtactatactggtacattttcaaatctcagttattgcttcatgttgtgtttcattctggtacagagttaagggcttggcaggatagagaaaactgatgctgcttatgtgcctggtgaatgagtaactgacataggaaaatcatattatgtattgtcgcaaaatgccattgggtagtgaatcacagatacttcatggaatgtataaacaacgatttgtcaagttgcttaaaatttccatctaatataacatgacacactcgatgaaatgtactaaaagagctctaactcaacttgataaatgctttaccgtctgttctgaatgcattattttagcagataacggggccaggcacatcaatttaaatcccatacaattgtaacatctaagaaaccaagtacgtttggactaaaaatgctaataacacattatcactcttgagcattttgacttgtgtagtacaagcaattgggtcaggtacaggtgcaaaatttactgaccctgaactttcttctgttgtgggtagcatgtttgagcataatgatcatggaaaaaagaacccaaggtacaagttgctaattcaaaataatttggtttgtttccccacttgttcctcaggtgctttacactgactgagctctctcacacacgcatggttcgttatgtccttgcaaagatgaaccatgaagttggctttgtatctccaattcctgaagaaacatgtccctgagctgtctgcatggtcaaacatcacagtggaagcttccatcctgatgcctcccaatcctatgaaccatgcaatgttttacatcgggatcactgctcaagcatcgccacagaaatgtgttgaaaatatgtgaggtatgtcgcatggtggaaattaatgaaaaactaggataatatatatattgaatttgatgtgctcttctggtttgcatgtgtgatggactgacggcagagtgtcgattgctaactagatttaaatgggtagaatcaggaaattatcgatgtacgtgcatggtttttttcagattgtataaggattctaagtacaatggtgggtagatgcataaaacacgacgaacgtgggatcgaaaaataaaggtgtaattgaatcttcaacgctagggatagacatgagtggatatataagtaacgattgataagttctggttcaacaaaattaacaaagtacataataaacttgaaaaaaagagtatattttagctgatttactacttgattgcagactcacattctgaaccttcttggagttgaatatctgatccattggtagcctaatccaaatgaaataggcataactaaactcgggcactaaacttcccgagagctccatcattggtacacatctagccatggacagcatggagccccaaacccaaatgtacattcttgcctgtaattttgcggccagtttgaaatggagcagttaatgttataaaaccagcctcagaatcagcatcactagctaaatgcgaaaaaacgctatagcagatccaacattaataacgacactgaggcacgatatttggtaacggagattcaaaagaattacttactcgctcgtagatggtaaatttgattaatgatattttttaggcaaattttgctacaggacatcgcaattgtgtgtatttagctcacggacaccgtgaaagtgaacatttgggggaagacatcccataatcgtggatatttgcccacggacaccgcgccgtctcctctccacttgacatgctgacatggcagacgggaggctgttttttggcccggtcagacgcaaatacccctcggccttatctcctcatatccactcgcgtataccgccgccgtcgcgcggcgccaccccctcacccatggcgagctcgctagagacaaccgtaccaccggaaagcacacacatgggttcacctccgccatcccattccccttctcctcctcctcctctccaaggagaccactccctaccaaccggcgctccacctgagccatccccgcagccccaccacgccacccccatcttgccaccgtctccaggtcaggccaccaaggagcgacccagggtggaagaaccgcaacctccgatcgatgggactccctgtgcggcaggcccaccgacgcagccttcgttcttcccctcgcttctagagctgggtagctcggcggcaccatctgcacccgcagcgacgaggcagcccgactccccttcgccccatcctcccgccgagccatcggtcgagttctaccccaggtcggcggcgtcatccccttcttcctcgtacgaaaccgcggaggatgactggccggcgccgccaccgcccactcccccaccactggtcttatgcgcctcgctagattcatcctacaccgagtcttcccctgtgcgcgatcgcttcggcgaggaggagggttcgcacgctgcacccgagccgccgccgctgccgccatcggagataaggccgaggggtatttgcgtccgaccgggccaaaaaacaacctcccgtctgccaggtcagtcaagtggagaggagacggcgcggtgtccgtgggcaaatatccacgattatgggatgtcttccccaaatgttcagtttcacggtgtccgtgagctaaatacacacaattgcgatgcgatgtcctgtagcaaaatttgcctattttttactgttcatgttttgtttttatagactttagagatggtatatttgatgagaactctaatgattatttcagactttagatcgaggaattttatggtggaatttgaattgagcataaatattcttgatttcttttatatagctttgattaaaatactcttagaatttatttcacatggatttttaataatattttagtggctaatatttcttacttttataaaatttacttttctatggattattttcctagccatactcctatttaggaagggctcttttacatatttattgatttggatattgtattgaaatcacactacaccggacctagtcatctgtgacgggctctaaccctcacctttgacggatttagtctaggttacattagtggtcactgatgactacacctcatctcaaacgggtgaaagcccgtcaatgatgattgacacctctgacggaccgaacaaaataacccgtcacaggtgagtctcacctgtgatgagtggatcttttcagcccgtcaaaggtgataaacacctctgataggtttcaacttaccacccgtcacaagtgtggaaaatcaaccaaaaaaaaattaaaagccctcagcctttagctctcagctctcaggcctcagccgcccacaagccatatctcatgacatgaagaacatctcaagatccctcatgacacaataactttgcattttattgacagatatgttgacacatgaagcacatccacacaagtaatatacatcacaaatccacacaactttgagtaataaactacaaatccacacaagcaaccgagagtataacccaatctgaaatttggcaattaaaatttgcacaacctacaagagttggagatggcggcggcgctagcgggtggaggagatggtggacgacgccgccggtcgggggtagaggccgccggatctgacggttggtgatgcggtggaggcggctgccgtcggatctggcaggcggcggtagggtggcggaggaagaggcgaccggcggtggagaggcgccggatccgacggttggcggtgcggtggaggcggcagccgccggatttggcatgcggcggtggggtggcggaggaggaggcgaccggcggtggagagacgcctgatccgacggttggcggtgcggtggaggcggcagccgccggatctggcaggcggcggtgaggtggcggaggaggaggggaccggcggtggagaggcgccggatccgcggtggggagaggccgcagtggaggcggctgctgccggatctggcaggcgacggtgggggggcggaggaggaggcgaccggcgggggagaggcgctggatccgcggtggggtggcggaggaggaggcgaccggtggtggagagacgccggatccgacagtttgcggtgcggtggaggcggcagccgccggatctggcaggcgacggtggggtggcggaggaggaggggaccgacggtggagaggagccggatccacggtggggagaggccgtactggaggtggctgccgccggatctggcaggcggcggtggggtggcggaggaggaggcgaccggcgggggagaggcgccggatccgcggtggggagaggccgcagttgaggcggctaccgccggatctggcaggcggcggtggggtggcggaggaggagtcgaccgacggtcggaaggtggctgggggaggcggcgccggccggcggaggaagaagcggatgctgccgccggacccggtgctcggcgcgtgtatcgagagaagtctgtggagagagagagggagagagagtggagaagtggagaagaatcgagagaagtggagaagccagccttatctcttgggagaagaaatatctcgggtatatatatatatatatagtgacacaactcactcaaacgggttagggcttctacccgtttgaggtgagtaaacctcacctctgacgagccatccggttgcgacccatcacaggtagctagtcacctgtgacgggttgaaaatggaacctgtcagaggtgaggtaagcctcacctttgacggttttcacttccggcccgtcacctgtgacgggtcgaagctggatggctcactaaagacggcatctggtaggactcgtcaaaggtgactttcatcactgaccaacacttatgcccgtcacaaatatgccgtcaaaggtgtgaggatctggcgtagtgtcaaaatttggattttgttttatcttttgttcctaatttgaattgatctctttaactgtactttacttggcatcttctcgacctggatattatttattactaatgcgaatttcaaatatatctaaattgtattgtatttttagatggactattttctcaacattagttattttaaatccgaatttcaaatattaatatgttatatttctacatgaactattttaatttgaatttcgtatattttctatattatatttttacatggactctactttcaatattatttatttgtagtcttaattttttatatttaaaattttatttctacatagacccaaattaatggtctagattttattttgtttctcttactagtgtaaaaattcttataccttacgaacgaatatggctgactcctttttctatgaaaaataccattataaattttacggtagacaaaaaaaagttgcatgagggaaaaaaatataacacgttactgggtgatcatggtgattattaggaccaacaagttgcatgaggaaaaaaaatataacatgagagctcgtagctgcagcatgacactgcgtaatttgacacactaatttcagtaggcaatgtcttaagtgcaatagctactgggcggtcaaagttaattggccagtaaccagtaacttttatgctagccagtactggtgcaatttggagagttgaaccatgcaatcggaccaggagttaaagtccacaaggaagatcctcatcccactattgggaagggagcttctctcctggtgcctctcaaccctagcataaactggtttgctaagccgctaatgcaagagcatacatgatcgctatagaaaagatgttgaaaaaaataagttaagacgacgtgtgagtggaaccctctcacacttgttgacacggagaaagtattgatatacataatcttcatgtttggctgtgcacattcggttgaatttagaggccgggtttatcttattttctaaaaagaaaaagatattctttcatgtcactcataactagccatttctcgtgtgagttgtcacagcttgaattggcacccacttttaatatcctaccttattgcgatagtactatacgggccggtaagcttcagttcgattgttgccttttacagtatgttacatttcattcactagtacagagttaagttcggaggatgcagaaagctagtgtgctagtgagtgagttgctgacaagtgaaaaatcatgttatgtgtcataaaatgccattggatggtgaatcacaaacagaccatgggatttatacagtgatttgtcaagttgcttaaaatttgcatataaatctagtgcaagagcttgaacacaatggggaaatgaggacccctctttgaagattcggctaagggacaagtcaagcataagtcaccctcagggaacagatggacgcaaaggagaatacaagttcgggccacacagatgaataatacccactcctctgtgtatgtggactatcaatgtggaaagttacaattagatccgtgacttgtgtgagctctaattgctaaagaatcgaaccctctatctgttggcatggatcctccttttatacgcaaacaagagtccacaatgccaatgcatgaatacaggagaggaccccgctccaaagagttgggtatgcttagtcttttcgatgtccccatggcaatcagcgcccagatgtaacagcttcgctctccggttgacaagtggcgctggcgacgaggtgatctccaccccggtcaccgtggggcccaccagtcaacccttgagaagtgacaaggtagaattccgctggagtgatgcgggcgtgacacatcgcgcccctcctattccttcggtagacgtgggggtgtaggaggctacatgtggcgccacatctctaaaatatacctggatgagttctccaaatggctccctcctgcaacataaatcatgatgttagtttggaattaaacctccggacccacctagagaggcggagaaaaaccccaaaatgagctaggggcagtgggggtgcgcttgggcctccacctgggccccctagtcacttgtactgtgctctagggcagcctctgctcctcggggcagccgcaaacctagggcttcttgcttgcccggggcaccgaggatctctccctactttataggttttcttgttattttggatgagcttctcgaagatgttactgatgaaggagttcatagtgatcaccttcgacggagtagcaccaagcagctgtctgcctccttagcatattggagacataaatcttgtaggtatgtaccctctccttggcaccttggggatgtagacactgcgcatttcttgaagatgtagatcttgtacgtctcttatcgtaacatacaacctcggatgccccaaagaccccggaggaccagggactcatgttcccgttcctaacactatgggagtgttatgcgcacgtgctatggagaagaaagtagatgtccaataatttttacatttgatcaaatgttcaaagcatagctattcctgttaaaaattgttatattttgggacagagaaagtaaatagtgaccgtggtaaattccggtataggttttgcaacagccaagggcttggcaccatgatgtgaatttatgccctttctactatagcaatttgttctaaacatgttaacttcttatgaccgtatgcgattatgccaaatcaccacaaacataatatatatgtatttttataatccttttttctttttttttggtaggctggtgatagattgacagtcaagattttattaagagaaggaaaataattaaaatgggcttagttcattggctacagtgtttagggccggtacaatttgcaaagttgaaccaacatgaactcaactttatgtgaatctcatcgtgctctgcttaagaaaagtggcagacctttacaagagagattcccatcccataattgggatgggatcatctcttctgatgcctctcaaccttaccataagctggtttgctaaggtgtgtatgcaagagcatacatgatcaccacagaaaggtgttgaaaataagttgagatgtcttgtaagtggaatcctcacacgttggtgttgagaatatatggacatggatatatgttctccatgtggctgatactagccacctcttgtgagttgtgactcttcaattgacacacccacttttgacttcctaccttatttctctagtacttatactatacttgcacccttcaattcaactgtcgcttcatgttgtatttcattcactattaattagtaccctctccgtcccataatataaagggttttggagggatgtgacacatcccaatactacgaatctggataaagagtctatccagattcatagtattatgatgtgtcacatctcttcaatcccttatattatgggacagggggtgtacagactacagagtaagggtttagcagtatacagaaagctaacatgactattgaatgagttaccgacaacggaaaatcatgttatcaattgtcacaaaaatatcattcgatggcgaatcacaaacattcaatggaatgtgtacaatgatatactccctccgtaaaaaaaaaaaaccattcctatcattccaaggtaaaattagtaaagaatgaaaatgacaaatgcctcattattgaaaaaagtagtaatggtgataggtagataaagggtattgaaaggataaaacttctcgatttatgtactgagagtaggtacgatggtaaaagttggcttttagtgggacaaaattcaaacagcagaagttgagttttttagggacggagggagtatatattacgttacctcaaatttcatctaactcaacacgcgacactcgagaagaaaaatatagtcaagagctccaactcaaacttgattaaggcttaccatatggtccgaatgcatgatttctagtagatagtaggtaaatacccatcaattggaagtctactatatatgagatgcaacatttttaagaaatataatcatatatgccccaccttcttctaaatgatttatgcttataaactaattaagtttggactgaaagtgctactaacactgtaccggtcacaatttgcatgagaactcttccaagaagcatatgctttgcattggcttgtgtaatcggcagggtcaggccgtatagtgatgcaaatgtactgacactggagttgtttatgttgttgtggccttgtgggtactaatatggagtggtgaatccaaggaaacaagaaacctggtctcaagttgcagaatgagagcagcttggttgatttccaacttgttcactaggtgcgttgcgccgaccatctctttcacacaactctggttgggattgcccttgcaaaggtgaaatatgatgttggctttgtatctccaattcctgcccaaggaagccccggagttgtccggttaaatattagaatgaaagcttcaatcctgatgtctcccaaccctatataggagcagcatatgcaattttttgtaggatcattgctcaagcatatatgaataattaatagccataggaaaaggtgttgaaaatatcctgtacagtagcaatgcatactaggagtatgcagtgagttttatgtgcttttctggtgaagtggtgagcgaagaagtaaatttgcaccggttctaagaatggaggatgtgttatagggttatacccggttttacggtcgagggagagaggactctatcaacagtaaaaatgaggatgagggagataaactagacatattcccatccactttgccctatcctaaaagtttgcggaaaagctaactggagcgtacacgctggcaacgcgcacttagtacggtggatttcctttttttcgtaacttttttttcccaagacgagtgcatctaacgtaactaatacattagttttagataatgacgataattaagataagatttttctttttagggatatttttttaaataacagattaaaaataaatctatatatgaagtcaaattttgaaaactttcaactcgaaatatgaattttttgcagtcactttcaacttttcatctcaattttgaaaaactttcaactcgagatttgaaaatttttaactcagatttgaaaacttttaactctagattttaaactttcttcaaattaaaaaactttcaagttaagatttaaaaactttctactcaaatatttttaaaaaagtgtatgctaactattaaaaataaggaaaaaacacgaaacaaaaataaaaaccgcgaggggagggaaagcggaaaaaagaaaaacgaaaaagatggcaaaaagaaaacgcgaaaaaaaaagaagagagaaagtgccgcgtgggggcgccagctgttactggggcgcgcgccaattagctgccccaaaagtttggcccaagcccaagcaaaatcctggaaaaagctcgacagactgtcacggcccggtccagttcggcccaacgggggcgccttgcgccaccgtgtcggagacgggaggcggcgtggccatctccgcttggctcgacggctcgcggcgcagaatcggccagcgaggccgtcgcttgactgcctgacttccgagctcctctttgcgcttttctcctttgaaccttccagaacgcgcaaggaagatcaagcagcgcgcgacgacgcgacaaattccccccccccctcccccctgccggctgcggacgaacgaacgaacgagcgagcgagcgaagcgaggaattaagatgttcatccagaaggtgaggagatgtctccagctctagtctctcgcaccattaatctgatgtcctcctgtatgcgtggttaattttggtggatttggttgtgtgggcgtgtgtgtgtgtgtgtgagggcgcgcaggcatggaggacggcggcgtttggggtctacggcttcacgcagttcaccaaatccggcttcgtgtaagcgtgatctcaccgagtcacctggctgatttcccccttgttttctatagctttgccaatttattgatattgtgttctagctgtgaaacgatagtctgtatcccctgtaggaatcctgattttttttttgaagggaaaatcccgaattttaggatacaactgctctggcccgttttggagatgtgatgtaataactgtgattatagctgcattgtgcgaattatgtgtagttcgatgccattatgccaagtagtgcaaagatagggaacccctgtccatcaataagtaccggaattatttagttatcactggagcaaatagtatcgaaggattttctgaggaatctatttgcgtgtagcaggttaacaactttcacacaatttggtactgaatgaaaagctgtcaaaggatgcaattgttgacaccatggctgcattatttttgtgttccatgctaacgaggattcttttattcagggaacatgccaagaaattcagagaggaggatatgcagatccggctggatgggaaaaattgcctagtaactggggctaattccggcataggttttgctacagccgagggcttggcatcacggtatggatctatacctttcctactatgatgatttgttctgaacatgtaaaattcttgtgatcacatgttttgtattcttccagtggtgccactgtttatatgctttgccgtaacaaggaaagaggagagactgctctcagtcaaatacgatctaaaactggcaacatgaatgttcatctggaggtacatgatgcttcagaaccgaattttactgcatgctaatttgcaataaaccttggtgatgttgtacagtaactatacctgaactaagtctctaacacaacaatagtattgtgttgcagatttgtgacctttcatctatcagtgaagtcaaatcatttgcaacaaaattctcttcaacagataaaccacttcatgtcctggtgagctttgcctcttcaaaattatgtcgtatatgtgtttcttgtctctggttgttgcttcttttatgttataaccatataattcagtaaagtttttttgtaaattacattaatcatggttttgaataaccagctataacatatgggttgttgttctaggttaacaatgctggtttactagagcacaagcgtgtgactacgccagaagggtgcgtgatactctgttgtttattgtgctcaatatattctcccctagttactttcgtactcactaaaccagatatcttgtttgctttcataacttatccttttattttaaaaataaaaaaggttggagctcaatttcgctgtgaatgtagcagcaacatacactttaacagagctagtaatgccactgttggagaaagcagcacctgatgctcgtgtcattacagtttcttcaggaggtatgtacaccgagccattgaacaaggatttgcaggtaaatttgtttcctctatgctcttattccacagttgaacacaatgtgtaaattgtgaaaataaaacttaatcattacgattttttcgtttgtcatgctcatgcctctctttctcaaaacctttttcgtttctaagtttgcaagagtgttgttaggagaaagatatttatacagtagaacttgctaagagggcccactaggaagttagcaaaacagaacaaaataatatagttggtggagcacttgattttttgttttcatacagttcactttgtggtgcaaaattcaagcaccctatttatctagttcctcaactgattgtcactgaaaacgaattagctttggtgaatttcagagagtttgtacaattgcatttctccccttttcatcttttgtcttataatggtattatggtctttctatgcatatctaaagtgttttacgaaatatgcatgtctaaagttatggaaaccatagaatcatgatgttttgttttgtcataaaaatgaagtagcatgtgaaagtagtcagatactgcaataacagtcctttttcactattgtttatacttcagttcggtgaaaacaacttcgatggaacacagcaatatgcccgtaacaaaagagttcaggtttgtaaacctcgaagtggtttctttatttggaatgctagtctttatgagattgagagaatataacaatctatgaacttcattcaggttgcactcaccgaacggtggtctgaaaaatgcagcaacaagggggtaggtttctattcgatgcatccaggatgggctgacacacctggagtctccaagagcctgcctgggctttcagagaagtagggctttctgctgtcctaagtcctaactactgcctatcttgatccatctgcttttcacttaacatcaaacccataaacttgtattacaattattatgctaggttatcaggaaacctgagatcaaacgatgaaggtgctgatacagtgatctggttagctttgcaacccaaagagaagctaacctcagggtctttctactttgaccgagctgaagcaccgaaacatctgaagtttgctgggactgcagcttcgcacgggcagataggctcgattgttgatagccttcgctccatttgtggcatttagggaaaaaatatttgctgggactgcagcttcccacgttcagataggctcgattctagtttctggatagccttggctccatttaaatttgacaaaaaaaatgaatttgcaccagccgggaatcgaacccgggtctgtaccgtggcagggtactattctaccactagaccactggtgcgttgtttagaggtggtgactcttatttgtaatcgttgtttggttttacaactatcatagctttaagtaaggaacgtggatatttgtattttgtaatggaatttttttcctatatgacatgaaaaaagggagcagatttttttttatagaaatttgacttagaagaaatgactttgtgtttgataacactttgataaaatcccaggtacaaatgattctcaaaatgattggcttgatacagaaatggaagatgctccacaaagaagaaggaagtgcttggaagaacgggctactgaactaatcatgaaggcaagaagtctgtgaaccagtgatgttcatgttctaccgttagatacatagtaagtttgtttcttatgaaagtggcagtgaatgatatccctggcttgcatgccgtagcacagatggatttggctattgaacatggattaacagttttgtgaatcagcttgaattctgtgtgtgaatgagtgaatcggcctgactaacccgagacaaagacaagaaccgcctgacgccgtacaaatgattggagaggagatgggcaagaaagtggcgagaccaagaagcgaatgcatggcgcgttgccacaaataggcagggagaggccctacacttcatgtcgaattactagtttcatggacggactccatatatcctttcttggtagctcacccattgccattctttcaagctccccgtccaaccgatcgtacgtctcctcagctcatccgcttgcctcgtcgctgctgctgctgctgatccacaagcgttcgtcggagatgaacgacctgttctcgtcgagctcgttcaagaagtatgcggacgcgagcccggcgagcggcgtcggcggcagcgacatggaggccggcggcgagggcgtggtgaacctggacaggttcttcgaggacgtggagggggtgaaggaggacatgaaggggctggaggcgctgtacaagcggctgcagtcgacgaacgaggagacgaagacggcgcacgacgcccgcgccgtgaaggccctccgctcccgcatggacggcgacgtcgagcaggtgctccgccgcgccaaggccgtcaagggcaagctcgaggccctcgacagagacaacgccacctcccgcaaggtccccggctgcggccccggctcctccaccgaccgcacccgcacctccgtcgtcgccggcctcggcaagaagctcaaggacatcatggacgacttccaggtataagtcaacctaccctaactgagtgacatgcaaacaacgagaggatgtcatgtccttgtggaggacggcgatgaacatggaatgcacgcaggggctgaggacgaggatggcggcggagtacaaggagacggtggcgaggaggtactacacggtgacgggggagaaggcggaggacagcacgatcgattcgctcatcgagtcgggggagagcgagtcgttcctgcagaaggcgatccaggagcaagggcgggggcaggtgatggacaccatctcggagatccaggagcggcacgacgccgtcaaggacatcgagcgcagcctgctcgacctgcaccaggtgttcctcgacatggcggcgctcgtcgaggcccagggacaccagctcaacgacatcgagagccacgtcgcgcacgccagctccttcgtccgcaggggcaccgtcgagctcgaggtggcgcgggagcaccagaagagcagccgcaagtgggcgtgtgtcgccgtcctcgccggcatcatcctcatcgccgtcctcatcctcccggtgctcatcaacctccgcatcttgacgctcagatgattcattcatcatttcctccctagctaacctgctaactcagatgtgtcaaattaatttatctactattttttttctccatcatgtatgttaatttcgttttcgtttaaaaaggaaaaaaaatctctgttttttggttagaagttgtaggcttcaaaatttgtaccttcctcattgaatgagaagcaggggagatgtatattacagtgatgtaacatttcttgatcatgattattccatactggcagcaaattcaatcttttagctaggattctctatgtttgagatgggaaaaaaatcaacattctttgaaaggaactgaataatattagcctccatcaaattacatcatgataatgccatgctaatgtaaatttaatcagttatggccatgtttgtttaatctctcccataagggttttgagggatatttggaagggatttattcaacagctattgtggtgtgaaattatttctcctcgatccccttcattcctcctctcttatggatattatacgaaaaaggtctaatagggtattatctgcattccatttcaaaagaaaaggacacatccggcgagcagaatttgcaaaaaaaaatcacaacagatttgaacgctgcaaaatggacaattcaattcatgcatagataggatatgttgaacgaaaagaaacgaaaatgaaaaacctattgattatcctatctatgtagactactatgaaaatttccctttttttaccaggtaaacatttttcagtttgatatatactccctccatttaaaaatatatgacgtgattgacttttttttataacgttaaccattcatctaattaaaaaaatattatttattttgttatgacttattttatcataaaaatataatcttaacttatacttctacctattcattactaaatctttgaataaaacaaatagtcaaatattatgtgaaaagtgaacaacgtcatatatcttagaacagaggtggtattatatacacggacaacgtaattttacaagagaaaattaaggatgcatccggcgtgaagaatttgcaaatgtcacaacacatttgaacgctgcgaaaaatggacaattcaattcacgcatagacccactctcactacatgtacgccacgcacgcacccacccacccgtctcacacggtatgctcacaccagcaccatcaacaatgccagcaacgccgccgcggataagccgacgccggcgacggccggcgcggcggcgctgatgatctggatcgggaacgcgcagccgcgcgcggaggcgttcttggtggtgatcttggcgaggccgtcgaagtcgcaggcgcgcacgtcctggtcctgcatctggaagtacatgttgaaggcgtaggagatgttgctcttctcgtcgaggccgttgcaggagcacccgtagccgagcgccgtgcagtcgccgctggcgcacgcgtactggatgttcccggggagcttggacttgtcctcggccccgtcgtcgaacacgcaccactgcttcgggaggtactcgacgccgggcacgccggcgagcggcttgtcgttgccgtggccggagaggtccatcgggaacttgggcttgccgtcgtaggtgaagatgccccaatggcgctcgaagttgcccgggagaatgctcttcatgtcctcgtcgaagaggccgaacatgtagacgtccatcttgccaggccggagcggcgtgccttccttcttggagagcttcttcaggaggccgtcgtagtagcgccgcgcgagcttgaggttggcgttcttgtcgccgtcggtcggccagccgacctcgccgacgacgacctttaggcttgggacgccggccttcttcagcgcggtgaccagcgtgtcgtagttggcgtcgaacacgttggagtagctgatgccgcccttgtcctggatggtcttgccgccgtcgacgaaggcgaactcgaacgggaagtcgtcgctctggtacaggctgaggaaggggtagatgttgacgacgaagggcgagccgtgctcgtgcaggaacttcaccatgtccgtcatcaggccctggatgtccggccggaacgcgccggaggacggcttgttgtccggcgagacgtacacgtcggcgttcagcgggacggtcgccttcaccttgtcgccgacgccggcctcgttcagcgccttctggatgttcttcagcgccgggaaggtcgtcttcatgaacgatccgttgtacgccttgagaaacggctcgttccccacggcgacatacctgctcgatcgatcagactcacgattaggatcatcgcggggattgcggccatggacgaacaccttggcgagcggccggcatatgcccctacttgatcttgagcttgtcgccgtagctggtgacgttctccttgacccaatcctgggcgttcccgtagctgttcatcgtctccagcatgtcgttggggatgccgagcatgacctcgatgccggagtcgacgagcgcgccgacgggccacgggtcggcgtcgaacagcttcaccttcaggatgccgttctccttgagcatctgcacgaccgacttgggcagcagcgggtgcgacagctgcgagccccagttcacgccgacgtccacggcgttgccgtccgccgccgcacgggacgccacggcgagcagcagcagcagcgcggccgcgccggccggcagccgcggaggcggagccatgccggggtttgccgtctcagctctgatcgatctccccgccccctgtgtttcggatcgatggcagctaggtgagagatgatcggatttggtggtgttcgcgcgctgcgggcctccctcccctcctgtggagaggaggacaaaatggcgggtaaaacggttggagtttgaccagaaaacatgcaagaaaagctcatcacctgtagacctttgttgaccacaacaatttcgcgtagaaaaaaataaaataaaacgaccatatagttgcatgcacacgtgttgtttttcaataaacaacgcaaatctttgaaaactggggcacgaatatgctgcacattggctatcggaagaataccaaattaacattcctaaaagtgttcctttgtgaaaacctacagctgcatttgttgttggatttaattccccccatatgtacaagttgaatttgattatgtactatgtttgcggactgatcacttcattgcaaaaataaatttgaccaaattttgatatttttatagggtaacaaactaaacaagattttaccattgcaaccttaccaaaatctatcaaaatttgactattccagaaccttccattaacaaaatgcaccaaattttagtaagtattaaactaaacaacattttcacattcattgacttgacgaaatttagcattgtcaatccttggttttaccaataaatggaagtagtaagatttattttggtaatgaagtgaataaattcgtcatttggaaaagtccagtcatcccttgaggggcaccttttttttcatgttgctcaagaaatcataaaaaaattatattttaataagataaattaatatgtgatacatcataaaaaatatgcaagttgatatttagcatatgtaaaatagaaataaacgataactttgactataaatagtatgcaccatttgctgtcaattttgttataattgtttatatgtgtaagtataaataaacaaatatagtgtcttaaaattttctttaatatttctatatatattataataaaaaaataataataaaagttgtttttttagattgtgttcttatccaaaatggtagttattattcacccgagggagtaacatttctcattgttaaggtcaagaaagccagaggacatcatgctcttatcggttaagaaatgcaactgtcacattgatcgtgttgctattagtttttaaaatcatgtttccttttctaaaataaattaaacagacacctacacatatcatatttggcagtatttctcactcccgatgcatagaatgcatagaatgtgttcaatgtttaagcctttaagatcactgtagaaataagatgggacccacgcattcttacgttcatttgcatatagcacatgctacaatgtatatagctttttcttatagatctttaagctgggacccactcattaaaaaattttatttaacatgaatgaaagagcaccatgcatggtgcaaaaggtacgaactaattttttatttcttacgatctagccttaaggttggctatagatatttttttcactttctcatctcccaatgtataaaggtagaacaaaaatactattttattattttgcatgcaacaccgtggatgcagtaatactattgaagtttcgaactcatcttgcctcctttcttcttcgccgcacggcaggcaagcgcctgcatgatctcgtcgatgccggctgatgctaccacagggatgacagcaaaaggaacaatgatgatagcagcaagggtagtatgcacattagcacatactcctattcattctagtgcaaaacatgactgcctcctggccttggaacttggaagattacaattcgaagaatcaggagtgtctagggcatgtttagttggcaaaaaaaaaaaaaaaattacccctgcatggcacatcggatatatggacatacatttatatacatttgtagtattaaacatagtttaataataaaataaattacatattccatcaggaaaccgcgagacgaatttattaaacctaattaatccatcattaacaaatgtttattgtagcaccacattatccaaccatggtacaattaggcttaaaagattcgtctcgtaattttctggcgaactgtgtaattggttttttatctatatttaatactccatgcatgtgtccaaatattcgatgtgacagcgtgaaaaattttgtttgggaactaaacaggccctaactgggcagtagaactttcactttcacactattggattggggcaagatactggtctaacatctatggtatacaaaggttaaaatttgagagaatctattctataccactgagtttgttcgagttcaatgatttaccattgatattgtctctttctataatataccaacgactttatcaattattctacagtacgccattggctgaaacttctattcaaaaatacccaaaatacccttagagacatacaagattaacaattgatttatctcatcagaagttttaaaaaaatatgaaaatttttatgtggcctctttacacaatttggaagtttgtatacaagtttcaagttttttcaagtatatttagtttttagaaaaaaaaacatttttaagtggtatatgagggagaatttgcttatacaagaggtaatagcataaaaatatcttatatagtgaatgaaagatgatttatattgaaaacaacaataaaaaagtattttatatagcatataacaaacaagttatattttgttaaaaaaataaaaatttagtaaaaaacttgaaacttctatataaatttccacgttgtgtaagaaagccacataaaaattttcatatttttttaaacttataatgagataaatcaattgttaaccttgtatgtccataagggtattttgggtatttttgaaaagaagacccaacataatggcgtattgtagaacaattgataaagtcaccggtatattatagaaagcaacaatatcgatggcaaattattgaactcgaagaaactcaatggtataaaatagattctctcttaaaattttcagcctggaactcggtgccaagctgactaacgtgaagataacgatatgtgaaaaagaaactggaatgcctgaaacgattaagctcataatttttttaaaaaatatttggttctaatatttggagggaggtatctccctttaaatcatttttttatagtttagaaggttaagtggccaaaaattgtttgaagtaaaatggactacctaaataggttgaggtagtaaagtgaactttttttagggtgtgtttgtcacggtcatgcatggataggatatggacatccatattttgttggacatagcgaaccaattttttgtttggtttgtatggataggacgactaaattttgtttggttagagggatataacatggatgggaaaagccaaaagtttgtgggacctatttgtcatatatacatatatgtatttatatttttattaacatataatcattcgagatcttgttttaaatatttaattgtaacaaatataatggtgtaaagataaatggtttaggagaaaaaaacatttagagcttgcttcacagaaaatcaaaccaaccacagccaatcagaatacgacatatcacccagaccaaaactggatggcttcatcgagcatattgagggaatattctatatttcggaccaccccatctaccctgccctctaaccaaacaccacaaaaattcagacgatcatctcctatccagactcatccatccaaccaaatacaccattaatgaatttgtattgtgcttatcagaggtataaacaagataagcgagagagtacgtgagcactagttttctcgatggatccaaagtaggaatacaagtcatctcgtagatcaaatctatctattatctatctacctatctattatatactaaaagtccattaaactttctacaaacgctcttaagctgccaagtaggactcctacaaatgctcttagtccgtcacgtgactccatcaaatctaaccgttgattttcacttaaatggtgaacccgataattttaaaccattagattaaactttccggtggacccgatattttaggccattagattacatatattttaaaaaaagaaactaattccttaggcagttacgtgtttatgtatacaggagaaatttgtacgtacgtacaactgaactaatgaagagaaaaaaaactacacacagaattaccataaaatcaataagaaaaaaacatacgtacttagtaccttgcaaaagtttgataatatttaaaataggattttctattatttaaatataaaacatattacttcataaatttacataaatatcaccgtcgatttttatttaaattggtggacccgatcgatgttttagaacattagattagatgcctaaaagtccattaaatttctcaaaaatgctcctaattcgccatatgacattctacaaacgttcctaaattgtcatgtgatgctataataaatgagtgaaattcttaaaaaatctgaaataacaaaaacatatttcatttaatttggtggacagattatttatagccattagattaattttcaagaaatgaaattactctcctaaacctaggaccacctaagcctgtatgtaaaaaacgaacgtacttatgtacgcctcctctttcttcaattcatttatctacattttcaccgattccttctcatattttcatgccttattagttagataagcaataattttgtgttaaacaagtaagcttctgaatcatacaactaatttctaatccgcgtaaatctttaaattatttataactaaatctacagttgaagaccatatttcactagctataatttagctttgaaaaaataatgtcattttggtttatattttattacttttgcatgccattcaagcaattataaaaaatataaaatactaataataatatagattatatcatcatacataactttataataattaaattaggtctataatcataaaagtaaaatgaatatactatgagtaatgtttccaaaatatgttagttagaaagcaaaattatgcaagaaaaaaagcaactatagcatctaaatccacaactaatatttgatgaacttatatctttagattattttacatttaaaggcccatatccactgtaatatcgacttcgagaagaaatatatcactttggggctatattttctaatttttgtgtgccattcgaacaattatgaaattatagaaagataatgatatagattttatcaatatgtatgacatcggaataattaaattagatatatatggataaaagtaaaatgaacctaaccatgagtaatgttttaaaaaactactccttcattataacattagaataagtcaaaataacattattggattgtagtgttcgtatttttcatatcttctgcgaatataatggaaaagacaagtaaaaatgatagattttaatcaatcaataaatcatttttcaatttttagttaaaaaagtaatagcaactaaaacattacaatccggtaaaaagaattattacaattatatgcacgcataatctctacccttcaacgctctctttctctactcactcatttaattcctttatctcctaatttttaactaagtaaagaaatatcaataataagaaatctaaatgattataattcttaaattaaatcataattttaacttatttgaatttttgttttatttacaattaaataaaatgtttaagatccatattacccatatttcactttataaaaaatgaaaatatgtcatttaagcatagacatcgttcctttgcatggtaaccaaatagaaaaaacatggaccataatacaaaatgaaaataagtattatattaccgtaaatcactggacatcctctgagcacactcaaggcgtcgcgtgttacaccttaaataaaaataaaactttacaaattggaagaaaaaccatcttagcatcagtttccacttaaataggtagatccattattttcaaccaatagataatcttttaagaaaatcttaagcaaccatgtgttacgtcttaaaaattagaaaaaataacataaaatgtgagaaaaaatatatcatcggtttcacttaaatcatttagataaaatagaaaaaaaatacccctccacttcaccatccccccacacatacgcacaacacggtactattcgcccaatcctttctcgtcttgagctctccactctaccccttcctgtttatatagccggaaataataaaaaattttaaaacttgcataaatttcaagctacacattcgatttctaatctagatattgttgtatttataattaaaagattgatttaaagatccataaagcctatattttgagctggtataaaatataaaataaagcaagtaatagaaaatgacaatagagactaaattaaactatttagagaaaacataatagttagtaaaaaattggttctcacatttcactaaaattggaccaacccattgcatgttcctttttcgtaacaattttaaaatgcttagacattaatgtccttacatctatcctatatcatagcattatgagtttcttcacatattattacacatacaaaccgcactaaggttcgcactatatagttcattgaaaagttatatttgttactattaaatttaaaattttggattcatattaactaggtattttcttttgaaaatatagtacatataacacaaatcgcaatgaagcgaggtatatgacatgtctttattaatttatatataagtatgtaaaaacttgcatcaacttaaaccaactagaaggagaactacttgatgctacaaataaatcatatttattaacaataatagttctttagaatttgttaaaaaaagcgagtaaacattctattaaaaagggacaaaacaccttacttctaatttatacttgatttattagacacattttccaaacaaactaaatcgaacttcattctatataataaaacgatcatagataattatttatatagatgtattaaatattatatattttaaaacctaacaaatatcttggaataattatcaaagcaaaatgccaatgaacagcggaggcctcatctgatgtgtcttattaaaaaatagtacttttaaatatgggaggtgtcagtctattgatttatatatattcaaacgcaatatacaatacatgcccgcgcgtgaatgggcgggctacctttctagttgtactaaatctagtccacagttattgacgccatatcccattggctaagtataaagtcaaactagcagccgcggtaattaaaatagtcacaaacagatctcagcttaccgcggtatatgtttcaagaacacgttactcaaagacaaaacttccattccccaactccaagcaacaagcacacccgtgccatggccgcctcagccaaccgcgccgccgtcaacggcgccgccggcagcggcgagcctgaggcgagccgcgaccatgtcatcatcttcccgttcatggcgaaaggccacacgctccctctgcttcacttcgccgcggcgctgtcggtccaccacaagagcctccgcgtcaccctggtcaccaccccggcgaacctcgccttcgcccgccgccgcctgccggggtcggtgcacctcgtcgtgctcccgttcccgtcgctgcagccgccgctgctgccggccggcgtcgagtcgacggacgcgctcccttccatgtccctctacccggcgttcctgcgtgccacggcgctgctgcgtgagcccttcgcggagttcatggcgtcgctgtcctcctccccgccgctcgtggtcgtctccgacttcttcctcgggttcacgcacggcgttgcgtcggacgccggcgtccgccgcgtcgtgttccacggcatgtcctgtttctccatggccatatgcaagtcgctcgtcgtgagcccgcacgtcggcggcggcgccgccccctttcacgtctcccgcatgccggaacatgtcacgatcacgccggaggagatcccgcctacggtggcgagcttcgccgaccccgacaacccgattgcccggttcatgatcgagaacgtcgaatcgacggacgtccgcagctggggcgtcctcgtcaacagcttcgccgcggtggacggcgactacgtggcctccttcgaatcgttctaccagccgggagcccgcgcctggctggtgggcccgctcttcctcgcctccggcgacacgccggagcgggacgaggagaacgacgaccccgagggctgcctcgcgtggctcgacgagagggcatcgcggccggggtcggtggtgtacgtgtcgttcggcacgcaggcgcacgtcgccgacgagcagctcgacgagctggcgcgagggctggtgcggtccggccaccctttcctgtgggcggtgcggtcgaacacctggtcgccgccggtggacgtggggcccgaccaggggcgcgtcgtcagggggtgggtcccgcagcgcggcgtgctggcccacgaggcggtgggagggttcgtgagccactgcgggtggaactcggtcatggagagcctcgccgccgggaagcccgtgctggcgtggccgatgatggccgagcaggcgctgaacgcaaggcacgtcgtggacgtcgtcggcgccggcgtcaaggtggacgccgccgtcggctccgtcgccgtcgtcgggagcgcggaggtggaggagaaggtcaggagggtgatggacgccggcggcgaggaagggcggaggatgcggacgcaggccgcgtgggctcagcgcgcggcgaggtcggcggtgagcgacggcggcacgtcacgcgtggcgttgcagaaactgattggagacctgcaggaaagctactagtatgtcgtcaccgcagcagaatgaggtgagaagaaattgttacaaaaattgagtttgaccataccgccggacagcagtatacacatcatggtttgactaggaaccttatttattgttgcttcagtatatgtgttgctttgactctattctaaacttgtttttatcaataatttatttgagattgctccagatgtttctaaaattcttctagttatcctcgcaacatttctcaactaaaattacttggactagtgtatatgagaagatattgtcgcaatatggagtttgttccaatgaaacttatttgtaatatatgtgtttactttttggaatatttagcatatcttatttttgggtgtatatactttaagtaacaattatttttatcttatagatgtatttatggatttttagatatattaatggatgatatttcttaaaaaaatatggctaatagaattgtttaatctaattaaagataaaattctatgtacttgtctcttttcatatgctttcttattttcattgaaaatgaattctacttgaaataagagcgcagttatatgcgtagtgtatttttaattagtatgtatagagtattttgaaatgtttaagtgtcgtagactaacgtatacttgtgttagggcaattctttaaagttttgttttattgcatgacttctcatatataagttttgtattatttgtgtttcctaattaaccaaagttagtactccacatacaactgggtgtgtttagtttcatgccaaaatttaaagtttgattgaatttgggacgatttgacagaaaagttggaagtttgtgtgtaaaaaagttcgacgtgatgttttatttttgggggaggggggttcaaggtttggaactaaaccggggcactgtcaatctttccgctgtctgccacgttcatcggcatcaatgcttgagctgaccaacccaatggctgctggcttggggagacaagaggaatatgaagattcagttttacatgtgggatattaattattttctaatatattttgctgacttagagcaaatttaatagtacagtctactactagctctaattcatctatagccgatctaatagccaattcatacaatagttacttactatacgattaatatatggtcccacctatcatacacacattgcatcttgaagtccgtgctacagccagctataaatctgtagcctgctactcttctctctcaccatttatcttattaaaatatgtttatagttggctaatagtctactattgtaactgctcttagatggccatgtctgtgctacattggcgaaaccaccatgcttcaggcaaggagggggaggttaatttgaacggttttaagagttgaggggtgtatattatacccagttctgaagttaagggtgtaatttagataactgctacgttatagttcgcgcggggggggggggggggggtaaaatggacttatccctttctttagggataagttagttattttaaattgaaactagcatggtggcctgcgcagattgcgcggctagcatcattatattttgtatcatataatagcatatatgttttctcattgtatttttcaaagatattaaaataacaacataattttaaattttgaactaactttacgaaactattaatgtgtaatatttatattgtattttatatacgtgttagttattaattattttaaatattaaattttagttatttgtaaattatatttatatatggactctatactcacctttcaatatttctatttttttaatttcgaattttcgttatctgtaaaccgtatttctatatagactttaggctcttcttccaatattatttatttttaatttttaatttttattatttctaattgtatttctatgtggactctaaactcatctttcaatattctttaatttttaatttcgaatttcagttacttctaaattgtattcttatattgactttagactcttcttcctatatttttaatttagaattttagttatttgtaaattatatttttatacggactataaactctactttttaattttattatgtttgttccgatttttagttagttttaaattcctatatggactctatactctacttctaatattccttatttttaatttcgaatttctattatttcctaattgtatttctatatggactctatactctacttctgatattccttatttttaattccgaatttctattatttcctaattgtatttctatatggactctatactctacttccaatattctttatttttaatttcgaatttctattatttcctaattgtatttctatgtggactctatactctacttctaatattttttttatttttaaattccgaatttcagttatctataaattgtacttttatatggactctagtctcatttttcaatattccttattttttaattccgaatttcaactatttctaaattgtatttctatatggactatatttttctttttctccgattaatatgagaatttctagatcgtgagagcgaacgtggaggctttcttttctattcctttaataagttaatagattccttgggatgattaatgcttacagtaaacttttgcgctcttcgacgtgttattgctctcattgacgggccatgaaacaatgttattccagggtatagcttcagcccagcacccggcccacgtaagacaacctgcgtgtggcatcacactgactgtgtcgacggtatcgtttgtgcaactttgtgctaaactagttggcgcaacggttggactcaacttggtccggatcggatcggagtatcggacagagtcgtcgacgtgctccggtgctgtgtgctccgctggccatcgcagattcaccgcccggccggccatacgcgtcagcagctatacaagggtgcagcgttcagtcacagcaaacctgaaagccggcgccagctgcatgttctcgcctgcgcttaattagcttacttccaccgctaataggaaagaaaactgtcggaaattaatgcttaaggagcctgctttggagtagtatgaccagcatattttccacccgtaataaacttacatttgtgatcgtgggttaccaaagttaccggtgaaatgagaaccctttgtacacgtacgtgttgtttgggagaacatcaataagctcggagttctaagttcttttttttaataatggaatataatatcccgacctttactcaaaagagctacagccaattattatatagtaacattcaagaacaaagtgtaaatctaaatgaatagaacacaccgtagagaaaagcaaagaatccagtctaacgtaaggagatcacaattattgaagtctatttgtaaatctccaaccataattagcaaaaagttgcataaccgtagtctccaattttcgacatgcaatttttagaaactcttcatcttctagttgtgcccaaaaccgaagccaatgagttgccctgaaaatgaccagcatataggaaaatgatggtgatttattaaaaaccatatcgttcctacaaagccatatttcccaacaaatgacagaagctccaataagtattagtttactcattttcttatcaactcacaaaaaccacccattaaaaatatgagataagctaactggaaaattaaaaccaaaagagaactgaactgttctccataggaatttcacaaaatgacaattcataaagaaatgttgaatagactcattcttcaaacaaaaagaacacttcaagctgccattccagttacgccttgccaaattatccttagttaacacaacccttttaagcaagtaccacatgaaagtttttatcttaagtggcaacttaaacttccaaatacacttatttatctcaatatagccattattaattaaagctaggtatatagacctcaccgagaacaagccattctgatggaaattccatctaaaactatcagacgaatcattcaactggatatgtactatagaggcacacaactcatgccaacaaacaagattctgactaactaaagctctcctgaaagaaacattaagcggaacatatcccataacagtggcaatagaagatgttttccttcgaacaattgcatacaaagacgaatatttatccttaaaagccaagttacctaggcatttatcttctcaaaatctaatttgttccccattatagacagtccaagaacccatatttaagaaagtacttttgacattcaaaattaggggggtgatggcgtgaggcgacctcctcggcggcgcgctctccctcctccctctcctcgagtggttccgccttgttgtggggccgcgcggtttcgtcgttgtctgcgaccacgccttttccaggcacgtgctatgcgagaaaggggctcgttgccgaggtatccaagttcctcttcggccgcttcgccgccgaccatgccgctatcgccatcgccattgcaggagtcaaagtcgaagtcgccaccgtggcctacttcccccgcctgccgccgttcccctcatcctcccactgccgcgagccgccactgccctcgcccgcctgccctcccgccgtcgcccatgggctgtcgccgctgccgctcggccaccgacgacgtcacgatgccgggcgccgggtggtgcaggtggtggtggtgcgagaggaacgacgagcgacgcgacatggactccagcccgctgcttcagctccagtccaatgccgccgtcgctccagctagctcccgccgccgccgccgccgctcgctccccacggatggccgtaggggagagggagaaataaagagagaagggaggggggaagaagaaagggagaagatggcatgtggggcccacatgtcagtgggccccacaattgtgtgtgtgaatgacaaacgggtcccacatataacttttttaattgaaatgccacctacgcgccacgtcagcacacagactaggtcgatactgccacgtcagtgaaaccgccctccaaaaccgccgagagagtcaaattgcaccggtttcaatagtttgggggttaagatatccggttctgtggtttagggtcacggattagattttgattacttttgagggtcaccaagtaaactttttccgccaatgtgacgccagcaacgagaatcaaggatgggaggaggccactgaagtagatcgagctagagaggagggcctgcagagtgggctgaatccaagagaaatcgtatggtgttcaaggattctaaagtgaggataattaagattgtctcacaagtgctactaagcaggttatctgcaacttgctcttctttaaaaataaaaagggtggacagatgcccttgcttaaacacctttttccattagaaattattaacagggaatcgattgcacaattgtctgcaaattgttttaaagataaaaacggtggacagatgccctttcttttctgaacatttcatgtactctcctccactgagaacacaggaacattctttcccatgataatacagaagtacagttatgggattcccttaaaaatgaatacgtataatgattagaaacatgggatggacataccaaaatgatgattttcgttgttttattttggttgattctggattaaatttttggatgagtaaagagaagggaggagggatggaggatgatatacgtgccttttggcgaatcagctcaaggcggggcaacactattgaaaaggcagagaacggtggcagcacggatgcaggcgacggacggcgcgaaggagaagggagaggggagagaggcgaggggagtcgggggacgacgtgatggagagactgaccagacgggcggaagagaacggcggtggcggcaatgggaatcgatcggtggcggtgcgacggatgttccggcggtggcgcagaggagatcggtgaagcggctgtcgctggcgatgtgggcgagcaagagtgagcggtggcggcgggtggcgattagggtcgaggggtgggagcgggaggcggggcacgggttggggtgcgatcgactgtgcgaggatggagaggtgtaggtcagaggtgtagtgtgtagagtccatcagaatcgttcaatcggatatagaagatgaatatggattgttggatttgatgaatcaggatcgtttagtcggatatagaagatgaatacagattgttggatttgatgaatcatgatcgttcaagaataataagaagatcgtactctgtaacaataatatatccattacaaatgaagccgttggcaagtgtagattatttatagtgatggtagcggcatagccgcacatgtttaaatcgatggatacatgtacaaccacaaccaataatgacacactcttataaccagctaccatatgattataaatacaatgtatcgacagcttttataatctcaaacaatagcccatcgtgccttcgggccggcccgactagtattgggccgtgcctgagccgtgtatgccgcccgtgggctggcacggcacggcccggtgcatcggtcgggccgtgccggcctgacaagcctcggcccaggcacggccgggcttgggccgtgccgtgccgggcggcccagatggccatctatagtctccatgcagtatcgtcatcttattatcttaaattcttaattcgttttgtggtgtgaagagtcacccaactttgatgacgacatcgtcgtagcttctctgcagctctccgaccagcttctgcagcgctacgcgcgacgtgccgccgtcgctcaccgccgacatcgccgcccgccgggcccacgcggcccgcgcccgcatcctctgcgccgcctctccgccggcgtccatcagcatcctgatcttctcctccacctcggctctcccaacgacggccgcgccgccgccggagtccaccctgaccccggtgccgacgatgtccacgatgtgcctcgcgttcagatactgctcggcgatcatcggccacgccagcacgggcttcccggcggcgaggctctccagcgccgagttccacccgcagtggctcacgaacccgcccactgactcgtgggccaggacgccgcgctgcgggacccaccccctgacgatgcgcccctggtcgggacccacgtccaccggcggcgaccacgtgttcgaccgcaccgcccacaggaaggggtggccggattgcaccagcccgcgcgccagctcgtcgagctgctcgtcggcgacgtgcgcctgcgtgccgaacgacacgtagaccaccgaccccggccgcgctgccctctcgtcgagccacgcgaggcagccctcggggtcgtcgttctcctcgtcccgctccggcgtctcgccggcggcggggagaagcggccccaccagccaggcgcgggctccctgctcgtagaacgcctctactggagccacgtagtcaccgtcaagcgcggcgaagctgttgacgaggatgccccagctgcggacgtctgactggaagacgttgtcaatcaagaaccgggtcaccgggtcgtccatgtcggtgaactttgcaacggaatatggtatgtcctccgccgtgatcataacattttccggcatgccggacacgtgaaaaggggatccaccgccggcgccgtgctcgacgccggacggcgggctcacggggagcaacttgcagatggccatggagaagcaggacatgccgtggaacacgacgcggcggacgccggcgtcggccgcgacgccgtgcgtgaacccgaggaagaagtcggagacgaccacgagcggcggggaggaggacagcgacgccatgaactccgcgaagggctcgcgcagcagcgccgtggcacgcaggaacgccgggtagagggacatggaagggagcgcgtccgtcgactcgacgccggccggcagcagcggcggctgcagcgacgggaacgggagcacgacgaggtgcaccgaccccggcaggcggcggcgggcgaaggcgaggttcgccggggtggtgaccagggtgacgcggaggctcttgtggtggaccgacagcgccgcggcgaagtggagcagagggagcgtgtggcctttcgccatgaacgggaagatgatgacatggtcgcggctcgcctcaggctcgccgctgccggcggcgccgttgacggcggcgcggttggctgaggcggccatggcagggctttgttgtggctgggtgcgcgcttcagagttgaagctgtccttcaccgatgttttttttttttttgagaactaccgatgtttttattatatagtaaaacttacgaagtaggttcgtattcccatgatcttcaacaacttgtttcaaaagaaacttttattctttaaaaaaggtattcctttgtctgaaattaaatatctgtacgctaaggagtaaagattatcatattcagccccactccggtgctttatactctgattagaaagcaatctgggccattgatcgtattttattgtagagctgagatctagttctactctcactagtattagtggaagtagaaatatgaaagggtgttttcgtcaagagaaaataatcgcgtaggggtattatcgtattttttcagtctcttactcagcctatcccgatccgattcctctcgcttcgtcgcaatttcaccgctgcccgtcaccattccactccatccctgcctccgtcgcatgtcctggcgcctgctccccctccagcgccgtcgccctcgcccttcctcgccgccctcgtccttcatcgccgccttctaccccgccagcacctctccgtcgacgtccgcctccccgcctcccccgctatcggcggcttccctccgtcgaagcccattactcgtcgccctcgccgccttctcctctggcggcgtctccgcgccggcttgtgagcccccaccgtcgccgtcctcctcccccgcccccttctccagcgagtcgcgtcgcgtcgccgcccctccacccgcctcagccggctctcgatgaggcctcttcaccgcgtcgcttccccccgccaccgccgccacgttctcctccccatggaccgccgcccccttcactccaccgctgtcgccatcgacctagccgccatcgcggctctcccctccccataatttccccggccccttctccgtggacatcgacctagccgccgtcgcggctctcccctccacatcatcccccgcccccttctccaccgtgccggtaccgctggcgtccccctgcaatcgccgtccccttctccagcgagtcacctcacgtcgttctcttccgcgccaccagcaatcccgtgtcgatctcctccgagtctccctctagcaacctcctccttggatggtggtaagtaaacatgtcaaaatttcttactgttatgattttgcagattaaggttgtttgttcttcaatccattgtattgttctttgattatttgattgaatggttgggagcagggtcagtttgcaagatgttggcatgcgcgaagggtatccgcatgccggcgaaggggttatcggagttgaggtgcgacgttgaagcagatgcacgtcggtgacgtcgacagcttactgccctgagtcaccccgaagcgtaaggtttcatataccgctccttctcaacaagtattcaaatatgaaatatgaatattatctcaaaaaggcatcaatgtttgggatccgtcaaatacccaagtagtatgtaaatgatttaataaggggaagagagcatagtaaggtaattgtggtaaatgttcgaaagataatccagttatgtcgtggttggtagcagtggacgatctttaatgttgttcagttcggagttgatcaaaattccggctaagtcctgtcgaaatgttttcacttccttctgcataatgtaaagggagtgcactttaaatgatttttcatattgggaagcactggtgcaaaatatgaatagaggttgttgtagttgcctgtagttgaatttctgggagataagatccgctccaatgctccatgaacttaagggtgtacaggccacacgagacgctacaagaattttgtcgttaggctaacacgtttccgtaattgaataatgtgaatatcatgtggaagagtttgagtcacccacccgtctccttgctttggcaatttttggactttgttgtactcccattcggtaatattgaaattaggccaatcgtgttttaactgtgggtgctgtttctctgtcccgtgtaatcccctctcgatagctaacagctaggaagttttgtgcaacgttggtaccatctttactgattggctttgcgagcgaatctggtatttacacctcacgtcgcttggcgttaataacggctaggtaccagtgtgtatctttaatattaattgggaggaaaatctacagatgttcaacagtaagatagagtcataaattgaattagccattacatagatagcttaagtaagtattaccatgtcaaatgctagatagccgcgtgccatatctctaatccatcgtttatttcgaggtttgcttgcttcgacatgcactccctctacatttagtagacttattttaatggccatctctaggaaggccttgccatctcccctgattcctttcactttatagcggaggcattggatgtatgcatccatgacctgaatttgaggttagttgagttacataacaaatatagttataaaagaatagtaggcttgttaaataggcgaacttacatcatcattcaagaattctggttgtgttagtactttcattcttatccatttaacctccacttgttcaatatgcaccatcactttgttatcctctgtgttattaatgtaggtaatgaaagggtcttcttttttagtcaactctacgaaggtaggacaaattagtaatagatctatagaaatgttaaatggttaggcattaccttctgaattttttaacggtgtctagccattcatttttttttcttcttttgacctcttaaggcgttctttggtgggccattgtctatgatttgttgggtaagatcttccttctcgatgtacactagaatagggtaagtcaaatcagtaacacacaaacatagaatataagtaaaaaattatggatgatgtagagagttcatacattcagatatttcatacggtgtttggttgttttgtttcctcttcttttcaccccgtaattcgtctgtgtctggcatgttagcttctttatccgtttacgcttgaaaaggaggaaagttagtaccatttacatgagcatatgtaactattaaatagcatagtacctattgttttctttgtctgtgcttgggttctgattatgtccttctttttacccctagtttcgtagatgaagtcagtccgattagtcggtttgtatgttcttccagtaggacctgtaagtctcttcctgctttgattgctctggttactgttgtcctgttaggtaacaaagtgcacgttagtattatgataagttgtagaaacgttagcgagagaattaaaattcagtttaccttcgtttcacaagtcatgttttcattttggtttatatagtactcttcgttatgatttgatacatgctccctaggatcaatttgttcttgttcaacatcctgcaatagcgtcaacctttttttagcggtgttacgtgagtaataatgattaacagtctagcttatcatctttacctcaaacacatgcgtagtatcttttcgttcagggcattttgaatcattttccatgcaatctagtatcaatgctcgcatacgtggccaaaaatcctttgtgaaatcgttgaaattatcttgtaaagtttggatgctttcttgtatcctttcttgtaaagtgatatcggctgattgttctgtggatattatagagtgtacctgaataccacaagtgagaaaaggatgtcaaacatattttgtcaaatagagttcgtattaaaaccccataatatatacctcttcagaagtgcatacaaaatcttcattggtacgtgtttctgagtcattgtcgtgcgcattttcattggggatttctttgcaatctatagttcccctaatgtcgtcgacaacctatgttttagtcaaaaatgtgtattagagattttacagacaattgatataattagtgtatagtattaaaaatgagatagttacctgcccttttccaaaaaggtaaaaaagtcgttttttttcttttattttgtcccagtactgaattagttgcctttcgcggccagaatgatatattgtcacagccaatttatctattcgcagtttttcccaataccaaatctgcaagcatttgaacataagataatgagtattgctatgaaaatatgttaatgtcaattttgtaaacatactcaatttgtgcattgttttgaaacgaacctgtaagaggcatacattcccctcaatgtttgtttccttctctctaaattttaatatgcctttcagtaactgattcagggttagactagaccagtttagttccctcattttgtcaacgtcgtcgacgagattgagatatcctgagcgcacatatctttgagttgtaagacatatgaaggatccaattgagaaaagaataaatcttcgaatgaagtggtcatcgtagctcgaggagttgattattgctacccgtaatgcttctaaagtaattgttgtttgtccttcttttttgtacaggttgaacaattcaggtttattgatttttggtgcctcaaatatctcatctcctttcgatggcagtccaagcaaacaatcgacatcatcgagtgtcatcgttacgaacgtaccattaatattgaatgctttcttctccttgtcgtagcttcttgcaatctcattgcacaagtcccggtaaatatgtattttgttaatctttagcaagttgccaagtcctgaaacctcgatagctttcttttgaggtggacttagatgtagtattacctcggacatggcatgtggagagcaaactagagttccctgattaacagaaaagagaataagagtttagtccatgtgaaaatttatgcaattgcacatatatatgattgcacattaccaaacctagagatcatttaatcctgctagaaatcaattagaaatcaaaggaaataatgcaacaaacttaagctgtaatgtatgcattaatcatttttttatcctttacaaaaatacatgagaaaagaaaagaaaattcatgctctggcatgttactcgtctgacatgtttaagtgatgtcctccatcactgttctggcagtctatatggccctctctataatttgtttaatcttcattcttatgtgcaggattcagtgaggttgaggagtttcaggggagcaacatgagtgaggtcttcgagggcaacatagtactgtcaggtctgtgccaccttcacccatgaccacatccctcactttggtttgaaagtttgatagtgtgaaattctgaacatgcagtggctaatatagatcggtcgtcgaggcgtggtaattatattgaaatttccaatcaattctaacatatattcagtataattcataagatctcaattgggttgacgattcaacaaatataaatcagattgtctggatggaatatcatgcattattgagtttctatgctagatggtcacagtgtgtctgtgtgtggcgtagccctgctattttacttctttgatcatgaggccaacatttcattcaacataaatatgcactgcatgtttccaatttcattgctcatgaggccaacatttccaggattcaacataaatatgcactgcatgtttccaatttcattgctcatgaggccagcgccatagttcagacagtaaaaaagacaggctcagaaagcagtacaatcgtttctaagggtttgaattgttgtagtattaacaaaattaacaaacagttggtgctaatgaagtgctgtagtgccattgagtctagatcatctccgcacattgttggctgaaatttcaacttgtaatcctgcataagccgtctccgaagaaatctaagatgtgagcttcgcattgggaggaaatctaagttatgagatgttcttttgtcaatgagatgttttatttttaatattctaagttagtttgcacggatgatcatttagaataagctagttgataaatatttattaaatgatacactatttggatatttattaaatggaactatattccaaattggtcagttaaaagaacatgatttcatcagattggctggtcagatcatatgtacagtactaggctggatctctgcatgctcacaatcgtgatgtcccactgtgtttttgatcgcgtgagatcgattcgccgtctgtctgtgcggcgacacaaacctatccttcattgatgcttcttctccagcgatctggagtacccatctatcaaaggacacaaatggatgtgcaaaatcaccatgaaaacaacaagaacatactatgggacaaaaacagtatatgattttctcactataagtatctgtagtgaaggtcagcaacattactagcataaatgctaaaaacagtacagtgatacaaaattatgatatatgtgaacttatatacaaaaacctaggcgatgaagataaatactacccttagcctgatagaacaatttcctcaacaaaatacagaaggcctcaggttttatgacgctttgatgttccacctgtgtgctgaccgtggaccacgagtgatcccctcataatattgggatggaagctttcctttgttccaagttttcacaaacttctcaaacagatcacgagcagactccaaagaaagatcagagaaaaatttgcctttttcttccttcgaccaggttgcgaactcgttgttctttgcaaaatattcatctttggatatttctttgaaatcctgtttaagtaaaaacaaaagaacaatgataagcatggtctcaaggagaaaggaaatggagagttcaaagggtgcagtatgacattatttatgttttgaacagtttaatacttccccaaaattgttgttagtcttaaaaatataaatggcatacatgacacaactgctgtccacctctccagatacagataagccattttggttcttgtgaactgtgaccttaaacaagtacctacttggtatcactaattttcatcacagacacacaaaaggaaataaccttcaaactgatatcactaattcaattcgatgcaacagtaaacaaaagcttttactttatattcagtcttcagagacaaatacatcctggcaaggttctgaaaaatttcattgttcaggaaaacaaaaggggctcctaatcaggctgggtaagatggctacagaacatatgccagcacggcgaaaaaaatggtcgtaagaaatctgcgataatctatccctgattcacgtactgaagaattaactgaactagggacatgctccagtttggttctacttgtaaagaaaaaccaacctcgttccagtaccatagttatgcgaagcccaagcttgtagaacaattcatatatgacttatgttttttttgttgttttacaaaaataatttcatgtattctatagaaagtgcacagtaagcagtactgaagtgaactagtgatgctggctttggttgctattctatatatttgtaagatatgaaatatacctttcgttgctgccaaaacctgatgattccctttctcttcagtgtagacacttcttttacaagcacagaaagttcatccaatggctatttcgaccggatcgttgcagttttgatggcagtttgtatggcaatcattaatttagttcggtcagtaaaagatcttgctgcaaagagattgccagataaaaacgagtcacaacacaagtattcaacattatatccagactcaatgccaaaagagtaattccgaccaccttccccaactcctggttttgttgaagctggactattttcgtcagtcttgcaaaggctggtagatcttgaagagaaattcctgatgcacaagggaaaatacttaatatgcacatcttgagaaaatattaaattaatccaacaaaaaaacaatgccattaatacaaaagatacaaagtttgtgagccacaataaccttattggttatttgagtgcaaggtctcacggaatggccttcatctcttcgatggagctccttttcccctaatttcatcaggatcaaggactctcttctctaatggctggttactagataaaaagtgagttggcataggaccaaattctccggccacgatgttctcatgggatgacgatcctttatccaaaatcccctttaagaaatccatcgtcttttctgtctgctcagggttcctagcggcctcaaagaaagcatcacttcccagatttcggaggctacgataacgaaccatgtgttcaaaccacacattaggatcggtattcctgtatgacctaaatgccgcctttgctcccattgtccacctatccacgacacaacatcgagggatggtgtcaataccaaggaacatgagtacaacaaaaaatgtgtgagcaagggatgtcttcgcactccatcttccgacagtgacactccacaccttccaaagactggcctctaaaagtaaccctcacttcatcccacacctcattatcatccttcaaaccaaaaacatacagtgacgaaccatcttgattagtcccactgatgacttcaagtccagcaattagccgtatctgtgcacgaactttcttgaacacgactgctgtgtatatacggacagcgtctttctccaatgggtcggcgtctattctacaaaaagggaccgaattggtagacttagcgtccaactgagcctccttcttacgcaggcgttgtatgcacaacttaacatgtttgactaagcacattagtgacatgtttctcttcagaagggtgtgaagctttgagtttagtgactcactacgttggttgctgcgcatacccaacaagtatttcccatctgtataggcagctgcccacttctcccttagtcggtacatcgatcagggcgatccattgaccattccccgtgcctccattctccttaaaatcagcccaacgtctctcgaactcctcctcatccatactcttataaattaattttcttagctcatcgagttttggcttacgaaggtgatgactcatattctcctctatataccaagtacacaatctatggtaagcacgcggcattaccttactgatagccttcgccattgctaggtcgccatcggaaattaatgattttggatgcacttgacgcattgcctccaaaaaagtctcaaggagccaacagtaagagttgacagactcattggatagaattccgcacccaaaaattgttgtacttctatggtgattaactcctatgaaaggaatgaaaggaagattgtacttgttcacacggtaagtgctatcgaaaataacaacaacaccaaaagcagcatagtctaaacgtgattcagcatctggcccaaacacattcctaagacgccctccctcatccgtggtgtatttgaggaaaaattatggatcttcttcatgcttccttgttagatatttcaacacatcttcagcatcacgacccttgatattcttcatctcgtaccgagtaaagaaattataaaggtccttcctcacaaaaccaacctcgtccaactcatcgtagttattctccataacctccatgatttgaaaggccctaaggccactcatgcgaagctcgaccgcttgggctttcttagaatcactcatcacacgatgaactccttaaaaaagcaacatggtcaggatttgcaagttcgtgcgtatgttggttatcaaactccttaacaaaccacacacccttctcctcgttccgctcaatctcaagcttagctaagcaaccacagcaggtcagtgcccgtggctccctttttcggtctgtcctctcaaagtgcttcaactccctgtacccttcacatgagcatacgaattgcctccatataatctcaccgtccttccgcttcaagttgtttttcctcacactgaaacccttccccttagcatagtctacatagaatttgtaaccttcctcctcgcttgaaaaaaccacagtacccattattttatactcttcctgatcctctaggctcacatagctcgaagacattatgtcagacctcacctacggaaaagtagaaaaaacaaacagaacaagcacccaaatataaccttatgtcctttatacctcataagtatataaaaaaaaagaacaaccatcaactgcatagatacattgccactctaaactattgaacaataattactacagatcccccacaatggctgcaaattctgtttgtaagctaaaagaactaaggcaagcactaataaattaattcaatgtactgctagtagtactgatgaactatctgcacaagatatgatttaacttcccacctttgctgaggtttatctatgtagattacattctttccatgccctttaactttatccatttcagcattgaagcgtcaaattgacaaatactctaactacagaccatgacagaaaattgggcagtgaacaatgaagtatcaaattgcttatacttgaataaaatcatgtgaataaacagatgtgtgaaacatcatgtcaagcaaccatgctaaattattagtgcaacacatataaaaggatctcttgctttgcagcacaagcttgaagaaaaaaagcagcagcataaattcaaaccagatgatagcagtgacaccgacgagggcagtggactgatctgagaagactctcaaacaggagatttagagtggtcctgcaaatgtcccactctccctctgttcattccacttctcaacctgagacaggaaaagctaatgatgaccaagaaaaaaactaaagtgtggttcttttaacagctaaatttcctagtcatgcacaacagtaataacttgtaaaacacacacacacacacacgcacagagggcgagccaatgcggtacagttaagaactaacacacataacagtcgttgacaaactgagtaaatctccaccgtattctatagttcgtttatcagataaataattttgcacaagccacatcgttcacaagaatcaggtcatctttattgaatcctaatgattcaacattggcagatatgtttttcactcaaagatgcattttgcacttgctactctgtaggacatgttaacatcaccactgaagcatcaaactgacagaaacgaatcaaatatcaatgtgtataaccaaatataccgaagggaatgtgctgttttctacttctgaccagtgatgtgatatgaaaacatcgatgggaaacaactaattttatggactggtatttacaaaaacaatagcttttaaaatccagaagaaaattttcagatttagattcagcaattcaggtaacacattagtcccatttcggcaagttcaactgctattgaactgaaaaataagatttccccgtttatattcaagacatcaactataattcttttactgttaaaataatatattaaagtcaccactgaggagaggaaagggaacagaaagtcaggttgggggggggggatgggaagagtggatacctgatgatttcgccgcacccagccactagcagcgccgcaggccacgccgccgcctgcgtcggacagacgcgacgcaccgcgccaccagccgcgacgccgcctgccaggaggaatagccgccgggcgcgctgccgcctgccggtgcctgcctccgaccagatgcgaaccgaagggggaggggggagatggccgggccgacggacggcgccggagggactggagacggcggcgagggcgggaagggcgggggaggcggactgcgacggagggggcggagaaggcgacgcgggcggaggagagggacggcgactgaggaggcggacaaggcggcgacggcgagcgatacggacggatgcgggcaaggcagcgacgccggggaaggaatagcctacgatgtgaaccgatgcgaaccgaagatgcgcaccgaacaaaacaccccttaccaaaattacccctaaaggatattagaagattacttatctaccctttaaaataaacggtccagattaattctactcggagtataatatttcaagtatattgcaccggagcatcactctatcatattatgtgaaattgatgcgtcaatataaaatgctgagatccaggcatcttttgtgccacttaattaattacctgggcagcaactagtattagctagcaagtgtgactgtcgattgggctatggcctgtgaaagtctattattactctcttccaattagatcgagagtgaaaacactgccaactactctcaatagaagagagaaacgaaatcaaagtggtttaagcgattaatcctaaaatataagtatttttagactctgacacagtcttgaagatgctactttgatcaataatatctataaaaataattaatatgttttaaataaaaaattacatattataatagtttgtttaatgataaatttagtaacatcaagtttacatgattgattttttttctaattctgattaaagttgaaaatatttgatttgtcattgtgtttaaaatgattatattttactatgaagggggtagcatatatgtaataataattaggacacaacagcaataaatgtaccatcccgagatgagatagatggttggtactctcttcgcgaataatataaggtattatagatagaaagagtacgagatacaagaaacacagaatatgacaaaaacctaagttggtcggtgagtgatggaaataaaaataaattgagagtgggcggatgtagcattgccgttgtatggcttgttttatacggatcaaatatttgaattaaaatttgaaatatatattatttttctcgattttatatatatatacatgcttctaaatattttacacaaatatacctctcctgtaaactggggacgcggcaccgcaccattggctcacatcaaacatgtgggaccgattaaagaggacggttccgcggcgccaacacgcgcgactgtcacggtcccgcaccaaccagtcagtcgcgcagaacgggcaggcggcaccgcgggtgatgccgcgtgaccaatctgcgccactgccgcaaagtggccatacacatatacacattcatatatagcacaacacactaattagctaatgctatgggcattaggaataagtttatttgattatgtacttgatcgtttgcatttggcgtggtgtcgctcgaccattatgcgggatcataatccagtcccacgtttcaacctcatgccatcgtcactcccttccgttcccattggtcccgcatggccatggcgcggcaccgatcctgtgccgcccggtcgtgcatgtgttggcgccgcgggaccgccccctacagccggtcccgcgttttggaggtgtcccgccttttttaggtgccccaacgatacggaggtgcgccaacgatacggtgccacatcactaatcaacgggagaagtatatttttataaaatttttagaaatatgtatatatatatatacaaaatcgagaaaaataatatatattttgaaatttaattctcgaatatttgacgtgtgaactgcgtcgaagttaagtcaggctcaattgttgaacttatcgtagcattaattagttctgtacgactataataaaaactacggttgcatttcttaataaccaatatgaccatgctagctagcatggatgggcttaacagtgagaaataaaagccattggtcagagagagcgtgattctagcatgtagctaggatatatagatattgctttcatcgttcttctgtctgggaccaaccctcttaaatgaatccacgggtggagaaaggagctttactcccggttcgtaaccccttagtcccgattttcaaaccgggacgatcaatccaggactaaagatcactatctttagttccgggtgaaaaaactggaagtaaaaatacatctttagtcccggttggtgttaccaactggcactaaagatagagcatttttagtcccggttggtaacagctagcctagctagctaggtccggttgctctattattattttcttttcttcattgtgtttttaatatattgattttactctatccccatcctaaaataccaaataaattatccccaatcctcaagtccccaaatcggccatattcaaatagatcacaaaattttaaaacaaaattacatcacaacttctacaaaattcatcacaaatacatcacatattcacggacatcacacacaaatcaaatacacagatccgaatcacaaattcttaaaaaaaagaaaaaaaacacaggctgtcggccgctgccgcgccggccgccgccgcgccggccgccgacgcgctacccgccgcgaggccccgcggtccgccgccgcgccgcagcgccgcccaccaccgcgaggccgccacccgggcctccgcccgcctgcgcgccacctcgaggccgccggccacccgatgggatgatggggagggaaggagaggaaatagaggagaagttagagaggaggaagaggaagggatgatgggggagggaaggagagaagttagaggagaggaggaggaggaagaggaagagatgggatgaagagatcaggtcagtgaatgaagaggtgaagagataaggctgcccgtctcctcctcctcgatctcgcagatggcagatgcctcgtactctccgccacgatcttttgtttcggttggtattaccaaccaggactaaaaatatatcttttgtcccggttggtaacaccaaccgggattaaagattaaaaagaagcgttttttcccggatcgtgttaccaaccgggcctgacgaacgatctttagtcaaacgggcataaagaataagaagtagctgctaactttttgaaccacgactaaaaataatctctaatcccggcttttattgcaaccagtaataaaagtggattttgactaaccgataaacgatgggttcaccaccagcgatctatcttcaatattagactttctacaaacactcttataccgctatgaggcaccctacaaacactcctataccaccaagtgacgctctaataaatttagaattctaaaataaatctaaccgttagttttcatttaatctggtggacccattattttttaccattaatctataataaaaataaccaatctgatttatcttaaaaaggcccacgtaacccacgtatgtgcatgtacgtatacttcatgcacgggcccacatccatcttttctcttttcttttttcttgttcgctcacaaggataaaaaccgaattaattattctagcccatagatattaactacagcctatatatatatgcaaaaatatatgtacgtaccaataatatattatattttttcatatattatagatattacgctggccccacgtccctccttttctttttttttctttttttttgactcacatgacataaaacccaaattaatattaataattatatactaaaagtttattagactttctacaaacgctcctaaaccgtcatgtggcatctacaaactactaagccgccatgtggtactctaataaattaaaaaaaactataaatcatgagaaaaaaacatctaaccatccactttcacttaaattgataggcccattattttaaccgtcaaatttaatctcatataaaaataccatgtacctttcccacctctcccccttagtcgttatgttctccctctccccacgtacacccctctctctccctcccctctatgtataattcatttttcctatattagttaatgggggaaattcgatataaaaatttcaacatttgtaacatctaaatcatatatataaaaaaataaacatctaccctttaattttttattaaatttagtggacataacacttcaagccattagattagatttattttttctcatccttaaaaaaagacatccatcctcctctccgttttctcttaggaaatcctctatgtttttttcctcccattctctctttatgaaagcttttgcaataataaattttaaataagaatacttctaaatatatattatttgcaacagtaaattttaaataatactaaatttttatcttttaaattatacgttcaatttttgatctatttgtaccattgtattatttatgattaaaatcacaattagaatttaagacacatgttgactatattttaacttgtaaaattatattcatttaagttttgttgagaccctttacatgttattcaaacatatatgaacaattattaaagaaagtgacattatgtactatttcatcatatatcacttcaccggcatgcataactaaaacagatttctgaactttaaaaagttctaaaaattctgaattatgagaaaaacaaaatataggttataccataatttgatgcatcacaaaatatgcataactaaataatatttacttaaaaaaatatttgagtcatatcctagctgtttgtccacctatatatcattccaaccttaagatagaaatgacctattctgcaccgaattctacttgataaggcaatataaattatatggaactaaagataaagctattttttttctgtataacatgataatataacggtaatgttcagcttcagaacaagcaagcaaaagctgcatgtgtattgccctatgtatctatatagtatatatgaaaaatccattaaacttcctaaaaactctcacaccgtcaggtgagactcctaccaatgctcctaagttgccacgtgtcactctaataaattagataaaaccttacaaattttgcgaaaaaacaaaaaaaacccaaccctcgattttcatttaattcagcggatccactatttttaaacaattagattagattcatttaaaatacatctcatataattatatatatatatatatatatatatatagagagagagagagacgcacacacacgtacttttgtactatactactcacggcaaaaaaaggaaaaaaataattaccaatgaaaagaaagaagggttaacgctgccacgatcccacctaattgctacgagagaaatgtatatacgtacggttcacccaaaaaaattgaaaaaaatttctcacatgtacaatacgtactactatccatcgaattgagaaaaaaaaaccccagacatgtacatactacgcaccatccacccgtccctaataaacttatcaataatgttggatattttcttgagaaacatagtacaaatgcagccgctcacaacgcacgcacactcacccttacgaacgcgcacgcacacactctacccctatgagtacctctgagagattggaccgacatattttgacattgacaaagtcaccatgagtgcctcgctgccgatgggtacgtcgtctaccactgaatgaatttgtcaagtctgggacttgaacacgagtgggcaatttccatcacaagaaacctaaccagttgagctatgttcaattcaaaataatgttggatattaaacaacctaatttttaagctacatttttggaatactcctatgccttttaaaccagtgaaatcattatttttaatcattagatctatcttatataaggaaaacaagcgtgcattcatggtacatcacatttcaaaaatattattgttcaattatattcacgttaggttgcgtagaacctcttgcccactctacatgaaatgtttatagatggattatctctcaaactacataaatcgtattaggctatataaaatttagtggagcttcatgtcccaccaaattcatcctctaataaaccatgataatatatatgcaataaaaaaagaaaaacacactacttttgctttgcacttacttttactttcgttgaaatattttctaaagaaaataagtctaccttcttttcaaatgatgaataagattataaataactgcatatagatattacttaaatatgatataatataaagctaatatgttaaaaattataaaagcaactaatgctaacaaaaatcatttacgaagaaatcggggtagacgttctccggttaatatattagttttagtgtctcaaacttagcgtacgacgtatacccgcgtattttgcacgggctacctagttgctggaaaaaggcctctcgatgttacccacctaatgaaggatcgccccatgtaatctgatatgatctgcctaaggtccgtgcatacagcacaatcaatttccccttatttctgcacacaaacatgcaggttattaatttgttgggtggagtattacttattcctttattaagagaactccaacacgtatttctccttttgtaattgatgcaattgtcagaccgttttgtacttatataaagagtatgtacgctctctctgtccatagaataactgacgatgcacgcaggcacacatgggatgaatcgatccctccaaagagtggcggaatcaggattcttaggcctcaactaatgtaatttacatagcttttcctttaattttctacccccttcattttaggtcataaaacactttaatttttgtcaaagtcaaactactctaagtttttgactaactttatagaaaaagtagtaatatttttaacccaagacaaatatattatgaaaatttattcaattatagatttaatgaaaaagtagtaatatttttaacccaataaaaatatattataaaaatttattcaattatagatttaatgaaattatgctggtgttgtaaatattactactttttctagatcttgactaaagttaaaacatctataatttattcaattataaatttattcaattatagatggagtattttacgaagttttaaagtacaattctaatgaatatttagactcaggagtagggctacagccctaattgccctactcctgtctccgcccctccctcgaaaggaactttattaataagttactatagaccatccattttacaagaaccaatgtacaaatatcctatctataagcatcctcatttgtaactaaagtataatcatcaatttttccacatgcttccatctcagctccggtgagaacgccatagacggtagaggggcttggactggagctgcgagagagattttccacaatccgcttttggggggcgtgaggaacattgaagccttcacaaagccttcacatattttttctgccatacatagagggaggagggctttagatttgttttagtttcttcggaccttcctattatttattcccggatctatcactggagaccctcctattatttcttcctggatctatcactgcgacatgctgattcttctctcttactaaaggtgaatacatgcgataggaaaaaatgcatctgtatttctcttcaattctcaccaagttttctccttttttactcataccatgtacaacggtagaaacgagtatgatatctcttagatgattatttagagattatatatatagaatagttgaaacgataaagggcctcacctagagttgcttcggtaaatgctttatgagtagaagtaacatttagcatcactacactattcacgtgcttgacctttgagccacacgaacatgttatattcgatccagccaacatccgggcgatccccactggagcggagacagactacggccttgacccggcgaagctgctcgaggtgatgcaggccgacgccgacgctggtctcgtgcccacctacgtctgcgccatggtggactcttccacctcccgcactacgactcggccgacgggtcgggctcccggcagaaggggtcagcctcgagggagaacgcgaggcagtcggcgcagatgggcgtactccggctgcgtcggcgggagctgcgtcggcgccggcggcgggcgctcagaagcattggggatgggagaggggagagagagttgaggagagggagatgggaagagaggaggaagaaaggggctgagaatgactcgtgggacccatgtgggacccaacatttttataattaattcatgtgtgtaactgacatgtgggtcccacgaagtttactatttgtccgggtcaaattgccacgtaagcgttacgtcaatgccatatcagatgaagaccaattcaaattagccacgtatgcgccacgtcagccaaaaccaccgagggacctcatctgcactggttttgacatttatgggacttttgtatatggttttctggttgaagtatgaaaatcggattcatttacaagttaagggatctcggatgaacttattcgtttcggttttggggatcagcacccagcccaccagtgccaacaggtgggctagcgctgcggcctacagcttccatcctccgttgcatgcttcatcgctggcaggggccacgagcccgtgagacgtatccgcgcgattacgaagcggaggacccgcgcgcgcgccgcgcgtgagccgtatacgcgagcgcggttttgcacggctttgctgatgactcgtgaccagccgacgagacgcatgacgcgcccatcgatcggcgcagtcgtatcgaatatcgatgaatcgatcccgcgtgctcgcgcgtactacaccggaagcggatcgatcgatcggggcgatatgagaactagcgttggtgcctggtggtgtgtgctagtgggcgattcgattggtagagctaagctagcgcaccagttgactccatgtctccatcggtgcgtgcgagctgatcgatcgagaggagagtgacacgacatgatccattaaaattgatatatttatgccgggcctcttgatttttcagttcttgcgcggcggcgtgattgtggccaacttaaccttgactaaccggagaaagtgagcagaacagcaacggcactaccatgcctatagatagattcctcctccatgtacgtcacaattaacgatcaagcgtgagtatatttacgagaaaagtcactaaaaccaaaaacaagtgagaattctgtgagcgatgagcatagaatagaccagagcaatattactatgttaggctaaaaaataaaggtgatcaaatcgaggggcccaattaatctcagctcaccgagacttctataaaacccggcttggctccatccaagagttgtcatcacagcatccgcgtgatcgaccagtcggtcgttttctcggctgtggttgcacgcatggcgaccttcactggacgtaccagtctcctggccacgctcgtcgtcgtcgtctccgcggtgatcatggcctgctccgtcgacgtctgccatggcgcccgcgagggtcagatcagctttttcattttgacttcacttgctactactccctccattttcaggtttcagtatataaggcgttttaactttggtcaaaactattttaagtttaactaagtttatagacaaatataataatacttataatactaaattaattttatcaaatcaataattaaatatatttttataataaatttgtcttagcttaaaaatgttactttttttttacaaatttgagcttaaaaatgttactatttttttttataaatttgatcaaacttaaaacagtttgactttgactaaagtctaaacgttttataacctgaaacggagggagggagtactttattttgatcagtgtccagtgtatgtgtgcctgtgtggtctaacgcttggatgcatgcgcgcgttgatgcaggagcattttcccgtcctgatccagcgccagctgatcaccgtcccaaagacgacgacgtctacgttcccggtggcggtggtgagggcggctacgggcctcggggaccctgctacgatcccctgatccccggccacggcggtggcctaatacccatcaggcctgatctccccgcccccggctatggacgcggacgctatccctgcttccgacctctcccctaccatcccacgccgccgctgccgccaccgcagaatggggacaccccgccgccgtgatcgagcatggccggccgccgcgacgacgacctcacgcgacccaatgcaccctataagctacccctccatcccaaaaagagttcaattgtaactatgaatctgaacacacatgtgtcgaggttcgtagttagaaattggctttgtatgggacggaatagtatacgcgtatacgtatgtatgtatctatatatgtcgagggcacgtatgtacgtacgtacgtatatacgttgatctctcgcaggtactagaacgtatacttgttactagctatatggatcatatataccgttcttccgtcttccatgtgctagtgttcattagcaggaataaaacggataggtgggtgcgtgagtgtgtgtgactggtttcaaacaaataaagtgccgctgtgttaattgtcgatattgtgttggtccaggttcacacgtactccctccggttgttgatagtcgacacagttaatgttagataaacacttgatcattcattttatttaaaaaaattatgcaactataaaaaattgtaagtcgtgcttataagtatatttaatgatagttaataaagtcacaacaaataaataattattatataatttctaaaagatgttaaatgtgtataaaaactcaacacaatcgttcataaaactaagggagtatacctgatgatagaaacacctcaatgttatggtatatccatagaaaagcgcatgccaaacgattttgaagatttaaaattcaaggaagttatacatgactagctgttgccaaaaaatttttgtctaacacatgaaggactgagagatctacttaattctaatgcaggttctaaaagtcgggttcagtgcgtgtcagttagtttgattctacaactaataaggatgataggaataattgaaccaatgaaccaattggctagtactgatatagtgtggtaaatacaggttggatagtttttcttgatcggcccatcttgatagaatttggaggtaatgatgaaaactatgtgaaagtccatccagataatgataatgaaaaaaaaatctaacttgcaaaacttcttcatctgatgcttcaccacatggagcgtgtatcggtgagaaatttagggccctctatcggtgaggtagtggaaccttattaaaccactcaggaatggccgtcgatacataaaagtttgctctttgggcttaagcccaaactattacctcatcacttcagctatcttcttgcacacatatcatctcttgtattgtccatattataccgatgaggagttgttccttgcatgttccgatctcttagtggttgatactgataaagaatttcaccatgttggtacttggtaccagtgccctctatcggttgtttgatgatttccaggaggaatctcattgtggtgcccccccccccctctcaagttgaatgtccttaagatatttgaggcactcctatcatcattggcatcaacattgacattgacatcgatctgtatatcaaagtttgccatcgtcttttttggaagacaaactagtgatcttgagcaattcattcatttactgtttgcttgactaaatccatcagcgtcaacacttcagattgaccgattgatgcaagatgcatagcttcatgccttcatgaaccaaatcttgaaaaaacttctgcggattagcgagctcatcttggcttggtttaccgatcagaactggccttggaaattatggcttcttaagtggtccttgttgcatcatgctgaccgactctagacaaagattttgaaaatcagccacggactgctccacctattgcctcagttcctccttcaaattctctattgtgactgggatcatgttgttagcatcggctttttcttcaacacgttggcttgaatataatggttccattgggcgtgccaaaatatgttgccacaaaattttgtccaacacacgaaggtctgagagatccgccgaactctagtgcaatttctaaaaatcggttcagggtgtgcccgttagttcaatcctgcaactaacaaggatgataggaataatcaaaacattgaaccaattgaccaatactgatatagtggtagatgcaggtctgaaggtttaagcatatgttggctggaggtccgacgtaggtagattaaaatgtacatcagctaatgaatcgataatatgataactaaagcttagaataatgcggctagaactccgatgaatattgcataaaaacctatcgacttagtagaagtaaacttattagcaacaatctaatagatcggatctaaccgagacggtatacaataggatataataggaaaaacttatttagccgatagatctatacaaatgtgatggatgtaccagatcaaaccaagtgatcaagcaatgcagccttagccaaagctgatatgtcaagataggcaacgattttagcaacaaattagaatatatcgacccgaaccgagaaattaaagtcctagctacataaatgaccgtatttctaaatacctcattatctataaatagctcaatatctattgtacatatttgacccatagttggatcatccattttgagaacatagctgctaaaggagagagatatatagtttgtaatttacatgttataacttatagacttaaatttctgtgattacattatatagtcatgccatgaattatcacttttcaatccgtcttgtatatagttccgtattcgtttttggttttatcattaatttcgatcccattttctaggatatggaaatggttaaaggtgttttgcgaccatttctgactctctttttttcacaccggtgtgcatcggcaagagaacggagcggaccgaaccgaacgacgtgcgttgcgagcgtgcgtggtgtgccattgggtcatcggtggagcgagctaggtagtagcgcactagttgacctgaccccatatcttcgtgcctccaaatttttccgttctatgcacggcatggttgtgggcagccttgactaactggagaaagcgagcagcaccggcactaccatgcatatagatttctccatgtatatacccaaaagagcaaccgcactaaaacccaaaagagaagtgacgattgtgtgggtgatacaaatatatagaaatagactagacactccatagcattattatcactactaaaaacgatttttttcatggtgtcacccttttatttttattgacgggttaatgaaataaacacttgtaaaaatgtattgaaggattttaggtcatgaaccaccagcaaaaaaccaattttcaccgacgaatgcttaggaggtctgtaaaaaaaactctattttttgaagcagacttcttaagtatccgccaacgaaaattgatgtttcgctggcattaaaatcgcacagccctatggcccactatccatgccacccactaaatcctccgtctcctcagctccctcctcccttcaacttccccacctccaccgtgcctgcgtgccacacgatggtgatgatgccacggcagcgatggcgatggcaacgggaggcgggtggcggcggatcatgtgacgagaagggacgaggctggtggcaacagcgatggcaagccacggatcttatggcggcatattcggtggtgacggtgcctggatgccacagatccagcagcggaaggggaggaggcggtggcgaagatgacgacaagccatggaagcagtggtggcagtgacctcaggcatagatccggtggaggtgacaggtcccatggcgtgggtggcttcgatgaggctccgacagtggatccttgtccatggtgttggcgaggggagctcgtccatggcagcgatagacgttgtgacggcgacgaccactcctccttctcatcggcgatggaggaaagagactaggagagggcagcgttgctcggctcggcttgttcaacgcgattccagatcttgctgagctaagtcctccctttcccactccacctatgacgaccaccgtcggtgcaacgacaatgatgaacagcacggcgacgggtgacggcgatgctatttcatttgcatctgttattgttgtttgcaaattgaaaatggagtgaaaaatctatgtagtgctatttggatatggatttgaatatggatctgatgaggatttgaatttggatctctagatgtggatttgaatatgcaatagcttctcttctcttaatattgattaactttttattggaaaaataacctttttgctggtggtcctcctagtagtgctgcatgcgaaaatcgaattttgcaatcggtcgtcttaggggctcgcaagcggaccgtaaccgctagcaaaaatcatcgatttttactggttttaggtcgctggcggttgtgtcagcctcctatgaaaacatattttggctgccggaaaacctatttttttaagtagtatatgctcaaataaaagatactatgtaaagttaaatggaggagccaatctatctggccttttctctcctcctcgatcgagctgtctataaataccgacttggttctaagagttgtcataacatctcgatcagctgcgactgcgagcagctaattacagagtaagggaagttggtactatacctgtcttggccgtttcctttgctggttgtgttttgtgcttgcattcatggcgaccttcaccgaacgtacccgtctcctcgcggcgctgcttgtcgtcgtctccgcggtgatcatcggctgctccgtccacgtctgccacggcgcccaagagggtcagctacctagcttcttccttcccctaaccccctctctcagctcattttgactttaatttgcatcagtatcatactaacaacagcgtactactggacgtttaattttccctgtcctctcgtccgtccagctgacctgcaggctgctggctactaccgacgcggcggcagcatggatgatcccgacttcgattttccctttcccggcccccgccatgttgtgtgcaacgacgggccttgccgcaccggcccaggccgattacgtccctacccctttccgcgacctttgccgtaccgtcagacgccgccggcgccaccgtcgccgccgctgccgccaccgcagaacaaacagatcccgcctccgtgatgaattgatgatgactgttcatgccggccggccggccgtcatgatgccacttaattatatatgcatatggctaattaagtacgtgcgtgtgataaaaacgtacgcacaccagagattacatacgcatattgtacgtgcggcgaacggccgggcgctagctctcttgagcggggtacaacgctagctacagcacactattgtgttattactaattaaaaacgaataatgcccgtcccgtgtgcttgtgtttcattagctggaatagaacaggtgtgagcgtgtaactatgcggtctaaaaaggaaataaaagactggtgttgtcaatgctaagagcagtgtactcttccaatgctgatagtgattatggtaattaatggcctatcacatagtatcaaattagatgtggcaaagagaattactgagataggagaaaaagcataccatttctttgcaaatgaggcactaccaagacacaaaccaacacaaaaaataaaaatagtactaggcaagtaggcatcaaggtggtgtcaaactgtcagtgtacaaagtggctgggttgtttgaattggtcggtggcaaaaggggctattttggttggctcccacaacttgattagtattatcgcatcttaagtttggtacatgtttaactgattcaggtggttgtttggttcatagccatacttatcacaagatgctttctccatcatgtaagttccacatgccattgaggtaaaaaagagtagctcaagctagctaaactgttgttctgatattgctaaccacgtattacataagttagctgaaaacttatgtcatgctctggtaatttaaagtactcaaccaaacatcccttaagttttgccacaccttgctttgttaaaggtgtggtatatatcccacataaagtgtgaccctccaatatcgatccgtcaccctaatgcgataacagaaggtgggtaggtgcagcgcgcgtacgtgctcgtggcggggcacgctgccatgcgtaatgaagtagcttctcccgcgatggtggtgagtgagcggaagggggagatcacgaggagggatcggttcaggtctcattgtgcgacgcgaggctacggctatcgctcaaagtgcataaggggaaaacggacgtcacggctcggtgtctcctccgccctcttcaaatccctgtccctccgccgccgccaatgccaacgccttcctccacactgccgccagtcatcgccgcacactcccgcgccctatggtcggcgccgtgcaggcagcacagcaggagctcgctgccatccccaccaaaggcatgagccgactgcccgagagtggggacgtcgacgaggtggccaagcttctattagcgatcaagttgtgggggctcttcgcagtgaccggccacatcatgcggagccgttcctggacaagatcctcaccgcaacgagggagttcttccacctatcgccgaaggagaaggtgatgtacagcaacatggtcgacgccgacgtggcggcggtgagaggttccttcctgaggtctaccgcatcgaccacatcgacaccaacaggcagatcctcaactggtgcgaccggctatacctccaggtctagccagaggaggaacgtcggctggatttctagccagaacacctgctagcgctccgaggacttgaagaatacacaagaggaacgaacacgcgtggcgatggtgtctcgctcccctgaccagttggttgggtcacaaaagccattgccgatcctcatccctcatcctctgccgacgttgacgactttctccatgctgttgttggttgccgctattcgcaccctatggcctcgcgcgccgcatgcagcgtctgctcccatgccaactccctgttccagccaccaccgcgacaaaaactacagcgagaaacaaagagaggagaaggagagaaataaagagatgaagagagagataggtgaagaggacctaacatgtggggcccatgctgaaaagcatggttgactcagtcaaattaccacatcagacaaaattacccgctacactgccctgtgacatatgttgcaccggttttggcagctaaggaatcgttgtatctgctatttcggtttaaggacgaaaatcaaacttgctgtcaagttaagagacctaaaataaacttattcattgtgtgcgcgtgcgcctggcccatcaccctgcccgtaccaacaaagggccatcagcctcgatcccccggctcctgcgtcgtaggctcgtaaccatatctccgcaaaccccccggacagtacacccgccggccgatacctccgggaatttttttcatttttaaaattttcttttaaaatatttaattaaataatctatcgttggaaaaatttacaaaaatagaccctgccgccctagtggagggcggcaagctgatgtggcagacggcaactcgacgggcggtgacggccgattgaaaaagttgaattttttgcattaacacccttgccgcccactgccagggcggcaaggggcctccatgcaaaaaagacaacccgggaagggccatatcaacagagctggaaagaagcatttgatttggttttttttgcatctaggtcctttgccgatgaaaaaaaccagccaaatgcttctttccagctgggcaaaatgcattacgcctgtaaggacggcaaggaccaaagcgcaaaatgcacaagtgacgccgtcgagccgtcgtctgccacgtcagcttgccgctctccactagagcggcagggtctactttttaaaatttttgcgacaatagattatttctgtaaatattttaaaaaaaattaaaaatgaaaaaattcatacctccggtgggtccgcaaggtcgtcgcggcgaggcaggagggctggaggcggccgtgtcgtgtaatcccgtcatacgcataacgcacctacgcatcgatcttccagttttgctactcggccaaaccctttacccgtgccgttgtttcgaaaaacctgcatccaacgacggcatgatgtactttgctacttatctgttttgaaaaagctcacacgcacaagtgtttgggtccaaaagaaagtgcatatacacaaagcatgccatgctttctacttatttgttttgattaaataggggaaaggtccgccctcattttataagtggatagatttttttcacgtgtggatcaaatttaaccttaaattttatatgaaaaattataaaatccacctcataagtcagttaaaatttgacatttcacttgataaatcattttattcgaaatgctcaatctttagtcggttttaatataaaaattaaaccaccctaatacatatgagcttaaccgaatcagcatgttatcactaatgtagagccacccaagctaagctagccgagtcatccttgtccaaatgcttgtattagacttattctttatttttttcgtcatatagcgaaactcagtgcaacaacgcttaagcactcatcaaaaattctatttgagtactctcaaaaaaaaatatcaagactatactcctagaaatatttgattttggtataaaccatattgacacctcacagtttatgaaaacgtaatgatttggttaagcacatgtacattgggggtggttttaacaacagaactaagtagggggtaggcattcgcagcaaactaacttacaaggtaaaatgtcaaatttcaagtgatttctaaggtgatttttgtaatttttcctatttttgtaaagagaaatgtgtgctgatatgtcatacgtgtggctaattattattttggtggtatgaaacacgggtgctggtatgtgtgacaaattattcttttagtgataacctacgtactagttaataccaagatgtttatgttaactttatcaatctcaagatatatcagtcattctctcagttgtaagaataaggtgtacatgtatgttcgttgcacatttgacaaaaaaaacccttagatttgagagactttttacatggctagaactgtatcgagattcaagcattaatagtaactgtatactctcaacccctttttctcccacacattgcttggcaaaatgggaagaagcgagctcactggtgatgcccaccccacctccaaccctggtcggcgcctaatggcgcgaacggcacctgctaggcccgcccactcggcctcttcctctcccttgtttaccttgcccctatctccgaagccggctgcgccgcttgctcgtgtccaccgctcaccgccgccgccggtcttctgcctcgcacagctaaaccttgttggttgggccaccggtggaacttaaggagaaggagaaggagtcagcacaaatcttagcatggacccggtggcccaaaatcagatttctgacagaaatcccgtaaatttttgttgtactaaggcgcgattaaaaaaaagaagtgtatttttccagaactcttcatacgtaattatttagatcgtatatatacaaaaagataagcacacatgctgtcaagagcttaataagatccactcccttgactaataaagcaattgtcaaggtagaaagccaaaagacattggaaatttagtatccagatgcccttagatttagactctcgggcccagtttgcatggagagagacgatcgagtaacagtggcgagcagatatgcctataaatacggccacccctgaacaccatcgaacatgcagcaagaaagccagcagaatatataagctgtgtgtgtaacgactaacgactcaacacttcgagctgccgatcgatcgacccagctggtgatcagtaccgcgcgcaatggcgtccttcgctcgatctgcccgttccctggcgctcctgcagttggcggcgctgctcgtcgcctacgcggtgatcaccagcaccgccggtgatttctccttcttcttcgtccttgctgagttcgcttccatgcacctgattgtgcaataccctgattttgtcttcattttttcatttttgcagagatgttggtggatccaagcgaccctttccagcccaatgatccgggttcgggctggctcgaccgagttccccgtgcggctgccggtgtcgaccgcgttcctcgcgctgcggccgccggtgtcgaccgcgtgccgcgtgctgcggctgctaccgtcgaccgcgttcctcgtgcggctgccggtgtcgaccgcgtgccccgcgctgcggctggtaccaatcgtgtgccccgtgctgcgggcgatcacgaataagcgagtcgcacagccgtgatgcatggctgattggcttctggcccgatcgatcgcgttcgccactacttcgcgtatacaagtaattaatgaaaggaatagcacatatggggtaatcagatagtagtaattaagtaactggagagagtcagcgaggagggggcttgcatgcctgtcgctagtagcagaacttgtgagttgtgatgataagtacgaacaaaatgggaggcaatgccggctggctgctcggctatagctgccttctgatatgagtgagtatgttatattgtaattagcttcagtttatcagaatataaacttcgagtttcttacgtgtttctccatatttagccgtgtatagtggatatagaggccgaattcatttccgttataaaaagtaatgtgtttggctatatatacaaggctacctccttagactatgtgtttcgctatacatgcaaggctacctttgttaggcatgttcaaagtagagcctggtacagactttcttagctagggctgtcaagaaaactcagaagtcacgagttgctcaagctcggctcggcttgataagtattcaaatcgacccgagcttctctcaaagctcatcagctcgatctaacgagccggctcgaaccatttgacggtggttcaaacttcaaacttttcaataggcgtgtgcttgcacattctttttcgctgtccattccaattatttctcccacactcaagtttcaaaatatcaccaccagacatcaatacttgagagttgagaccttagcctacaaacccaaccacttctaagcttcttttccatccctttatgcccagacctaaatcaatttctctcgtcggtctcctagatccccaatcctaggctgctcctctgccctagatctagttgagtcctatatttttcaagtcctaagtgacctagataaacgtggagaggctgtgttgctatattgtaaaatcaacttctttataagagcatgcctagttctgttagcaacaaaaaataatcttacacacaattaacccattgaatcgtgcttttcatttcatatcttcttattttccctagttttaactctagtttgtccgtctccactagtttgcgctataaaccgtccattcttgccgtgaaaatgtgaatccctttgtaggttaggtttgccgtgaaaatagtatatactacctccgttttttaatagatgacgccgttgactttttctcacatgtttaaccattcgtcttattcaaaaaatttacgtaattataatttattttattatgagt

SEQ ID NO: 82462 - DNA, 13758 bp, Oryza sativa
cgtgcaccactcccgggagtcttccaccggccgcctcctcttctccgaccagctccgctccggcgccgctgccggcgtcccctggcgacgccttgcgcagggcagcggcgccggcagcgtcggggacgacgacgacgacgaaggaggactcgccggggccgcctcgcagtggaggtgctacgccctcggggcgttcgccttcgtggccgtgttcgccttcttcctgctcgtgctctggggcgccagcaagtcatacaagccccacgtcgtcgtcaaggtgcgtctctcacctcttggcttcctcgttcactctcgttttcccaagaaatcaacactggccattttagccgtcctgcgagtagagatggtagtgtagagtgtacatttccgtttatttccttcaccttctcaaacgaacaactaagtagaaaatttagaaatgtactataacccctgtcaatctgcccaaatgttttcgattgaatgcaactatatgcaagttttgagatatcggtactggcaccgattgcccccgtcttccttccaagagaagagaaacacaagctgtgtacatccaatctgaatgcatgcatttactagaggcagcgtccgttccgacgatcgtacacgcattttgccaatgaacagctgtaggagtactcctacctagtaaaagcatccgcgaaacatgcacacaggaatactaggagaacgagtactacttaaaacaatataggagcaggagtttttgcttcctggacatcatgcggaattgcggatattgcgatcaatttgctagccgtttctgtgctggtgccattctagtgaatcaattgaaatttgaaaggagtataaaatgtagtagtgctactccattattgacttgctgtacgatttgctgttcctctccatgtgtgtgtagagtgtggtgttcgagacgtaccacatccagggcggcacggaccggacgggcgtcccgaccaagatgatgtccgtcaacgcgacggtcaggctgcgcttccgcaaccggggcaccttcttcagcctgcacgtcacctccacgccgttccacctcttctacgacgacctcaccgtcgccaccggccacgtacgtgccctttccaccaccccaaccctcgcctttctgctcgtacttctacctgaatttgcctatgccatcctcgttacgtttggtgaatctgaatggattgggtaggtgatgcggacgtttccgtgcctgattaggctggcgtaaatcgatggtagttattgctagttactgcgtaacaactcacaaacaaacgggtgaatcaagagttggatctgggctctgtacaatggatcagtagggttgtcccgattattcgtactgtgctcttcattactaacatgagttctatcacgactatagtggagtactaatctcctatgccattccgaccgtgatgccagcagtccgtggaatttttgccggtttagatcagcttttgagcatccccatgaacatcatagtgtggtggagtatactaacctactgcctaggtgcgggagaaagctaaacctaacagcacggttcccttcttatttgtctctgtccttgattagttttttcggcagctcttcactcggaagacagaacaaagttgcgttttaaaaaaccggctcctccattgtcatcctcgaaccggggatagcttgcagccttgcattgccatttgcttcctcgacggagtggatcatctcagatgagacttcgcagccatgcattggggctattctgaggcgctgttggacttaagcatgatagtgcattgttttgagaatttgagtgtgcagcagcttgcattcggccattcaggcaggacttggatttagcgttttacacacagaacctcttagcgtttacacacacacagacggtgagctcgtgagtcgttccgcagtaacaaaaatatcatctgtcaagttacccgctcggctaactgcagcgattttctttcactagaatactggtgagtctggtagtactgtgcaaagtgggggcgaagtgcatgtgatcaagtaacaaatactcctactactactagtactacacagaaccagcaaaaaggggacctggaatggaaacgcaataacacccagaggcaagcagtggcgtcattggctatcggtgggcatggtgttcacgtgactcgagtcagggatgccatcgcttgccatttgccgatatgagcagattttttgttcttgtcacggcacaaagaccagccggtaactgatgtaaggactgaccggttgagaacgactactcttcagcctccctctgctatagtttttttagaggaaaaagacaacacttccctgatgactgtcttgccgctgctgcatgcgctaccactggatactccgttgcatagtacaggcaaagagccaatgtgatatgtcaggcctttgttccatcttcaacgtcaacactcaaaaggattgccttttggcaagtactataagcacctttatataagcccttttatgttgcccctaaatttaccacgtagattaggtgatgagtcggaggagaggagttaggagagagagaatgagccacccctcatgcaaggggcaatctccacacaatctccaagaaaaatataagatgatgtgtgagagtaaactaatattggggtttgtgtactagaggtgacatgttgtaattgttatctcttaattaatgaaaagatgacatggtttaaattagacgtggcactcacctccaccataaaacttgcccttagggcatgcccaaccctccaccttggagggtatccctagctcgccccactttttcgcccgggaccatcgccctgcaaagaatcgcggacctctgcagagcgccgcgcacctctgctcgccccggctcgagaacagcgaagcacgcttggagcggcacgttggcgaggtcgtctccccgtgacggatccacgatggaagatgccgccgccgggaagctccgccggccaccgacgcatcgatctgctccgctactgtggaagaagatggcgaaggggtggactcgagagaaaggcgtacccgggaagctccgtctctgccgcgtcgctccctgccgctgacgcgtcgatccgcggccgtcgcgtcgatccacgtcgccgctgcttcgatccgccgctgccgcctcgatccccacctcctgcgcctccatctgccgccaccgcgtcgatctgtggccgcagccgcttcgatccgcgcccgctgccacgatccccacctccagcggctgctcgatctgctgccgccgggaagctccgccgccaccgctgctcgaggcgccgaggagagagaggggaggtcgtgctggggagggcgccgccggagaaggggaaatcgcgccaccaggaggacgggaatcgagccaaggaggggagcctagtgatttttagggggtatactgctaatattggatgtatatgtaaataaaaataatccaagggtttaaatgtaaaatatgaccgactgacaggtgctgcagtgtaaaaatgagatgtgggtaagggtgcgccctgcattgggcatgcccttactgcttttctatgtttcagacatcacacctttagcttacgttactttaccgtagttacagtacttttgccgtacgctttgtttactctgtgctgcggcgagggaatccttttgctgtacaagatgatggcccccagtgcgcagcaacccagccctatcatggttcatagactcattgacttgctgtgcatgttccggtctgtatttttgttccttgttttctaccggacggtaaatagtgcaagtgcaatttttctcattccgacagaaaagtttcccgtgcaataatatactggaagtacaatttattcggaggatgcacaaccaaaccgcactacagtacactgcactgaacgatcgtgttgcgtgtgtgctcactcatgcgtgcagatggcggagttctatcagccgcggcggagcgggcgcgtggtgacggtgtccgtggtggggaagcaggtgccgctctacggcgccggcgcggagctgcacagcaagcccaacaacggccgcctcggccccgcggtggtgcccgtcaggatggccttcgtgctgcgggcgcgcgcccacatcctcggcctcctcgtccgctccaagttctaccgccgcgtcctctgccgcctcgacgtccgcgaggcaagcctcggcaagcccgtccacggcgtcgccgccgactgcgagtaccacgacgggaggtgaccacgggcccttgcattcagacgctgcgtcgataccgtgggcgtggattgttaattggaagctctgaaactagacttctgggggtggtagtagtattggtaacacgaggtaaaatccaatccgttgtaatggaacaagtgttgatgctaacagtaatcctgctaattctagaaaattttacttgctgttgaaatctgtactaccattggcattaactcatgtctgaagctccggccgaaatatgtaggccatcattccagcaatatacactactaggtgatattacaacaagctgggctggcttctatgacatagcagttgtcaatttactatctgaagaagaatccttcccttccctgatggagatttgcagaggaataggggaatagtcattcgcccatcaggatagtagacaatgggatggtttcacgttggccaaatttacaatgtacagtatgtaaatttacaatggtttcaggttggccaaatttacaatctactagcatactcatcatgcttgctcatgctgcacaatggccaacatctcacttgcaccagattgccctgctcgcatcctcatgctgataatgaaggcaatgagctgcagagtagatatactctattcttagtatggcataaaaagtgtgcactgaacatattcagttgaaatcttaccgtacaaaagccagcacacatgatactgaaacctttgaatttgaatggcgctgtttctgaaaggacccatgctgccgcaagaaagcaaaagctatggagtaaattaaaggaaacaagggttataaactaggatttatttacaaatgaaaaaaatacctgttagaggggtaaaaattagtggagctaatatgctggcaaacgagcttatgcccgatatacagccttgagcaattccctaagaggcaacaccaaagtaataggaataatgagcgaaacttagcagtcatgtcaactaatacaacacaggtcatcatttgaaatactcaaagacaatgatcagcaacaataggaaaaaccaacctgctcatttgatccaacactcttcgatacattggttcttatctagaaaaacagagaagaagatgattaatattgttctgaattgcttggaaggaaaaaagtttttaataaactgttgggaaaaatatggcttacagaagggtgaacaaaagcactcagaattataaacaccgcagataaatatggtacctgtagatgattaagacaacgttagcgaagatatgtgtaatggatgactgatattggtttagtgaatgctggaaacgcactattgcactgctgaaccagcaagcaactaaacctgattgcaaattagtgcaaaacaagagcgtagttctgtctatacatttggatatagccaaaattgcattcttttgggtaagagtctaataagactacaagagaattattgccaagtccaaaggaagtacccaatatgaccatgcaatgccatacaggaaaacctgaaatataatacaaaattgttcagggattacaatcacactcgctgacattattgcataacggttcaaaaatgcaagggaaagaagctgttacatgagtacatcctcctaggagtcctataataagcagtatatcctcgccaacaaatcgagccaagaccggcattacagtcagctgaacagcatgttatcattagtcagaaatcagaaaatgtaaaaaaagcaattcctactccgggctggaaagcctaccatataacagttctgctgaaaaaaaaaatacaatcgtacctgtgacagcattcctgcagcaccagcaattaacagaagattagcgaactcatctttgctgtaaccaaactgtgccttcaggtagtactgcagacacatcaaccgtaaaagaaaattcgtgttaaatttaactgacattgaaactgaatacttgtcagattaggtgggggatagacaccagtaatgcagtctgaagcccatgttccccaagactgtaaaagaaggtaacaattgctgcccctgacagggtcaaactacaggcagcagcaatgactcatcagcacattacagtttatagtcaaaattccatcaaacataggtgtcaataaactctaacaaaagaatatgagtatcggcacgaattgcagttaggcaagaaagaacttaacctgccagtgagaagcgaaaccatgtctgacaacgacggcaccccgcccttgtgcggcggaagtctcggtgagatctcctcatcggaggaggacgaagacgaagtcgcggcggagcaggatgagccttgtaggaagggatcacatgcttcgtcaacgaaggagttggctccgccggaatctgggacaacggccctgagatagatggccgtcgccgcggcgacggccgccgccacctggaaggtggttgatgtctggaggaaccgcgcggtgagtgttccggagacgaaccccgctgccgacacgccggagaggagcccgaacgccgccgctcgccgcctggcgccgacttggtcggcctgcgtccacaaacttcacctggtcaaggactccctgattgggcggtgggccgcccacttctgttacgctgacgagtgggcctaatcgccgtattttccgtttgttcagttgtactgtattggtagtttgtcctttactcctttttgtgtggtagtatacattctttctgttgtcgtaattgtacaggtcacatgttctcgttaaatatacgtattcgttattcaggatgcgtatctcaataactttgaaatatgtatttggatgatcgatctatcatagtgaggttttcattaccacgtaggcgagcaagaggcaatgcatgctgccctcgcagaagatgccggcgaggaccttaacgacgtagtacacgtagaagtacaccttggagcggttgcaggccagtataactgccagaaaaaaaagtggaaaacatatgaaaatgtgcacagatgcattatgcagtttcatcaagctagggtgacccaagtcatgctgcaaagagcatacacaacggcagaatggccacggtcaccggcagtgtcatcagcgccttcctgccgtatttgtccgacaaattccccacgatgggagtcaccacaagagcccccatccctgtgatctgcgcaaattagccaaaagccgttccattttcacaaatcccacccgcaaaatgtgacttaaataatccgaaacgcgcgatactcacggcgctctggaagccgctgaggtagatggcgacggagcactcgtcgcggccggggcagacggcgtccatcgtcacgtcggtgatcgccgggatgaccatgtaggaggcgaagtggaacatgaacgccgccacgaacaagtgccccagcacagccaagtccttcatcctggcgtctctaccaaatcgacagcttaagagaaacacggttaatttgcatgccaaaactccgggtctacgttttatactcgcatgcacggcacgcaaggacaagaaaaatatacatatcgccaatgcaacgcttccaagtaagagaagcagaaaaaccgaagcatcgatcagtcgctcttgcttagggtgatcacccacttgatctcgtcactaaaagtgaccctgcatttttgccaggtttgcacagttatattgcgccttgtgaacatacttttacgtgcccaattccccaaacaagccaagcaaaactgtaaccgtcccgatgtttgttgcagctgggagcctgagagagtgatctgaggacgagaacctgtgattactggagctagctaagttgtcgctgccgatggtgattggttagtgtggtgccggtggcttgtacgcatggcgctgcaacagagcactagagctaacatgcgagtgatggatgatgtactgatgtgttttttagagtgcactccactctactttcggagctactgctcgctgattgggtcttttgtagcttgcagccctggaactctgtttactcgtggaatacggacaccgttggtcttgcttctgggaaaagctgggataatcttgcttggctctttctgcatttggtgctggaagtttgcttcttcagtgggggaaatagcttagcgcactcttgattactagggagattagatctatgtttggtagtagctgagcctcaacgacagttgaagtctcaaccctgaaccgaacagaactactgaagtgcaggggagtatcagagaaggatcggcatttttttgatgtactagtactagaaatatcggaagaactgtatccttcaagactgttgctcctatatattttactatggtccatatactaatttacatttctaagttctatcctcatttttcacgtatatgtttttcaaattataaaatttttctatagaaaagttacttttaaaataatattaatcggttttcaagtttttaaactaatacgcaagtaattatgcgttaattcatcatcaccctgttttctgtgcccaagggaaaattcccaacccctactcccgaacacaccctagattggtgataaattggttgtcgtcaatgccaataattttatctacaaagtgaaatatcgtatttactattcagaggggcacttttttttttcatcaatccaaaacagccctacattccaaactcaataaaacgcaactggaacggatgatgggcttggtgacccactgaaaattgcagagtccgtccaattgacgataggggatgtcgtgggctgtggcctgcctgtgattcttccaaacttaactcggaagccaatatgcgggcgtaaatttcactccgtattccgcctcgacccacctacgaacgtcagcctaagtttatttttggcccctcatttatgtcgctgagactgaaattcgtcctcaaatcgcagtacaacgtgcctctcaactccccaaaccagtggccccgagatggtacggatggttgtttctactgccgtggcgtggcgttgatatggcacttaaagtatataaaaaaacccgtgagactgataccaatgaatgttcggttaaaaaaaaaatggtacgtcctattgcggtttaaggatgaattttagactgacaataaattgtggggcaatagatgagccccatgggcaggcttgtcgaggtcagcttcaaactgtgttggaatatcgaccataagctggaataacgtcagttcacgtaccgtacatctgtatgagcagacgtttgtctactccggaacatacatgcgagcagcagacgccgtccttttcattcctgatcagtttgtttgtttgtttttttttaaaaaaaagaacttgttcattgttgatcaatttgttcgatcagctgttcgaagacaggccgcctcgtctacaagaggaatatcaaacccctgcaaacaattaattccttctccccacgcataaatagcagtgagaggcgaacgagaatattcgtcaaataagaaaatggacgcgttatccagctcatacatccagccgcccggcctatgccgtgccttctccctctccctgatgccctgatcgatcgatgggcggccactgccgaagccatcgggctggcgtccacggaaacagcagtgatcgcgcccacgagccccatgtgagcctgtgcgacgcgcgcgcatgtacgcccggttctttcatagcctttcggctctgtctcacggttatttcaacaagctttcggccttcactcacatcctgcagctgctactgatttactgaagtgatcggtgacgatggaatgctcatgcatgctacattgctaacgacgcttcgatcgagttaattctttatgtttgcacgtacgtatacgcttggacgaagtttgttatgttcaccgcctcaccggttcacgtggttgatcggttcgtgattacgtacagaccgaaaggagggagaggagtcacgttaatttttttagggtaaagagagagctttattaatgcttaaataaagggttacacttctaatttaataaatctagaattcttgcgaaagcacacaacctccactccgcgcaggacctagaacacattgccatttatgctaaaacatgtgctaccctatttgcttatctctttatcgatttaataaatctagaattcttgcgggagcacacaacctccactccgcgcaggacctagaacacattaccatttgtgctaaaacatgtgctaccctatttgcttctctctttatcgatttaataaatctagaattcttgcgggagcacacaacctccactccgcgcaggacttggaacacattaccatttgtgctaaaacatgtgctaccctatttgcttctctctttatcttgtgcacttgcacttgctgaaggcattgcatcactcctttaatctcttcaatcgtcgtcgcccaggccgatttcaactgatcatgcctcattaaatctttaacaatttctgcattgtccatctccagcacgttaattatattggcattgatttgtacgtgtacgtactacgtactatctacctgctcgtgtgacagcaacatgcataatgcattggtagctaactaggctccaaaatgcagcagataatttatgaatgtactaggctaaccgaatacgtgcacgtatgccaaaattgacagcctgaatattcgggtgtgtgtgtctccagcagtagttcttctcgatcgacgaatctatacacaactacgtgcgtatagagacactcgtcctacttagtactcctgccgtacgtatttattgtacgtactcccttcagttggattaatttcatgagaaaagcgagagtccgatccgaatatattcatgtgggttgatatataagtttttcatttagcaactgaagacatgcttggaagtttgaaagcgcgcagggagtttcgcagcaaagttcactgcaaatgattagatcctaattcccagacaggaactaatttcaatttgtctgctacaacggatatgtcatgagtatacacggttgaaaaaatatttcaagattattattcgtgtagtacatgcagctagcatatacttatacttttgtgcatgcatggcaggcaaaactttttcttgcccgcaggctaatacagcgaacagtccacttgtaaagctgttgaaaaatccggaccaaacctgcaggggagcactagtgctagtctccgatcagaaattcgccaatagcatgtgatgtatgggcccaagctagctagcgtccatgcaaatagggtttgacacagataactatactacttattcacatctgagtatgcatcaatattaaaacgaccgaactaactaatcccattgaaaaaaaaatgattccacctattgcgtggcgtccctttctaatctttacacagacaggtgcctatgagctgtctaattcgtaaacctctctaaataaaactctagcttcagacacgcagaaatgttatttttatatatctatatattctcgttctccactgctcattaggacagccagtttgcgagaactctgagaaaagaacagcaaaagccactgcaatagaagcgcgcgagcgctgagagtatctcagatccatggagatggaggctgccacgccggtgccgaggagtgacggcaggaagctggcgaggtgcccgaggctgcagatggacgccaagacggtcactgccatcgagcagtccacgggcgcggccatcgccgacgccgctgcggctggcgccgagggcgccggcggcgggatgcgcgtcaagatcgtgctgagcaagcagcagctgaagcaggtggccgcggccgtcgccggagggggcgccttcgcgctgccgccggcgctggagcagctcgtgagcgtgctcaagcggcagcacgcgaagaagcaggtggcagcggctgctgatgtggtcgtcggaaggcgccgctgccggtggtcgccggcgttgcagagcatcccggaggagtgctttagctaggtacccacgtctacgaatgtgtagtcgattcgcaacatgtatagcttcggtgatcagtccctcctttttttggcgatattcccttccttcctataggctgcaaccgatcgatctagttgggccaaagttagtgcccaatggttgcatcccaactttgaaatgtcatgtattttaatctggcatttggacccaaattttcctccgttttcctggttcgatgcatgtacatatctctgcacacgaatagtattcaataagatgatgagctgggaaaaggaacaacaaagtgtgtgaagtgtccctttctttggcttcaagttgtgtcctgcgtcaggtaataaactgtgtgtggcagcgaggtagcagatggagtgttgctgggaaatgggagccagcaaatccctaaagattcctcttccagtacgacaagatctactcctacagtcctactacacaaaagggttgcagttacgtgttggcccaagggtgtagcagtggcatggcctactgtgaatctgtgattgtgtatgtcacatgagtccagtggtcgaggtaatcttgctagcttcatttcagagtcgaattgaaacttcgaaatagagcacttatcctctttccgtgaacaaggaatggaggatatcgacgccgttatatatggcagatcgttcagtgcctgtgagaggggaagttaacttgccatgaacacaccatcaaaaattcagtcattggatcaggaatagactgtaaattgcctttgctgctctagtgctatgacgagagggaggggaagtgagtcagtcatagagagtaagaattaagaatgatctaaatttagcgtgcgagtgacaaaagcgtaaggcacacgatcaggattcaggaacgatggatggttcagatagctatgttacaccgatgtcaaattaatctcgagttgcttagttagttactaaccatattgtgtgtacactaccaaagtatgttgacagttcacgtacggtcttcgttattaaccaccactagtcagtgtagggataactacattatatcacttatcaaagcataggtagtccgggccgtgggtacgttcagagggttttacacagggaagtggtacgtgttaattccttgaatcctcacagctagtagtatcgatcgaaatggatcatggatgatcatgaatgctagctttcacgtaccatctcatcaccgtgccgctccaaggaaactatggagctcacgtcctaaggtacatatacagtactcttctacataacgtacaggtccattcctcgtttcagacctgtacttgtaaaacaccgactaattaaaaattccaatcgtaatactatggctgtgttggatccaaacttcagtccttttccatcacatcaacctggcatacacacacaacttttcagtcatatcatctccaacttcacccaaaatctaaactttgcgctgaactaaacacaaccta

SEQ ID NO: 82463 - DNA, 15412 bp, Oryza sativa
ctagaactgtggtcgacatgtgaacatctagactgtatcacttattgaatcagctgaactcatagcatcacaaacaggtagcttgttctcaatactcactcgacaaattgggcatgaccggcacttatcagagcacgctctgcagggccaacaaaaagaactttagaattccacttgcagttaaacagaaacacacccaacatgtagcaacttgcaataatacataaatatatacaccttgcaagcttcagacgacataacatgtgaaacatacatgaatcagtgattgccaaagaagcttactcgcaaagaacataatggcggcatggaagcagaactatgcaaatgtctctctcaaagcatatccgacataggatctgttcctgtatttatatagaaaaaggttcttgttaaaagtaattgaaatcgaaaaagcacatcaactcttttatggatgagatttaacagcctaccactcatgataatgattcaatattaaaagaaaataaactccaaactgcaatactagaaataatattatataggtgcagcacagaaccaaatcaacctagagccttgtgtatcactctatttgaaattggacattgtagaatgctttgtctgagaagtgagaatggaaatgagtagtacattttttagcttatcacactgctgttgactaagcttagccattttggtttgctcccccaaagctaattgaagtctctgtacctgaaagtgcaagtggttaattagcccaatgcaaataaagaaactgttactgtatgtacagtaaaacaacctctttgacaagaactttcttcggcatctcttttaccatctctggtggatagctgcaaaaggtactatacctgcatggataagaccaagtaataaaacaattcagctaccgtggaagcatttgcagtgcgtccaatgtaattggcataccttgttgattcctgagtgattacctatcttagtgcttctaatctaaagcgataagcatagcttgttgaatgatgaatgataagctaccttgttactgaagtacacagtacttttaaatgcaaatgcaaaaaaagttactttttcgtaatgaagaaagacctagcaactctggaaggttaacattaaactgtgttgtatctagaaacttgttttagtttagtagtctttctatattttggagcagttgacgttatgtgggatctcccaaatttgattaatgcggatctacatgacaagttcttctaaactttactcttgccatttttctcttcaatctctgagacaaaaaccatctgtttccccacgatgttatttcctggaatatttgagcccattgccctaccaaacgaagaaagaaacacaaaaccaatatggcaaaatagatgttaacatgatgttgagttggtagtttacttcatgtgtccatatagcattggactcaaacatcttatgttctctagctattcatagtacatcccacgataagatcctttgggcagtccaggagggaactatggtcctcagaagaagcaagtgtgtagcatactacgaactttttttattatttaaaccattttattttaatattttaaaaataaactctttacaattttatttttaaaaatgaaccttttagccacgccagtaatattggcgtggcgtctaaatactgccacgccatccttattggcgtgacagcactagccagcgcggcatgagtgccacatcagcaaagctgccacaccagtgatgttggcgtgactggtgcatgttgcaacgcctacagcattggtgtgacgagactaggcgttggctggcgtgaacccctgatgcattgtttggtctatgcgtaattagttaatgacaagattgcactaatacacaattatacaaagttactatttacatgcacgtataatgtggacggcaagtcccaatatccctgcatgcacaacatatataatacagatatccacactaatctacaaaataacaatgttctatattttcttaatttggtggtttcctatcgccatgaatggaattccgtcgtcatggtagtgtgttcagattgtttgataatcacttttttgagttttggaatggatttggtaatcatctgtactacgctgattcatagttttgtaagtgctatcttgtggagtgaatcacaactaatataattcagttacttataacattaggatcttcatgcaagttgcgatctattttgttaatgcaaacaagagctgcacatctttttatgagacatttttatgagctgcactctcagcaagttgtcccagccaactcaaggttcgtcacaccaacactctaggcgttgcaacatgcaccagccacaccaacatccatggcgtggcagcttgttgatgtcattcatgccacgctggcagcgctatcacacccgcgaagatgtcgtgacagtattcggacgtcacgccagtaaaaactggcatggccaaaaggttcatttataaaaataaaattttagagaatttatttataaaatattaaaataaaatggtttaaataattaaaaaattccatactagcctagagttttatcagcaacatgtggatgagtcccgtggttgggggattgttattcagcagagcacagttagaatgtgctgcaattcatcaccacagcaacttttggctagcctcagtaagctgatagtttccttcctaatcttcaaaatttttggtagactgagtttcaagaacctacactttctagtagtaacaacagcattcaagaaacgacaaaaatgtctgtcaagaaagaatatgggtactgtcatgataagcgtaagcaagatgcaattaggaaaaatttagaagagcctacccagaattatttgcatagcataaatgagcttgctcctctttgctatcttcatcaatagaccaccaagcgatgagcctgcccagcaataaaatcatcaaatgagaattccatgtccagcttttatgtattgtaatagatgtgcaattggcctgagccctgaactactaaagtgatactggatagcaataaaaccttgaaccatgttgcatcatcataaacaattcatcaatctttgatgagaaagaaatatatccgtcagtgatctttttagctcgtaattttgtaacaagcctttcaaagaatatccaaatagcaaacgatacagtagtcacttgaagcaaaagtataggtaagaaaacagctcggagtgggaaaaattttgcgttagatggagtgccctgcaaaggatccagagaaaacaatggtcagttagactaaaagctgtgaactaatgatatatcaacacagaaacaggaaaatggatagcaaagcagggtctgccaaacaattttgaaggaaagaacattatttagtaaattgagttcaacagacctctaggcgcatacacagaagaacttgaaaaattacaataggaattattaatatagggccaccaatgtcctgcagatagcttgtctaaatcagtatcccttttggagtaaaatggaacactgttgttccagtatcagtctctgttcatctaagacaaaaatccaatttattggtataccattggattagaccatctcgtgcagacaagaaagccaaagcactgcgaaatcctgtaaagaaatgtcaagaagaaatcaaaggattattccttggggttacaagcctaattttaaaaggagagaatattacccaaaattaatgaataaatcccaccaccccagagtaactgcatctcctgtagcacaaaatataacctgattatgaaaagcttctacatggaactctgacgcatgagttatgagtaagagtttcgatgttcctactttaggttggttatgcctactcatttctataaacatgttagtcctcaaaaactctatagtgcggaaaacaaaaaacagctaatttcatgcaaaggagaacggcatatattaggccagtgacaaggttcaggaatatctccacgagaacaagcatgcttaccacacaacttaagaagcatgagtgaagtagccgctagtagaaataccatggaaatggcaacccagaagtgctaagaaaaataggaagtcgttagtaatgactacatgcagcttaagtttgtataagattaatctagttctcatctgtaaagagttcaaagcaatgatgtcccttgttactatatcaaagattttattgtagcaagggtctttgtatattttacagatttacagctccatatactcataaactcaattatgcagtatataaatacacaatagcaagtcagatagcacattggtacaactatagatctctttgatggctgttaggtgtgatgctctatgatggctgttccttgtagtaggaaacaataaaacaaacaaaagaccctcattttgctggctttattagagctctaactgaactgtctcgtgtgcgaacttgtaaaactggcaacccgttgaatactctgttaccctttagtgcttttctataaaagtaggctgttaggcctatggtctaaaaaaattgctatgatataatattatatctggtcaatgtgtattgatagggtatcgtatcccctgaattttaaattgcactgaacaacataacagagaatatgcaacttgtcccacatgaaaacaaagaacagagaatatggaataaaattgcatgcaggcgaaggttgcgacttcagggttaaatacagtacataaaacaccaaaataatgcatagttgattggagctccataattggctccagtgcaaccacacaaaactatctattgtataacttctgtaaaacataatttgattagcagtattggagctaaagttctcactttacatggtggaaagttaaagaattgtaagtgcaatgtagtcttataacttacaggaagcctctcccaaattgcttcatctgtcatagtctctccatgtccaggcattagtgcaccacacatcctatatagaatacataatatattgttttaaaaaagaaaaaaatataacgatatttacaaaagtatactctataacgaataaacagttgaacttttctttacagcacagtttatgacaaaataacaaatgtttcttcaaaataagtctgactctgttttcacaaactggcttcaagttgatgtagcatttctacagagtgacaatgtacatgctatatcactaacaatcaaactgttctaaaagaaaagttcatcagattgcattatcacaatatagtacttagctagggagtaggtaatcagaagtcacaaaagttaaaaccctggagaagtacgaggtgaacattagaaattacttgtcaaaactaaaaaagaaataaactgtggtgcataatttcatcattttgcactgtgtactcagtacagttaggcaattcatatgttaaatttaggccaatgaacaccaaccgttctgtaagaactgaatttatgttccccaacaccaattatatcagccatgatatgtctacaagcaacattttgataatccataactccatatggcatatatccaaaaacatatgtaagaacctatgcaaatttgcactgaagcactgtttgattacctgaaattgtcaacaagtgtaatgatttccaaagctaatagtggaaggaatacaagctttaaatcaataaaaggttcatcatgacctgaaaatgatgaaatgaaccatttgcatggcaagtgaataactattgactttaaaaggtagacgaattcacaataagctttggatttgccatcaataccttccagataaacacatagaagcagctcaaaagcaactagcaatggtgtggcaacaatggaatggcaggaagccatctgtgcagtttaataatccgattaaccttctgctagtcaggtatacagttcagaatctatgaaggtatgaaaatgaaaagtaggcagtgaatctacctgacaactttgtggtgatgaaggagcaggtaacgaaaatctacatcgagcaataacagcatggaacaaccatagaggggtgaatagcaccctgcaggtcaagcattctgtcaatcccaacatgcagagaatcaaatgtatcacataacaagtcaatgaagcacgaatgagatgcaattgttattcaggacccaactttagaggaccacttgccacctagttttcctgtaatggccataccagtctctgtagagctatctgtgtgccatactaactggttcatccatatccatgttgcacaatactataagttgtgtagccaatgattcagtcacatacaaagagacacacgcacccaaaaaaaaaaaaagacaaagaacacacaaaggtttctggcaaatcacactcaccagattagtgtccatttctcaaaaacaaaatttactccctttctcaaatagttctcatactaaaatgcatgcagtaaactttgacaactttgggaaacctccaaaaccaagtataaaaaacatagttccaattacgtggggtagctgatgaggactgcattcacctctttgtctcctgatcttacactaacagggtgtggggaatattgaaaggctggataggcattcctcttcagcttcccagtgaactgaacgccgagctgcaagagcgtggtggatgttggcaaggatgtttttccagccgagctacaggaagtcatttgacactctcttcatgttggtttgttggttaatttggaagcagcgtaatgcaagggtgttcaatggccagtcgcgcacagcaggccaattacaagacatcaaagagttcatacccatttggggtgtttaagaatgacaatgaatagtctcttttagttttacatgctgggagtgctggaccctgtttttcgacatcacatcgtcgataaatgtgtaacttgtaactgtttcccacaaccttgatggaattggtcggccttcttcagccgggcccggcaaaaaaaaaaaaaaaaaaaaaacaaacaaacaaaacatagttccataccctgctcaggataatgtgcaacagctaacaacaacaaattaacccaacaggatgttaacaataacctcactcagtggctcagctgaaggactgaatcgcaccaaaaagggcacgacgtgcgctatatgcagattaggattccatcagatacgcacgatgcatctatcgcatccaattatatcctaaaaaaataagaaacgccatcactaaaaagcgcagcgattgcacaaataaccaatagaatataccacacgtccgcacctactcctaactcgcaattccacaacgagccagcacaatccaattattgccaaacgcgaggttgcgagagcatttctagcgggcggggcggggctagatgaagcgaagggagagggtgggggggaacagggggggggggggcggcttttaccaccacgagccgcggaagaggccgtcgagcttgagggcgaggagcgcggtgaagcagagcagcagcgcgtgcgccgccgcctcctgccccgccctccacacccgcccccacgtcaccggcgcgccactgctccccagctccgcccccgcctccggcgcgcccccgccaccgccgctggtggtggcggcggctccccgcggtgctccggcttccattgccatcgtgtgcggagtgcggagggaggagatgtgactggtgtgtgtggtggtggacgtggcctcgccgcggtgatctggaggaagcggagagcgatgtgggggcccgtgggcttccgctcgtgtgcgcgtcagcgtcaagcccacggaggataatatctacctttatctgcacttcacttatcagtttttgcacaaaatcatttgagattcctccattcctaagaaaaagtattgggaaattatatggaccattttcatttgttcctctgtaagtatttacttatttgtattatactgggtatttgtctttattcttatggggtgtgtatttgtctttatgagtattaggtgttggaattaatggataggccttagcccactcgaagattaattctggaaaatcataaaatcccacctcatgggatgacatgcatatggagtttagtactatcttacttattctaggagaggggacctccttaaaagggatgatgcactccttgccacttgaagcacatgtgatggagagaagagggagaacacacgcgcctcgcctcgcttggcagggcaggcggcgcgcgtgcacgacgtacacgtcaaatggtgtggattcattgtatatattttgtatattaggagtatgttactaggtagtgcatctatggctaagaacgacagttccatcactaaatggggtagagcgtcgaatggtgtggattcattgtatatattttgtatattagatgtatgttactaggtagtgcatctatggctaagaacgacagttcgatcactaaatggggtagtgagtgtcaattgtgtcatcatcagaagacactttgatagtgccttttgctttctctgtatcaatcagatactcgcgtactaccacattgtcgtataccctctatttcatattataagactcatagggagagagtagtattaaccaatgcatggtcacatgtctagcactcattcgcggacactgagtatgcataaaatggtgtcacacttggccccataaaatggtgtagaaataagtgaaacgacatatttataaataaaaattaatttgtgaataaaatatttatatacatgttctagcgatctaaaagcaaaggctgaaaaataaacttcaatgaaaaaaccctaacaacaactttaaatttaaaattgaaaatttaaattttaactgataagcataacataagcgaaaaaataagaccgattgcctttttttttaatagaactagagcacctgtgttgcatcctgaaacagcaaaggcacataactttcacattgacaatactcagcaataagacatttaaatttcaggataacaccgtccattcagaaacaatcaaaataatatatatacaactcaagtacaaaaaattgaaattaaggaatagtaactaatctaaagggttcaacacatatattttctgttgggatgtggcagaatttccacagaacggcaagattcatgtctcgtctccattcctttcccgacaatagctaagctaataacaaacttacaagcaaaaggagcacaacaaaataaatcaagctagcatgaggcctcatgatttcaccacaagcaataatgctcgaaattggcaccaattaccccagaaatttactgggccagtatgatctctctacaggatacatcagccattcaattaaaaattggctactcatcgtacaccctacagatcgcgaattttctctactgtacagtatttcttacaaaaggtgacccaggcacaatatgattctctgccaactctcttcaaattatctttgcagaggcttgactttgatcctaatcttagtagttgtcaatgtccgtgtagtatctactggcgtacccacatttgatatcttgggttcaggaattcgcattggagctggtggccttgccgatgaggttccttgcgagtctgaaggtttcgctgtgttcttctgttcggaagaagaaaccccttcaccttccttctgctttttgcctttttctttctccatccttttcttctctttcttaagccgttttttctccagatactcaggatcatctttcttatctcgatgccgctttttgtctttcttgtccttcttcttctccttcgtttccaatccattcatggagtctggggcttgatttccatcatagcttgtggagactacttctagctgactccgtggcttgtctaggacttcctgtccattaacaacgggagagaagtgatccttggggagagcatctagcctggaatcggctgtgcactgtagctccttggatacttcatgcttgtccattagtttgacattgccaatgcttgctgacatccttgattccctatcgtggcaagagttttgttccctatcatggcatgagttttgctcctcgatgttatgattacttacatttactggttctggtgcttcagtcataggtgcatccactgacatagagctacatggacctgcttcattttcatttctaccatgtgaatgatctctgtgatcagcatcatctgctttactggatgatgaagcacgtttaacccttattttgacaacattccttctctcactgcagttagatatattatccgcatcttttgtgggtatagaaataacattccttctctcactgcagttagatatattatccgcatcttttgtgggtataaaaataacattccttctctcactgcagttagatatattatccgcatcttttaagggtccagaggtaggtaagacttcacggacactaggagtgctagtggaaggttcttgaggccttgattgttgaggaactgaggaatcagctttagtgtgctgatcactagatatctccaggacaacttgaggtggagtgacaaccttcggaactccatgcagtgttggagacctgagactcatggcatgttagtatagaagtacaaatgataacatagtgtaacaaaaagttacaataagtaaaaaccaatttcagtgttgcaaggcatgtttgatgacttaatgttttgtgtttgtgataaactgaaattaattggaccattcgttattcgacaacataggattgtttggggacagcaatatccagtcggggcagtgaactgcatgttgaagatgaagcactactgatctcatcttcttttttgtctaaaaaaacaacaagcaacactactgatttttttttcctacaatttgaccaaccgcagaaaggagtcacataaagggacactgacaaacaacgcagatctgctaatgttggcaattccttatacattaggtagttgaggactcgaggtttaatatataaaggcaacaaaacacaggtctacttaagggagaggtttcagtagaagttcaaatcccgcctacattccatgacaatctagagggcccattgtggtactcatacatctcggagatcatcaaaatcctactctacctaattaccgtcgcagccattgacaatgagctgccatataaattactgtatctatgttttatggtgaccattgacatacataataaagctacacagaacaaacatgaacacactaagttaaacatgatatgaacacagaaatgctgcgaatgacatctagaaactggaaacaatagaatgaaatgcctgggttgtaatgttgtattgatgaaaaaaatatgacaaaaaccgctgtagtagtaaagaaaaagtcgttttgttatttgattgtagatagttacacatcttttaaattttatgcatcatatatgctttaagcactagtagaagtacatagaataatcaatagaaatttaatttatatgcttgatacatagaaacagtttacttgatccttttcaggaaggcaaatttatatgctagggtttgcagttataaatgaacatgtgaaaattggaaaatacatataaagcaacttctctaaccttccagcagcaatttgcaatatgcagaacacattatgtcgaagatatacattgttgtaggcctttttgccagcaagcaggcaaaggaggccaactagagttggcaattgtatttgattattatcatgagattcaatattggcttggcatagacgcaagacatgaacagccaactttgtccctcctgcaataactccaacgtcaaaagaaatcaaggtattcaagatatgccagaagtaccatagcaatcttcatcaaacctctcaaagatctttcttcattagcatatttcaagaataataaaagagctgcatcaagtcctttatggtgaaactcgagatcaataagaaccctgccagcttccattcgaactttccatggtttgtccatgttgcgatagggcacaattagttcacagacgcgatcctacagcgacaaaaagttacaccatatgaatgaaatattcagatcagaccaactattagacacatgcaggagcatggtgccaacggaagagttcttacaaggcaaatggaagatgacaccctctgtgcaatacgtgcaagggtgcgaatgcagctgacagtcaaaaccccattgtatccaggcataaagctgcaagttttttctagcagttagtaggactgacagaaatgaaggacagctaagtcaaaagtagtaattggatattttctactaacttatcaaattgcaggagccgatcaatgcgcttgagaagagacgacaatagacctacaccctgcagagaaaatgaacatcattttttgataccattgttttaaaaacaacttgacaacacctaaaaaagaatacccagcaaaaccttaaggacaagaatagtccatataaaccataagaatataattctaatttattaattgcagaataaaaactgtagtctgaaacaacaggtgcagtgctttaaagaccataaggccataattatctactttatatgagttgattattttggtgatgccatggatagaatagaaacctttaatgtacacattttttgcaaaattgaattgataaagcacatatctcaggcacatgcacagcagttagtaaaatccttaaatagtatgttgccattatagtttacatttagcaggtacttccataactccatagctattcatgccatgtactcctactacagtagtataaatatttttttcttgtcaagcaggtaatacacatgtagcatagatgatagctcaagcttccagtcattgaaataggtaattcatcacaacaggtgtccacataacatttttcatactctatcagaagatatacatgcatacaaacctgctggccaaattctaattcacctatcgcctgcaccattgcagatagccagtagacatcagagtatacatttccgttgttatcattatactgaaacaatataaaatgtgcaaatgtattagtcggcacacattcaagtattatatcaatgggtattgatttgtgttcaagaatatcataaatggtgaaaaccaaatacttcctaatatgtctgaataaatataacaaagggttacaacttacaagtaatgaatacaaaattattatattgattcacgtacaagatcctaaatgatgaaaaataaatatttcctattttgacaacgtataacacggagttacaatttaaaaagcagataaaatgcaaaccagagataaatagcaacctttagaagctgaaggataaattcaatggcttcttttgggctgctcttgtctgctgatctaacaagagctactgcatgaggaattgcctaatagaaggaacataagtcaagcaaaatacaaattattatcataagtgcagcactgccataagaaacatcaaaacactattgaacaacacagatcaattttaaatcacttcagcaatgtgtttatgcataatgtaatgctggattgcggattaaaaatgtttagttgactaagtccaggtgtaaggattgaactgtctatttaagtcaggcaagagacagtacacttgcatatatggttatgattaagtgaccacaaacactaactttatttcatttagaacaatacctactggactaatatcaagagttttgaattccatagtatgggacagaggaactggagtaagaaaggtgggaaactagaggaaagaagactatctcaaaatccttgcttgtcgcaactctagacactctctcattacttataccaacctaattttatttaaacgatgaacccaactagcaaggaagcaaactaagtacagtttgagtcccccagatcaagcaggacactagcccatccaaagtggcctacagatgaaaccaaataacttgtatcctacgtaaacttgtcaacaagcaacctggcactacggaaatgtcagcaatactgacataaatggattttcttgtcatgggtaatcacaaatataagtcctacctcaaagcattacctcaagaacaaagtactccggaatatcatggaagtcattcggcctatcagtaaaacaagaatgaagctgtttacacaaacatataaaagagggataatttgtgggcgaaaataagctactgcagaatggatcttgacctgggtaatccaatatctgcatcaaatcggcggcttttatagaacttaaccagatgaagcagtccagttagttctgtgccctaaatgaaagaaaacaacttaaataagtaacacatcagtgcaaaaaagtggtaacattaaaacatctcctctgtgctattgagcagtctaacacagattcatatgctcaaacatcaacttctagtgagaacaaagaaagatacagaaagaagattgtatacacattaagtcagtttgaatcttccatgcatgcctaaaggttatgtaaagctacttcagtattgtcaagtgtgaatcactaactccgatgtgtaagcgcccattcccaggttccagatactatgtttgcaaaaaaaaaaaaggaagaagaagaagagagaccaaaacagcaggagagactcctactgtgctatatatagcaaatttaattggggcaccatggtgctcgggctccaagatcttggtgaccaggcaccatgaaaaatatatatgggggtatgttgcaaaataagtagggctgtatgcctgtatggaagttaaaatgaatgcaaatgcccaaacatcacctacttgttctattctctgttgtattattttattgtttaatttctttctgtttttctacatcttacttcagattcaaactttgcttggatccttgatcttttttaatttcatccttgttcctctactggcaattgcacagacgattctagtgaaaggggaaaggcatatgacttaagtaaaaaaacttcacatcatggattgcctcaggtgaaatttagaataaacgcaaactttcaaccttcctcacaaataaaaatgtataattgagaatatcagtcagctatgtaataaatggaaccttttgatctaaattttctaaattgaatttgaatgcatatacaaatattcagaattacaatattaatgccttggaaaaatagtttaagacaaacaagcttacgcatacctctgatgcagttacagctaaagcatatgctgcttcaactctaactctccaaaatgcctgcagcattattaacaagttactcaatgatattcaacaagatctcaagaaacatgctgaaatacctttgtatcatttaagaaattattgagggcattagtc

SEQ ID NO: 82464 - DNA, 7323 bp, Oryza sativa
aacatgctaaaacctgtagttttgtgataatggagacaaaatctatagttttatgataaatgaaggcactaaatgtgtagttttgtgataaacgaatacactaaatctatagttttgtgaaacaaattcttaaatatatagttttgtgatagattgtacaaagtaactatagttttataataaacgcggagacactaaatctgtagttttgtgataaattatgcaaaatacatgtagttttgtgaaatttacactaaaatataaaaaaatattcatgctatctttatgcactattttttttaccggaccatacgagagataaggatatcgagggggtggcgtggttcataaagtcggtttttttggaaaggtcagtttttgtgccaaattgttttttgtttactgaagttaatttggcttttgaacggttgatgtttttttgtgtgggtaggggtgggtatggacggaactccattttcaatgttgtagagatatggaacatttttttaattagcatacttgtactacttcctctagctagaaatatttggcgtttaggataactttcaaattaatgttcagtttaaaacaagaaaaacgacatgcatgtattgatgtgccttcaaaagtagtaccgatcataatatcataaactcattagattctaacatacaattaattgatagtcaaagtgttgaagtttggctaaatcttgtcctaaacattaaacattttatgacataaggaagcacttaatttatgcttggtaatcttctaattaattacctatatgatgttggatatatagatatattcatgagatatgtggtgcgtgggccagtttatacatgcatcattccagacttcccagtagatgtcttcgctagaagttgagagctagagtacatgcacgaggccacacttttgttcgatcgatcaatgcagtcacgcagatgcagtgtagtggagagatcacgtactcgagtagcatgcatgcgcacacggtggtggtggtcgccggccggccggccgggagattcgccggcgctcgtgcagaaggcaagtggccggcaggcattgcatctgatcatatgcatgcatgatctcgatcgatgctgcaagaatcatatcatacatatcgatcgatagatatgaaatcagcatgaatatgatgcaatgcagaatgcagatgagagcgagtggtagcttagcttagctgcttgtgtttgtccggctcccgtcgccgttttcctccctgtcggtttctgcatgcatgccaactgcaatcgtacaccgatactgtgtaccagtttttactctgctctcgctgcagctgcaaccgcatcgtttctgaatcatcttcagacatcacggcgacacgctgcccagcccagctaccccctccctctccctgcctgtctgcaacaacacataatgatccatcaaccttgctaacatatagaaatatacatttggttaataatatactctcttaacacccagtttttcaatcgagaatgcaggactatatatcatcaatatataatatacctccagattaattggtcatgcaaagcattgttggtgtatggggaccagcaaaatatattggagaggaagtacagcatatatatgttgaaaagcagggaccagatcaataaatggctggccaagtggccatggatgttttttctcttggacattactgacctgagaccacccctggtcaccatcatgttggtctgctggactaccctgcagctggccagcacgccccacatgtcgcacgaaaccattcagcagagctccattagttaacccttgcagattaattaacttgattcagagattaacaaagaaaaaattgctacaaaaaagcatcgccacagtgagtccacagctagctagattggaagagagcatatggcaaagggctgatgagaagaatattgacacacacatagcgtcatgcatgtcagaattgtatatttcagaattcagcattgctattgctattgctattgttggttagctgttttttcctttcggtacaatatgacaatataagtagttaggagaatcaagctagagttgagcacaaaattccaaccccaacagcatgcatgggagctagtaaacaaactttagatacagtcttcctttgctcatgccctacatgacaagaaagaaatacaaggtttaggcaaccgttctagcaatgtgtcattttcatgtaatcacctatattggatgaatgtagcatgatgcctgcattttgtgctgctttgtcatttgatcaatgaggagtgactaccccaagttatgaaatggccaaggtgctaagatgtctttagcaacgggacaaaagcgtttcaatgaaaacaaaaagatccaagaatctcaaaagttcggtaaagaacaaatacatctttgagtagaaaaatcagaactaaccagacattgtttgtaggaccaccacatggcacagtgctccattagccttctatggtagttaatttggtgaacatatctgaaaccacattcactttcagtaactgatcaagtaagtcgagtaggtattcgggcagcaaatatctttggtattcgggcagcaaatatctttttcacctggattataccgacaataccagatagtcaacagtagttaccattttttctggcttccaaatatccaaaaaatcaagttattactgtccaatggtgcaggaatacatgctttgacgttacatgtcctcatgtacagccttcagcctctttgcagtgtgccttccagaatttaatacgagctttggcatcacagaatcacacttacacagttatccaatcaaaaacattagggtacatatatacatatgcatagagtacaatattagtgcaattttatttcataatgccagattgtagcaaaatatttgaattaataacattgttatatttacaaaaataattagatactacatctatgatttgctaggttacaggctaaccattttcctcagctggaaattggaataatttccccataataagttggaaacactaactaataccgaagatatcttcatcttagagtaagcgtgccatgggtttctaacttacacaatccatccttagttactttatggaggccaatgctgatctttgaaggcttttatacactccatagtggattggatgctgcttgacacgcccttccccaacttgggcaggttaacgcctcctgaaatctgagggttttcatgaaagtttaggagcctttgtcgagattctttcctcacagccgctacctggctcgcataactgatggcatcccagaccaagcctctgatgatggtaaaggtgtaaaacctagctgattcgaaagggatattgcttgcgaaacctacaaacaggaggaaattctgttatccaaaagtggagaatgtagttggtaccttgcaataatagacataactaaggttggctaactggcaggaggagaaataaaactatgtaagtttatagtagaggagtgttattgctgaactgctatgtctgcattgcatttgatggcactgcagtagcgcgtttgatggtaaaatcacttatgatctaacatctgaacaggactacatgcatatggttagattgctaaatcatgtcgcagcaatcacatgggttgccaggttgcaggggatcccttataacaacagggaaagagcatcattgaaatagagatccaacacaacggtgcagtgtgcacacgtgcatgctactggacatactgatctttttttcacacaaacgggtagttgctttcattttcatttctattcccacatgaacattaattgatttactattactgaacaagttaaaactccattaatttccgagatccaccaactgcagtgcagtgaaacagcgtatattctgcaggaacacaatgaagtaatatcactggataaaaagaacactagccagtgatatttatctcacctatatacagttatagataacaaatcacttccactaccaactcaactactacatggattcgaggagacaaatatcaccctctggtatttagtctcaattatcaataacaaataatttccaatactaactcaacatatcaataacaaaccacttccaatactaactcaattgctatggattagaggagacaattaatcaaacatggcatggcaaacgacgcaatcgaaaactgaaactgcagaagaagagaaaggcatcaccatcaccatcacatatgagcaaagagcaagagagtggcaatataccgctgtggtactggttcctgatgaggccgtgctgcggcaagccgacgccgacgccggcgagcgtgacgccgacgctgaacccgacgccgcagccggcgccgacgtagccgatgacctcgggcccgaacccaggcccccacccaaccccgcacccgagccccagcccgatcccccagaacgtacccaccgtcgggtgcacggggttccacctctcgtacctccccagcatccccttgattatcatcctcggcttcacctgcaccggcgccgccacctccacaacccccaaaccaaacaacaacaaaaaaaaagtcaatctccgacgagaattgctggaaatggcgcgggaggggagagagcatttcaagtggtgggaatacctgcgagttgcgtggggcattcggtgtcgtggacgcggcgggatcggtgggcggcggcggcggcggtggcggcgggtggtggatttggggggaatcgggcatgtgtgtgggttggtctcggggattggatgggttggaggaggaggaggccacttggcgggttgaacagtggtgggcggccatgtcgtcgccgtggccaccttatccttctctcaatctctctctcacacacacgctcgaatccccatccactccggccgtcgccgtcgtgcgcttttccggctgcgctttttggagaggacggaggcccagggggtcggagcttcgctgacttggcatttgggcccagtttacttttctagcggaagaatttgagcgccatttcacagctgctgcaaatgctggtagaaagtacgactaggatcatgtgaaattccagtggctgaattttcagcggcacttctacatttttttaaccagtttttttccctttttttttttttactatagttggtacgtattacctccgtttttttaatatatgacgttgttaactttttcacaaacgtttaactattaatcgtattcaaaatttttgtgcaaatattacataatactttttaataagacgaatagttaaatgcattttaaaagttaacgatgttatatattaaaaaaataaaaaaacggagggagtatgaaaaaaaaatgtggattgtcttactatttgctaacttcatctgccgcaagttcaaaaaaaaaaaaaatctgccgcagtttagaagcatacagagaaacaacatgtacgtggttgaagctgaaacatataccattcccaatcacaataagatgtttggatgccaaagtaccaccaaacgagatgataggggtcaaagtgcaattcaacagggagtacatggacataaataatgaaaggttcctcattttcagaattttcttacactttgttcagagagtgcataaccaaaaggtacaggctagagtatatacattacatgttttggaacaaacctaatacacaagcaaggctacttatttggctacaacaacagactacttaggccaagcgccagaaaaagcgattggtgatctcattcatgacatagaaaagaagattgaaggtcaaaaaccacaaaactatacaaaccggagtcctgtgatcagttggaatcatcgaacccgcctgatctgccgaaatctgatgttccaaaaccattagggcgtctgctgtaccgtgtcgaacctgaatcatcaaaactcctagagcgtctgttgccatttctactgaaattgccttctccaaagtcaccaaatccgaatccatcaggctgcttggaactagacctgccaaaggcattggagggtcgtctaaaatctccaaacccactgccatatcttgaaccagcatcgcgtgatctcccaccacgattaggggaactgccaaagccatcaaaatcaccaaagccccgggaacggccttctccaaaaccaccatagcctcctcgtccgaaagaggagccaccggttcttgggcttccagctaatctagagcgattgtctctcacaacattaaacatgtctgaggcctcatctgcaacttcaatctttggaagctacacacggtaaagcaaaaataagcaaacatatttttatctcagctgcaaaaatgatatcattaggattcaacatgcacagttttggaactgtttttacctctgtgaatttgcatcctatatcttgctcaatgatccttacagctctagcttgatcatttgtgtatattaaaattgcacttcctttcttccctgctcgtgcagttcgtccagatctgtgaacaaataactccgaggtgtttgggagttcgtaatgtataacctgaacaagcatgcggaagattattttttaagttaaccgatatgaacgtcaaacagctagattaatcatacttttccaaaaatttccattaaagaaacacatcaggctacttacaagatcaacattgggtatgtctaatccacgagcagcaacatcggttgctactaggatattaaagcggccatctcgaaatcctgatagtgtcctttctctctgattctgtgaaatatccccatgaagcgcctgacatgcatagctcctgcccatagcatatgctaatctatctgcctctcgtttagtttgagtaaacacaatacattttccaccattagcatgctcctgtggaagtgtagagaaaagagtcgttaacggtgcaaactataaaacacatcatacattcagaagagtgctcactttgatcaatggaccaagaattgatggcttcccatagtgctcagaggcaattgaataaagagagattccttcaggtaatttctggtcctcatcaccaaccttaggaaacaatgtaaaatgtcagaattatcttaacaatcctgttgctcttctcagaaaaactgtgataaagtccaagtactatttccagagttaatcaaacaattcaacaaatgtttctaacctacagatgtgcccaccccatcatttcttatatcaatatgaactccacattatgttatgctactccttatccaggagtaatatcccttcaatttaccatggcacat

SEQ ID NO: 82465 - DNA, 36607 bp, Oryza sativa
attcctgcagcccacatgcacacttactgagaactcagtgtgcatatcttgtccggtgggtgatgctgtggttattaattcagaacacacagatcaaaatgttgatggtcttatgtctcaggagcactctgtagacaagtattcaccacagctggaatcatctgttcaacatcgattttatggtgctgttaatctgaacaggcatgctgtggcaggagcattagctggcacagtagtcagtgtttctctgcatccaattgatacagtgaagaccattattcaggttaacagttctcgacgaagttcattctaccacacgttaaggcgcgcccttgttgagagaggtagtgtatttggatgaattttacgcacatcaacagagatactggcaactttgatagatttgatttatttccactttctcttgaattgctagacctttttaatgcttgacaaatcctatacaggagttttaggactttatggagggcttgctagcaaaattgcttgttctgcaccaatttcagcaatctataccttaacttatgaaatagtcaaggggtctcttctgcctattttgccaaaggtgacaatatgttcattcattcattttaattttttggctcatgtctatctagttttttgtttaccacagattttaattttgtactatgttgttacaatgccatttcttcaggagtatcattcaattgctcattgcactgctggtggttgttctagcattgcaacttccttcgtttttacacccagtgaatgcataaaacagcagatgcaagtgggttcacagtatcagaattgctggtacacaatctcttgcctcattcttataattcattgccactgctacgtgccttgtttctctattaaaaaaacacctcgatttcaatagaaacatgacactacatttttcctcatccccttatacaagtttatgacttcagggatgctttattaggatgtcttcgaaagggtggcattacttcactatatgctggatggggtgctgttctttgcagaaatatcccacattccgtaattaaggtatttcaaaagtttagtacctaatttactttcagatttgttaattgtgtttacagaatactggaaggccttgtttttctattttacagttttacacctacgagagcctgaagcagttcatgttgaaatcagctcctgctaatgccaatcttgattctgggcagacagttagtaccctgagctataacttgttaaaccgtctttgtgtctttgttatcattagtcaggactgaagttaaactcattggcattctcactactaaattcagtttttttctctaatgttttcgtgcgtaatacagaatttaaattattttacattatgtttagatcatagtgtagtatcagattttgtttcatcagtaaggatgtaactaaactacacctattgttagtatatttagcatgtttgatgatgccatgttaccagttcttgtatttgaacaaacatttgcccagaattctagtcggtagcatatgtatacttcaatatatgtttgtatgctagtgctgaaagtgggtagatgaaagcctgattggtatgactgtagattgtactgtaaggtatgcactgtaatagaagcaaagtctcgtgacttattaaacaaagtctatttgcagttatattatgcacataggctgtgttcttttgttgggaactcctttcctatgcacagaaaacaaagcacggattaatgtatgattaattaagtactccctccttcccaaattgatcatcatatatgtttatgcatcaagaccaaggataatttaaatcacatcatcaagacaccatgtacacattctctcataatgcatgcatcgattaaaacactataccaattacaccttagcatgcactcattctcccatgctgcatcaatcgtattctgatgaaattcgtgtccatgccatatgatggtcaatttgaaaaattttgaatttcattatatggtgatcaatttgggaaggagggagtattagctagtgtttttttttttttgaaaaatggattaatatgatttttttaggtaactttcctatagatttttttttcaaaaaacacactgtttagcagtttggaaagcgtgcttacggaaaacaagggaggtggagttgggaactcacgctaaagaacacagccgtattctgtttgttctttgttctctgcttggatcagcaccgcacaaaaatcactgccaaaatcattgatattttgcattgcagcttttctgtggaggttttgctgggtctactgctgctctgtgtacaactccatttgatgttgttaagacgcgagtacagttacaggtaacataaagcatgctttatatctgtaaatcattatcatcaattaaattgcttatctggttttactggctgaagtcacacgttggtcttttcaaaagtatagttgctggtatgttattggaagtaaactattggttacagcagaactaaactgagtattacccatgtttgttaggcactcagccctattagcaagtatgatggggttcttcatgcgctcaaagaaatttttcagcacgaaggcttgcagggtctttacaggtacggtcatttccgcaccatattggccatgctattgaatttaggttcttatacaagtactcaaattattaagcaacatatgtatttccaggggtttggctccaaggttggctatgtatatatctcaaggggctatatttttcacatcctatgagttcctcaaaacaattatgttttctgaacaagagcttcatgcaaggaacttttgatcacagaatgatgcagcgtggttcaggaacacttaaagcatctgagtttcaagaacaatctcatgaactaagtgggatggttctattaggctagaggattgtagacttgtggttactgaaccaaacatttcttaggtcttgatagtaaacatttgtacaagtgtacattacatttttggatacataggcaaccaaactggtgagcagccatttttgagtagaaatcacatctaggaaagcaaaattttgtatcatcaacacagtttgtaaattcccttacaagcaacctgtgactggatgtgcatcctaattcctgatattgaattctgacagaaaaaaagaaggcaagtctttttttacttgaatatatctgctgcacagctgcacttacatacatacttacatccactcaaaggaaagagaagtagtacttgaaggtagccctcctagcagctctctctgtgttgctgccttgtgcatatgcatgaaacacaaaggaaatacgaagcgcaaaaaggttcaagaagcgaccgacggcgcgtgcggcctcgtcgcgccagcgtgccgcgcgaacctgaccgagaagttggcctcgcactcgccgtcgccgaggcccccgttgtcgaagttctgggagtaaccgagcgggtcgtagttgagcccgctggcgctgaggacgtacgtccgcaagcgccggcgaggaaggccgatccacctaagcctccgccacagcgccgccaggccgaggccgaaccgtccccagcaggacgcggccgcgcggcggctgcacgacgcgcgcgtcgccgccgccgccccctcctctcccatcgcccggaagcgtatgcgaagccgaggagaggcggccgcagaggacagcaccgcgttcgcgcgcgcgcgcgttccagtcagtgtgacaggaggtgtggactgtggagtggagagcgttgcgccgtatggcccgtagcggcgtcacggccgcggcatggggtccctgcaattgatgcttagttcctggaatcttggtcgacgtggggaatcacctgcactggatgcgctagtatatgtgttgcaagttggcaacaattgaacgtgagacaattagacaaaaaacgagcctggagtcggtaattctctctggcaaaattggcatccgcgcgggcgcaataagacagttacatttatcttgtgatgtgaacatttgtggcttctcgttggtgcttgcagatggagacaaacttgaaaatgacccttttcccccctcttctgatgaaatgaagtgcatttttcctacacgggacaagaaaccgtttatcggatacgggaggcagaaattgactccaagtccaagctgacgaactgaaccaacgtactgacatacatctccaattctctccatctccctcctttaccgtcaccgtgagaagagctccgggcagcgcggatcttggaggggcaccttgcgtgggtgtcagacaagcacgtcgtgcgcagagcggtatccatctcgacgcagcacaggaacaattaaaaccaagtgaaaccccgtgcattattttgagaatttagtatgataacaataaaaaaaataacgtgtaatatagctagataacatcagattaagtaaattaatatggtttatgctaatttaaatttaaatagtatgtagaatggtgatttaaacataaaaaacaaggtgatatgactttatggaagaagaaaagtaggagatagtttggactgtagattaaacatctaaaggctaaaaacaattaatgtgatatgacttaattagaggaaaaaaaagaaagataatttggaccatagattaatcatttaagcactaactaagtgaggatgaactatataagtatatagaatatcataaaaaataataaagatatacattgaaacattatatgaattatgttggttgataatttaacatgtatgtatttgaaaagctcttaaattataaaaactataaagatataacatatttgtatgatgtttaaatatgatgattgttagtggatgataatgtggcatcttgttaattagtggattagtggatgatgatgtggcatctttgcatgttaagcttaaggagttagtgggggataactttatagaagataggattaggaacaggtataactcaggatgtaaattaggcctggtttagatccaaactttttcttcaaactttcaacttttccatcccatcaaaacttttctatgcacacaagcttctaacttttccgtcacatcattccaatttcaaccaaacttctaattttagcgtgaactaaacacactctaagtgaactgaagtcagaactcagaacattttcagaggttacctgacagtagatgagataatgagatatgctgaacaaaacgttcatgtaaaaaacgaactcagatattgagagctggcatgtactgcagactaacaccaccaagaagaaaaacgagaaaaaaactgagattagctctgcattaggctttcttcggtttagcatgttcttttcttttttgtaatggttacatttctgttaatgaaaatggggggttacacccttgattaaaaaaaaaaggttcatgccaagttgttgttgtgccaaccttcctaacaaaaaacatttttgttagccattctgcaagctgagagatgcatggagctgaagtctaaaccacacgatgttaattacagcccatacaactataggatatggattttcatccctcgagaggatgtcctctcattgtttgcatgtcatttaagtagttataatattttttaaaaaaaattgacaacatagattaatatgaaatatatcattccacaaaaatgcaagcctaaatttaacttctataagttgcaaaaaaaagaacaaaataaactaaaaatagtaatcgcacattcaattcgcagctatatttgttatttttgttacaactttagaagttaaattttaacttgcatgtttgtaaagtgatatatttcatattaatctatcttaccatttttttaaaaaaaatttatgactagatggcatgcacgaaatgagggattccctcgagggataaaatcactttctcacaagtcacaactttacatgtactgtatgttggtagcttattagcgtgcatgactgcatgggtatgtagggtagatcacccattaattcatcgtggatcgaacttacatacgaaaaggtaaacacgaagtgtgaccactccatatgaaataaatgttgtgaatacaagaacgatgcttgttcgcacttaagagctctcaagtaggagcagatacaaatgctctcaagtaggagcagatacaaatcaagaattgagcttgggtattaaaagcgaggagataactgcatttatgctgtcattactcatttccatagtgtgcagaattatctaccatttccttccttcacaatttcgcatgtggatgaaggcatgaagctcaagcgaagcgtgacggaacttgtggccgcaagctaggaaccttaatggttgctatattaaggctgttcatcgtgcaggcacaagttcatctccatgcattccagtaaagaccatttttaggacaaacacatcggtttcaaaaaaaaaaaattaggacgaacagagcaatctcttcgcatgcaacagcggccgccattttccctagattcaccttccattggtagcttggttgttcaccaatggcgcacttaggggcggtcctctgcatccgtgttgctctcgtcgtcgtcctcctcccgtcgcttctggcgaccgtcgccgtcgcgcacaacgacaccggcgagcacaagaactacctcatcatcgtgcgcaagccgtacgagtacgaccacaatgtgtacaagaccgtgtcgagctggcacgcgtcgctgctggcgtccgtgtgcgacacggccaaggaggagctcgccaccgaccccggcgccgagacgcggctcatctactcctaccgcaacgtcgtcaatggcttctgcgcccgcgtcaccagggaggaggtgtacgagatggccaagaaggactggttcgtgaaggccatcccggagaagacgtacaagctgatgaccacgtacacgccgaaaatggtcgggctcaccggcgccccggcggcctaccatggcggcttgtggaacaggagcaacatgggcgaagggatgatcatcggggtgcttgacgacggcatcgccgccgggcacccgtcgttcgacgcggccgggatggggccgccgccggccaggtggaagggccggtgcgacttcaacagctcagtgtgcaacaacaagctcatcggcgcgcggtccttcttcgagtcggcgaagtggaagtggagaggggtcgacgacccggtgctccccgtctatgagctggcgcacggcacgcacacctcgagcacggcgggcggcaacttcgtgcccggggcgaacgtgatgggcaacgggttcggcacggcggccggcatggcgccacgcgcgcacctcgcgctctaccaggtgtgctccgaggacagaggctgtgatcgggatgacatattggcggcgatggatgacgccgtggacgagggcgtcgacgtgctctccatctcgctcggcgatgacgaggccggagatttcgccggggatcccgtcgcgctcggggcgtacacagccatcatgaggggcgtctttgtcagctcgtcggccgggaacaacggcccgaacccattgacggtctccaacgaggcgccgtggctgctcaccgtggcggcgtccacgaccggccggaagttcgtggccaccgtgaagcttggcaccggggtcgagttcgacggcgaggcgctctaccagccacccaacttcccgagcacgcagtggccgctgatagcggacacccgcggtgacggcacgtgttccgacgagcacctaatgaaggagcacgtcgccgggaagctagtcgtgtgcaaccagggtggcaacttgaccggactccggaaagggagctatctacacgatgccggcgccgccgggatggttctcatcggccctgagttcatgggctcaatggtccaacccaagtcgcacatcctccccgtggcgcaaatcgtctacttgtcgggggaggagctcaaggcctacatgaaatccacgaagagtccgacggcggcgctgatctacaaaggaacagtgttcggcgaccgcaagacgccggaggtggcgcccttctcgtcccgggggccgagcaggcagaaccaggggatcctcaagcccgacatcaccggccccggggtgaacatcatcgccggcgtgcccgtgacctcgggcctcgccacgccgcccaatccactggcggcgaagttcgacatcatgtcaggcacgtccatggcggcgccgcacctcagcgggatcgccgcgctgatcaagaaagcgcacccgaagtggtcaccggcggcgatcaagtcggccatgatgacaacggccgacacgttggaccgccggcggaggccgataaccgaccagaaaggcaacaatgccaatatgttcggcctcggcgccggcttcatcaacccgacgaaggccatgaacccgggcctcgtgtacgacctgacagcgcaggactacgtccctttcctttgcgggctcgggtacagcgaccacgaggtgagctccatcatccacccggcgccatcggtgtcctgcaagcagctgccggccgtcgagcagaaggacctcaactacccgtccatcaccgtcttcctcgaccgggagccctacgtggtgagcgtcagccgcgccgtgacgaacgtcgggccccgcggcaaggcggtgtacgcggcgaaggtggatatgccggcgacggtgttggtgacggtgacgccggacacgctcaggttcaagaaggtgaaccaggtgaggaagttcacggtcaccttcaggggcgcgaatggcggcccgatgaagggcggcgtcgccgaggggcagctcaggtgggtctcgccggaccacgtggtgcgcagcccgatcgtcgtctccgcccaaaagttcttgaacggtaacacgagctcctccgatcacgcgggccattgattgttgattacgtagctttgccagtaaatggggtacttgattagacccccaaggattataaactgccccctgatgattgtcctcgaaaaaagatgaagagaaagacaaaataactctattagaagatggaccaagatgcgaagggattgcgtggccggaaaaaaaaaaaagcaacatgggattctttttccatgatggccatggcctggatatgtgcccctgaaccaaactgcttcgatattgggcttgatgggtttgttacggatttagacctttatacaattagcatagctaaaatttcgatcttattgttgtgggttggatattggatgatagcactacggcactacctttgtggataagggatatatctcacacacaattcattcaaatttagacatttagtagtagataaaatggtgaaaaaaattacattaacggcacacaaattttgataagattttcttttgttcttttgaaaggtctccgcgggggtagatctccaatgaacacgcacattcacaaaatttgataataattttttagaagtcaaccaatacaatatactcgcacagagtcattgatgcaaatagaaaaaaaaaaacaaaaacaccaagaaactgctcgccaaggacgccgtgctgatagagaaaatttccacgcgtatgtacttaggaaagttcctttttattaagaaaataggataaaaactttgtctcgtatatattaataaaccataagtattcaaaaacatgttgtttagccatgaagtcaacttctggattggtcgattggtcacttcggctctaccgttgtggctccaccgttgtgtgcttcgctataggctctgttcggctgcacttaatttcattgttgtgcagccaacacaaacaatgtgttgtgtctgtagcagcagctgtatcggccagccaaacaatcccatagagcgtcaaaaaaccataccgaaacattctcagtgcgctaaattttttttcatgaaaaacagtctaaataatcattgtcgatgataaataataatcccttcaccgtttggactgaacaatatagttagtttcgctattggtgataatatgttatacacttctagcgtatttttagagcaatcatacaaatacactttctaaaaggaaaattgcggatctcggatagtatccatttcgattttggaatgcgttgaagctccaacgggtcacagggttttgacaaggagagagtcgacctttatttatttctttcatttattgccaatataacacgcgctttgcagcttgctcggcagtcctggtcaaagtcgcctcatatttaatttatctttcacaacgcttttgcagttttaatgtatttttactggcacaaacgtacaagcaaatatcaggttgcaaaattattttctattaaccaaatgggccagctgcaaacctacaagttgcaatagagtgtgttcgtttgaatcgtcaagtcctcgttttcttgcaaggttaggacgcgcaagactgtactacgcaggatgttggcctgctgccttgccctgtcgtgtcgtacagtacatagcatgttgcgaaactttctcttgaattgcccctacgcgttgttagtacattattattattttttcggtttgaaacatcggatgtatcgttattttgcttaggtcataaggtcattacaactgccaggttccagcagtcgaaaaatcgggtggcagacgacttttgtttgctaaaatacaacatattgaggatcagccgatcatgatgttttgctgcgattgcaagataatgatcgccggatgtttagctgcgattccaagataatgatggccgcttgcttgcacgttggcttctaatctaatgtaaagtacaggattaatcttcctgacgacgataatgtgcacgtcgcagcgttcattaacggaaaaatagcatgatatccaatgggtaaattgatccgtatataaatacgacggcatttgcaaaaccagaaaaacagttatacaagaaatacaattatactcaattctaaaataccttttaatccctttagtgtagtagcaaattcggcatgagacaaattcggttcctagtcatctatcatccaatgcaaattgccgcggtcccagcgaaacaagacctttttttaattttaaaaaaacagcgacccagagttgacttagctttaggcaccgtttattcttcgaattatctcatcgaactcatccctggttcttaaccgccgctaatgccaacatatctcctccctccccgctcgactcgactgtctccgtctcaccggcaatccggcggcaatggacggcgtcggcctcggcgtgcacaggcggtgggacacgtcggggagcgggtcgcagtacagcttcaggacgtcggtaagcagcgtcgcggagatatccaccgaggtgggggtggaagtgagcccgccgccgccgccgctggcggcggcggcggacaaggtgtttgtcgcagtcgccgcggacgtgaagtacggcaagagcgccttgcagtggacgctgcagaacctggccaaggatggcgccaaggtcgtgattgctcatgtccactgccccgcgcagatgatccccatgagtaagcctccagtcctcaatcatttgtttgatgatctgcgtcacaggagagagatttaagattggataccttttaatttcggtaatttagcgacgagtttggttatttggatcccgcttccgttttgaatctatggttagcagtttaataatggatatgattcgttgacattggcgacttgaaagccgaatgccagtgcaaactatgcatactccctttctggctttcttacagtacaatagacatttgcacgcccaaacgttgcttgacgaagtttctcatgagttgtatgattgtatctgccggcaatgctgacttcgtgcagatattctagaaaatacatacaattatttgttcatgtagcattattggtcctgtaactacttccaaaatcctattttgccgtcgcttcgtggaaaaaagtaacctagggtgtattgttaaaatgcaagaatttctatactaatttcaatatacctctacgtgggactattaccaaatcccaacaacactactacacatgcatcaaaggtcatcctcttattgcccagggtaacaagttcagaagcaatacgttaatatttgcaaacgatgcaactggttcacttctgatttctgacttctagtgcgatcagaaatcctccatgatttgtttgtcaccagtgcgatcagaaatcctccatgatttgtttgtcaccttttaaatagcttgtccttgattcctattgtttcagtgggggcaaaagttcattataccaagatgaatacaaaacaggtgaacgactataggaacaaggagagagaaaaggcagaggagaaactagatgaatatcttctgatatgcagaaaactgaaggtgttcttctcaaccactcttatgtctttcctaatgagcaatcaacaaagtaataaattacctaatacccaattatgcattctactaatattactcgagaagatatatcaatatatatctcaggaataatttgatcaatatttcgttttctcaggtcagctgtgagaaactaataattgaggaggacgacattgctaaaggccttacagatcttgttgcccttcatggcgtcaccaagcttgtcatgggagcagcagcagacaaacactactcaaggtgaccacaacctcataagttttttttttctgatgactagcacacacattgcacatttaaaactgtttcacaaaatattgtttcttccctgataagtactacctccgtttcaggttataagactttctagtattgtctacattcatatagatgttaatgaatctaggcacacatatatgtctagattcattaacatatatatatatatgaatgtatacaatgctagaaagtcttataatatgaaacggaggaagtagcattcagtgtttgccgctagcaagaattgagaaacagaaagtcccctcaaaaaaagaaatgagaaacagaatggtctgtaaagtctttaacagtttcgaacctggatgttttcccaatatgcaggaaaatgaacacacctaagtccaagacagcactcaagatattggaagcagcagatccttcatgtaagatatggtttacctgtaaaggacatctgatatgtacaaggtaaggttaagccaagcgggtcaaagcagtcttacgatagatggttttcagtgatactaacatcagaaaagcacattgaacaacacgtgaaaaatagctaagcttacccgtcaacattgcagggaagcaaatacaaccgttcctgcaataccaccatcacctgcacacacagttgcatcaacattgtcatcaagcagcatttccagccgtatgagatcaatgtcattgcacccgtcagagagtgaagcatcaagctcaagcggaagtccaaggcacaatctgaacagatcaagaacagaagtggcaaagtatccctcacaaggatctggcactgcaccatctcagttatttggacattcagatcaagatgtcaatgaccagccaacaagaacagcaatgggttctatagattcctgggatgaatttgagagatcgcaaaactcctgctacgattcatcaagaaatagtgatacagttagggtctctggatcagcaatgcagcagcccatgtatgaacctgatgatgaccattttgtatctcctcgtaaactggtacatatcgcctgatgtactgtgcaagttgaaaaacataagagtaggactcttctcaatgaaatgtaacacataactgaactttttgtgcaacacaggagaattcaggcgatgatgcagacatatatggtagactccaagaggctcttagtgaaactcaagacctgaagagagagacatacgaagaatcaacgaaacgtcggaacgccgaaagaaatctgatttcagctcttcaaaaggcaagtcattttgcttcaaaagtccataattcatactgtaaaataaaaagatagaacttatcttacaggtcaaagagttggagaacctgtatcagaaggaagtcatgcatcggaaaataaccgaagaggcactggagaaacagatacaggagacagaagaaacggaaaggcactgcaatgcattatatgacaagctgcatgatgtggaagaacagaagctcatggtggagcagcacataactgaaatggaggcagttttaaaagaacgcgaagataggctgcatgatgtagaagagcagaaattcacggtggagcagcgcataactgaaatgcaggcagttttaaaagaacacaaagataagctgcatgatgtagaagagcagaaactcatggtggagcaccgtataactgaaattcgttcagttttaaaagaacgcgaagagaagctcgcagagagcaagtatctactccaagtgctccaagcagataaagagaagctacaacaagagcgagatgccgcagtaagtgaatctcaagacttgcgcctgaagaacaaacagagaatttccatgccgggtgaagatctaaacaccgagttctcctcttatgagcttgaacaagcgaccagaggcttcgatcaagaactcaagatcggcgagggcggttttgggagcgtctacaaaggcacactccgcaacacaactgtggctatcaagctgctgcacccacatagcatgcaaggtcaatcagaattcgaccaggaggtaatccagttcatcagatcactcacataactccatcaaatcaagttggcaaccatggctaaccaagcaattgacaccattattgcagattgctgttctcagtagagtacgacatccaaacctcgtcactttgatcggctcttgcagggaggcatttggcttggtgtacgaattcctccccaaaggcagcctcgaggaccgcctggcctgcctgaacaacacgccgccattgacatggcaggtgcgcaccaggatcatctacgagatgtgctcggcgctgagcttcctccactcgaacaagccgcacccgattgtccacggcgacctgaagccggcgaacatcctcctcgacgccaacttcgtcagcaagctgggcgacttcggcatctgccggctcctgatacagacgaacaccggcgccgccgccgccgccaccacccggttgtaccggacgaccacaccgaaggggaccttcgcgtacatggacccggagttcctcaccaccggcgagctgacgccgcgctccgacgtgtactccctcggaatcatcatcctgcggctgctgaccgggaagcctccccagaagatcgccgaggttgtggaggacgccatcgagagcggcgggctgcactccatcctcgatccctccgcggggagctggccgttcgtgcaggccaaccagctcgcgcacctcggcctgcggtgcgccgagatgagccggaggcgccggccggatctcgcgaccgacgtgtggaaggtcgtcgagcccctcatgaaggccgcgtcgctgaccgccgggaggccgtcgttcgtggcccggccggacgactccccgccgccgtcctacttcgtctgcccgatctttcaggtagcaaaaaatccgtgattaaattattcctgaaaaaaatcgaggcaaaatttcctcgtgattggatgatggcttccatcggatgctctaatcagctgaagaaagagtcaaaattttcaaacttaattttaaaattaattttaagatattttaaacgtaattttttattgacttttaaattatcaagaatatatatatatatatatatataagtttacccaacaatttatttttattttctaaaaagccaaaggaatatgagtaaactatgggggatgattcaaactcgtgttgggatggatgtgaaagcaggaggagatgaacgatccccacatcgcggcggacgggttcacgtacgaagccgaggccatcaaggggtggctcgacagcggccacgacacgtcgccgatgacgaacctgacgctcgagcaccgcgagctcatcccgaacagggcgctccgctcggccatcctcgagtggcagcaacagcgtcaacggcatcagccgcaagaggaggacgacgactgtacatgagcaatctctcatcaatcatcactcaccgcagttgatatcctccatacctggcgcttcgcttcgtcctgactgtagatcctgcacatacattagcattagctttgcttgggttgaaatttgaagatccaagattgctcgagaaaaggggaagtttaccctgttcgtcttttgtgctcgttaatttgatttgcgatttccgctgtggagtacagacatttgcagttggtaatcctacccaattttacccatgttgaatctggttctgatccgtcttcccctgtatataagtgacgaacagcgaaaagagatgtgcacggaggcggcggcgggcggcctcccgtgatcgtgaggacgtgaggcctgatccatcccggtgcacagtggctggcccgtgaacagtggccttagtcactgagaaaagtttaatcccacaaaattcgtggcccatgaatgctaacgcatcggcccatccatgcctctgcttcgggaggtggcccaagcaaaacttttttatataggcccaagcagaactgttcgttgtacttgtgttgcgtgctcgcttcattgcttgacgctggtcttaaactataaactgcatcaacttgtcacgtccacgtcgaatgctcggtaatttccaagttactcagcttgggtccacgcggcaaacatcgtccctgcatacagtagtatacaatacatctccctttagcgacatacgcgcgtatgagctacgtttgcttgcttgatcacgccaacgcgagcgcaaatggcatctcgtcccaccgttgtgtaaagtcatagcgtcgactttggcttctggtcttcaaagaaaaaaacaactttgcgttattaactttgtgagtcaatgcatgaaatgaaaaatatattcggtgctgactacttctgctttcttctgtaacttgatctcgaaatttccattcatgaaacggctgggcagttactctgcagctgcatggtcttgtgcttctcatttctcaacgtcaggaagcagcaatggatagcgacggcgaagagtacgacgcgatgtggagcgctcggtgcagcgtcagctcgtcggccggctctctgcaggacgccggcgaccagtgggacgagcagagcctggccgccggcgaggacaaggtgttcgtggccgtcgacgaggacgtcgagcacggcaagagcacattcctttgggcgctgcagaacctgtccacggacggggccaatattgtagttgctcatgtccacagccctgcacaaactctcagtaaaggtaagcatcttgcttctcctgctttgacagctacaatcacctggtgcaattcagtttacatttctcgatggggacaaaagttcactgtaccagaatgaagcctgaagagatcagcgagtacctgatgttggcgaaggaagaggccgagaagaacctagatgaatatgctctgatagcgaaaagcacaggaaaagatatgaaggtaaaattgtctcattactttttttgttagtgcttgtgaaaaaaattacttgcatcaagtaacgtggggacgaaatgatgtttatcagtcaaaatataatcaatatgagcatgaacattaatcctactatttcagactgattgtcagaaagtactaattgacatggacgatgtcgcaaaaggactcgaggaacttattacccttcatggcatcaccaggcttgtcatgggagcagccgcagaccaacactactcagagtatggaccacatctgcctaatgtagcgtttttcctgtaatgttttcaagaaaattttactatttctcatcgcaaataaaaaaaaaggggagagagatagagagagaaatttattcctggaactggaggctctggtacttaagacggtgtatcggactatgtggataacttagtacttgaagctctgaagatttatcaggactaggctatcagcgtcagcaaattaatgaactaaaacttcagtcgtaaatttatttcattctacaccagcatcaggagtccaggactaatcaaactacataggtagcaggaatagatagaacattttatgagatgaatccatactaaatatatgtgcacaaaccttatgatattataacctgtagggaaatgaaagaaccaaattccaagatagccctcaagctgatggagactgcatccccatcatgcaagatatggtttacctgcaatggccatctgatatgcacaaggtaaagtcaagtgaatggtcatttgctacctgactttttgaacttcatagagcttagtgcatctcatgcataatagtacttcgtacagcatgcggagaattgtaggacacataatgctacatttgagtatctttacttctgtcaacgaattgaactaggataccagtgtattgcactcttaccaagaaaccaggaaaatgactaaaatccattagttgtgtgcacttacagggaacccaatgaaaaccttcttgcaatatatgtgccgcctgcacaaagcaacacggtaccattgtcaatgtgcagcatttcaagccaaatgagttcgatagagctgaagaaagaagcaccaagctcagaagaatatactttaagatcattggctcaatcggcaatgagtgattgggactacattttcgggggtgactaaactgactatcctaacatatttagaatttctaatttacacccttgcaaaaaaaaggttatattggattttcttgcttaaatgatttatgcatacagcatcaaattgttgttttacatgaattcaaggggccaaaaaatgatatgtagtttcaatagttctcccaaaatatagtttcaagaatccagaggtttcaataatttatagcttaaatttaatactctctgcagtcatgaatatttgatgttgaagacaatattcagtcaaacttataaaattccgaccatcgatagtttctcaaatggctagtttgaattctgaaaacaaaagaaatggtatgctagaattcgccttgagaagaactatcataatatcataaacttattagattttataaacttgttataatataaattaatggtcataattttagaagtttaaccgatcttgccctaaacgtcaaatattcatgaccagaggtactagtatgtttcttctttgcaagctatattcctgatctgtgatgaaattactgaagcttactactaggatttatacctcagaagtcataacttaaacagtaggacatgtagaagcagtgggtcaaaataatcgtttttagttatttagaacaaccgtgttaatcatatatctgcagaaagaaaaatgaactcctacatgaggagaacagatgatttgagccatgctgttggcatttctcttctaaacgtagtcatgctaatctctattttattcataataatgaactccagattggggaaggacagggtatggttcattaaggactgatgatgcaataagtattcctgaagccacaactctagctgcgattgttgacgatacaaacaaacaaagatcagtgatgcactctcctcaggaatctgacagtgtcaatttctcatcaccagcttgtgatcccgtaagactactaatgctaaatcattaagttaccaaagtaactagctgtaagtaaatctctcttaatgattggtggcatgcagcaacaagaagaagaagaaccaaatttagatgaagacatgcatgatatacttaatgaggcatgcactcgagctgaactactcaagaaagaagttgatggtgaatctagcaagcgtcgcaaagctgaaatggatctacttatagctcttcagagagtaagctttgttttattggctgactctgtagcttgtatatttgtagagaaaaataaataaagtaaccctcctttggccagcgtaccaaatgtgacatgcctccaaaatactgcttaaattaatttctctttttaggacaagtataactaaattagtcttacaggttcaagagtcagaaaaatcatatctacaggaggtgaaccagcggaaagaaactgagaggacacttgcaagacagaggctggagatcgatgaaatgaaaaggcgacacaatacattatatgatgaactacaggatacaaagaaacagaagcttctgctggagcaacatatatctgagattaaatctgctgcaaaagattatgtacaagagattactgaatattttatacaagaatcatgtgaggaagccaagaaattccaaaagatcaagatggatctgcttgcgatgcttcaaagagtaagcactttggttcaggactcaggagcttttaatttttccaaaaaaaaattgaccaattatctaaaaaatacgtgacgaaaatccaaactattattacaggttaaagatgtggagaatttaaaccgaaatgaaaagatgcagaggaaagatatggaggaaaagattgcaagacagaggatggagattgaagaaacaaaaaggcagcgagatgaattataccatgagttaaaagatgtaaaggaacagaagctctgtctggaacgacttgtaagtatggcagtatgactcagattcagcatattggtttaattcttgcagacgatcttactgaaaactttatataggattcatctaaagaaactaagaggagaagaaaagctgagagcgagatgctctccgctcttaagaaggtaagatactaagacgtttgtttcagtggtctgtactcagtactatgaattgcaggtttgtcatgaaaatgtggagtactcttacaggttcatgacctggagcatcagtatctgaatgagttgaaaaggcgggaagcggtggaggagacatttgcacggcaaaaagaggaaattcaagaaacgaaaagagagctaaacaagatacgtagcagacatatgacagagatcaaagctcatgaagaaaagcttgcagaaagcatccgctttatccaaaagattcaagcaaagtatgacaaaacactacatgagagagacactgccatagcagaatctgaaaaattgcgccaaatgaacagggatggagcttcaatgatagcaaccacccagatcgccgacttctctttttttgagctgcggcaagcaacccaagactttgatacggcactcaagattggcacaggcagatttatgaatgtgtacaaagggttcatacggaacacggctataactgtaatgttgcttcatcctcagggcctgcaagggcagttagaattccatcaagaggtaaatgagataactaaagttgaagctatatagccatacatttccctttcagcagaagagcactgaatcatcattttctgtatatgtggcgtcataactgcaggttgttgttctcagtagactgaggcatcctaacgtcatgatgctaataggtgcatgtccggaagcttttggcatggtgtatgaattcctcccaaatgggagcctcgaggaccagctctcgtgcaagaaaaacacaccaccactgacatggaagatgcgtaccaggatcattggggagatatgttcagccttgaccttcatccactcacagaagcctcacccggttgttcatggtaatctgaaccccatgaacattcttcttgatgccaactttgtaagcaagttgcacgtctgccagcttctcagaaaatacaacaccggaaataacacttcaggaacatcctcctacattgaccctgaattcttgtccaccggagaactcgccccacgctgcgacgtgtactccttcggcattatcatcctacatctactgacaggaaaatcaccacagaacatcacaacaatagtagaagatgctatggagaaaaggcagctgcattcaatcatggacacctccgcagggagctggcccttcgtgcaggccaaccagcttgcgcatctcggactgagatgcgccaatttgagtggaaggcaccggccagatctcacgggggaggtgtggggggtgatcaagcctctgctgaaggatgcttcccagaattttggatgcaaacaagcatttgaagctctatcagatgacacacaagcaccatcctactttatctgcccgatcttgcaggttggtaatttgcgaccacatgataaattgatgtgatataattgatgatttcacacaaaattgacggggttctaggtcgatgtattagtagtgctatactggtttatccaattgggagtatgtattcgaacttaccagaacttttgctccgatggatggtgaacaggaggtgatgactgatcctcacatcgcagcagacgggtacacgtacgaagccaatgccatcagaaactggctcgacggcggcaacgccaggtcgccgatgacgaacctgagtctcgaaaaccgcgagctcacgccgaacagagtgctccgctcggctatcctcgagtggcgacagcacaggagatgacatcaacctattcctcgatgcggactcagctcatctagatgcttcatctcacctgtaaaatatagtgggggatttctggtgttacctgaacatggcgtgtgcctgtgcagaagtgtgcctctaaaatctcaatcaccatctatcggcgtgcacctactctactatcttaggtcacaaaaggtggatgctcatgagcggaatcggatccttacctgtgcgcgcggacggcggaggggcggcgagtgctggcgccgcgccgggccggtggggtcgatgtgacggcaaccgacgcgcgctccggctcggattcagcgcgggcggcggcgaaggcaagcggcggattgcggcagcaacgtaggtcccctcaccggttgcgcccccgccgcctcgccgcgaagggcgatgctgccgcacgctgcgctcgcctacggccgccacgcgctaccgctctcaccggcagagtcgagccggaaaggcagctcggttggtgagtccggtgggctcgccaattctcatgggcctatcgccgctacgagataaagaaggaataagttcaccggaggtcttaacagcgagattttttatgtcccttaagtacaaaatgtttacccctaaactcaatgtttatggcagtatatatatatatatatatatatatatgagtggtttcgctgacgtggcatcttagttagaaaaaaaaattaaaaaagatacgtgggacccacttataagttgcacatctcttttctactcgttttctttccccttctcttctctattctctcttctctcttctcttcttcaggccgacagcaggcggagagccggcgggcaagcgtggacgcaggcggcgggcggagagccggcgggctgctgtcgccggagctgcatagccggctcctctccgaccaccgcgcacccttgctctccctcctccgccgccgggacgacgagctccggaccaagatcaagtaccacctcctcgcgctcggatggaccatcgcctccaagcccaacctccctggcctcacgcccaggctccgctacgtctccctcgccggaagcatgcatgcatgcatagcaatacacaaacatatatatatggtgctcaactaatggctaggtcctcgcatgtgcagcggctgcaacaacaagagcacggcgacggcgatggtgcctccgcctccggccacctccgccgcggcccagtgctcctgccgccgacgacgccctccccttctcttgcgtcaccggccggcgccgccggcagccgaacctcttgtgacccgtgggccgtggctccgcgcacgcccgccgctccgctgccgtgctcgcccgccgtcgcgctcgcccgcagcccggcggcgcttcgacggtgaagagaaaagtgaagaggagaagaagaaaagtgaacaggagaaaagagaagaaaatatgtgaagatgacatgtgggccccacgtacttttaaaaatttttttgctgactaggatgccacatcagcgaaaccacccacgtatactgccataggacctttagtgcacggtttgtataagtttagaggtatacatttctggtttatggttaagggacttaaaaaaaatcttgctgttaagttgagggatctccggtgaacttattccgataaagaaagcccatagacaccccaggcggtgtgggccccattaaaggctcaagctcaagatacacggcccagtatacaacggtgggcctcggccatgttccgcacgttggcccgtgaaatgcagatatactcggccctgatcaggttcagggcatcttctcaaaataagaaaatccatgaaataataagtatcatattttttttaagaacacggcaaagatctgcgtatcatttcattaagataaagaacaaaagatgtacggtgttagaaaaaaactccgacactcgcccaccaagaatacaacagaatactatcgacgtttgatgtctcgactacggtatttgcatggcatagggatcgttggtactaggatatacgcgagactgaggtaaaagagacggagacatcgatttttatacaggttcaggcccttgaattgtcatgtaataaccctacatcctgttggccgaagccggtcgttgcccttattcaccataatcacaccagtacaatatttagggtagcctatctaactgttgtcaacatggcagtctgaaggtctgactcgcagtcgacaacagggtagtcttcctcctcgaatccgtgctggcgagatcaaagatagcgctttcgtctctactgacagtgtccggagacaccataggggactagccgtgcctatctctgaagtcgatatccggcgttttgtcttggcgtatgttggcttgtatgttgatcttctgtcttgatctattattccgtagattgtggtgggtgttgattgtctgtgttcgtgtcccctctcctcctacgaggccttgtatttatacccataggtatccccttgtccaagtagaactagggaaacaaatatggatacaatccgagtagtcattgtcgtttccatgtagaactctggttgtctttccttatccggaactcctcctatatccgcaggttgtttccgtataggacatggtatgtggtgggtcctgccgagatttagtcaactactattaggtatgtggtatccataaccctgacaaataccacacacccaaagaaaaaaaaacacaaactagtgcattagcagcccagtcctagcaaagagatcatgaagcctagcagctcctgctaggcaccaaagagcgccctcattagcgatagctcggaggacatcggccaagcataggatagcaccattaaatacacaattgttcatgtgcttccgatcgaatttcccaagcgaccaagatgattaaagagtttagccctttcttctcattagtaggtaaaccccttactgttcttgaccctcaattggcaaacctagcaataacctgggtttgaaaagctagagtagccaagccgttgcacgaccaaacaccatacttatcaagaaaacacacaagtgactaggatgtgactaatagttttctgagctagatcacataatggacatgtaggcgggtgttgaagtcctcgcttgtccaaccggtctgttgtccaacaacgattattaattgccaaccatataaacaatctgtatttcaaaggcatccaactctttcaaattcttcttctaggtgcaaaccttaccgtcccaacaaagatggcctcatatgcagatttagaagtataaattcctgagtttgagagcttccaaacatgctgttctggaacaagtatcatattttaagacatactatcggtgaatataacttccaaaaaaacgtcatcttacgagtcaacgcgttgtagaaatgacatatattgctgttagagttatatccattttactccgttaacctcgtcacattttaacagtgagaaacggatggaacctaacggtaatggtatttttaggtaagttagcttgtacaatattttttggaagttgtgttgttggattttctcctaaaattcagcgggttactgtatcccttcgtcctgcagtccgcatggtcaagcggttgtactgcatggacgagctctagaggtgaacggacatgcacgagtacacaactcgagtcttctttacatcgtttttgcacatctcgcactcggtagcactgttctcgccgtacgcagaagcggcttcataccgctatttctactgtggtagcaggattcagaattcgcaaaattacataaggccacgaagggagacaggacaagacagcagggagacaacaatggcgttgtcgtcgtccccatgcacgaaggcggcaacctacacgctggcaaatcatgcaagatcacaggatacagaatcgccgaaggtaatagctttgggctgttccggccatacaactgaatggatgacagcattttggctggcagtgggccgtgcgccatggcgctgtccaagttctttaatcatgtggtgttattagcatctactcccggacagggtatatcgagttgtctttgcttggatggcttcttgtcttggataagcgcgagaaacctatcaaatttattctgccaggttgctttcatgaattattagtatttcggatggacctgattgatcttctctttctgtatgcatgccctgattaagctccaatttaaactctagctcgtttaagaaatccaaagtactctatggtttgtgttatgtggtaggcccatgctaatccaaatttatttccaaattccaaaccaatgatcttgcatctcccattatttgcctgttacatgtggtttggttttgctaagctggtacgtaacagaatgtcatttgcgtgcaaaagctgatgcttagtttatctatttctgttcatgtcaagaaaagccaataataatactccctccgtttaaaaatattatttgacaccgttgactttttagcacatatttgaccgttcgtcttattaaaaaaattataaaatatgtaaaactatatgtgtacatgaaagtatatttaacaatgattcaaatgatatgaaaagaataaataattacttaaattttttgaataagacgaatggtcaaacacgtactaaaaaatcaacggtgtcaaatattttaaaacggagggagtatgacctaacgaccaccggccctgaactatgagccaggcagtagttaggccctcactatattaaactaatatttgcggaagagaactgatcctcgtcgatagctttttatactttgctggaattgaatttcttattgattagttcatcctcgaagccaatcatttggcttcaatcatctggagcatatccacagacaccatcctaccagatactttaaattgaaaataaattcgcacggaaaaccctaaatcatccccataaattctgcaccacgcaaattaaaaaactgatctggaaaaaaaatcaaaaaactgttaagtcagtaaaccatcattcgcgtggctgacactggagcagttggctgtggcgctggcgccgcccagggggttaggcagctgcccggggcggcgcatgtgcgcgccacggacgtgtggcgtgcgcgccgtggccggcagggcgtgacgcgacgtgcacccgttcgagtggcgcacttgcgctcgccgcggtggtgacgctctcccggcactgcctgcctgcctgcctctcatcatgcggctggcacggtggcaatggacaaggtggtaacaaggtgaggggaaaaaaatgaattttgaaacttgattttaaattgttatggggtttttcatcgctttctttttaagcttgcttttaactgctaagagtgaaatataaaaattctatccttacaaatagcaattaaagatttaccactggattcacatgttataaactgttagcgataaattattgaatgccacatcttaaaattactaaaaagttaaatgctcccatgcactagttgcggctgatgaaagaaacaatgcaaagccagcgagatactgatgatacagtggtacggctctgcagctttgttccaacggcttctcgattttttcagcagcagaaacagttgtggcaacggtcatcactcatcggagctcagagtctgctccccccgccaataatacagtgatatgtgtacgtgttcgtcagttagtgcgagtacaattgcactgagaagaacaggagggaatagttctccttttcggtaggattattgaaggagatgggatgtattttatgcttgttttttcccatagccatctgaattccttgattctgtgggctgaacagctagactgtttcagcagtgaaatattggagaatgatctgttcttcggtggaaagattgaggtcgttcaaagctcgggaccgaaactgacatgcatgatagtggtatttttgtttctcaggatattcagagcatgcgaagtggctcatggaaaaacgttagttgcaaaatttcaagcacaagtgaattgatggtcttgtccctgctctttattttaggaaccttgttctttaattctgaagttgtacagttctgaatttctgatggctcatcctggactaattactgaaaattcaggtcatagaaattcagcaacgaaacatctgcaaaataattttggccacaatcatgccctgcttaggtgtaaaggacgaaagtttccatgcttagctgtagcatggggtctctgaattgctggaaactctgtgcaatagcaggcctctgaatatcaatcaagaacgtcacccaggctttttccgcaaacaaattcagtgcaacaactactgaaaaaacaagtactcctgtgcagctcgctttgcctcagaaactttactttctctcttcagatttttcagtacatgtagctgcactatacctgggccctttatcaccaggaacaccaaaacaatggcatcttttgactctccatggaagcgacaacatactacagtgtagcatcaaatgatatgggtcatcgagctaagtgtaacacattcaattaagtggtctgaagaaacttgaactccccaacaagttgcctatccttttttcattttgggtgaattgcactgcagtttttctatcattatgctttctggaaaagtttactgaatgatgaagccaaagtggttaggttcatgtttgcatcatcatccatccaaagcagtggcacagatctgtgctccattaagctgtgataaagcatcgacagtaacataactactgcaatgtaaactactccgatagtagtactcgtagtagttgttctctttctttaacacgcaactgtttaaagcaaagctgatcatatgcagcctgatgcaggaactgtatctgatcacgctaattcgacagtactagttaaaaaaggaggatttttacggtacattctactactagtatatactaccagtatatttaatttaacggtttaaaattcatccgatctcccttccaattatcctgcagtataaattgaaaagggtatatttgtctttttatctaattatgtgggggtaatttcgtgatttcacgtttcatcactggtcagatccgatccacggtcacccctttgtggaagtcgcgcccagtcgtcttcctcttgcgagcagcgagcgccgcctcgccgccgccgccattgggaatcgaatcgatttccctcctcctttcctcttcttgtgtcttttctggcgacccaaaaccctagttcttgagggaggcgatgggcaggcggagcagcagaagggtgcatgctgctgtggcataggcgcgcagcttccgcagctcgcagcggcaagggcagccatgcggcggcaggtcggatgcggggaagaataggctagggcttgagggagggcgccggggacgcgggagacgccaggcgcgtggaggttcggcttctcccggcgccggaggaatcgggatggaggcgtcggcgcgggagcaacgacgccggagcagcgacgcgagatgtatcgtgaagaagcggatgacgatatccacagaaaaaacaactgaaggaaattaatcccagtgaaaataattctctaatttaaatgaccaaaaagcccttttcagattttcacctaataccaaaactaccctttcatatactggtagtatatactagcagtagaatataccataaaagtccttaaaaaaaggtttctaaactcgaatcgaagagggttctaaactctaaaagaattagccgctaacatggatggactgtacatcacaaattctcacacacatgacacatatattataatcatatatgtgcccccatcactgtcctttcgacgttggctttggatcccggacaaaacagaaagaatccttcgaagtgagggaaaggattaggcatcctggctagtaggaggagtacaacagaagaagccatacttctagaattcagtattgcataatgcaattaggctgtgttcttggtggaagttaagaacctcacctctcgacacgaaaatggaacgatggactaacatacaattaattaagtattaataaaaaaatataaaaaaaaaggttaatatgatttttttaaaaaaagtaattttcaatagaaaatttttgcaaaacacacattgtttaaccgtctgggaagagtgtgcgaaaaaagaggaggagttaggctgcgttcggatctcggagatgggaactcattccctcctcacgaaaaacggagtggtccattagcgcgtgattaattaagtattagctaacttttttttaaaaaaaataacttttatatagaaaattttttaaaaaacacatcgtttagccgtttgaaaagcatgcgcatggaatactagtaagagcggttgggagtcctttgcaacgaaaacagccttagtagcaagcacaaactaactcagctttagaggcccctcatattgatgtttaacttgttatggggcatttatttctacacagtctcatttatcaactgaaactaaaaaggttgtccaattccgtcctccttttgtaacggctcgcaaatacaatgggttgtttagattcatgtcattttaaatcatattattttttataaagttatcaaaatgtacatatatttatttatttttaccaaactttactaaatgagataatccaacaaatggcatttaaagcgttcaaatccaagaaatgccatcgccgttatgcttccgtccgtttcacgccgttaaaatacaatgttcatcctataacacttaatggtgtggaatggacggaaccctaacggcgatggcatttttgggataaagtcgtttgtacgatggcatttcttagaactcatatttgtcgatggcattttttgaatttggatgattgtcaatggtattttttggattatctcttagtaaatacataaggaatcatgccaaaacttgacaatattgtcaacttatcaaaatttaattgggattattttggcgataatatgaacagcccttacatttctgaagaattatagctcaaatatggctatggccctgtttggattcggagggctatttaatagccctccggaatcttgctatttaagagtattaaacgtagattactgataaaactcattccataacccctacgctattctacgagacgaatctaacgaggtatattaatccatgatttgctacagtaatcagccgctaatcgtggattaatatacatcattagattcgtctcgtaaaataggctagggattatggaatcggttttatcggtaatctatgtttaatacttctaaatagcaagattccgaagggctatttaatagctcggagcatccaaacaaggcctatgtttagatccaaacttccaactttttctatcacattaaactgtcatacatacataacttttcagtcacatcgtaccaatttcaacccaaactttcaactttggaagaactaaacacagcatatgacagtgcagttcagctcaattttgttcggagcctaaaaaaaagaaaagaaaaaaagctcaatttggataaggctatgaataaactcaaaaaagcatccaacctaaccaccacactggcccaccagggcccacgctccactcccgtgatcatcacctccttccctttccagaaccaccttctccttccttcctcctcttcttcttcagtgtactctgcctttataacaccctactcctctctctcacctccaccatctagctcactcacacagtctccactcacacgcattgcagaggagaggcgacaatggaggggaaggaggaggacgtgcggctgggggcgaacaggtactcggagaggcagccgatagggacggcggcgcagggcgccggggacgacaaggactacaaggagccgccgccggcgccgctgttcgagccaggggagctcaagtcgtggtctttctaccgggccgggatcgccgagttcgtcgccaccttcctcttcctctacatcaccatcctcaccgtcatgggggtctccaagtcctcctccaagtgcgccaccgtcggcatccagggcatcgcctggtccttcggaggcatgatcttcgcgctcgtctactgcaccgccggcatctccggtcagttcactctcctttggcttcctcccccaccttcaagatctcaagtcttcaactttgtcatgattttgccttggtttgtcttgctagttgatacttacttgttacctgcactttgcttggctcagtagtttcttcatactagcatgctcactttagtaaagcatgaggtatagaatcatgtgtactactactgctccttccataagtagcaagactttgaggcatatggcattaacactgaataattgatgaaagacttttagttacctgcttttggggtgttagatcagtattagtaactggaaattcactaaatttgttgtccatgctcttgtagttttaaagaattattatagctttctacaggtgttgaatgcaccaaaaatttatgacactaccttttgctcttgtaccatcatgtaccttgtctgcgcaaagatttgtcgctggcatattgtactgctgtggtatgtgaattttgttcttatgcaaaggtttgatttacgactagaagattaaggatttaaggtcatccgattgatttaactcttaacccagcattttcttcggtagtgttctaactgttgatgctgaaaccacacaaattatcacacaaaaatatattatttttagttcatcaaaattgaatgtgcacttggagccttggaggcaaagaaatatgtgatgccaaaattttctccttggttaatcttcctaccagaatattaacaaaactatatgaacaagtaaatatcttgtgttgtcaacttatacagtctatcacaactcgcaatcttagaagttaatttctgtaccagttttatataatgcttcaaaatctcaaatactaccttgttaatctcaaaatatgaatacatgagggtacactatacagtcttacttcaactgtcatgacaactgaccacaaaacaactacggcaattaagggcactactaatatccattatattgtctgttactgcaacaggaggacacatcaacccagcagttacttttgggctgttcttggccaggaagctgtccctgacccgggccatcttctacatagtgatgcaatgcctaggggccatctgcggagctggagttgtgaagggcttccagcagggtctgtacatgggcaatggcggtggtgccaatgtagttgccagtggctacaccaagggtgacggtcttggtgctgagattgttggcaccttcatcctggtctacaccgtcttctcagccactgatgccaagaggaatgccagggactcacatgttcctgtaagtatccttctcctttttgcagtgtgatatgtgaaagttcagtagtagttagtgtggtctaatgagttatgcactgtgataactaattcatcaccaaaccctaaagtgataatgtgcaaatcactaagcagtattttggttagcacctttacatacctcactcatacagtatgcctttaacaatgaactggtgtgctcataacttgtaggtgtgcgccatttatggctagacttttaactagtttaatttatcatgtttgctcaagaaattgactgtatgcgtatagttactggaagtatatatgggttttttgtgtgttgcataacgtatttctgtcctttgttggtgaaaacagatccttgccccactgccaattggttttgcggtgttcctggtccacctggccaccatccccatcaccggtactggcatcaacccagccaggagccttggcgctgccatcatctacaacaaggaccatgcctggaatgaccatgtgagcaacctttcttctctttttacctactcgccgttctcagcaattggttcctcttacattatcagatattagtcagcacatcattgataatcgatacattttttgttggcaaattgaggtctaagctgataaacatgtcagtatatataatcaaatgttctcagcaattggttcctcttacattatcagatattagtcagcacattactgataatcgatacattttttgttggcaaattgaggtctaagctgataaacatgtcagtatatataatcaaatgttctgatactttttttggttatatttttctctttgtatgggtaggtctaagatgataaacatgtcactataaccaaatgtagcagcatgctcttgctaaagtttacttagtagcttaccagcttactagcctttgctcaagaaaagagtagaagacacgacaaagagtttttccttacaaattttggtatctaaattttgcagtggatcttctgggttggtcccttcgttggcgctgccctggctgccatctaccaccaggtgatcatcagggcgatcccattcaagagcaggtcttaagccccgcgccgccgctgcgcagccgacgacatgcaacgcaatcgtgatgtcctgtttcccgcgcgctactgctgcgcatctgtcgattccctctatctctagtccccaagatgtttttcctatctgaaccctgaacaactcaatcgtgtaatccagtactcagtcactgtatgtttttatgtgatggagatcttaattcttaagttatcatctctgttgctggaaatccggtttcctcttcgtgcatgaaccgcgcctttaatacacgtactagaataatcttggcaggcagcaatgctggtatgatcctacgaagcctgaactatgaatgtgaagggaagaacgaagcaaaagagaaaagagaacaaaaaggtagctctgtctagttcccgaccgagtaatgccatgaaagaacaaatgaaccctagtgagtgtactataccaggatgagtgatgagtccagccttgcatccatcaagggctagggcttagcgatcgatctgatgaggagcggcggtttgaatctgtatgaatgagttagtggtgggcctggcttatgtgcgtcaggacaacgataacgatgaagatgaggacgattgatggtggccgggcgcggtgtaaagaaggccggctggccgggtagtgcgatggggacccgctagccaccgggcgcacgctactactactacttgctacgtaccctacggcagcgcggcacatgggaggtttggtggggtgtttggtctcgccactagggacttggaggcgccgaggcaaaaggaagttgaaacttggaagcaaagcgtgtaaaaatataatggagcagtgtagactgtagagatagatagatgaagtactatactagatacctgggtcgcatttagccatttactacccttttgcatttcgccttcgtcatcctgcttcagggaaatttggcaccagggaatattgaggtttatttatcatcatctcatccctcaaaaatatatgctaaatggaaaattaaaatggaaccgttccaaatgatcctatgaggatgcaccacccatcccatggttcagacgatttcccacttaagagctcctttgaatcaaagaattttatataggagtctcatacgatttaaatcctataggaatattttctttgtcgctatttgattcaaaggattaagggtttctaaatccaataaaattcctatagaatggctcattgcatatagattttagaggaaatctagcaagagctagattttagaggaaatctagcaagagctccagcctcttcaaaaatttcatttaagtctatatctctcatccaattcttacattttcatgcaatccaatcaaacgaccattcctatgttacacgtgtgttttgcacttgcatttctataataatcctatgtttttcctattcctccgtttttttcattttcctattcctccattttttcactaatacgattcggggtgcaggaa

SEQ ID NO: 82466 - DNA, 11702 bp, Oryza sativa
ccaatgtcgacgggcacgcggcgggcgcgctcgcgctcgcgacgccgacgccgacgccgcgggcggcggcgaggagcgacgacgtgtcgagccgtctcgacgaggccgacctgagcatctgcggcagcaacgcggtcgtggcgccggcgctgcccgcggacgacgacgacgacatcgacgccgccgcgccgcgcgaggaggaggaggaggaggaggaggggccgggcgccgcgcgcgccgccggcgcgtcgtcgtcgggcgggtcggggagcgggagcgggagctacccgctgttcaagcgggggagggaggagctggttgacagccttagcgaggtcgccgacgagacccggccgtcgaagcggccggcggcgaagcgccggactcgcgccgccgaggtccacaacctgtcagagcgtgtaagacctcaagaacaccaaccaaccattgatggatagatggtgttgcatcatttgcaacaaggtgaatgttcttgattttttttgctgttcttgctgcagagaagaagggataggatcaatgagaagttgagagcattgcaagaactggtacctcattgcaacaaggtaaaataatttctgcgaaaagttgtgggaatttttgttatcctgtataatagtatagtgttcttggctattgccatggttgaattttgtggcaatttgatgattctagctgtttctcagactgacaaagcatccatactagatgaagcaattgagtacttgaagtccctgcaaatgcaagttcaggtttgaaatcaaactttccccatttctccacagtagcaatagaatttcaatccttctggatgaatcaaatcacggtgcctgattgtgagactgttgcttcatgttcagatcatgtggatgactaccgggattgtgccgatgatgttccccggtacccaccagctcatgccaccgatgggcatgggattgaacacggcatgcatgcctggggctcaagctcaaggcctgaatcagatgcaaagaacaacatattacatgaacaattctctgccaaaccagatgcctcagatcccttctccagctatgaatgcacccagtgttccagacgatatgcagaatgataatcgcatccgcgggccaagaaatccttttcttcattgcaatgatacactgacagcaacagctcaggttgattattatgttaaatttcatcattaccgatcattcagacttcaattcttgtttatcttacaatatcagttcttttcaggtgccaggtttgtttacctatggatctcaaattgcagaacaaaatgagattcaggagttactctctggcgctgtcattccatcctcatctgatgggaccataaaataagtaagatgttttgatggtcagtacacagttcttgatatttccaaacttaaatgcagcatggacatgtacatgaaacctccctatagatgcacttgcacaacaatatgaggtatataaatcagagaatacatggtatatcatttttttgcgcttaaccgcactaatttgtgtactgaaactagttgattgtcgtcatttgatctaattccatcttctgatagatcagttttggacacttcagttctgctttgggcattgtctagtcctatcctatcaatagatgaactctggctgtggttgtgcgtccatttcgttctttcgctgttgcattcaatagactattttgtcacattagaaaaaacagtgggctagttcacaaacaattgggttgagcatcgctttcatgatatggacatgataagcagtgtatagggacttgcatgagggatcagcaactagcgaaaaacgctactagtagcactgcatgttgagcaagttgttgcctccttgatgctatccttaatatctcgacaaccaatgctttcttaacacgattgctgaaagataggttcattagctgataaaggttatgatgatctataaagaaacaagtttagattgaccatctaaaacataactgaagatgtcagggaaaattagacatgtgcaatgccatctagcattataagaatactttctttcagcatataaaattcacagtcattcccaagcaatataatactagtgatgaaacaatgttttcctcactttttttttctcatcatcattgacttgtttgttgtgcagtgaccaacatgcaaacaactaggggagataaacaaaggaaggcagaacaactggtcctagaagaatgatttgattccaagatgcagtttgtgtcctgtgagtcgtgtaaggctgaagctttgggacaccactcggcagtcgacacgtgtacaccgcctcctgatgctattcttatctgaagagtatagtgatcaacatcacctttctgtttctggaagggtttttgtctatgggagatgaactggaggatccctttgcatagataatcaagacaacaggaagatgcttcatatgatgctacatgtatggaaatggcaggcaccggcaatatgtgaagaatatagtggctgtgtggactcagcttgagccggcatcgcaaaagctgcacaagaacacaacagtgacagtttcactcttcttttagctgatgttactgttatatgatgcctgagggacatgcatctggtgagttcttacaagaacaaatcaaggaaccaaatgacagttttggttgctatgttgatttttcaactggataagcataaccatcggttcttcaagattgcacatggtctaaagcagaaaaagaacttaggtagactgaaccatgtacaattcagatatatggcacatcaagatcattggaaatgcgcagatatcggcagaaattttgctcctgaacaaaacagctaccacatctgtatctcctcttgccttggtactcattgcctcatcaatgtaactttcacctttctcatgatcttgactgtactacttgcaactagtcgaattccctgcacaattgtgcagtagacagtatagcaaatatgaaattgcatttcttgtacatctataatcacattattcgatcaatctccatcattataatttggacttaatttgcacatttcgcaacatatacataatttgcaagagaggtttttgcaatgtctggtagtgaaaatgccaaaatgggggactatgttcttcctgtgttaatgatagttagctggtacaccgttgctttgtcgttagttaatcatgacagggatgtgcttcattaatcactacttataaagtaattagtgagtccatttcagtcgctatcaatcaagatctgagcttttggtccgcatttatacgttgagatttggttctcgccctaaagttggatgtagagtatcttgttgggagaaaatggcacatcgagattgacataaacatatcatccttttttgtcaaaagatgatgtttatacgacaagccttcagtatggaagcattgcaatgttcaacagtagtacaaactaacaaacacaaaaacagccaacgcactacgtggatctcttcctatcactattcttccctcaatttgttaatctctctgcacccaaaatcgtgtattatcactctgatcagccaacaattcaggcagattaattttctctttaaaaaaaattaggcagattaacagactgttccatgaacagcagtttgcagggatagttttaatgctcttttaaattatttttttctactgcaaacacaaatggggtggtggcgcagttggctagcgcgtaggtctcatagctaatgttgtgagtgatcctgaggtcgagagttcgagcctctctcaccccaaatttttttccttttttcactgcaaacatgaaaccttagctaaacccacatgagttcatggaaaattaaatatgaattattatttttttgtaatgctgcttttatatttgttcagagcaaacatgaaacctgaacccacatgtgttcaatgaaaattaaatactccctttgcttttaataaatgatattgttgactattagaaatatgatgaatggaatgacaaaaaccgagtgattgcgtgtatcagctgttcttcctgttcatatgatcatatcgccggcgccaggggcaatggttcaactgctgcattcctgttcaatatcatcagggaggcaagggcacagcacagtgttgccttttttttttttttttttttttttttttttgctctctgcgctgtgcagcctacttcttccagcaatttctgcacagatttctgtttggagaaggtggagttcccttttcagcttcactgtttagtgatctgtaatcttttcagtcgggtaaataaagacattgatcattcgataggaacagaaaatggagtgtttgcttggtaatgtagatgtggacctaaattaattggttttaggcaaaatttgctacaggacaccgaaagattgcggtctttgctgtgagacacctgaagatcgtgtatttgctggtggacactgcaaaaaagtggtaattagctgctggatactcctcccattattttattatttccggtaaaaatggagagagagagttgtgtaagtactaaaatgcccttggacactgttcttcctctctctctccttttcttttcccaattcttcctcgcgacggcggccggcccgagccaggatggctcggccacggtggggcggcggcggcggcgcatcaccggggttcaccaccgacggcgatgacgcacggcggcggcccggcgcacggatgaggtcggcaaagcttggttgtcgacgatggctcgcggaatgtctcggcggcggcgcttcaccttggatgaacggcgatggctcaatttcttcaaaggattaccatgcatgcatgtctttcgtgttagagaggtccatgtgaggctaccatggcaaggaatcggattgggactcaccggagagggagaaatcgaagatggacctcggcgaccggagttggagaaagatgatgccgatctctaagatcgctgcgcgactggatagggtacttgggggtaaatggagaggaggtcgaggtgaagctgatggcgtggtggctcggcctacaacggtccactgcacccggaacggtgacgacgtcgaggcggcgacgcgcagagcgcgctccaaggccggcgatgacacgatggcgttcccgtcgatccgctgcacaagagaggatggaatcaaaatgaaaaatcttcggcatgttaaggtaagtatggaacggtggtgaggcagagatggagatagctctacggtgacagtgggcattgtcttcttcatggccggcgagggatttgaggacaacgaagagattgagggcttcctctctcagtttggtcgacactagagccggggtttaccgccgacggcgacgacgcatgacggctcggccatggtggagctcggcggcggcgcaatgagaaagagacgaacagagaaagagaggaagaagaagaatagagaaagagagattgacaagtgggcccatgggcaaacttgtctttaaccaaagtttctctctccattttgatctgaaataataaaataatgggaggagtgtccagcagctaattaccacttttttgcagtgtccaccagcaaatacacgatcttcgggtgtctcacagcaaaggccgtaatctttcggtatcctgtagcaaattttgccttggttttaagccatgccattatgcagatgtaatgtagatgtgcagcctacatcttcgcagcaatttatgcacagattcctgtttggagaaggtggagatcctttttcagcttcactattgagggatctgtaatctttttagtcaggttaaacaacactcaatcaatagaaacaggaaatggagtctttgcttgataatgtagatgtggacataaattaagttattttaagccatggcattcttgtatcacgaaaacagcatagtaagttcttttgtctgttaacatcagttatctttttggtagtactgacatatgctgccagcatcagcattacttttgtctgttaacatcagtaaacagttattatttgattgataatgtatggtgctaactgtatatacaactagtaagttcttccttgacacatgaaaggacatccaattagcattttcttcagataccgatcaagttattcaggaaagatcattcttagcacaatctatcaacaaatctacaagttattctgttgtcaggactgagcatcacaagatgcattgtttgagatcatggaaaaccttgtcgaagttctgatgctgtcacaagtgttcaaatgatatgccatcggtatatacttccgtttgttgaagccaccatagaagcttggttgcatgtgaattagcaggagttgttgttggatcatcctgggagccttttgggtgaagaattcttgggccagcatgagatggtacagggttaacaagtaagagctacaccatttagtaactgtgtaactggaactggactgagctgttgacatgctgtgatgacacacaactgggagaaaggggaacgaagaaatgagcgctgttcttgacctgcatatggacagagagatattcaggcacctggcagcctctcccagcagcagctagatgttcagattaattggttgacatgctaatacacattaatgagggatgtggaaggactacaataatcttctactgttccaaaaggttgtcttgccttttttcttgtagtgctactatgcagttggaccttcttgttgtttttccattgtttgctggttgcaagcgattctcacatgtgctgcttcatgcaacatttctgtgattatataatgtaaagttgtgttttttgcaacttcatatatatctcagcagatactgcacctagattttcagggctcaggatcattccaatggtgacttagtttcagacttactagtatggtttcttacatggagcttgtaacctgaattcggaacatcttcgttcttcaggttatcgaatattcagatgttaacatggagatcttccagtccatacagaagcatcttcaggttagcatggagtttgtgatgaaatctgtcaaaccaggagggcctttggctcttgttatcagaaattcagaatggacagtgacaaagagcatcttgaatttgctgaaatgcttctgtcaggtaagctttctccctttctgaacatttgactaataacacgcaacagattggatggttaataatttgaagttttaaactcaagttcatggattcagtatcatctgaaaatgataacatgctgatgttgttggattattttgaagacttcagcagtaatttcttcgaaaaagtaaaaaattatagcatgcaccatgcatcattttaggccaaggcccaaggaatttgacacccagctttatatagaatgcaaaatggaatagagtgtgaactccagcttacaatcactcaccatgtcaccagctcttactcctttctgtttaaggactatgaagtctaaaactctgaagacaacaactgttacagaaaaaaggctaaatgaataagtcgaagacctcaattaaattgagaccaaattaagtttcacctttgacatacactaatcctaccaccctcagtgagtttcttaattagtatcctaaattaaggagcatgcattattcaacctccattattcatgcatcgaagaatatatgcacatttttcttcttcttcctcctgaatttcttgcaggtccaagtacagataccgcgtttctacggatcgaagcaagcattgaaattacagacaaatatacaaaccgtcggatttaattaatgggtagttatcgaatatcaagattcaatcacaatgtgtcacatccagggttcactctattgggacagccctttgtatcgggggtcaccgaaatcctaaaatttcggaaatttcggctcgaaatttccgaaattttaagcaaaatttagttgaatttgaacaaatattacccaaattcataaaaaattgaaaaattgaaaaattacaaccgaaataatatcgtatcggagatgaacgaaatgaccgaaagttcagaaatttcggtccgaaatttccaaccctggtcacatcaatctataaaatgcatcctttttcctttaaattgtacaatattatagagtatgtgtgccgaataattgggcggctagtaggaaggaagaagtacatctattttttcagaaagccccctcaataagttcaaattgtacaaccacaccccatctcctctctctccggcgacattgcggcgcctccggccggccgggttctccggcagccaccgccttcatcggcgggatggaacttccgacgttcggcatgctcggacgcgtccctgtgttctcttctgcgcaggcggcggcctatcgatctctgtctgccatggacggattgaggcggcggccggcggcggtgtgcagctctcgccggagtgcggcgcggcgccggccgtcaacctgactcaacggcggcatgcatgcatgcaggcaagatattcgaactgattggcacattattttgctctaactgcagcaagttcagaactgagcaaaggtttcagtattgaaaattattttcgggaatacgcaaggagcgtattttttccattaaaagaaataaaagttatttacaaggcagtattgaaaattatactactataattaatctatcatattagttcacatgcatgatcttgatttcatcacaagataaacaatgtaggagtacgtatatatacatcagaaacgcagcgagtaaatgcaaatgcatgcaatgcacacagtaatatataattaatctacaaaggctagctatctgacttcagagaaattccaaaaattagactagctcgggcatgcaatgatgtaaatgctgtatatatatatgcactgtcatgttcatatccactgattgtttttttttaactcaaaattcgtgcatgcactagctagatccatgtgaatgattacttaacaagaaaagaaaacaagcattctaaggatatataaaacatgcaatgcaacaagaaagaagagagagatgtagagagagaaagagagaagggaagagggccatgcttggcacctcgcacgccgtacgcagcggccaacaacgagatcgagttcattgggttggcagccatgcgagcggcatacagggagccaggcatatcccctaccttttcatcaccttcacaatcacccaaagtaccaaacacacacacacatatatctcccctccaatgccgccatattgccacaccaaactaactacatctaaattaacaccatgaacactacctatatctatatgtctctcttaaaactatgtcactctttcttttctccctttcaaagtggatatgcatggctagctagaagagaagatggatggatggatggatggatatggatatggatacatggaggatagagcatggtgtgtttgttgtgctaatgctgtgaaatggtgcatgtttgcatgatgagaagggaggcctatccctacttatatagtgcagccactagcccacacctcctctcctcttcatagaatcatactagtcagtgtggctacacatccctataactaaatatatactccaagcaataaaccatgagtaattaattaacctaattatgtaagcccacatccaatgtacacttgtgtcaatgcactaattaatctgcatgcatgcatgcatgatgagctttcaagtttcacctaaaccctagctaagctatagggcgtctccatgcacatgcatggtggtgtgtaagtagcacagacaaacacatgcacacacacatcattgcaagatggaataaagtggagaggggcactatgcacccacagaaagagccacagctggcactgtacatgtcaaaagagtctcttctctctcgcttctcttatgtattgtatactccactttgtatatatatatatatatatatatatatatatatatatatatatatatatatatatatatatatatatatacatgtacatacattatacacagtatgtgtcctacacagcatacatcccatcaaattgacatgcaagttaaacctaacatagtgcaatgcattggccattggaacatatttgagggatccttttgaacggggtactaaaaacacaagaacatgaaaaattgcaggaatcagataccatgttctacacgatcctatagggttacacacgaagatttaattggtgcgttacgtttggatggttcacagaaataaatattggaatttttttcgaaaaagaaaatattggaattttaaagtgaactgtttgctagagaaaaactagagggagaaaggaagagagtgcattggacttctcaaatgaaaataaaacatgaggtatgagctctcgttatattttcctatagaaagggggcatacgaaggcaaccaataagaattttggcatatccctattctttgatccaacgtacggtcctcataggaaaattttttctaaggattcaatcctccacaaatcctttgaaaatccttcaatgcaaaggagccctgaactttttgtgtacatgtttgcatagttgcattgcatcatgcatggtactctctctctctctctctctctctctctcaatctctctgtgtgtgcctgttttgcaaagagctggctttctggactgggctttgtctctgggtgtttggaagcaagtaggattcccctgtgcaggacagatgtggaccagacctgtgtgagtcaagaatcaagatagctagccattgttttgatttgtttcaacctctttctccatggccatgcatgtgctactgctagctagctagcttcttgcacatatgctctcctcttctttttcacaatcaattattactgctgctaccctatttactctttattcgttgcttgacatggcagagggtcaagctctagcttgagaagaatcttgtcgctttatgtcttggacttggaacatttcaacccatgcattaaccggctcgtgtcgatctatcgtcactcgaaatattctcagccagtgtagtaaccgctgtagtattgtctcgagcttcctgttcctgtggccgagaagagaatgcataaaattaatgataacaatttattttagcaattctggaatgcacattcatcaaagttagttttgctatgcacaaataaattagttttgctatgagaagaacgtctgcatatttattcataaaaataagtaatttgctatgcagaagtttgtatgatttcttctgaattaaatgtcaattattcgatggaactcattgcctttcctcacatagtcatcttcgttgacgactttcgatggtggttgcagtgtatcttaatttgccaagttgttcggattatgtcaccggggtgggtgggtgtattaaggatagggatgggaagaggaaggatccatggtttagacggaggctggggaggggtgaaggtaggttgacgtatgtggtaggacaagggaagattggttaggagggaggtagattttcaaggcagtgaaaataagtggaggggtgatctgaagggcaatggagattggtagaaaggggtagagtggtagacttgaaggcggtgacaagaaatgaagggtgaggggcaatggatattggtag

SEQ ID NO: 82467 - DNA, 1086 bp, Oryza sativa
acacagcgcagaagcagctgaatagatttaggatatcctctacatagccagatttatcaattgattaattcaagaataacatatattcactgggctggggcatcttgagaatattttcccaaaacaaatttctcttgcctaaacaaaaatggacatgtgtggctgaatgctcagcagaacagatcagtccacaggttgatcgatgctgccaaaattcttgccgtcacaattctgtatatgatccattacacaaaggatagccaaaaggcaaaagcaaaggtctacagcaacgaagaaaggaggcctacacatacatgaaagcaacatggataaggactaaaaaagaggggaaaaaaatgggggggtgacatcttgtgtcacccggagcaagcacgcatgcacctggcaacttcttggcaagcattttgcaccatgcatacaggtattggattggatgtccatgtgatgtgaggcagcatgccctccacaagaggtagatcattgcaggccacagggcatggcaaatcatagcaacgtgaccaaagaaacgaaaaggctgtagccacaaatgttgaccttgtaagctgaatcctcgtacggcaagggtgatctttccagtatatacagcataaaagtgcacatatggtgtatttgacatgcgcaaccggtagttgccctcatcatttgacaagaccaggagaaacctcatgcttcaacttaatcattggagatacgattgagcagataagagcatattgtcctttttctaagtatgcgcactgatgcagattcagaacatttggtctctgagctgcacaaatttatatacccatgaatcatgaaactggagcaatctgaagttcctgctgcacaagatttttcttaactgtgccctcagttggtaagattccttacatgggaaaccaaacatccgaactagcgaattgtgcctcagaattcaatgatttaagtggattttcatgttggcaccatatgcaagaaaagattccaagaactcgcacgcttcttttgcttcctttgtgtcatatcactcacggttatgtgtgggttagcgagcaagccttc

SEQ ID NO: 82468 - DNA, 2422 bp, Oryza sativa
ctgactttacgtcataggagcgcgctctatggccggtggcgcgagagaagaaggggtacaactactacgtactggtacgaattcttaaaggtctcaactctcaacgttagactttcttttttctttttacgtgtaattctcaaatgagtacaactactgctggtactataattctgttccacgacgtactccctcactctatccattaatataagcatatgtttggtaattctcagcacacgttactgtgtcaccataccgtttgaaaaccgttggccgctgataaaatttggtcaagttctgttataactgtaaagttcagtttgggtttttttttttaacttgaccggaaaactaggcgatttatgttctcaagcaagctcggaaagtccggttttcataaaaacaaaccgatgttcatcggttttgtaaactttgttccgaacattaaagtcgtttttaatctcaacattaatcttcactaaaacaccaacattgattatattgcggactaaaaagagtatcacagaaaattgtcacattcaatctaacctgcatagagaagtaggagtaattcttccgtcccaaaatataagcattttataaaattttttaatggtatctaacaagctagagagataaaactaaatagggacatttattcttttacctgagaaatggggatgttcgtttattggttgagaaaagtaggtactatgtactaagaactataagttttgaacgtagcgaggagtatattttgggacggagtacatgtttatttactgatatatttaagggagtaccccataaaactcccacctttaaactaacatgcataaacaagtaaagagtagttccgtccaaaaaatacagggactagtgaagttttttttttacaagaagtacgagagtggtaaaattaaaaggggatatttattcttttacctgataaatgacctatgtttaatattgttgagagaataataagaaagtaggtagagaaattgaggtaagaaaatatacggagaagttctatatttacaccatattagtagcggtgttatggtatactcacctacccgataagagggagaccaccatctatcttatggaccatcactgttaacctaaattctactgcagtgagaatctatttgctttatgtgtattttttagtgtttatcctactatcatcattaatcagagggtgacaatttagttttcatcagtttacctaatataattagaatccgctatgatgtataggtattttgttagttgtatgataaattttgaatgcaaccaggagtactccctccatcacattttaaatatagctgtaagtttctagattcaatatttaatcgttcatcttatttaaaacttttttatggttgtatttttattataaataatattttatacatgacttatatttttattttttttcgaaagaaaatcaaataaaacgaatggtgaaacgttgaatacgaaaacccatgttgacagcagcggatccacctcccgggcaagtcgggcagccgcgcgggctccgctattaccgtcaccactattgatagctattgacacccataaaaattaatcgatcaccgaaaaatactatgggcttaatgatgatgctggctccaccactgtacgttgaatacgaaacccacaactactcttgaaatgagacggagggaggtttttttttttttgggaacagtactcctttccaagctgccgactgccgttgccgattttgagggctgggccggatatggctgactgactgacaatgttacgtgacgtcccaaagcaggcaggccaaaaaaaaaaaaaaccgacggttcgtcaacccgtcctctcctcctccatacaaaaatgctacggacacgtctccctcattctttctccgctttaatttccccgacgaaatcgagcccaactacaactatccatccatttcttccactagacatctcaccttgcttcctcgccactctcacttcctctccacgagcaagaggagcaagaagaacgaggtcaggtcaggtcagctcagctcactgccatgatcactgtactccagttctttgcttcttcctcttctctcttttgattagcttttctgaattttcagtgaagtgtgacctgccggctgtcgaagaattgcggcgccatggatgcgggtgcaactgcaaggtcgtcgtcgtcgtcggcgatgatgatgaaccagaagaagcccttgctgtaatcaagatttttcgttttctttttcctttttctttttgatcttgtgttctgtgttgctatggttcttgatcgatgtaaagattggaggatttcgttctgtttgcttgcgtggcgtagctcggatggcgagctggtggagctcctgtggcaggacgggggcgtc

SEQ ID NO: 82469 - DNA, 10737 bp, Oryza sativa
ttttgtttgtgctggaaaagattagttcttgttgctaattgttgcagtcaaatttagctccaggtgattctcagttgtttaggtgttacctgtagtaggtctggttctaagcagctcaaagcagcaggggcagaaagtgtgtgatcaggtcatgcttcccatgcgcacaaggtgcttgttgcattgcctccccgggtgacttgcacttgcacgcatgtcacttcaatcctctccggtgtgaaatattttgtcatgtgatttcgacaaccaaaaagtcccttttgttgagacatatcgtctacaaaccaacggtcatccgattgttcttgttccggactacaaccatcaggcaggtcactggttttggtttggtgtttccctttcaagagggcccggtgtaaatctcttcctgattagttaattagcaacttaacatgtccctatcattggttagttaattatcaactctgtccttttcctgcccctcttccccctctttctgggagagtttttcttttgtaaggtttccacttcaggtgtatgttatggtctttgtatttgtgatacaatcgttgctgctgttttgggaagaaaagtcttccaaaaacagaacaaagaaatgataagaaaacgtgcttcctttgatttcatcagacaggagactgcaggaggctaaagcagcatttgacacaagcatagataatgggatgaccttatttgatacagcagaagtttatggtacagcggtaagaaactagaaaaacttcatgattcctcgctcatattttccttgcgtcaaaattctgaaggttcatttaaccttagttgttctgtccttcagctgatgggagcagtaaattctgaaagtttactcggagggtatgccacgttttgctgttcagcactccattttttttattattttttatttttgcgaaagtcacatgtgcagcaatagtcacctgttgttgtctctcttgccgccagtttcatcaaggaaaggcaggagaaagaacagattgatgttgccgtcgcaacaaagtttgctgcacttccatggagatttggccgaggaagtgttctttccgcactgaagaaatcgcttgaccgtcttgggttatcttcagttgagctctaccaacttcattggtcggcttgtctgctctttctctgatacatactttttctgtaaattttgagcattttgatctcagccgcttttgtttctctgttttcaggccagggctatggggaaatgaaggtacacagtccaatgaaaattacccatataaccatttttatgaattattagatagttccttctagcatgacaaaaacttcaacattctgacatcgttgagcattattcagggtatcttgatggacttgcagatgcctatgagcaaggccttgtaaaggctgttggagtctcaaactacaatggtctgtattctgtctgtggcctgcaaattaaatgttcttgtacattcctcgaattgtttcttcctcagtaaactttcattgaaataatagtttctatgatgacttcattcaagagaaacgccttcgggatgcatatgcgcggatgaagaaaagaggagttccacttgctgcaaaccaagtgaactacagcctaatatacaggactcctgagttgaatggtgtgaaggcagcttgtgatgagcttggcatcaccctgattgcttattccccaatagcccaaggtgagaaccatttctccttattttctgtcctaattgcttcatcgtatttagtgctatttacaatacaatcgcactcgttcttgtacatttttttagccgggacggccaaaggattaggccgctaaaatttgaattttaaaacttaattttggagttgattttacggtattttcagcgtagtttctttttcagcattggttttttgatcgctaataaaccatttggcatataattagctcttggccaaccgatggggcccttgttcttgtaatgactcatttccgttgttcaggtgttctgtcaggaaaatacactccagaaaaacctcctaccggtcctcgagcaaacacatatacccctgagttcctcaccaaggttatattagtacatattactgaacccttaagctagctagttacatacagcttcagcttggatgcgccatttagtctctgcaactgaacatttttcttatctaaaacctataaacatgtttcatgtgcacagcttcaaccactcatgaacaggatcaaggagattggagaaagctatgggaagaacccaacccaggtgcttcacctcatataatgctcagcaaatccatgcaagaaaaggaattaatatctccaagtaggatgagcagcaacttgcaaggaacagaagtgcagttccactgaaaacagctggtgttttcttttttttgtttcaggtttcactgaactggctgacatgccaaggcaatgtggtgccaatccccggagccaagaacgccggccaggcgcaggagttcgccggcgcgctcggctggagcctcaccggcgacgaggtcgaagagttgcggtctctggcacgcgagatcaagggcatcaagatgcccatcgaggagtcatagacatgtaaaaactgaagaagtttttcatgtatatgataggagatgtgtattgattgtaccatgcaatagtaaacattttacggcgataaaatgtgtagaaggtgtagaaaatgagtcagaaatttctgcctgcatgaatagaaaaggtttatatgactttgagccagccctgcccagtgatgattcaaatgcctgtacaatgtaactttgacgcaaacacgcgtgaaccattacacacttgtatttaaaaaaagaaatagatctcatacgtacgttttatattataagtcgctttaaatttttttctagtcaaacctttttagatttgaccatttcataaaaaaatagtaacatctataaaagtttcccataaaaaaaacatctatacaagttcagagactctttatataaattctataagtaacatacgcctgtagtgactttgtcaatctctagtatagatttgtcggctcagtcctcaaagatgcttataggggtatggtttgtgtgtgttcataggggtgggtgtgcgtgcgttgtgagtgtctgcgttgtactgtgtaatttaaaaaaaaaatgatgatatgaatactataagtttgattgaatcttatcataagcaccagatttaaacaataagattgcaaaatttaattatttaacatcgaaggaggccagaagttcttttttttttctatagaatgattttaccgccaaaaaaaaataaattctctctctctctctctctctttttgagttatttggaagcgatatacccagagcggccagcggcgcgtccacgtgtttacccgccaaacacacttgccagtctactctcgccggcgtcttcctctcctcgcctcgtctcgttcgtggccaaacgaagctcgcgcctcccggccactcgcagtcgaagcccagcaaccgccgccgcgccgaggccgagcaacagtgaggaggtagcttgcctgcaatgatggccgggaccctgcaggtcgccggtggctgcctggcgcccctcctccccagccgacgagcggcggcggcggtacgcccgccacgcgcgtccggggcgtcggcgtcggcggcggcggcggcggcggcggtggaggaggacggcaaggtgaggctgggtgggtcggacgtggcggtgaccaagctcggcatcggcgcctggtcctggggcgacaccacctactggaacgagttccagtgggacggtacgttcgcccaatgcgcatactcatcgatttgcttattaactcttgattatttttgtgttattccacctgcaaacctgcaatcgatcgggattgattgaccagttcttgatttaggatctcagtaggagagtctggagtccggactccacctaatatgttgattttgggggaattgttgggattgattccactcattgtgttgtagagtttcatgtagctgatgagctagctttcaggttcaaaggggtcatagttttaacctgtactaagggctaagtagtaattaaggctgtctaactgaggtttgtaaacttactaaccttgaactaacagtgtagtactatttgcaattgatttctgtcccaaggtaactgtaagtggtggtatcattaagacatgaacatcctggggcctagtctaagtaaacattgcattgcaattatgacactagactaaacgtcaaatatttatggtcagggggagtatgagttaaggggtcaggtctctaggtgaatctttgatcatgaacatgctcatggatttgttctctctgcttgtcctaatgttgttgcaactcgcaacgttcgaactaattacagattgtggaatttaagcaactcgcattggaatgttttgagtctgatttttgtatagtttggaaggcaccagccatctaaggatgtaggatctgaaagtgtgatatttaacaaagttgtctttcttttttgcattccttttttcctgctacttgttatttgtttgttgggctgaaatcagggtcatacatcccatgtgcttgatgtgcatgttgcattatctgcaagaaaccacgtgccacatgtaatatgctttgcgaaattttaacgaccaaacacatgaaatgtcataaatctctgcaattgttagtgaagtagacaatttgcttaatgtcaatgacaatccaatgacaaagataccagtgacagtcccttaatatgatgaagcactctgaaatttgccagataggaaattgaaggctgctaaaggagcatttgatgcgagtgtcgattgcggaataaccttctttgatactgcagaagtatatggtgcaggggtaagaaccaaccctgttcatagtttctgatcattctctggttcatttgaaggaaagatctaacactgcattttggttatggatgttctgaagatatcaggagccataaattcagaaagtttactaggaaggtatacaatgtacaactgtttgttgttccaaatatatgacgattttagcacaaaatttgttctaagttctcatttaccatcagattcatcaaggaaaggcaacagaaagaacaggtcgaagtagccattgcgacaaagtttgcagcccttccgtggaggcttggccgaggaagtgttatttctgcactgaaggactcgttatcccgccttggcgtctcctcagttgagctctaccaacttcattggttgtctcattgtcttttcactccaatattatgtgtttattattgttgctagtttatttaactggtgtcatcatctccttttcaggccagggatatggggaaatgaaggtattctttaatatacccatatttaaatactccctccactttttaatatatgctgttgatttttgcatatatgtctgaccagtgcaaatatgcaaaaataagttatgcttaaagtatgtttaatgataaaacaaatgacaacaaactaaatggtaattatatgaatttttgaataagatggtttgtcaaccatatgtttaaaattcaactgcatcatatattaaaatatggaggaaatacataatagaaatatttgaactgtactcaggaagcagtgggagcaattacattgttcttacatgattcaggttaccttgatggtcttggagatgcttatgagcaaggtcttgtaaaagctgttggagtctcaaactacagcggttgtaatctgacttcaagagttacatatgatgcagtttgttgtgctagttacctcttttcagtgaaactaatttcaagaacgctctttctataatttgatacagaaaagcgtctacgggatgcttacgagcgcctcaagaagaggggagttccacttgcttcaaaccaagtaaactacagtttgatatacaggaaccctgaagaaaatggggtaaaagcggcttgtgatgagcttggtattactttgatcgcatattccccgatcgctcaaggtagaattctgattctctgattctgttcttcacattaccattcaactatatcaagatcttttttttgcaagaaaaatgttcaatctagtagtttaaatgaaaatgtcctatcttagaactgaaatgtttacttcatcgatcatcattccatttctcaaatgagtgattatcgaaaataaaatcctagcttaatatgtctcctctgttcaggtgttctgacaggaaaatacactccaaataatcccccaactgggccccgtggacgaatatacactcctgagttcctgaccaaggttgtattttttactaatattattatgagcttgttgcatccttgttcacgaaccctctcctattgcactgctgcaactctgctcattgaagatgtttcttattccaaacagctccaaccacttattaacaggattaaagagattggaggaagttatgagaagaccccaactcaggtgttcttgctgctcaatatttccttttctgaagtctacccattgccaaaaacttagaatgcaaattattcagacataggagtaaattgtaagagggaaaaaatgataatttcatctttcaacaagctcaagggctacctggagatcaacaagatcccaaatgctgaagctaaaacaaccactaacactttgaattctcggaaatttgcagtgcaccaatttcgatgacatagtagtaagcaaagttgctccattctttttttctcctgcattttcttcaggtggttctgaactggctgatctgccaaggcaacgttgtgccgatccccggagcgaagaacgcagagcaggccagggagttcgctggtgcgctcgggtggagcctgacggatcaggaggtggaagaactgcgttccatggcacgagagatcaagccggtcatcggattcccagtagagaagttgtaatttctagtgagtttttcttctactttgggtctccgagaacatcatttacataaatacacaatgatctagacatacatagataggaaccatgtgtagtctttggaactgaaaattaagatgtcttagaaaataaccaaaatttacagtctgagtagcgtacatgcatgtatgctcatcgaccatattacaactaagattggtaactggattatcttcaagaaaccaatgttttattttctctggaaaaagagaaaacctgtttgcaatgtaatgaatatggccagtggcgaagccaggatttgagtatgggggggggggggcaacaaacaagtgattacacttcacacgaggtaaaatatatgttatttcactttacactgggtttagtacatatttttactttgcatcagggtatatcaaaataatttgtgttttacactagattgcatcatataactgcaggaaaatcttataaaccacgtgtgaaacttgtgatatttttttaccaagtttcacaaagttttatccatattttgtaaaacttgatgaaatttctataggtttgattatgtttatcctggtgccaagtgaaacttatttgaaagcagctcggtaaaaagtgaaattgggtgtgttttacccgatgcaaagtgtaatttactccaaaattaacaacaaagtgcaaggattaatatttcagcgatttgaaactaaaatgacgtgagaaagtttcctaatcagcatgtgcaagcgcgagctggaaatacaatatatcaaacgtatacacagtagtagctatagacggcgacgtaaatgatccctgactaattagagcaagattaatagtatagccaattgctagctccaaatcatctatagttaacttaatagttaattcatacaatatttataaacatatactatacaattaatatctggtcccatctgtcatacacacatgcatcttgtagtccgtgctgtagctggctataaatctgtaacccgctgcttttctctctcttttttttatcttctcgaactgtgtttataactggcttatagtatactattgtacctgctcttaagcttaaagctttgaggggatcgagcaattagcaagtgtctatatgggtcattactgcgttttcatgaagttaataaaattattttaattgcggcctcccacaattcttttttcaaacgtgtaggagacccgtgcatcattatattcattcattttgatccgcaggagtgttcaaacacgcataaacagcaccttgcaaaatactatactaacatagtacaacataacatagatttgatttatcataatactatgaattggacaaacagctattcagatttgtaatattaaaatatatcacatccgtattaggtttcagggacggatgagagagtgactgtcccagaagaatacatgaaagaaaaaaaaaggggagagaaatagagaagaaaaacagagaaaaaggaaacaagaaaaaggaaagggaagtaaaagagagaaaaggaaagaggagaaaaaactgaaagatacacaagcgtttattgtagtttattttacaacgctggttataaaatcgctaataacacatatataaaaattttactaaagtatttttttagttgttaataagttgtattccctccgatccaaaatataagcatttttagcatagtaacaagtcaaacatttttaactttgactattaatagcaaaaacattaaaaagaacatgtaaaattgatgttactaaatttatcattaaacaaaccatcgtaatatataactctttttatttaaaatattttacttttatagatattattggttaaagtaccatcattcagagatcgtgtcaggatcttaaaatatacttatattttaaaatggaatgagtacatataaacacataagccaaacaataggctacaacagagcaggcatgctcgaagtgccagctgtggtgaatgatgccattgccgtggaggaacaaagctccagctccggggaccgaccggagaggggtatcgacggcacggtcagaggatccttatccagtacttacatggtgctcgtttgtacccaagataatgttagagcacggaaaagaacaaaaccattaacacatgattaattaaattttaattattataaatttaaagaagtaagtttacctacttacttcgttccaatataaactgtaacttagtatatatcatatttacattagattgcacttatattagaactagaaaagtaatatttttaagcaatttatatatataaagtttttacgaaacacaccgttaagcagtttaaaaaaataccaataaaaattgaaataaaatatatatcttaatttttttagggtgcatatgcgtgcgagttgcgacggtgtacatgtgagcttggggtgtgtttagtttaaaaataagttaaagtttgaagaaagttaggagtttgaaaaaaaaaagttaaaaatttatgtgtgtagaaaagtttttattgtaatataatgtgatgaaaagttgagaacaccgggaaactgaacacggccttggtcactcgctccctccacagaaaaagtactacgcctacggcatggcctgatcatggtcaggtcagcggccaccgccggctttacgcagagcacacaggcagagctttgacctccccacgattccccaaaaccgaatattttttttcttcttcttacggttccggccggagtacgtgccactctacactacttgtactagagaagtatatacggtacacggtctaggacctccgagatctccgcaagatttttttgccacggataataagggtcccctgccaaaattttacatcctatcatattaaatgtttaaacacatacatagagtattaaatataaaaaaaataactaattatacagattgcgtgtaaattgcgagacaaatctttcctaattgctccatgatttgacaatgtggtgctacagtaaatatttgctaatgatagattaattagacctaataaattcgtctcgcagtttacatgtggaatctataatttgttttgttattagtctacgtttaatactttaaatatgttgacacgctacaactttacacccatagtccatagatttaaacacttcctaaggcaactgacaacgttaatagtattagctttgtttactcttattgcgtctcggtggcattcggtcccaacgtgccagcaaggatttatgctgtcacgttcatcacggtcgtagccgtatgaagctcctcggcacccaagacgggccagcctctagtcgaagccgcgttagggacgtcatgctcccgcgacgtgatgccccccctcccccaccaacctcttccctccgagctctagcggccagggtacaagcacggcgacgaacctaccattgtagctcatcgccactatgggtcggctcaagaagaatcgtcatcgtcattgaagagcctaccgccttggacaagctcaagctgaccagatccgcgtcggagaagaccgtcctcaccttgatccggtccaccaagagctcaccacccctatctaaccttgattcacgcagccgggaagctcaccgacaatgccgcctcgatctactcaagaggatgttagcgtgcgggaggagaggatgacaccagcgtgtgggggaagaggtcggttgtggaagagaatggcaccgacgtgtg

SEQ ID NO: 82470 - DNA, 3095 bp, Oryza sativa
tttctttttcattgtccttcttagtttcctcttccttgtcctccttttctttttcattgtccttctcagtttcctcttccttgtcctccttttctttttcattgtccttctcagtttcctcttctttgtccttcttatcagcagaaccgttgcagccattaacagcttgatcatcagatatttgagcaggtttcccaccattttcttcacatttttcaccattttcattttgtttttcaccattttcttcatgtttttcaccattttcttcgtggttttcaccattttcttcgtactgtggctcagttattgccttgcttgatctctctgacgagatgatgagattaggtgcagcttcactatttagagaagagatatatactgagcatgcagcatcagcagcagtcttcgaacatgatactgaagaccaactctgttgatcaccagcatttttccactgaggagaatactcaaactcagcagcttgaccatccactaatatgttcctaatcgtcatgttgtcagcatgcagagcaaaagtatcattttcagcttgaacttttatctcagtgtacctttgagtgaaccaaaaatgtaagctcaatcagctcccagtgttaaaagacataaattttatactatggagactggatagaacaggtgaattacaaagcagaagtcacaactattaggattctttcagctgcatttagttaagaacttacagttaaaatgcacgaaacccatttaacaacttttagaaagagttgactacaagcacagcaatatacaataggaagaagtacactcttcaacccagaactctgaaaccatttagaacgcagcctaagattatttgtaggcaggttaggatatgcaactggttgtgttctaggattgtttccaagttcaaggtgaaaaagaaattaaatcctataagttggcatctaatatgctcactttgaatcagaaaggataataaaagactaatagtccaggtacatttcaccacctcttgataaaactttatcatgtgacaacaagactgggattgatccatcagaatactgtgaaagctcatttactccaagtttacctgttttggatgcaagtacataactgatacatgctccaactatgaaattatgacatttcaatggattattctacggaaacggaagatgttactgtcacaagtcatgatactatatgagaccttagcacgtttatacaccaaatgcaatttagattctccaatatcactttgacaaattgtatgcagttaccagtaagccaaggtgcatctagattagaattataagacacaacatatttacatagtggctggttgtcagtttctgctaatttctgcatggtatttaatcataaatttcttgtatctattgaaccaatgctctagaaaaccatacaacaaattctaacaagcgataaatgcaaatttggtgtgtcttttccatatccactatttcaagatctgattactgatgtcattcgaagaactaagcacaccaatacactcaattattgtgcaagcatttgtcactactgttatattcagtgagctacaaatatttgtctgcatttttgctgatacagaacataaattcagcctcccattctttccaataccacatttggtagcatagatacaattttctttcatttctcaaaatcaactttacaaacagaagttaaaaccttctctcaaaacttattgattaccaaacacatgttgagtctaccaaaaccatgtgctatcaagtaaggaactcccaacttccaagaaattgagagtacatgtacatataaacgtactgcaacagaagccctgcatatttcagtaccacttggcacttgccatttcctcttataaaagcttctaccgtgcaatttccacttaatatagcaaatcatctcatgcattcattgaggctcagcccctggccaacagggttaaactttaacaatgattaaatagcttggcacatgacttttgtgacagcagtggactagttcagcaagctggtcttatacgatttaagattatatcttggccgtctcagcagtattcaactgcatttaggtataagggttcatttggaatgcgtaaattctgttggattcgatgtggataagcaatttgtttcctctcatacgaaccctgctacaagagaggtaatgatcgactatggtcacataagctccttcacaacagtttaaacatctcaattttgagcttagctattggtatcagctacaagcagaagaatacttgtttcactaaagcacatactgcataagtatagctattggtatcagctacaaaagcaggagaatacttgtttcactaaagcacatattgcataagtagcccccacaaagttagagaactgaagtaatatacacacaatgagcaatccgcagtaggcacagcaaatccgcatcaaatacgctgttgagcagtcacattgcactattaccacaagttcactcgctacgccagcagcaactccgaagacaaatcagacaacaagtgagaccagcgaaaaccacaattactcaattccagcaactctcgattcctcgtacaatttagccgaagcaagtcagactccaaaacacgaacccccaaaccctaatccgcacgcctcgaaccatccccccaaaccaaccaaatcaaccacccaacaaaggcagctaaagtgggcacgcattagggcaacgagcatgagcaaagcgggggcgcggcctcacccatagatcagccggttctccatgtcgatggagaggcacagcttctggtggagcacggtggcgccccctcccccgccgccagccccgccgccgtcgggcttctgctcttcgcccttctgcttcctcgccttcgccataccgaaacccctcctcctcctcctcctctagggtttggaagcttctagaaggggaccaaaggcggtcggaagtgaggtggggggcttcagaggtgaggtggtggtgtcgaggcgcgccacgtcatcgcgcggccgtgtggggaaagcgaggggagaagccgcggggggggggggggggggggg

SEQ ID NO: 82471 - DNA, 4392 bp, Oryza sativa
tgtcctcgtcctatgtgaaacaactacatcatctcgcgagtgaatccattcattgatagtgtggttttgtgaaactacacgaccaaaatatatgtacttaaatgccaagtgttaaagtgtatgtggttttctgcaatttagaccacaaaacatgtagttttatgaaatttactcttttcattatgacattcaaagaacaatggaatatcctcactagggattaaaatagttttccccttcttaaccttcaaaattctgttgcgccgggtttcctcgagttccgcgcaaaccccgtcgaaagagagatctgttgttacccacggaatttaacttctagaactaatttcgcgcagctaaaataaagataaccatcgaactgagcgaatatcgcgggatacgatcccatccatccgtttcccgttggacggcactgatctggccgaacatttcaccatgcggatccatcgggcgagggggtcccgcagccgccaaggcaaatgggccatttccttccttacaataaaaggaaaaaaaaatcccacgcgtttttaccgcagcgattatttccttttttttttcgtttcattttcaccgctataataatagtactagtttgttccaacgtactcccgcttccatctaatcgcttctccaccggagctgctttagggcgacggcgagatcgattcgacgggaagccagccatgggaggggggtccatccgcgcggcggcgaaggccgccatgatcgggggctaccgctccgcctcggccgtgcgccgcgccgtcctcccggcctccccggcgccccagacagccccatcggcggcgggcgagggccgcaaggcggcgtccacctacgcggcgatcgacgactgggtcatcccggaccgcgaggtgttcggccccgtgcccacccacgaggaggccatggccgccaccctcgacctcaaggagtccttccagttgtgcgtaactttgccaccaccttgcccttcacgcttttagttttctcatagccgttgaatgtgctcgtgtgatcggtgatcctattgctccatccgctgcatggttgtggcctccggtagttttattcgaatcatgcatgtgtgtggtgtgatctatggttcatagttattggacactgatgcgtggataagtttattcattatacaatgacttctagcggactataatttcttttgcagtaatgaaaaaaaaagttattcgcatctattggcttttgatgaagtgacgaagcatatattcatagtatttgtagtagagcgttagagtagtattacttgtgatgtttttctccttgtttttagaaataacatatatagagattgttgcaacatgatgtgcctctttgctgttcattcacatgtttattttaaatatgtttaaaagtttttgaatctttctttctcatcactgcttcttaatttgcagtatgtttcgacaatgaatatctccatatatatatatgcgaagtatgcctgagaaaaatgttaacaatatgtagacaaattattttgaagttgttcaaaccgtaaaatcattctattgtgcttttgttattttccttctatataaaggttttatgcttcactgctcttccttgttctttacccccaaaaaaaactgatgacctgttttctcttaaatagtgctaagtctgctcaattggagcctctcccctctggtgaccttgatgtccctacaaaggtgggtcaggagggtcttgttcactcagaaacacctcaggatcttgttcattcagaaacacagggtcttgttgatttaggagcatcccaggatcttgttcattcggaaacatctcagggtcttgttcattcggaatcatctcagggtcttattcattcaaaaacttctgagcatgaggataaccatgaaatttcacttgtttcctctggagcccctggacgcgttgtgcaagcgttcacaatgctacaggatagccctgaagcacaggtacttaccacaaactttgccaatgtaaatagagtcaactactaagttgttgtgccatcgtttgctagcgtcaatgaggattacatgtctctttttcaaacactaaaagataatgatgttttgtgaaatctgagccctattattgaaatttcacatgcaagcttgacatttgatcacaaaatctccagccttcatattttctggagtaacactttccattttattatgttagtttggttcaagcgctcaatttattccttattaaaatatcctggttctactgcaagcatagattctacttttaaattctgaaagttcttctctttggaagcttataaaagttgttacagatcattttatgataactgttggttgcaggaagttgttgcctcacttgcttctgatcagaatgtttggaacgctgtaatgaggaatgaaaaggttatgaagttttacaagacctatgcgacgagtaagtattagtctaggtgcccggcctattttgctcatctgattgagtagatttttcaaaatttaacctgctatccgctcttactactttccctctctcagagcttaacgaagatgaggtcgaaggcagtgagtcagactccgtgcagaacagcagtgagttgggcagcgctggagaagcgttcatgtgctacgtggagaaaatgaaggcactggtgtctgagatgatgacgaacctttcaagcattatgcaagatctagttgcaacctcggacgagggccagagcaaggggaagctgaagactatgatcctggactccaagaaagattttgcaaatgctccatcagccttcgtcctcttggctattgcttcgatcatggtagttttacttaagcgcgcgtaggccatttgcccagtcataatgataaaataataaggtaggattctttggtgttcaggacattcgggttcttttttttggtcagatttttttttcttctcagttcaacaagtagttgactgtacgaatgaatcctcgtaatcgtgttcacctgatacattgagagacatcgcgagagcttgaagtctttggtattgtaaagttttcactctccttataatataaagccagcttttgctggatctttcaggaaaaagaatggcaggaatgcattgcatggtttttgaactatttaggttgatgatacgttcgtgtacgtctggatagcatgtattgtcatcgcgtgcatacagtttcatactttcattattaagctatcggactatcgcgaatccatttcgtgttattctcagatttaaaaataataatatacgcttcactgataaaaaaaataataatatacgcttcactgataaaatcaaattagctacgatgacacgtgtaaatcatgcacacaaagcaacagattgattcaagttgatttcagtgattactggcaacaaatttatcaagttgatttcagtgattattggcatacaaatttatcggtataaacatgcaatgaaccaacaatatcaacagttccagattgagcataactcttgccataacaatatcagcagtcccggattgtggcagtaaaaggcttttcgaatcaacgagggaaagttaagatcccctcggcggctcggccctctcaagttttatttgtaataattcagacacagactgatggaagcatgaatttccagttattgaaccagtcaaatttcctaagtcccaagcatccctcttatagctcagtgtgcaactctgcagagaaaagaataaggtaaaattgagaaaactctcttttcatagtcacgagaaatactgtctgacagtcaaatgcacatactttcatcagggttgactcttgctctaacataagaaacgctaaaggcttagaattgaagttccatttctagcttacaccaacttgcttgggaagtctgttgttgtatagaagaaaccgctaacaacatggctttgatttatacaagacacaacataagtttacagtagaagaatctagtaataccttttgccgcaaaacacccacccagagtggatcatgttactcaactcggatctgcttacagagaatcttaattgtggaccttgagcatcttagtttaaatccatagcagaagattgaagaaatgccacagtgctgctaccgaagtttccactagccatttcttctgagagaaggggaggttcatcaggaatctaccacccagagaaatccttaaattctacattagacacactcgcttttcttttcttgtttgaatcatctgcaaccacatcagcaaagccagctgtccgagcttttaggtacttgccaacgccaccaccagagctagttgaaccagcaacgccagtgcctggattgctataccatgatcccaccttatcct

SEQ ID NO: 82472 - DNA, 10687 bp, Oryza sativa
ggagccgcctcgcctcgacgagcgctaccacgaccatggtgaggcagaccgtcgccgcatccggccggttgacctggccgtcgttgcgggccatgtggagccgtcttgtctcgacgagcgccgccacgaacatggcgagacaggccgtcgccatgcgggcgccgatgcgctggagcatcgtgatgcctccgccgcgctcgcctctccaccccctcgcctcctcatccgccgccgccgtctaaagaagaagagagaaagagatagagagagagcgagaaactgacaggtggggctcacataatttctaataaatgaattgctgagtggactgccatgtagaccaaaaccaccgcggattggatcaggggggtaattcgtccggtttacatagttcggggtgaagaatatccggttttatggttcaggggggtaattcaaatgactgcgatagttggggaggggggttaattcgtaccttttccatttaaaaaacacataaaaattattaagcgtgtggctacgtatagtttactctttccatctatactagccactttgtcacgcgttgcacgactttgatgcccactttgacatgtaaaagttctatgatgaatgtccgttgaaaatatatgcggaaattcaatttttatatgaagaacttgataaagaaccgctatggattttatttcgttatattttttcatcttaaattgaattaatgttttaattgtcaagtgtatttttttagataatggaatgaaacatcccggcctttgcttaaaagagctatagccaattgtcaagtgtatgaatatctttcggtttgaaagaagaagattcattttaatagaatccacattttattagtagaaaaagtttatttttatttttcttttaaagttgggtttcatggtataatggataatcatcagtctgtttaagctcgtcacatgaagaaaagaggatggaatttctgctttccagcttctattagaaaagaatttactcagagccacaaacaaattgcttcgtctccatagccggtggaactcttccctctccttttctcccggagcctcttgaagccttcagactacccttgggcccttttgatttggagaaaaaacataggaattttagaggttttcaatcctataggaaaatttcctataaagccctttgaaacaaaggattgaatcatatccaatcctttaaaattcctatggaatggacaatcctatagagattttggaggaaatttagcaagagcttcaacctcttgctaactttcctttgagtctatctctctcatccaattcctgtgtttttcctgtggttcaatcaaacagtcattcctgtatttttcctgtgttttgcaatcatttgttttacacttacattcctatcaaaatcctacgtttttcctattcctacgttttctcaatcctgcgattcaaaggggcccttaaccttttgattctttgttgggctctatatccaacggtaaattttgtttcaaagctatatttgatggccattagtcttctgatgacttggtaaatcctccattcgagaaagaataattctttcactagttaagatgtagcctttgacattggtattaagaagggtaaaataaacctaaggaataaaatttaaattttattagttgttatattttaagatgaatatagtagtttctataaattcccttagaaaattactccctccattccaatataatatataagatataaccatccttaacctaaagagtaaaaaataattattatcgcattattgtttgaatcatccaaaaaatattatacatacacccaataaaatcactgatttttactatgaaagagataaaaacataatagtttagggccctttgaatcgaaggaatgaaaaaacagtggaataggaaaacacaggattctgacaggaatacaattgtaaaacagaggaaaaacacaggaatggccgttatttgattggaccacaggaaaaacgcaggaatcagatgagagagatagactcagaggaaatgttccaagaggttagacctcttgctaactttcctccaaaatgtgcataggattacccattccataggaattttaaatgattggatatgattcaatcctttgtttcaaaagccttcataggattttttccttaggattgaaatcctctaaaatttctacattttttctaaaaatcaaaggggcccttagtggagaaaaattgctagttaattacatacatgcatgtacgccagtacatgctactccctctccccaaaaaaattcaaaccctagcatcccaagaaagttttaagattagcaacaaaagtctagaatacccttaattaatgtgaatgttgtattggttgatgcataggtgaggggtattgaagtaataaaaattttcgatttgcatattggtgatagataataaggaatgagttgatttatttttggataaatttcaaacctaggagttggtttatttcgaatagaggagaactgctagggagtccttgctactgttcgagtgactgcatgcacttcccttggcaaacaatcaaataaaaatgctgctgctactactactccactactccatcctcgcgcgttttctgttgagcactgagagcaggctactactactagcttcatgtactcatcacaagtcacaagtcacaagtcacaataggagtatagtacacatcaaatcacatcctgtagagattctcccttccctcttgtctccgtttctctcacacacgcatactcctagtatttgtctctccatcagaataggagtacaattaaacatttgcagtagtaggccagcttggtactaataaccggttacatttgcagtataggccgtgtttatactccctcacgcacatttcgccactttgaaattgcggatgataaacaatgtactccctccgtccgagtgtataagaagttttagagttggacaatgttattaaggccctgtttagtttcaggggtgaaaagttttgacgtgttacatcggatatatggacatacatttgaaatattaaacatagtctattaacaaaacatattacagattccacctctaaaccgcgagataaatttattaagcctaattaatccgtcattagcaaatatttactgtagcacaacattgtcaaatcatggcgcaattaggcttaaaagatttgtctcgcaatttacacataatctatgcaattagtttttttcgtctatatttaatactccgtacatgtgtccaaacattcgatgtgacatggtgaaaagtttttgtgtgggaactaaacagggcctaagaaagtatatagaaatgaacggtggaggtttgtgattggatgagtagtggaggtactaggtggaaaaattgaatattggagggttgttattggttgagaggagaatgttggtggagaagttgttatattttgggataaatcttaaagtctagaagttgttatattttgggacggagggagtatgttgaggtagaagaaagtcactcaatatgtttttgttggcctaagaagaagtgaaggtaggtggaaaaattaaatggtggagggttgttattagttgagaggagaatgttggtggagaagttgttatattttgagacaaatcctaaagtctagaagttgttatattttaggacggatggagtatattgaggtagaagaaagtcactcaatatgcttttgctggcctaatatttactccctcactcctaaagtataaacacttctaaaatttaaccacaaggagagatgtggaattaaaatgaagggctgttgaaatttgttgagataagaaaatatagataaagaaattattaaaatgaagggatgttgaaatttgttgagataagaaaatatagataaagaaattaaatgagagaatgttatgattagttgagacaatgaaaggggtaagcagcattattttggaaaagaacttcaatgctatatatatatatatatatatatatatatatatatatatatatatatatatatatatatatatatataaaagacgaacagggttccctgttaactatagaagtagagaaaagtagaaagagatatgtagctaaattgtggtgattcaaattttaaaggtggggattaatctataccattttaccattttttatttaacctttttaatttttaattttaaaaacaatctattccaaaacttatttttaaaatccgaaccttttatagacactttagctgactgttggagtggaataatactgtcacggtgatgtgaataacgtgatggtgttatttggttacatcggtttagaacgggttattttttaaataaaaaaggttcccgtcttacacaaaatgcaaatcgcattatgaaaaagaaaaacaatactgcaaaatcaaattatgtttttctttctggaaaaagaagcctgagtttatacgtcaaatgcaataatacgccgctttgcgtctgttcggatggttggctgctgcagccaacaccaacaatgttatacacacaccgagaaatcaacgaattacgacggctgcagttgaagatattgaatatatctactttgcatacgaatctaaataagtgtacgtttagatttatatagaaattaactttattaatatgaatgtattagtttcgtgtaatactatctacgaaaaccgctagtttgctggtaaagacatgaatggttgttttggattaaaaccaaaatgtgctctactaaaattttggtaacttagccaccaatggattggtagagtatttcaccctaaggaacatatagcgagtcatatacagtaattggtgttaactcgctggggtcatatacagtaacaagtcatgtacaaccgacccgaggcccggcccggcccgtgagaccgatacgatttggagcttgcacttggcataaagaagaggagataaacggagcaacacactttccccctcgaagagagcgaccccaaaacaaaccaaaccaaaccctagacgcctcgccttcttcgattcgtccttccctcgatccgctgtgctatggcgctgcgccacctgcccgggaagctgaggctcaccgccgccgccgcatggttcctggtcgccctcgacttctctcccgctcctcccaggtccgtcgtctgattccccacctcttcctcatccgtggtagctacatgtggtgcttaatttcctgcgcatccgagacgacgaggtcatgcatctccgcgcgtaccatgttttcacgtggaatcgtagatcgatcgcaatcgtatcctataatcatcaatagactgcacgcacgattctctttaaataattgcaatccccagctgccggtgctttatttcccctcgcacctcactttttttactgaaatcgtcgctgtttttgtatatttgcgattagccttagcaaatgtatattgtgcctgtcgatgctattctggcaaacccaattaggatgctgtttggaactattttgtaccttattaattttaatataagtaaagaaatacaagtgtgaaacatggaatctgagccaccgcttcttcccttgccatactgctgcttgatctggctcagggtgtggtttctgctgctggatctatcagctttagtaaggggagcggcaggcagcatgacaatggggaacagaggattctttacggttgagggaagtagatgatcatgagcgaggacggaggttgattgaggctaatccggtttagggtatggctgtatgggtaaaccgaagtagcaaaacgagacaattcatggaaacatggaccattcattcatcagcatttcattgatgaagcttcatattatttcgtacattagggcgtgtggatgtgagaaggcaatctgaatgttggttggggggaaagtactgtttatgagctagaccttggtgcatattttggaggtgttggtgttgacgaagagtgataagcctgctctggattcatgcctcgataatttaggattgctcttgaccaagtttttggatttacaggggtataagcggctggaaagcttggtcaaacaagtactggcctcactcctaccttgggagaccttagtgttttgccatatccatgatttattgatttggtttaggtctcatggtttgaaaatatggaagagggcacttatatatgttagagatctttttttttttggccattcttagttacatataactgactagcttcttctatgttagtatagttgcatttatgctacatgaagggattgcatgcaccatataatcttgtaggagtaattctttcttaaaatgaataacatgcacagctaattcatctttttattcaagatggtagtactatgtgctttcaaagattttctgttaggctgtttgcggtgtatggtttaagtaattagtttacatgtcaagttggtttatttggtaatcttgttgaattgcagggcgaaaaaaatggccgtgcaagtagagtggtcctgaatgaaaaaagtgaacgtgaaaaagaaatcttgtaagtgctctatgtaataataacctgatgtttgatttaagtataaatggagtgatcctaattcattcatttaccatggttgtttctggaaggcaagacatggaaagaactatcaagaggctacctatgattacagcgttgtctatggttggtggtgctggccttgcgtttggcttcttgggatgtgtgtttgttattgcctcggccagtgaagactgaggagacagtttaacaattggtcagttcgctgtttgtatgaggcatcgtgcatttggtgttagtccaagagtactaatttttatgtgggtaatgtctgttatgtaagatcgacgcgaagttcttaaatagtagtagtaccacccagcatcgatcccagagggatgtgatcgtagggaaggaaaaagaactactgtctaaaagactgtattatgctgcggtgtgtttaaactaatatattattattatgttgttgtgtgttgtggatcaagttcccatcttattttttcgcttatgcttattcttattagttaaaatttgagctttcaaacttaaatttggagttgattttgaggttttttaatcgaagtttattttttaaagcttttttccttcttttaaattgctaaaaacatgcatgaattattattattattattttctacaaatatgtcgtttggctattctactaataagtaggggccgttcgcagctcatgttattatatatatacatgctatatattgatctgacaccttataccatacctctttctttgatgatgacataaattgaattcatcttccaaaaattactctcccctgtttgtccgcctaagcctaagctgtaggatcattcaaggtgacagcagagccagcatcatggaatatggaggcgcggcttcgctttgtctctttaaccgctcggacgccgagactagactagcaacagctgtgtgctgtgcctgttaccgcggcggccagccaaggagtagcatggcgagagagacagagacctctcggataagatgctcccgaatacttacgtggcactggcatccgctaattcgatccggttcacgtcttctaccctagtggtactattattataaacactaacgtgtgggataaaataatagaatatatcttctccgtctcaaaaaggaccaattctacctacgaatttggacacatgtaggagttcgttttttctgggacgaagtagtatatattagtgattataataataatgtcattatggcagatgattctcacccacttcgctcgactagagagagtgctgttaatttccatcctcagatccatcgtatgcagaccttgagggttgctttcgccatcgagttcgatcgagcacataatttgctctctgtggactgcatgttgtggcctccatatgcatcttgtgtgggcagcgtcgtctgccatggatcgccgcttgtcttgtgttgggcgacgctcaagatcgaatatcagacagagcaagagcgccatggcgccagagtatggagttgccaatttgtcatcgttcggagctgtggtcactacgtattaccagttgcaaaagttacagtacgtccacccaccaccaaactaattaactgcaaaaagccttgtagtggtattctctggtgtcaccaattaagcagctacggccttgtttagttcgtgtgctaaaaatttttggaagttcgaagaacaatttttcttcaaactttcaaaaattccgtcacatcaattgttaggacacatgcatgagcattaaatgtggacgaaaaaaacaattgcacagtttgcatgtgaattacaagacgaatcttttgagcctaattacgccatgatttgacaatgtggtgctacagtaaatatttgctaatgacgaattaattaggcttaatagattcgtctcgcaatttacaattggattatataatttgttttgttattagattttaatactttaaatgtgcgtccatatacatctaaaagtttctgagcatgaactaaacacggcctacatcgtctgtacattgaatacccacactgccatacatgatcctccctaggcgattaggcccgtccctgccatccatgtcctcttgctgcgtactccctcagtcaaaaaaaaacacaacctttagatgtgatattttctagtacaacgaatctggacatactgctgtccagattcattatattagaaaacataccattcaatactaggttgagttttttttacagagggagtatactactttaggttgtgctctctcttaccctggttcgaaatcggagtggcagattagcgtattattagttaagtattagcttaattttttaaaaaatagattaatatgattttttaagcaattttctataaaatccatttgtataaaactacactatttagcaatttgataaacgtgcgcacgaaaaaggatagagtataattaagttggcgaaacgcaatagaaaccaccctaatcgcatattattctgtgttcatttttactagttcccaacccttctatctcgttttccacgtgcacgcttttcaaactgatggtacgtgatttgcaatgctttaaaaatattatattaatatattttttaagtttttatactaaatatttaattaatcatatattaatttattgctccattttgcgtgtgggggggagtggttcccaacccctccataaatacagttatatttaatctataaagcaacaggtacgttctttgctaggtgcacccaacaaaatatacataaaacatccttatctctttgctcaaccatccgatctgttcatctgaagactgaaaatggaccgtgggtatctctgtcttataataccatgatgaaattaccgatccgctcctccgcgcaatttccgctccttttgacgcccacgactctgccacctaaataaaccattgggataatgttttttattttctaatttgatataatgttacacacactacttaaaaaagggttttccttgtacatatacctctttaaattgcagacggaccaatcatgtctgcgaaaatcatcctccattttcgtgcgcggctccttaaaaggaccgcacaaaaaaatcgattttcgcgtgtgagcctcttaaatggatcgcatgcgaaaatgagtctattttcacgagcgaacctcttaagaggtaggtacgcaagcaaaaatatccctccctcttttccctctcactcactttaaaattttcacctatctcccttttattttcccactcatccctctatctcctctcctatctatctctttcctcctctcctctccgcggctcggtggccggctcggcgtcgacgccgacgaggtggtagccgggagtggcggctcgcggctcggcgggctcgggcatggcgaggtgacgaggcaggaggcggcggccgacgtgctcacgtcgacggccgcatgcagaaggcagcgaggggcgacggcgatcgtcccccgcttggatccggcgacggcggccgtcccccacatagatccacgcggatccggtggtggtggcggcagccggtgggcggtggggaagagccgtggcggtggcggatctgacgaggacagcggcgacggtggcttcgaggttagggttcggaggaggcgtggcgacagcggatttgacgaggacgacggcttcgaggttagggttcggagaaggcgtgatgatgatggatctaactaggatgacggcgacgaggaggaggaggaggttagggttcaggtttttgattttatttttagttttgcatgcggacgacataagcacctgaacgcaaaagtagcgatttttgtagatacctgtgtgcgtgcggttcatccttccgcatgagaaatccctttttcaccgcacgcaaaaatcattttcgtagtagtgacgtagttacttctacgatttcaatatattaagacggtctaattggacaagtaggccaactattcctaagaccattttttcaaagtatacatggaagttgataggtcatattttaagaagaaatttcaaaaatctataactttactatcagtttgctgcaacattagtgac

SEQ ID NO: 82473 - DNA, 7273 bp, Oryza sativa
  unsure (1)..(7273): unsure at all n locations
tccgcagatgtactcgtgtggcatttcgcgggggcggtggagggttgagacctcacctggtggtgncggtgtggcggcggaagaaggcggcggaggtggctgggaggcggcggaggtggagggacgggacgggagcaggcggtgcccgccgccgcgcagccgacggcggaggagcttggacagcgccgccgccatctttgaggtcaggggatcagggggcttggaccggaggaggccgcaagacagcggcgactagaactagagtcaagacccccttcacccttggtcaattggagtttgattttttgttttcttataaacgagtttgaaattcgttttcccgttgtttgaagctcgtaactggtatatactgcctccttctttcatttttaaatagataacatagttgacttttgaacatatatttaattatttgttttattaaaaaaattatgtacatataatttattttgttgtgagttgttttatgactaaaaatactttaaacatgatttatatcttatgtagttgtgtaagatttttgaataagacaaatatttaaacatgtttgtaaaaatcaacaacgttatatatttaaaaaacagagaaaatacgtgagatgatatgtttattcgtatcatagattaaattaagtatttggaatctaaaaatgttggaaacaaagctttgtaacttgtaacactggaaaacagacccgggggaagacaaacctcggtcgatagaaaattcttcgagtagaaaaacttcatagtaaacgaacgtatgccgatagaaaattcttcgagtagataaacttgatagcaaatgaacgtactttccctaaaccatttcttctcataacgtgcaatttcccttttgcacttctaatttcatatcaaattgtacaagtagaaatcccttctaatttcataacaaactgtacaagaaattgcaaggtggtgctccagcacctttacttacctgcacacattatacaactgttctcccaggatgatgcaattcacttaaaagaaccaaatacatagtttaaatatttctctcatgctacatattattactctcagagtctcaagcacaaatttgcaattcattgcagcatcgatttatcaacatttttgtctccctttagtttcatccaaagtaaacaatatgatccacaaatcacgcataatttcaaattcaccaagcaagtatgcaacacgagggtggaacctcttgtaagtcggaaggaagcacatgcgtgcacaataccagatgcagtctgccaatataatgccaaagcaggttacaaaattatgaacacaacctccctgatcaacaataactcttgcataatttacaggccaagtgctacgcaacatgcaaaaagagagaatctgcgtacttcaaaagctaaaaatttagatcaattcttcttttttgagtgcttcacgagccagtcgatgacagagtcaatgtttgtcgagttcttgcatgatatcatgaagcatgccacttctcggtcagtgattgtctttagccccctgcaatgtcacatataacttgtcgaacacaggtttgtgcgtaagaaaaccttatcggtctgtaatagcttagcgtgtacttacattacgtctgtgaagctttgcttagggaaagcttcaggtttgtcaattttattgccaatgactagtaatgggatcccagtcaaagaaggcttgctcagaagatcatggagctcgcttttggcaatagccatgttctctcgatcggctgcatccacaacatacctgcaggaacccaaaacattccccatggtttgtaaagtcaattattgccaccagcaacgaaaaataaaataatataacaacgaaccagattttaaggggaaaagtcagctagaggggttacatattagaatttagaacatgcgccaagtgaacaaaaaagcaaaaatagaaaaatagaagataaagataaacaagacatcataattatcttcaataatgcaaaattaaaaaagtctgatcaaataaataaaagcatcatctttttctagaatatccaatatccaataggcaaggcaaattcaaactgacttatccttgcacaaggataactacgacataaggcagagggaagaaaagtgcagtatgccttacaaaagactaagaacagtttagttgagaaataaagaggttaaactcaagaacataagatctgcacaaaatcccatgtttcacctaaactatccaggttaagcttttgaaaccagtgaatgtgcactacaatatgaagctacttctgtctatggggtctagtaattaaatttcattgatgaagtttgcctaaatttcagcagtggtcaaatcaaaatgacatgaaaataattggttagcatgtgtaagcaacaaccaactaagcatgacaactactgagtatagtgcaattcctgctgcacatgcatcaaattagacaggaaaggaacttacacaattgcagaaactgcacgacagtatctctcccacatgctacggaatcttggctggcctccaagatcccacaattttattgtgacattacctttggtcacctttctcatgttgaatcctacagtaggaatcatgtcctcactaaagcctcctgtctgcagattacatggtgatccatgagaaatcattataattcagcaagtgaataaataattaagaaactgatacttacagcaatgacattcacaagcgatgttttcccagcattttgaagccctatcaaggaaagctccatctcttgcttgaaaaaaagactgcatataaaggaatatatgttgaatcctcatcaagcaatattagtaacaaagcatatccattttactcgctaatataaaccagaagttggcccacatgtcattacgtcgaagtagtgcctcaaagaaacaaaggaagttctccactacccaatcagtgcatgtgatgagagctcctttgttttcatactaacttacttggccaccgccggtaggtagatgtggaactaatcatagcctaccacaactctttttcataccaatgattgaaattcagtgcaagcatggccaacatcgtcctaattctacagtccatgatacaagaactttgtaatgtgaatattcatgacaattaacagagtagacccctctgttacatacaaaatcactctgcaaattctgtatcccctcacctcccttgaatttttgattgacacgttgaatgaatacagttgggcaggcacgttcaattaatacagtgattgacgcgccctgataatacttcgattggcttatacgatactccatttgatagtgttgttcaacagataaaaaagcttctgccatacaatgttcctacagcgtacttgtaagtagcaaaaggggccaaatctgaacttggaaaaacagaaaaggaccacaagaagccaaattcccctacgtatatcgggaataaacgcgggtatgcgtgtatcgacccatcaaaaacaacatttcccgttagtcaacgttgcaaaaggaaaaaattatctcaataccatacttattcgcgcgccgcaaaaccatccaatccagtaaaactatctaatcctaacccagatccccgacgcatcgatcgatcgatcgatcccctcccccgtcaatgccccaagcaagagcgagcttcgacgagcgtacctgcggagccagttgaggaaggcttcccagaaccccatggcgtcgtctcctcctcccccctcgcctacgaagcggggaccctgggtggtggtggcggcggtcgccgggagccggggtacggacggcgacgggagcctcaccggtggcggctcgcgcgggtttactttatttggagggcagagcgtgtgggaagggagggacgggggcagcgcggattgggaggagcgagcgacagcgaggcaaggcgagagcgacggcgcgaggaggaggaagagacgagagggaggaggggatggtattattatgtggcgatccaccaatcgtatgtggcctcgcggcttagctggccgctgtgtttagtagagtaggtttcattgttttaccgatttggatgtgcgtgattggtccaaaggctcctactaccaacattggtgacaggatccagctcggttacggaatctgctccccggataagcggtggtagttaatgatgatttgcggtagtaggtgaagctgttttttactcctgccgacgatttttcataatcatatttcatcttatcacataggccaaagataactaattctacttatcatttatttaaacatactagtactagtcatttctcgtaaacaaacgattcataaatatttacatttctccatacccatgtagctaattttatgtgaaaaaatggagagatctacattaaatctgagaaatttattgagaggataggctattggattaaaatatatctatcaaaataaatttttcagatttaaaaatatgattatcaaaagtagatagagggaatatgattatcaaagtaaatggagggagtaaacaaaatgttttaagtctcgccatctctggaccaattgtttcagaggttttgactcaccgggcgacttctttgcatgggcatttggcctgatgaggtgaacccaagaggatcatcatatatagcccaatcgagtcgaacagctcgtgtcaccgtgtagatgcacgtagactcggtgtttggttatttgcatctagcgttgctctcacttcgcataaaactggtgtaaatgtaatgcaggggtgtttgggggaaactattttaacagctcgagtggacgtccacccgtttattacatgtcatctaaatagttatgaaaaaaattaaaaaatatataaataagatagatcaacatgttatatatcagtccacaaacatgcaagttgaaatttaacttctacaagttataacaaaaataacaaacaaaacttaaattactatatgtatatttacaattaaatttgttatttttgttacaacttgtaaaagttgaatttgaacttgcatgtttgtggagtgatatattatatattgatctatcttattaatttttttgaaaatttttcgtaaccatttagttgacatgcaataaacggttgcacatccactcgagatattagaatccatctccgggtgtttggttgtctgcacagccgtcggcgtcgggtcctgagtttgcttgtgcaaaacggcctcctaaagttagacccaatgacaacgatgggattcaagctcctttcgttgtccagggcaaggcggcaagcggatacaaacgttgggtatgagcgaatgcaaatgcatgtgtaagtaagtacgcgctggtgttgtggtgcagggtgggactggccgggaccgtgtgcatccggtcacagccaggcacagcgaagcggccgcggcgatctccctttgacgaggagtgcgaggcggcgagatagctttattatgataaagtaaatatattgctttaaaaataatgctcaaatgataaatttagtgtaaattacatcagcagttcacgaacttatcaatctagcgcacaaacttgtaaaaatactcgttttggtgtataaacttctgttcgtgcggactaaggccaaaataacactacatggctaatcctgttgatttaagtgctgattaggatactatataaacatatatgtgagaatatcgctatttagaaatacatatgttcactaaaagatagaatgagatatacatgatagtagaaaaaaaatataaatactgatcaatgacacaagagttagaaatatatagaattcattatttcaattatgaatgataaagtaaagatcaaaattataaatatattgttttatgaatattcaatacatgtatgcatgtcacattctaatcaacaccagcttggtataaagttaacaatgtcaagttattttctcacacaaactagataagttcaaatactgtaacgagcattttacaagtttacgtatacttagatatttacctaacaagtttatataccatcaatataatttactcataaatttaacaatgaatatattgatatataaaaatgaaaattcagctacagtcatgcaaccaacgaaaaaaacataatcttttccgaacaatacttttgtacaaccaagaaaacaaaatctcatgctagtcgtgaaaagaaaaggctcatggaagcatcgactgaattcaagctaccgttagaagccagaatttattgataagaataatgtgcatcgcatgtatgtctgaataatgtgcatcgtacctatgtctcgtgtttcaaacctggatagtaatgtgtcttggtgaagtttggcggatatggtgtttataaactagacacacccatcacattttatcaaactcgtccgataaattcgtggctagctactctccctgtcccaaaataagacaaatcctgggtttccgtgtccaacatttgactgtatgttttatatgaaatatttttataattagtatttccattgttgttagatgataaaacatgattaatactttatgcgtgacttgcctttttaatatttttcataattttttcaaataagacggacgatcaaatgttggacatggaaacccagagtttgtcttttttttatggagggagtatatatgaaccggaacacatctgatctgacacaaagcaaagcatcgcgattgagttaatactatacgaccctgcgatggaaagtggattttgatccgtcgaggggatatcttcttgttgcttgcatgttactcaaatggttatgaaaaaatttaaaaaaatttgaaaagatatattaacatgtgatatatcactccacaaacatgcaggtaaaaatttaacttctacatatcacaacgaaaaaaataaatttgactttgaatatacgttaaccagctgcggtttgatttgtttttttacgagatgtagaagttgaatttgaatttacatgtttgtgtagtgttacatcacatattaatacatcttcttaatttttttattttttttcataagagtaaatttcacaaaactacatgttttatagttcaagttacagaaaaccacacacattttgacacttggcacttaagtacatatattttggtagtttagtttcatttggtagtttagtttcacaaaaccacactatcgatgaatggattcacccgtgagatgatgtggttgttccatttaggatggggacgtggcatcctg

SEQ ID NO: 82474 - DNA, 2684 bp, Oryza sativa
ttcaaaattatgtgaaacttacaagtcacagtgtagttacatgcaagttacagtgtaattggatataagttacagtgtaattacgttacgattgtactataattacatctgtcaaatttttggggaaaaatttgtcgataaatgtataggcagtcccattatctattacttcctccgtattttaatgtatgacgccgttgactttttgacaaacgtttgacctttcgtcttattaaaaaaattatgtaattataatttattttattgtgacttgatttatcatcaaaggttctttaaggatgacataagtatttttatatttgcataaaatttttgaataagtcgagtggtcaatcattggttaaaaagtcaacggcgtcatacattaaaatatggagggagtatatatatactacttaaaaagtataagatgcttccttcgtccatataataaaaaaatccgcttctgattaaaaaaacaccgttcataagaaaacagcgtgaaaaaaaaggccttctagaaaacggcatcggtaaaaaaaccccgcaaaaaaagtaacccccacacgcggcaaaacgccgttaggaagaaagacggaaaaaagaaaagaaattttgattccgatttaaaaaaaaccgtccccaagaaaacggcgaaaaaaacatctagaaacggcgtcagtaaaatatccggcaaaaaaggaaaaaaaaaaaaggccagaacactatcagcaagaaaaacggcggaataaaagaagagagaaaagcaaaaaaaaaatagacaaagagaatcttaactaattaaaaatttggtagctttcgatcatcacatcgatttttagtccgtactaccattttccgtccgttcgcaacatcgcgcgcaccttttctccaaatcccacataatcaaaatccaagtccaaccaaaaacataatctcaatccaaatccaaatccaaatctaaatcggaatcatcacaaaatcatccaaaatattaagagatgttgagaggagatggaggggcgagcgggaggccaccgttcctcctccgccgtcccgtcattgcatcggggatcagccgagccgccactgtgtcgctagggagccggggagtagccgcggttgcgttgggaagtcgctggctcgcctctgcgccaggaagatgctgggagggagagggaggagccaatcctgagccaccatgccgccggggagccaccgacttgctggatctggcgaggagtgggatggcagcagcaccccgacgaggaggaattaaaggagccaatggttagggggggagggagggggagcggcaccgcgggagaaaggagggcatggagaggcaccaccggtgggggaggggcgtggagaggcgccaccggtggggaaggggcagctcgcggtgggaggagtagcgtcgttggtggggagagaggaggggcgccgctggtaggggacagagacggcctgcggtgaggggagggaggggaaaatgaattagggttagggattttttaaccgcgacgattttgatggattcaaaatcgatctgagccgtccatcaaaacgaacggctcagatcgatcccgtgttgggccagcctccatctttaggccgcatcactgctacgcagcacgctggccggctggtccaacaaagcacttaggttggactttcggttgggggccacacggcaatgagaggaggagtagggggagccaaattacacttcctgttgggccgaatgctttcctacaggttgagacggaggggaggagaagggataaaagcgggctgaaaatggcctagagaccaaggttgatttttttatttaaataaatgctgaaataatgcttgtactatcaaaattagctattaaactctagaaatttcaataaaattccaaatattgtaattaatcatggagacttcaataaaattaaatccaactatataattttatttcgcacactaaactaatttaattatatatctacctacttaaaaaataccaaatattttcggaaatttatatttcaattaattacataatacatatctttctcaaatttttctcaattttctagtctttacaattcctgttgcaacgcacggacacttttactagtaaatatatatatatatacatgcgtgtgtgcttgtatagttctgcaaaagaataaactcgatcaccagcgtgcggtgtgcgcttatatacacacacatatatatatatatatatatatatatatatatatatatatatatatatatatataactacaatagggcacctaaaggtgccacggattaaatggcacctgatacaacctcacaaccactctgccccacataccgccaccgaccacgcagcccgcatcacaccagattaatagtacatagttaaaagttaactcagtgttgtacaacatccatcacatattttacagtgtcgctattctcaattaagcaaaattttaactctattttttttcttcaggcatcattcaaaccacacactagcgggcgtcgtagcacagatcattatatggggttatttttaaactcaacaatctgtttttgatttatttatttttaattttccgacatttattctaaatgtttaattaaatgttgtccatttttttattatttggattctaacacttttattatcatgc

SEQ ID NO: 82475 - DNA, 1079 bp, Oryza sativa
agacatatgcatcagcattccattcacttgtgaggttttctttcgtgaacgtggaggacctctaggcttgacactgtcagcaatagcagtagtcattcgtggcatcaggcttcttatatcaattccctgaagaacttgcaatgctgcatcaaagtttcctctctgatgttccagtctacccagcaatgcccgggcttcctgttacattagccacaatgaatacaacactgaggaaaccagaaatatagcttatcttctcggaagagggaaggattcagacaaacctcataatttagtgaaagggtctctctcaggtctgattccacttcgcttacttggttgtcatcaggagttgattctcgatttcctatccttgaagaagaaccagttgctgagtaatcccgcgtcgcaagagattcaggcgatcgaggcatttcttcaaacttggattggtccccgctacaactgcataacataattgccggcattttctgctgtgctgatgatttactgtagataaatatctatctctcaagatctccccaccagaccaatgggattaaccagtcatcaagtatataatatactatagaacctgacaagtaaaaatggaaggtgcttagtgcacattttaagtaatcataccctaataattaattaaagaatagagctgtggtgctatgatgagtaaaggccgggatgttttattccattatcttaaaaaaagaatacagctgtggtccttgattcttgaacttgctagtctgatgtcatcctggtcactaaactctgaaatgcatatttaggactctaaaacttgttgaacttgtcggcttcactaatttgattgggctatggtggcttggagaggcgagtcggaggtggccaaaacagagcacgcggcggcgctgacggcaatcccgagctccagcggccaatttgcaggggcggatccaacttgggacatgggggtttgggggaacaaacaacaaactgtttgttacttgtattaacgttaaggctctgaaattaagaaaagagctgaagaacttctttcagaatccagatctagaagagaa

SEQ ID NO: 82476 - DNA, 7708 bp, Oryza sativa
ccccatcaaccaccatccctcgtcggtcgaacaccttgtgcgcgatcgactccacccctctccatccatcctccgccctaaatatcccttagaacaccttatatcaaccatgttctagcatagtaagccctaaccgaagctctgcgtcgagttttacctcgccgcaccaacccgagcaccgccgcccccgcgctgctctgttcttcaccgccgcgaagtttttctggccgcaatccgtcgtttcaaccgatctcggtgagtttttccgtttcaaccatctacatactacctagattccattttagcaatccctttgcactaccatgctcccctctaagctgccgatgtgagcacggccgccgcctatggaggcgctcgtcggcaactattctccgcaccttgccaaaggtcggcaagctgccggaatccctctagacacctcgtagatgctctagaaccccctcccctagccatgtctaactcatatcaccttgatcaccattacagcctaaccgtaccaccgccgccctagtcgccaacccatccacataccaaattagctcctccgccgccgatcgccgtcgccggagatacctagctccctcccctcttcggccgcaaccactttccccctccatcgccgccgtaatcccaaaccctagcaccgccggctgcatttggggaaacggccgaaggtagaagaagagaagagagagagagagagagactgacaggtgggacccgcacacagtgccatttcacttttatttgatttttaaactttagaagctcatatcttttaaaatatagatccaattccaatgaaacttggaccaatattcttctaaaatcattctctatcttttgagcccctttttgctatttttgcattttattttattttctctatttttcatatttttggatttcatttgaattccttttaaatttgaattttacatatgtctaaccctaggtcttgaggattcttctgactcaatagataatatccatcaatctcaggacatcgagcaaggcaagttaccatataccttttgatcattcaagcctatattttataaattatttacttatagccttctattcaatattctattttctatgcataaatcaatcatagaaacccagataatttagtattgcttattttgcttacaatctggttaaaataccctatacttagattgggacagtacgtaagatttggctgatttccgggtggctagtactgtctcaatcaatataagttttaccagatacttatgttgaacgaacgagtacgaccgcagtttctagaatagggacagacctagttattatgttaattagcaatatggcacctctgtatagtggttcttatttttaagtcctcgtgcaggaggcaactatagccgcgaagggaaactttaaccattaccatgtacaggtaaatggtttgtgatactcgagtataaactatatggtatatttctaaaccctgatcgagatgacgtggtgtcatacgatcagttccccttaaataccttgggaacgccagaactcctcttgctgctgttaacattacattcagagcatatgaggatatgagttcatggaacaggtgccacaattgttaatgacttaatactggaccatgactaaagccgatgattatcagcaagtcatggactgcgggtaaagcgtacatctgctacagtagaatatctttgaaactattcgaatagccgtactcatggagttgagtactgggactcatatggtaccctggttagaaatctaaagtttatatgttttataaattcttgctataacttttccagattgtctagtactgctttttgcaaagaaccctattatatgtcaatgcataacatattcccatgataacttgctgagtattgtaaatactcacccttgctcttataacccctttttcagatctgggtcaagaggaggacccttatgactattactacgaacatcccgataacttagagaatccctaaaggttatacctcactagtcagaatgtatagaaacttctgttgtgtattaattagttaggtgagtacctattattgtaaaacccttagtattgtaagactttttaacatatgcaatgaagaaccggttatattgtatgtatcaatatttactgatccagggattgattcattaatctcagtcggattcaagttattagttttgggctccgacaccatatgtgcctttttcctctataattattccatcgcaacacagggcttctcaggtctcagctacactggtggagaaactgtttgtagtctcggttggtaaccccctttagtcccggttgtccaaccgggactacgaatccgggactaaagataactatctttagtcccaggtgaaataaccgggactaaagatcgatatttattcccggttcgtgttaccaaccgggactaaagattgatcagccacgtggccggccaaaccatctttagtcccggtttgtgttaccaaccaggactaaagatcggtgcaccatttttttttatttgcaaggccctgtttgctgcatggttgattatatatatatatacatatatatgcataatatataggcatatatatatatatacatatgttacaatacatatatatgcataatatataggcgtatatatatatatatatatatatatatatatatatgtgtgtgtgtgtgtgtgtgtgtgtgtgtgtgtatgtataatcataatattacacagacatatgaataatttaaagcacttaacattttatgtgcatatatatatgtcaccaaaatatatattaacacaaaagtaaatgtgtacatatataaatatatatatacatgcatatatagtacaattcatttgctcggtagctatagctacgactttgacgccggtgttatgtcagaagaggaaggaccgacgttatgaattgtcgatccgtcgtagtagaattcaccgtcgagattaaggacttcttcgttgatgaatcccatcagttgttcttgaacagccgtgataaaatccttgtgtgggagattatccctcatgtgaatacgctatcgttcgaaaaataatgacgtatgaatatatgaaattaataaacaacttaacaaatcgatacgcaatgaaattttgaatggtttatgtatacgtacatcgagctctcgtgttgtgcatatttggtttgataggcagtgggcatactcgcatacgtagtagccgcataagttagttccctggtcctgctttgcacactacatgagaaacgatgagagatttaatatactctttatattaactgtaattagagattcaatccaatataattttggatcatgcatgtactcactggaaaatcaaacctccgtccaagtttttctttccaagtcccgcggaccaattgacggaaccgatcccaagccctacatatgcagttgcaagctatgattaattaattattacttgagatcaacataatagcaatagattccccgcgactttggaatagatggcattatattacctgtctatcagtttgaagaccttatcaaaaatcttctcctctttattcattgagtcgtacacagtgactctgcatgcgtccaagtcgaagaataacaggacccagtggaatctggaatatgcgtgagaagagatatatatgatcaaaaatgtacatgctatatgtatgggaacaaaatttgttcgaacgacaataaaaactcactctgtgttgtacggcagtagtatgtacgtcttgaaatgttgctgcgttaggagatggacgagattgtcctctgtgtctttctcgtacttgtcgatcatttcggtgttgattttccgagggtcgatgaacccagtatcgtagacccccgccgtcgggccctttgaatctccattctacaacgatgaaaggaaagtattattgcttacatatatgccaggagctaattattgaacgaaacaaatcgaactcaaagatactcacaaaatccatgcgctcagaagagagacgtcgagggcgtccaactggtacagatcgaagagatccttgaaatggatccagagaacatcttctccttgcaagaagtcggggtttctgatcctcgctccgaacatctctctacccttggcactcatttccatgtaccattcatggaatttgtacatctgtgtcggtagggactgcagctgtttagttttgacaagcggtttaccgagttcaaacttgtatgccacttccgccttcgggattggtgctcctccaaccaactgatccacagttagaccggtgtctgaaatgaattccgttatgccaaaatcttcgccggtcaccaacggctcgacctcttggtttggttgttctccaagctgagggactggtttggacttcttgtgataggctctctgaagtgttcggtcatagtccgatatctgtaacgcctccttgtttgttgtggacattcccttgaagaagttcttcacgctcgggtcaataggtatcttcttttcaggactccaaggcttgagttgcctcttcacctctcctgccacataagcatcaagctcctcttgactgcaatcgtacggtggctccttgtctttggtggcgtcaactttcgccttctttgttgcccttgtgcgggcaagcagtggagcttggcgagaccttgtcttgggaggtgcaggcgaacacggtggaggcggaggagctacaggagccggaggagatggtgcaccagtgaggtggcggaggaaccggaagagatggtgcacgagacgccgcttgtcgcccaggaaggatgatgtactgcttgcgccatagtatgatggcgtggcttgtgtctcgtagatgcgtctcaccgtctcctcctgggtagtccaactcgaggtcctcgtacgcggcttccaccaactcaacttcgacactcgagtatcctgctagaatcggcctgtagtggtaagtcccggaagggtccgttgggatggccattcctgacgccaccttcacgtgatgagaggttatctattagtaatcaacctaagcagcaacttgcggaatgtacaagtcaaaaatcatcaaactatgagcataccttgattgataagttcttgaagggaatatgcagctcacatggtgtccgctgcgtgatctcatcaacggggcaggtggtttcgtcctgggtttgcatggcgtccatgctctgtgatccgacctgccccgttgagacgcagctgctacgattgcctgatgggctgaccattgcaggatgaatgtacggctggggatcctgggaccgatgtgcggccatacgttcatccaccttccttgccaccttctcttgcatgctgagctcgtagctcgataccctgtactcaagatctgcaatcttcgcctcggtatctctcttgctcctcatccgactcctgtacgtgtggatgtcctccttaaatccaatcttccagggaatcacacatttccctcgtgttcgtcctggatgctcgggagtctgtagggcgagtaacagctcatccttctctctgtctggtcggaatgtgccctgacaagaggctaccactgcgtccgttagtcgactggcggcctcgtgtatctgatcgctaaagacaagggagccatcaactagattaagcgttccaccgtgagcatagtaccagaacttcgatcgatccggccatttagtggtggccggttcgatacccctctcaatcaaacttgcctccatctcctcccacttcggcattgcgacgctatatccgcctgaccccaagtggtgatggtacttcttcttggcggcattttctttgtttctggccatcatcgcttgcccttgtcgccctgtcttgtaagcaacaaactcatcccaatgatcccttagctttgggaatacgtcgaagttcggtgttagtcccttcaggatgtatttcttgtagagatctcccttgaagctctggaactgttccgccattttcttcagagtccactgtttcactatgttctccgtacccgcgggtagcgtgaacgtctcaagcattgtggtcccagcatctctttcttgagtccgggcaaactgtcatatccctgcgtgcccttgttttgtgccagtacaccgtgctgacaggcacgttgtccctcacaacccaaccgctgtggcgtacaaaattcttggctgcttctgccgaggcactaggtcggccgtcttcgtccacctcagttatgatgtgccgaccctctatcttcttcgcggcacctcgttgtccgagtgccctcttctgtccagcggagggatgacttccactagcctcctcctcatcgttcccctcctcgctcccctccgcatccctctccacgttcccctcctcgttcaagtactggtttggatcctcgttcccctcttcttcgttccagtactggctgcttctctctgcgattgtatcgtatagtatctgttcctcatcgcgatcagccatctgtgcatacaaaaaatacttgttaggtatataggatgtatttgctaaccgtaatattaaaactctactaatcttatattaaatctctaataatcttatattaaatcgctactaatttcatattaaaattgtaataatcatatatatatgctaagtataacaatcttatattaaatcactgctaatcttatattaaatctctactaatctcatattaaatcgctactaatattatattaaaattgtaataatcatatatatatgctaagtctaagaatcttatattaaatctctaacaatcttatattaaatctctaataatcttatattaaaattgtaataatcatatatgctaagtctaacaatcttatattaaatcgctactaatctcatattaaaattgtaataatcatatatatatgctaagtataacaatcttatattaaatcgctactaatcttatattaaatctctactaatctcatattaaatcgctactaatcttatattaaaattgtaatagtcacatatatataataagtctaacaataatatattaaatctctaacaatcatatatgctaagtgttacaaacttatattaaatcgataacaatcttatattaaaattgtaataatcatatatgctaagtctaacaatcttatattaaatatctaacaatcacttctttacatcatttgcctgcgcgaattccttcgatggctagctaccacttcggcttgagggacgacgacgatgtcttctctgcaacattatcaggaaaatgtattagtctaaacgggccaagttacatatataatcatatatgtattaccagtaaatcgtattagtataaacgcgttcgttctcacacttttagtacaagtgcatacacgttcgtaagcgtttcgtgcacgttcgttcgcgttccgtaatcgtttcgttcacgttcgttcgcgttcattaacgtttcgtgcatgttcgttcgcgttcattaacgtttcgttacgttcgttcgcgtttcgttacgctcgttcgcgttcgttaacgtttcgttcacgttcgttcgcgttcgttaacgtttcgcgcacgttcgttcgcgttcgttaacgtttcgttacgttcgttcgcgttcggtcacgtttcaatcacgttcgttaacggtcggcaat

SEQ ID NO: 82477 - DNA, 3523 bp, Oryza sativa
cttccagacctgtcaccgtgctgccattggttcgctagaaccaaatcaatccaggcttcggagacgctgatgctagtgatttttactactggactcatcatggtaatattatcatgcttgcagattgcaacactgcgatgttctcatggtgctcattttagtggagacaatggagtactgctgctacgtgcaaactctgcaagtcacgtgaccatttgttccccgccattgacagttaccggtcatggacacaagatgccacattgcattctcgcagaacacgcatggccaaggaacaagaatcctatgttcagctatttttgagtccaaaacatggtgtcctgtgtcctagtcctgggtttattgtggccgttgagagagtgaggagaatttaggtgacctaggatacctttcggtgttaaataagtgttttagtgtaaagcacatgcttatcatttaaggggttagtgtgacgctccttaattgagtgaaatatcagcatagccgcataggtgcatataaaagatggctatttatgcagaacgttgtgcatggtactgactgaccgtgcaaggttagccggctagcatctactcttctcgaggtaccatcacatgcattcttgacctgcttttgccagagagcacaaatgtagggtacaaaaaaccctttacctattcacatctgcccccatttatcagatggggataaaagggacaacacttgacagcaaagtccacagggtaagcagaaaaacagcatcgacattcaacagttctatcaattggagcagagacgaggactgaacaacactgactatgtacattgttgggcagaggcagcacacaaggccgagtttagttccaaactttttcttcaaactagggtgtgtttagttcacgctaaaattggaagttaggttgaaattaaaacgatgtgacagaaaagttgaaagtttgaaaaaaaaattggaaactaaaccaggccttaggggcagatgtgtaacagattcgatgtttttatttttcagataaaatcagcaagtactgtaaaattgcttctgcaagcaccatcaacctcgtggacgactagctcattgaacaaaaaaactacaaagaatagaaacaaataacaatgtctacgttgtttcctcaatgtaagttccgtaacaaaagaatcaaggatatcagaagctgctaacaaaacttttctatcctctgagttcaactacgagatgcccatatggatgcacatcatatcaaatgtggcaagactactttgatcattgcctgagagatgaagatgcagtactcaggttatcgaacatctctttctgaagcagcgggaacttgagcttcataaataagtacaagatgcaggagacaggtttatgttccgctataacttaaccttctttgcctttatccgctttgcagccatgaaagtcacagcagcagaaagagtgtacctaataacaacgaaagatagtaggtggtcataaacacacaaatacaccagcaagaatgataccaactgtaaccatagcagtcaaagaaacaattatgtatctagctgacgattgcaaaattttagtgcatgattacagcgagaaaatttgcctgcatatatatgtgccatatgcaagctaatctgatgtaatatgggcagaccttaagaagagtttgggataattttttttttctataaaggagacacaacagctttccagtctcagctgaaacagaacaacacagtacataaccagcccagagagtttggaatacaaaccccatactatgtgttcctactccagtccagagtcacattcttgtaatgtacattctccagtttctgcaactcaattttcactacagtattgcatttcatgtgcatatatgatatcctaccacttagttggaacattatttagtgaaagaataccacataactatctaaggaagcaaatggtatcaacagattacacctggcagttctgtaaagacaaaaggcttaaatgcgatagtgagtacccgatacggtaggaaattgctctgaacctttctaatatgagcaatagtatctaactatctattgggagtcttaacatttctagtaataacaatccaagaatgaatggaatagtcataatcaagtaatcaactagatagcactcataaaacttgtcaagtaaagctgtagcaattattatagatcatcatataaaaatgtagcagttattatagatttcacacaccccaccaacaatgaggaatgtgcaaggtattgaagttaataggcacttaccatgtaacggtgtattttagatggtcatgtggcatcactgagtgatgaatcaaagtactgacatcttttggaacaggataaggatttgttggagagacatcctcatttatatcttctatataaatagtattttcagggaggccacatgcacgagcaatcatgggaacatccacataaaaccactggccaacactgggttcattagctggaacaaatatgctgggcttctcacttcctcggataactcccaaaactcttacaggaggttttacaggtttttcaatctgcaaaaggtggaaaagcaatttgcatcaaatttatgcacggacaataatcacagtggtttccacacacaaaccatcaacaactacaaccaatgatttaaagcacgcctggttggttattcataaaaagatatttgataatgtgctgtcacattgttatcatgcacaataagtttatgtaccatgttgctgataagatatcaatgcataaacttgatctgatgagcaaagcagaaagcattaacatttttaagcaataggttggaaacgacgcaaataaaggaatgcaaaatcacctcacaagattgttcaggctccttagagttagaccaaaacttccaccatgaaccttttccatctgtctttttatcagcctctttatattctggaacttctctgacgccctggtgatcctgtacgttcttatcacgccaatcacgaggaacccaccctctattcacaagtataggtggccacgaactgacaatatttttcagaaatacaaatattttaagaaacatggaagaaataagacaatgtagtttgtttctatggttcaagcaagcaatacagcatcaggcaactatgtttctttttatgtgttctctgtgttagtaacgtgaggagaaacttaattcagaactaattgtaagatcgcaacatcttcacggggaaaaaaaaaagaagaaaaactttgctaataccggtccaagcatggatagatggcatatcgcacaacacaacctcaagtggaagttcagcttatcagaaatgtaatgtaatgcagaaacatttattagaagctatacaccccaatttgagattatggcttgtgcagagcttctctactgagacaaataatgatacgttagttccattttagtcaagtagatcttatgttcatcgttgattcgtttctctatcctaatcttgag

SEQ ID NO: 82478 - DNA, 23672 bp, Oryza sativa
atctatatgaatatggataatgctaaaaagtcttacattgtgaaacggagggagtatatgtattgtagcagtatataacgtagaagttgcagttttgtaataatttcatacgctattattgcagcaaactaaaacatgtcactaatgttgcagcaaattaatagttttatcactaaagttacaattttctgaaatttactttatttataaatattgtagtagaatgaatgttattgccgctaatgcaaagaggcgaggttgcttcccgtatcatcggtgtaaacgccagggttcaccataccgccggtaaccgcgcggttaccgggcttaccgcgggggtacggtaatgtaaataccgcggtaacctccttaaattcaaataaatttaaaaaataatttgaatttttgatgaattttacacggtttcgtacggtttttcacggtgcttaccgccggggcgcggtaactccggccctggcggtttgaaaaaccctgctaaacgctgccttttgggctgggtggggtcctcaacgttgtcattccattcggcaggtacctctgataggttgtgtcgcctctactcttttaactactccctcatcctataacgatcgtcatacatatacatatttatgtatcaagaccaataataattttattcgtattaattaagataccatgcgcacattttcccgcaatgcatgcattgattaaaacaccataccaattacactttagcatgtacacattctcccatgcttcgttaattgtattttaatgaaatccgtgtccatatgattatatgatgatgaatttgagaaattttggattccattatacgatgatatgggaaggaggaagtactaattaattaatcccttggtttgtttaagtaaataaatatatagaacgatatgcatattcattcagttttgagactagccgtacgtgcaattgggcctggcctcccctaattatgacatactaattaatcctctaattatgtaattatgtcaagcactgtgttggttccttacagttttgcaggcccaattaagcaggctagtgattaatgtatactgggctacggtggcccccgtcatcggagatgtcactgctgtctccgtcttctaaccacacgcttcgctttgctctcgtcaccaacactagtaattaatcactggttatcgatcccatatttttgatggtgccgtcgtctcccacgaccatccatttaagaccggtaaattcttctctcttccccctttcctcacctctctcccaccctgtctaaacccaggattttaattattgattggccccaccgttatttcgtcggagtcaccgccatctcgccatagctggggaagaaggcatgtaggatgaatcgtgacggatccaatgatggagggttcgacagaaatccaccccaaatttacatcaaatggaggttagcacttctgataatatatagatacgaaaacatacttttgttgtactttggaatggagggtgcatgctcaaaacatatagaacattatattgatacgatattcctttagagtaaaatgcttaaaaatttgtgtgtattatggtacaattttattttataatcatcatcattcagtacatatcttttaagttggtatcttaagtccaaatcctggcttcgccgttgtgtttgatttaaataaatgcatgaaaatgatcctaacatctactccatccgtcccaaaaaagagcattcctagcatctcaagataaaactggggagtcaaaatgaccaaaatacccttatgattggaaaaagtagtaagggtgataggtatgtaaaatgtattcaagacatgattggaaaacgttgtaagggtgataggtatgtaaaatgtattcaagtatattcaagacataaaacttcctgctttatgtgttgagtgtagttaggatgatagaagttatattttttttttacaaaattcaaactctataagttactactccccccgtctaaaaaaaataatttaggtggagatgtgacccatcccctcatatacatatattaatctagtgggggtcatacatacatcccctcctagattgattctttttggaacgaatggagtaagtttttaggatggagagagtactatatattttgattttacatgttgtttgatgaaggcgggacatagatgacactactgtgagcaggctgctgcccatgattacagccacgtccatgcagatttgtatcaggtgcagttggtactatgactgcaacttaggcagtccactgccacctgttagatctgaatctaacggtccacatgcacccggatactgtagaacattgtagcaacaaacattctctattcctactgcaggtgatcccatatcctgtccatgcatggttgctgctgctgggccccccggccttctggggatgtgtttttttgttgctttcggaggcaaagatgagggggtgttttagtccctctcacccaaacactctctcacaggaggtgtttaaccagttgtcagttcgctgttagtttaagagtatattattatggttaattaattaccggttatgtaagagtgatgtaatgcatgtggtggagagaaaaaaaagtactcttcaaataaccactactcgcaagcattgttggtttataaataggagtacattattttcatgccagctgccaggtgcccagcttcttttattctaagtagttattgaattgcatggtgcaactaaggatcattattttttgagagatcgatgaacgtgagcatgaactcttgtaaccaattaattaatctattgtttttatttaattaagtaaggtctcctttagaacgcaacattcaaaaaccgcaaaaataggaaaaaaatgtagggatatattgctcttttgaatattttgaaacacatgattattttagctagtgctttaggatggtttacatgaaatagactacaagaattatacaagaatcacttgtggaagagtgaggaagtagagggagtgcattatattggacttatcaaaggggaaaaaaaaagagctatcacacaggattttatccaagtttgttcctccaaagggccatatagaattaaaatccgtagaaactcaattctctaaattcctataaaaatcctccaatccaaaggacacgacttaaacaatcctgcgtgacaacttgacttaacgatcttaacatgcagtactgtatcaattctctataattccatgcatggatgaatgctacacgagacatagtgacataattggatttgacacctagtgcatttcctagctccgtatttgttcttgatcgatgcacttgcacattagtatgtcacctcatgattaaactcagggaatcaaactctcaattgcagctgaattgagcattcagctgcaattgagaggcattcctccggccggtcgctggggaacttgctgcagcacaagggatccttgctctctttggagaggcctctggtcttcataccaacttcaccaaatgctccgcgatcccgatcagctgctcggaggaagaggtcgcagtacttggtaactccttcccctgcccagttgaggagttcccatgcaaatatttgggtttgactctttccatcagaaagctgtgtcgtgagggcctccaacctctggtcgataggattgcgcagcggctgccgctgtggcgatcggattggttccagccggccgggcgcctagcacttgtcaaagcagtgctgagtgcgatcccggtttacctgctcatcgccattgcccccccaaaatgggtgctgaaagccatcgacaagatatgacgcggcttcctctggtatggtcgtgcttcctctggtatggtcgtgcgaatgctcagggtggccactaccggctggcttggtcccgagtctgcgcgccattggaatatgggggacttggcatccacaacctggagttcatgggaattgcactccattctaggtggctctggggtgctgaaagccatcgacaagatacgacgcggcttcctctggtatggtcgtgcgaatgctcagggtggccactaccggctggcttggtcctgagtctgcgcgccattggaatatgggggacttggcatccacaacctggagttcatgggaattgcactccgttctaggtggctctgggctcaacgcgcctcccaatccctatcctggcaggggttgcaaatctcgtgctccagacaagagcgcgagtttgtggccgcttgacctgtgtccttggcgatggcaagtcgatcctcttctgggaggacagatggctacagggttcgagtcttcactctttggcacccgagctctatgatcgcattcgtgtccgccggaagctcttggttgctgatgcattggccaacaaccgttggatccgcgatctccatggctccttgggagtccaggcaatcttgcaatacttgcatatttggtcgttgctgcggacaacaactctctccgagggccatcctgattctttcatttggaggtgggagagttcggggttatactccacccggtcggcttaccttgccctcttcgtgggcaggatctcatttcagcacctgccaatctggcgatcttttgccccgcctcggtgtcgctacttcctgtggttggtcgctcaccgacgctgctggatggctgaccgtttggagaagcgtggactgccacacccagcctttttgtgtcttctgtgactaagtggaagagacaatcaaccacattctgattggatgccccgagtccctccagctatggtggactgtcctttcaagcctcggcctccctcagtgtttctcctctggcgctgtttccttccatgagtggcactctcttgccggctcaaagttccgagggagcgtcgttgtgggttcgatacgattgtgactcttggcgcttggtccatttggaaagaaaggaacaaccgtgtgttcaacaaccgttcccggtcctggcctgaggttgtcacagccatggcgcaagaagccgccctgtggcgtcttgcccatcccctgtcgccagcgcttcctagttagcttatttggtcgttcggtcgtcacattgtaatagcgagagtaggcttaagtcctttttttttccctttccctccctttttttccctatctctcttctttgtttgccatttgtataaattttatttctcttaatacaaaagtgcgcaatccttttgcgtattccaaaaaaaaaattgagaggtattcatattcatatatagtgattattgttttgactgctgctgaaacaattaaagatattgtggcacatattcatatatagtgattattgttttgactgctgctgaaacaattaaagatattgtggcacaactttgtccaactgtataaatacactgttacacttgtgagttgcgacttgccacctacacattatatacatctagtactgagtaccttgcctgtgcagctagctgtgctgcaagctgtgcacgcatggaatccaaagcaagatagcacagattacagataagatcataatagagcggtgcttgcaacgtattgtgggccgggcacgcatcaattcatttattatccaaagttttcaattatctctgcagatatctgtccagtaaaattaataataaacatgcatatattcatgtgttgtgcctattggccatgtgctacatatgagaaactgcagtctctggtcgatccctatggctgtaatatgccatacattcttgtctatatatatatatatactgtcctatatatgtgcccttcttttttcttgagaaaatgttggtttaattacttttttttaataatccataaatctgttagaatatactctcaccatttctaaatatttgacaccgttaactttttaagcacatgtttgatcgtttgtcttatttaaaaacttttgtgaaatatataaaactatacgtatacatataagtatatttaacaatgaatcaaatgataggaaaagaattaataattacttgaattttttgaataagacgaactgttaaacatattttaaaaaaatcaacggcgtcaaatatttaaaaacatagggagtatgttatattctcatacatttgtgtggtcacctctatttctcatgcgacaataattaagagagaaatgatttgggagcacgaagccgagacccgagggataaatgggtgaacagttaataagtgtgagaaagatcttgagatgcacaactctgcacattgatatgtgcctatgctatatgcacgatcaatatattttgttaagcgtactatatatcagtgttcacgtttcacaccattcgtttatgtccttgctgattggtaaattgtcggcaaattcagaactttcaaactctaggtctaccgatgatagtgtcttcccacctccgcgcttacgtccctattccattaattggttagttctaaatttcttgtatttggttattattgaaagttgtagtaataatatattaatgacggatatataaaaagagactaaattgttcaatatggtcgagttaggtcaataaattgtggtgaggagatcgaaacactacagcgagaagcttttgcaatgcaaaatgtctaagggagggaaagaatatgaggtttcccatccttaaatagcatatatacctcttaaaaggaggtaccacaattaatattataaattattagttataggttggagtaggtttagaaacttatgtctatatatgttgttgaatttttctccatttttaatgaggtgtagaaagttctattagctaggaggtatatatacttcacattataagtgtataccacatcactgacattacgatgtatatatatacctctctacaccactttacaaatagagaaatatcatcgttgccaatcttaataatactatctagctccctctgttctaaaatataactactcaaatttaactatattctcttcacaatatatcagaaattttcgctattcaaatttcctgtctacctcctcttatagaacaatcacaataccttatttagtttcatcatttcttttaatacatgtgtccaactctaaaacttctcggaacaactaaataacaaagttaacagaaaatagtggaaaggtatatacctcgatcttcatgtcgagaacctcaaagaatatgccacgtggatatgtagaaaggttaggagtgcagttcaaactcgtgttaggaaatcagatggtagaaaagcccgggagtttccatgaatttttaggtggatcaaatgtcgctagaggcagaagaaggcatcctggccattggatgcgcacccaacaagagaaggtataaatctcagccgtacgtctttaaaaaaaatgcgccacaaattaataatgtcagtcacggccacgaataatccagcacgacatctcataattaacgtgcgcgtcatcaatagcattaatcacgcacggttacacgcttaattgctctactaccaaattgacccaaaccgtactcctacgtacaaatgtacggtttcatacagtgagtatacgtagacgagaccccttgcgaaaaaaaagtatacgtagacgcgatctccgtatatttgtccgtacatcggtacatgtacggacacatgccaccttcgcgcgccacctaccttcgcgcgcctccgcctcccatctctcccgcctttttcttcttcttcttctacctctcgcgcgctaactcacggcaacgcgggagctagcggcgccatggaggccggccaggatgacgcggcggacaggctcacctacgagatcttctccatcctcgagagcaagttcctcttcggctatggcggcggcggcggcggcgagacgaagagcttgcagtgcgcgccgccggtgtcgagagggaacagggtgtgcgtgctctccgtcgacggcggcgcgcgcccggaggacgggctcctcgccgcggcggcgttggtgcggctcgaggccgcggtgcagcggcgcgccggcagcaaggccgcgcggctcgcggatttcttcgatgtcgccgctggctccggcgccgggggcgtcctcgccgccatgctgttcgcgcgcggcccgtgtgggcggccgatgtactccgctgatgacgcgctcggcttcctgctccgccgcgtccgccgccgcgggtggtcgtcccgcgccggcggcctgctccgccgccccgccggcgccttccacaaggttggcgttcgcgtgctcgtctactttttgtactactcggtatgcgtctaagctcgcgccatggctggtgaaccaggtgttcggcgagctgacgctgcgggacacggtgcgcccggtgctcgtcccgtgctacgacctcgcgacgcgggcgccgttcctcttctcccgcgccgacgccgcgcagtcgccggcgtacgacttccgcctccgagacgcctgcgccgcgacgtgcgccccctcgggcggcggcgccgccgtggaggcctcctcggtggacggcgtcacccggatcacggcggtcggcagcggcgtcgcgctggggaacccgacggccgcggcgatcacccacgttctcaacaaccggcgcgagttccccgccgcggccggcgtcgacaacctgctcgtcatctccatcggcaccggcgaggccgccggcagcagcagccgccaccgcgcgaggacgccggtgatcgcgcggatcgccgccgagggcgcgtcggacatggtacgtgccccccgatcaatacaccacacgacacggacgccactgttcactcttgttttacacgcacacgtagagttgaagcaaacagagtacgccgcataattaatttgctagtacaatttttgtacgcatgcatctcgtctcgtcttgctcggagtactcgacatgagactgagatctgatctggcatgcaaatgcaaatgcaaatgctgaaatccatccaatccaatccgatcccattaggtagatcaagctgtcgccatggcgttcggacaacacaggacaagcaattacgtccgcatccaggtaaaaggctacagtcaaaacctctgagatttttgcagtacaatcgatcagaatttgattgatttgggtggatggattgaaattgttcgtgcagggtatgggggtggcgcggcggcgcggcggcggcgtggcgtgcggcggcgagacggcggagaaggcggtgtgggtggcggaggcgatgctgcagcagaggaacgtggaggcggtgatgttccaggggaggaggctcgccggcgagaccaacgccgagaaggtggagcggttcgcgcgtgagctgatcaaggaacacggccggaggaagcagcatgttccgccggcggcgagcggcggcggcggcggcggactggactgccatgtgagcaagaaacagccgtaagtcagccacggcgagcggtgtcgcggtggctgaccggccgaccgccgggcgtattgcggtgttgttcgtgcacctccggcgatggacgtcgatcatactatcatacaatcgtactgcatcatgttaattaaataataatctcgaccgatcatttaattttcaccttgttctgcttgctcctgtaattaattaaatgcgtggcagtggatcacgtcttgggctgatggtctcgtcggccgcagccgccgccgccgcgctggtcgccggagtacgacttcggccggctgcgctagcttgcgccgccgtacgggagcaacataataagattgaaacaagacaacggaaaacaacagaataagattgaaactgaagacaatttatcacaagttcacaactactctgtcactttgttcaaaatcatcacaactactctatcactttgttcaaaataatcacaattactctgtcactttgttcaaaatcatcacaactctgttacttgttcaaactcatcacaacactccagtcacttgttcagaaaactccatctggcagtgcagatccttgtttcatttcttgaaaagtctcctccaccaaggaaccttattagccttcacctcctctcttagctctttaattgcatccgcgataccctgcagcatctctgaaatcctcttggctacttcttcgcatgtctccagcttgatatctttgatgacgtaaggcacgtagaacgccgtgactccaccgaagccccccagtagcaccagcacgatgcgccacgcagtgattgacacggtgaatttggaggtcaggatatcatcccttgcaacaaacacacaacagaaagcaaatcatttagtatttgtcagaatctaattcaacaacacggttgagtgagtccattgcaacaaacacacaacatgaaacgatcagttgtcagtttaacaacacagctgaatcccttgcaacaaacacacaacagcaagcaaatcatttatttgtcagaatctaattcaacaacacagttgagtgagtccattgcaacaaacacacaacatgaaacaatcagttgtcagtttaataacacagctgatcccttgcaacaaattaaacacacaacagaaacagtcatttgtcagaatctaattcaacaacacagttgagtcccttgcaagttgcaagggacacacaacatgaggcaaaccatttgtcagattaataaacagagctgaatcccttgcaacaatcacacaacatatgaagtaaccatttgtcagaatccaatttaacgacaaagctgaatcgcgatatattaatcgtatttatacatacctgtagtttctcctcactgagtggagttcatctttagttgcagccatttcttgagcaagctgagtgcagtgtaggagcaaggagctgtggcgagagtgagccaactcttcctgctggaagttcttttgcagtacccaagtaatcgtctgctccatcttgttattcaccattctctccataccctccactgtcttctccagcaatttctcaagctgatcagcgcgcttctcagcgatgtccgcgcgcaactcagcaatgcgcaggttggcgtcccatttcgcttccacatcctccagtctcttctcaaggctcctcacaagctgctccaactcggtgactctcacactgacatcaacgagtctgatcctgtttgctctcctcttgtcgccattggcactgctggtgctggtatcatcagggatgctgacattgggagtacttgagaggcatcgagtggtctgcatcgaggacagacgacgtcgactccctttagaagcagactgcaccgggatcatgatcttgatgccgttggcagtggcgagagagctgacattggtgatgcccgatgacggcggcagtgtcttcttgtcacgcgcatcgtcgaacacgcagggcgccagggagacgaagcctccggtcgtttcgccatgctcaggatggccaccgccggcgacgatcaggtcgcggatgagctccaccatgctgtcgtcggcctcgagcacaacgaattcagggtcttggatcgccggcagcggcaggttcttgacgaggcagacgagcgccgcggcgaggtggtgttgctctgccttgctcaagaggtgacgagcgcggaggagagcagagtcttcggtggcggtcgccggagccaccggatccgaccccaacttgatggtcgcgctcgcgctcgcgctcgcaccggcggcgccgatcagccaaggagcagacatcccgactccgaccatggcttctccgccaccggaggcagcggcggtaggcgacaccatgtccgcgccgccaccgatgatgatctcctcggggcgggggcgggggcgggggtccacttcaccggcgcggctggagagcgccctgagaggaaggcacggcagcgggacggtggtggtggcccgggtcgcgccgtgcgcgccggcggcgagcatgacgagggcgcgggggcgaggcaggcacgccgccttggccttgcggccggcgagggtgagcgcccggaggagcagcaacggcggagacatgcttgtattgtacggtacggcgagtcggcgaccggaggcgaattgaagtggcggcggcggcggcggctagggtttcgggggatgaatcgaatcgaatccaccaccaccaccaccacgcggtgctcgccttctcgctccctcgtctcgctcggctgctgctgctgctgctgctgcacagctttcgaggacggaaaagcagcgggcggccaatgtgtgggtgacgcgtgtaaggcgagagattccattttttcaattcatcacctccaatggatgccgtccaatctgcaacggacggtccagatgatcgcctcgcctgcctccttcccgtctttcgcgctgttacagcaaacacgtagtattagcctgtttattatacttagttggactgattaggttattattgtagtaataatgtagaggaatacatatacattcatgtcaagaaaatgagccagattttgtggtatattgaatcaaaacttatcagtgaaaaagaagaaacctgcaatatatataatttgcatatgcatttttcctttttgcgagaaggaataaaaatgcctgctctgtattgaaagcatagtactccagtttacaggatggatgtgcagcacaacaaaacagggctcacagcagacaattgaaacccttttctatccttgatccttcagatcacacccaacataaccccaactagtgcactctacaccttgccacaaattgaagacaataacctttataaggtttaaccctcacgcgctcacgacttcagctttgccaatcttctcaatatatagagctttgaataatcctatccagctttgccagcgcctctgatgtctcatctcaatgccagccaccataactgcaagaaggatgccaagtttgtgaatggcggcaacaggataactcaaaggattcaattatatattttctgcttaacataaacgataaatcatttggccttcagaatctgccaattttgcaacagaaattgggcattagagtagtgcaagaagcatcattgctgtcctattttgcttctcttgttttcttaatacgtatgagtatgcgtatcatttcattaagaagaaacgacgagggagtggctaaaacaccttacactccaaacaacaacagattgctatacaaacacaactcactcgccctgaccttacccagccggggtaagcaactttctaaggaactcgccgagcttagaagccccagcctacaccaaagaccgtgtgaatgacaatcataacaatagaactagccccatcaaacacactcattcctatacttccatatctcccaagccacattcattttgtttctcttgttatatggatatttgtttcaaaatcaaagtagcactacaaattcatactagtcaatgtagagttatttgtttctcctttgtagttcctttaatcactagaagttctccttgtctctaactagtaaacaagcatgttcaatgcacatcatgggcaacatgaatcgaaccaaacattttcttttgaatgagttgctagaaaaaaccccaagcatgaaattagaaaataagatacacttaaaaaaggatatagatactcacgttccattcatgtgatttcatgaaccaggagagtacaagtcattggctaacacatctacagtagcagtaaataccaccaaacattaatggtcattgttcaagagttcatagccccttatctacagtaacactaaccacaagaatgaataatctaactaatctatactaatgtaatacccaaaatcttcaaaatccagatatttaatatattccaaatttctgttagcatggttatatgattggtggtaataaaatgaatttttaatccttaaaataatttttgaaagcatgctcccggtgtcatttcttcagttataaattcaggttcctttaaattcttactattaggcacgggctataaagtgttatacaagaaacaaaagcaagtggtagtggaaccatccctataatttatgcatgcatcagagtggagttcaagcatccaaggatgtattgccatctagaatgcctagcaatccttactcttatatttcattatattggaaaaacatggaagaagaggacatgtgggagcatgaaacattacacatgcatattagacagtgatctgtacaaaataaatgaatgaaactatccatcatttgtgggactgaaatatgtgctacaaagcacatatttagttatttaccaaccgtatcttcccttgtcatttcacttttctaactcattgcatgaaccatcatggaaaaccagagcttccatgtgacattgtaaaatcataaagaacctgaaattaatgattttaagttgcaacgcgctgaaaacattgtgaagccgaaatctacttcagtccaaaggaactgtcgaataaaaaccttacttccaacgttaaaatgcttgtagagcgccttgacaatgctgcatcatatcagtatacattataatttatggtgattgtagtcccataaaagttttttacattacccctgacaaacccagtgcaagtgctgttgccatttttatgatgcaccataaatcaacaatgttcagtaaatgaaaaaaaaatatgtgtagcatcaaaagtttcttaaaggaaaagaaaaataaatgttgaacgaattgaatggcctttcgagattcatgtgtgatatcttgtagttcatcaaggctatgcagatgggaagggaacaacaagccttgtacaatggaaagcagatgtgttgtaacagaaaaaaagaacggtagtgttgtaacaaatggttaccattcacttcttaatggaaattaggaatgtagctagcatgttcatccaaagaagaaaataccttccatgtggctttctcccttgtttcagtttgctcgaaaaggtatttaagcatccctttcccttgttggtctgtccatgttataattttctaagctatcatactacacaaagccataaagcgaaaaggcacaaaatataaatgtgcatcaacaagacatgtatataaaaatattcttatatattgtcatgtttatgagagaaataaaacttcatctgcaaaaaaagcctattgactaaaactcgtctagtaaaggattgcaaaatgacatgtaaatactgttatttttccaatctcattttccctatgtattgacatgctgatcaaaatctctatgcctgtgttgtgaccaggcaatcaggaaaacagagagatggtatgttttccttcaagctttacaattattttgtaatgaatatgtaaaaatgatttggcttgatcaatagaacaacacttaagttctgaatcatttttagtacatattatgtttctgaagattgttcctgattacatacaaagaaagtgcttaaaactggaaaagctagcaactgaaatatttcatgttagatgatatcagaattggagtaataccacaatcctcacaagttttttaaatttttttagaaaacgcaggagagctgcacttcatttcattaagaaggaaaacaaaccacccatacaaccaagggctcatgagcccttcacccagaacacatccacaactagcatcacacaaggcgatacacgaccaaaaaccaccgtacaaagaccaaaaaccagcctagtgccctgggttagtgacctacaaaggaaatcttggagcgcaagagctctagccaggaaccgaaacctagcttctgttgacactgccctcgacacctccatgacgcttggatccgctccgttggaaacactgtcattatggtgtttccgaatttcccaagcaactaggataatcaatgaattgagcccctttttctgctccctatgcatgacataactgaactcggtgaaaccattgaacatttaatgaattgatccttacagtccttactgaattttattcaaaacttaccatgttattttttagataatatcatcatattaaataaaatatactgttataaactcgtaactactgccagcagtgtaaatgagtttagtggcaaaaaagtgttctccacaggagattcaaaacaatttaaaacagtttgtggataaaattctgaataagttgagaaaagaagttgatatgcagttcatgaacactatgatcacctggaatcctcaatatgcacaaactgtgtatctttcagcaaacatcaaagaattcaacataagaaaaaattgcttagtaacatacaaattggttccaggttaatgtaaaaatatatacatgcattgtcttgtaaaaccgttcactacattgtgcactagctaaaagttgctcccaggatgatttcaaaaagaatatcctgattgcatggaactcacgaaaaagaacaagttgggtccgactaaaattggttatcaagctaaaagtggttccctgagaaccacccatgacatgctagacaatttttttacgcaaaaggatataaagttcctgcactgacaaaaacatagtaaacggaaaattaggatgaggggatgcacagaaagtaatgtccagatgaatgaacattaactggttatcctttgataaccccttgtttatgtggtcaattgcttttataaattgtacactagataaagtcgaacgaggcttcttttcaataacctgaataagaattaatccacaaaatctgtttgtggatgaatagccacaaggaaaggattaccaagctagtaaactagttgatttatgcaaaacctgtgactactaaatcatacagggcatattaaagagcatattacataaacataccttgatcaaatttaatatgataattgggtttctgtatctcatctaccaaggtcaccaaaatgaagctgagtcgttttatagtcagtgtttggttgtcctgcggttataggagtgtcacaaaagtcctatgtacataataatttttccgcagatttgccacaaggaaaggatttagggcttacttgtgatgtttggcttaatagaaaatttagcttcttgagaccacagaagatgtatggatcctccgcattgcacaacagatattatatttgatggcattttatcttgggtgtcttgaaacacaatttgctttgtctcaacatcatcggcggcaattttgatgtgtttatacaattctgggcccagcaaaatggcattaaagcttagctataacagtcactgaaactttctcctaaatgagccatgaactatatattaataattgcactgcaaaagaagacaatagcgtagtaaacataaaaaaaagggcgcatttgataataatgataaattacaggttcaacactaggagtacagagtagagttattttttttgcgaacacgtaaaaggaagtagagttatgtactaaccatcctagcagctagtaaaaattagcaatgtggttttgctgacaaaaacataattgcatttgttaacaattgttattaagtgcaactatacatgagttgtcaaaggtgatgaacaaccaatttactactagtaaattctgcggttaaatgcagacgaggacactggataaactaccagagacaaggtcgacaaaatggccccaaatcacagctgcagcaagatcgctggtggatggagctcgttgcggacgaaattaccggccacgaagacgaagaaatcaaaccaaaaccgagccccccgaaaaaaaaataaatcattaccaaatgcgagagagacattgataagcattaagcaggcaatcatggtgtggtgagagagattcgaggaggcctcactacgaagaagatgatgacgagggagatcaggacgaggatcaactcgggatcctcgcgttcccgccgcgggcgtaattggcggcttgccctcgcagcgaaaccctagggctggctcatccccctctccgctcccacactcgcctagcttcttccccctcctgatccgccataacgaaggggaggccgaagaggtcggtgccgccggggacgcctcgacgtcaccaccgatggcgccgccgccggcgaaccttcgcttatcgggagtttcgccgccggcggaactgaagcgacggagcggcggaggaggttttgatcgccgtgagtggtcccacaaatttacgaacttacggcccattaagcatatgcgagattacggcccatcagagaatatccgtagcgggctagagtcggcccaatatctggtcgggtcgcgaattttttcgtttttagattttttttaatatttacagaaataatctatcgacaaaaaaaatttacaaaaatagaccctgccgccccaatggtgggcggcaagctgatgtggcagatggtgggttgaccgcgccgtctgccgccatcggccaaaattgcgattaggcccttgccgcctatagggctaattgcaattttggccgcccataaagagcttgcggccgtactttttgcatctgggtcggggcggcaagggacccagatgtaaaaagtacggtcaaaagatttttctatgttatgttaataataaataaagaagtatttattggtaaaacttgttaatattgttataaaaatgtattgaagttggttgttgcgcaatttcatatgttaagtgagctattattttgtaccttattcgacgtattagtactcggataatttatataggcctatcgcagtctgggtcgtagaaacattatatggacttaaacgaggagaattatgtaacatgaagaaatagtagtataatttgaacatgatataactatttgcattgcggttacatagatgatattagattcgaactaggagggaggtagtgcaatagttgaacacaacgacgatgtagtaatgggaaaaggaagcatgacagtagaaatttcaatatgccaagttgtccgataatagctaacccctacgtgaggatccctctcctctctcaaaccgcgctttagtaaccctgtattgctctagtagttcaagctgcacaacacggctaggtggagttagaacccttctggtgtctatccattctctgtattgacatctccttggtggttcctgggaggaaagaatagatataaagcaagcaaagttagtaaatgttgtgagaaaataaggattcatgtaatcaaaatattcttaccatgaaatcgtcgtcaagaatatttggaaccttcgacccaatgttgtaggatttatggaacgaagaacctgacaacgatcaccacacctgcatcttggacgggctttccatggagggagtgccgtagttagcacccgccagtcgctctgttgttcacgacattgtcgttcataaagccgcttttctctgtaagtattgctcagtactttcggatgcgaaataccagcgaccttcttgtaaacaagtggttaggtcgagaacgagattttttgtatcgacccactcgatgtatgcgcaagccgtagtgcgggtctgccgaatagagtagtgttacgaagaataaagcgattgcccatacataatgaataagcatatgcagataataaaatatctcacggtcatagttagggcacctaaaaaagtgccttcctcgaatatcaagattccttgaagccattagttggcatcgatcaccgcataggcagagaggacgctggcaccaaggtggtagtaggtatacacaaggatcgctacgccagtttggatcctcaacaccccggcgtctagccattgacgaaagccggtaggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattagcgccgaaagttacatgcctgatcggcgccgaaagttacattggtcgtatgcgccaaatggtgggcaaatactcgtatcgcacgcgaataaaggaggctgcatcggtgcggcagaaagtagtcgtgcatgcgccgaaaggtatcgtgcacatataacaacaacgtagtcattacacaagcatacagtactggaaagtgaagcaaataaacaaagagaagactgctctactggccctgccctgcgccgcgaccacgcttggtcctccgggcctgtgctcgcacgtggtcctggaagtaggtgaaacgatccggtggcacagcacgggtagcacgagtgtctggcggaggagtggcctgcgcctggtcttgcgtctgcactagcggtgcgtctcccagctgtgaggggccgatgacgtcctctgtcgagcctgaagcgaagtcgaagagcaaggtggaaggcagcaagcggtccgacgacggcaccacagagtacctatcgtagggtagtcgacctctggtcgctcctcgtacagtgactcctcgtacacgtgctggtccacctcagggcggccgatcgcaatcctctcagttgcccagatagaaagaaagagagggcacccaccaaaggtcgcactgggatccgtcttcgtgcaagcctcacaaagtgcacggtacagagccgccaacaacgcggaaccccagctccactgaggcacctcgcctaccgcggcatcggcgatgctcctggcgtagtgcacgagtcccttgtcgaccgcgtgcccgtgaccgccacagaacatcacccagccaaaaagctagagcaagtacgcctccaaacagcggctgtaggagtactcgtcggcctccgcctgtagctgctcgacgtgcaagccttcgataaaatgttaggcaccttaactgtggactaaatatgtaacacgcttgtcatttcagtacaaaacactcacgggaactgaagcagccacctcttcgtaggtccagtgttgcggtggtgagccaacggctcgagcgggaggtgcagtgtgcgctgtactagtgcgaaatgtgccgtcagatcatcctgccagtccacagccgtggtcactggcccaacagcgtctcccgcgagcggtagccccaacaagtacgatacgtcctgtagggtaggggctacctcaccgcacgacaagtgaaaagtgtgcgtctctggcctccatcggtcgaccaaagctgcaaggagggacctgtccacagtccatcgtctggccgggtccgcgtcgccggcggtagcctccaccagccgacacatcggtaggaggccggcctcacgcaacctgcaataacaaattaatatgtcattataaaaaatattacagtgcaactaatttatagtaatacactgttcgtacctctcgacaaaggagtcgtgaaccgtgagtaactcaccgcacgtccgtgctcggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaagtagtaatgtaaaacaaaagataacttgcaaaattatgaaatagtaataaaatcatgagaataattatgtacaacaagagtacatgctatttaaatatagcaaacgttactaatggtacataacgatgacgtgcaatttaacatatatgtagagttcgataatataacataacattacgtgtcgaagtccgacatacatcagcatacctaaagacgttaggcgccttagtttgacgttacatcacgagacctaaagacatgacatgccgaagtctgacattacacgacgaaacataaacacatcgataagttcgaaacgaattacaagcaaaaccacatgccaacatagaacataagaactacaccacgtagccagacgtggcacgacgatgcctaggacgtggtcgagtggaggtagtgccttcacccgtagggcgagctctatctgctgctgatcctgatagtcctgcctccgccgcacttggtttctccttgtctttaggacaatgcttgtaggtgtgcccatgttcatcgtatttgctacaacgcttcaccctgccagcctccgactcgtccatatcgttgcggatgcgacgagtcctcctccttctagccttgcctcggagcttcgatgggtcaggaatattgagtacttcatcgttagtctctgtgaactccccagctatgccgaacccataaatctcgccgctccatgtatgatatattgcttgcttactgaagtactgtaacacatatactgcatctggtatgccacactccgctgcggcagcaatgacatgggtgcatggcctgtggagcagcttcggctttgcacaagagcaatgacatatgccgtcggctttgagaacacactcctgcttcactctcttgcggtagatacccctgcctgccttatcttgacatagtatctcaaacctgtgctgttgggtactttgcactagagctcgatgtttcatggcctttttacgcaactcctctagctttttctgcatgaaagttccaaacaaaatgctgttgttcggcatagagggaagaactgcctggaactgatccctaaaatacctgcatgtcccatgtaaaatgaactccactatgccaactagtggcagtccacggacaccgcgcatcacccagttgtaaacttctgccaaatttgttatcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgctgcacgctgatcactacatttggctgtcaactcatctaatctcttccaaagctcattaaattttttctcctggttctgattgcacagcctcttgaacatgttcatgagctccttgttcttgaattgcttgaagaaattagctcccatatgacacatgcaccacctactctgtacatcttcccaaacaccatggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacatttcatgaatgccatcttgcatgcatgtagagctaagaacgccctttgcagcacactcttgccaggatgttcaattgaggggaatttcttcacttcgtaagagctcccagggtttctttcctcgataacaccaagcaggcgtagcaaattgtcatacgaggcttcgtaagttccaaatctcatatctattattttctgtttggcccaccaggccttggcatagctaatagtatacttgtatgtctctttgatgtgtcggattattgaccttggttcatatgtgagattatgggg

SEQ ID NO: 82479 - DNA, 2792 bp, Oryza sativa
ctaaccaatggtcgatcgtcatcatcaacaggaaccttttcatagccgaaagagtggtcaagccaccgaccacatgccaaataccgtatgcttgaaatttaaatgtggtgcggacttgtacaagatgaaaaattgggacccattggtatgaggcccagaattagccatgctgacaacacctcttcctgaatgtataagttttgaattcagttcatccttgaaaggtttaccccatatggactcccctccacttcctgtgccagttggatcacctccttgaatcatgaaatttctgtaaaaggaattattaaacagataagatttagatatgaccataagtatgcataaaacaaatgactaggtaaaaaggactaatgtgatcagaacatacttgatactacgatggaagataagaccattatagtaaccattttcacaatgtgtgaggaaattttcacatgtccgaggtgttatatcacaatgaagctccaaattcaaatcaccatgggtggtatgcaactgaacatatcccttcttttttggattcttttcaaccttaacatactcaagttcatttttggtgacaggatcataggcagttgatgtgaaagaacgtgaagctgctcctgtggtgtaacggcttttaacctgaaatcattgaatcatctccatcagagaaaatccactgcgtatgtaacacaaaccagacaaaatacattgagatgatacgaaagtgtaccagtttagcatttacaggagctcgatctcctgccatgtgcattgctattctagcagctgttttctcagcagtagcagcctttgctgcggctgcacttctgccatgaacagaagcagaagcagcatctacaatactgaaaggctgatgaggtttaggttctttgccagattttgagtcatccttctccttttttgccaatatagcagcaagtgcagcagctctttccttttgagctttctgccctcccccaccatgcaaaaaagctaactttcccttttcagttccaagttccttaatcatttgcttaagatcaccagaaatatttatgttgtaggttggatcatttttcattcgttgcaactctgagcaacagtcatacagataaagcatgtaagttaactaggaaatagcaatatgaaagaagtaagagtgaaagagggaccggaatcaaccttcatcttcaagtttgaggcctttcttgacatggtcaaattcacctaggatcttgctatcaaccgcatttggattcttcaaagttcataagatgaatataattagattacagggctaaatgtcaacaaattgacactgagtacagtagacatgcagttctaaatacatacctgaattgttatcaagtcatttcgtgtaaagggctcatcagttagcaattctctccaattctttggcttgatgttgagttcttggattgcctgcattttatgagtcaagaatgcatgagctaaaaagtaccataggtccataatactaaattgttcacttgaaaaagctcaccaaaccccacctcataacagaagacgttcccagtagtctttacagcaactatatgcgtgaattctgtaaaaactttattcaaaacagggcactggaactctcctgcaagaaaaaggacagatatttaatgtccgagatagaagagtacatgtaccgtaacatttggttcaagatactctgaaatttttgcgacggtttaactcaccatctgagttcttgtggaatgttaaaggcattagatcttcctgcttgagtggtgttcctgttactgggtgcttcccgaacttcttaatgtatggaattatgctcctacatttatacacagccaacacaggattttcaggatctcagtctctaatattttctccaaaaacatatacaaagaagaacaatgaacttacatcaaatcaaagacgcttccatctgctgtgcacactggatcctcaaatggtaaaaacgtaagcctaaaccaccaaaccaaataattataatcagtggagaacggaggaaattaacatttggtatacagatccatccactactaagctcaatcaacataatctaaaggttaaatatcatcaagtactgaagttgaccacaaagaaattactatactttgctaaccgccttaactggtaacatatcaactaaaagatcaacaggaagcgcaataatgaagtttatgcactaaataagaaaagctacaagctcaggctctccccaaaccctaatcagaatagtaatgactagcagaatacacagaaggaggaaaatctcccttccggctagttccaaaaacagtagaggaagggtaattacgcgcagcagtagaagggaaggcgcttgaagggcgtgccggcctccttctgcttggcgccgccccactccgtcgcccactccgtccgcgttatgaacatccggtccttgctatgctgcttcttccccatctccgatgagcctacaagatcgcgcctacagccggtggtgctggtgccgctgcttctgctgctcgccggcggcgagaaagaggggagatttgacggcgaggagcgtttgggtcggattggtcggggagagagaaggaagaagaagccgattcgcccgcggctcggctcggctccggttggaatacggctcgagccgccgcctcactaggtcggtccagagatagtttcggcgagtttttttcgtttttagatttttttttaatattacagaaataatctatcgactaaaaaaattgcagaaatagcccctg

SEQ ID NO: 82480 - DNA, 6019 bp, Oryza sativa
aaacgtaaataagaaacaagtaattgaaaatatcataaaagcagactaccgtcgattgaagagattgagcaatcttttctccacttggaacttccaaataaacctgtattatagcttaaaaggtaatatgagtagctacaaggaagaagaataaggaaaaattggaaaaaaaaaactttcactaaactaaacaggaaaataggcagagaggaaggttaaaaagaaatttaattgttagtagctacaagtcagacaaatatatctggaatatataaacaaggttacaagagttaaaaaaaacaaaaaccaaaatatgtaattttaaagggccaattagttaatctctaaattggcccttaaaacacaatcaacctcaataacaaagggagcctggatgcatgcatttatgaactattccctctgcataactatatcggccgtgtatttttctcgcattaaaccaagaaacccaatgagatagcctaaatgcccatatttatggctccataagagtattgatgcaattgttgcctggctctaatcccagctgcatgcatgcatgaattaatcgtattatcgatcactcaattaaaagatcaataccgtatgctaagagcagtgataactacattagcaagcactctagcacccaaattatacaaattggcaaacttcatcagcaaacactaataactaaaatggatcagtaaaccaaacatgtaaagaagcatattggctatatagactgcagcgctaaaagaagcatagtccaggtgctattgggagctgaagcaccaagcagccaaacatcagtgctctaaaaatcggtgctaggcgcctattagccgcctgggattaggcattacattgtgtactagacggctagccatccttaggtgctcttgtgcgatctaatttagtgttgtactgtctaatttttatgtaatatgcttgctaatttcctaggcgccagccctgcagacactctagggctattgtattgtctaacatttgctagtttaagttagacatgataaaatgtatagtacatagaaaatcagcagagtttagtgcatacaatggtaggaaaaggcggacgaatgagtgaactaagtatctgtggatcagatacatcagcatcgcgccagacaagtgtaccaatttcttcttcgttgtcaagctgctgaccccggaggtacatgaagcggggttgcaaagcacgttgtgcctccagaaattcatcaactgtagggttaatcagcgtgtgcacctgcatgcccagctttccaagttcagaactgacaaacaaaatatatgtacttaagagcaagtttaatagtagatctaactactagatataagctaatcaaaaagtagcattagggctcacatgtgtaacagattagttataaggttgtctctaattttcttctctctctttttctcatttatataattaatgcatttatcgtagacaggggtggagctatcaaaaatatcattgaggtcactcttcacataccatggtgcaaatgccaattctaagagtaatttattagttccaagcatatttaataatataattagcaaaaataattggtgtcatcagtaaccatacactggatccgcccctgatcttagagcatgtgtatagctaactttttatacacaagagcttaacactttttattctccaggttatctctcctccacataggtttatactagatggattatagcctacaattaaacttgctccttaacaaaaataaacagcaaaaggatacttacctccaacctcccggacgagatcaactccgggaatgggtacgatggccgctgctgctgggacccaggcaccggacaaggtggcgcccgctgcttgcctaccttcccacacagcactgcaagcaccgtgcacttcacccttgagccgctagggaaatgaggcatggttgaaaacctgcaagggtttgcacccatagcaacagcagatcgatcagacctccacaatagttctccacccgaaaccaacaaggaacacaaaaggaaccgagcaaatcaaacgaataccccagatcggatcgagcagcgaaaatgggatcgagcagagaaaatcggatcgagcggatctaagctaacaggagaccaaaaccgactgccacaactcggaatcgggactcctgagccgctaggacgccggtggaagcgctcgatccatttggtggtggcggcggcggaggtaagaggaaagggtggagctgggatatgggggcgagaatgcaacggaaccctaggtttcctctcggtctcggatcatttaatagagccaaaaatgaaggggaaaacgccgattaatccccagaagcgaagcaaaaaaggcaaaatcgtaacggcaaaaaaaaaaaaaatcgattggccgggagggacgaaccgctcgaggcactggagatcgaacgatgcacggaaacgtgattttccccaattcctcacatttgctacggctgctgctggcctgctgatgctgatgctgatgacgacgacgatgattcatagcttgcggagagaaaaacaaaaaacatgtcggattaaattagctttctcgcagcaggatttggaaggagaattggagagaaaaattaaaaccgaatttgttctgtgcttttctgggcgcatacctcgatcagctttgattatctgctgctgcggctgctactgcttttgggttttttcggccgcatccatttcgatcggatcggatgcgtcgcaggcccgggtgttgttgtgtttggctcatggcattggctccggaggagggattttgggaggaatcgggatcgcacggcaggtctccgggcgggagacgtgcgagcggaggcgccatgttggattgcttcgaggggtgatggtgcgtccagtactccagttcctgcatgttcgtccggctcttgatatttcgatgacaagagtgcgaatgaacaaatgcgagcggaagggagatggggatggttgatgcgcgggcggtcgcgcaccagctcgatcagtttccccctctagtcttttccctctctctctataagtatattgatacgtatatacacgtacacatacaaactttatacttcctccgtttcacaatgtaagtcattctagcatttcccacttcatattaatatgtttagattcattaacatcaatatgaatatgtgaaatgctagaatgacttgtattatgaaacaaaggaagtattttactagaaaagatactagtgcgttgcaacaggtgaagattattttaatcttgttattgtcatacagtttaattgctgtgaaatttattgtagaaattcgcctggatatatatatatatatatatatatatatatatatatattaaaaaaagcgaacttatttccaaaagcgaacttaaaaacggactcatacacggatgatgtactaaagtaccggtaaaaacatcttcaatttttataatagtagagatgtgtgtatagataaaataaaccgaaagatacttatatatttaaaaactgaaataactgaaacaaaaccgaaagaaaactgaaaaaagaaaaggaaaaatcgactcttcccacgcgctccatgagagagaatctgacttagaccctgtttctttccgcttaagattattataatctagattattgagttagattactataagctagattgttataatctgtagtagaatacccggttagttgtttctttcctagattatttgggtttgcaagtctaaagagggagtggggtgacatggtgggtaatttttcacccaataatctagaaaaagctcacctaaatgagtttatcatattataataagctgggctccagattataataagctacttcaataagttgtctgtttctttcagcttactcccaataatctggattataataatcccaagctgaaagaaacagggccttatatgcgagggccgactaaatagcttttttctttaacttattttgaaactagtatggtgactcatcgttataatttttctcacataatagcatttttttcatattttatttttaaaatatattaaaatggtaataggattttaaattactagcaacatgtatgtgcgttgcaacggatgaaactaatattaatataaacaacaaataaatactaaaattaaaatttaagtgtcacaacataacgttacggaagaatttaattttttggctaaatttcttattggccacatttggacaaaaaaaaatcaaagtgcaaaaatattcctaaatggtaactccgttgggccaagaaaataaaggaaataattcctgcgagcctgacctgaaggcctacgaacattttaattggtcgatcacggttgacagggggagcaggttggtttttctttggagttcatgtctagggttttccctgcgaaattttttatatttttttagatatttttatgttttaattttattaatagaccattctaaaaaatatttttaaatctggaccttttggcccgcacgtggccaaataactctgtcacgccgcgtgcagcgggcatgacaattttatcctaccacgccagcgagagcggcatggccagataacactgtcaagccaacgacgccggcgtggccaaataacgctatcactccagcgggagcggcatgtcacgcccagaaattcactagtaatttccaaacttatttgtgcattaaatcctcatccagaaatcagccgaggtacacaaactgacaatttaatatacagattcatcaagttaactaaaacgataaatacttacataagaggcacttagtcctcaccacgaagaaaactgcagcggaaaataaaatctagcgaagctccggctccactcccacaggcagctcaactagggtataagccaaacatcttctccttcgtaacttttcttcaactgaggtttgattgattattacaaggtgagtacatggaatactccgcaagccacacagcaaatatgcaagtgcacaaggataccaaaggatgacataatatagggctcatttgcaaaagcagcatttagcaaacatttaagaattgtaaaacagtagagtaattaatcatcaatattaatcaacactgaacagcacacccatgctgcacaggcccaaccatcctgaacaaccatacccggctgtacagatctatctccaaaccaggaataaaccattcaaaaccaggagctaatcaaattattaccagttatagcatcatttattatgatgaaaagtgtgagactaatcacgaaagacattgttagacctgcctataaccgcgggcacggctattcgaatagttttactctggccagaggtgtaccactgtacccacaagacacgattccacacatgttaccatgccctgaagtaccaccacgccactgcaaagggggaaatcgtgacagtacccttcgcacaacacaactcaaagcagtgcaccgttcctggatcataatcacccccttataaacacaaggcatggactccccagcgacccccgtgggcttatctccgccacttctcagtctggtgccccgcaatgaaccatgctatacaaaagataaagttgttgcccatactggcttgtggtttgcacggttaatgtttcacaaccgaaactcgtgaaccagtccttaattgtcatgagcacgaccagcaaaaccatgtgctcacaacccacatttatcaagttttagttggcaaattaattaattaaccaatcatgattagccatcgtgagctaccattatcatgtccatcattaagtagtagtgaaacattagttatcccaatagtgtgctaatgtttctaagcatggctaagcaattatatctaatatatctagctgaaccaatatataaagctcaactagtcaaattgtaacccaaggtatcaaaggacagagtaatcaatacaaagtggccataacaaaggtatagtttcacaccaaccgg

SEQ ID NO: 82481 - DNA, 3012 bp, Oryza sativa
cagccatttcttgcaaagcattcaacaagacagtgttaacagccggccatacagtttatattatatcaagatactgtttgatttataaacattgttgacctaaaagttggtaaaagtttgtgacctgcttgtaagtctagcacaaaacagtaaataaactctaaaccgcaattttattatagaaatgaaatagcagtaggcattacaattgatatgtcagggaaattaataaggacgtccgaaacctcaagactttcagtgtctcttgagcatatccactctcttaattgagctgttagctcttcctcatgagcaggatcttgagtttcatctgcaaacataaaaagtcagagaaatgtatgaaattttcatgtactaccgtcgagagtgaggttcttcatatggattgcccttaaggaccggtgcctaacggcggacaatctcgcaaaacgtggatggcctcacggcgacctctgctcactttgccaaagggacagcgaagactgccattacctgtttgtcgtctgccctttcacggatgcagtttggcaaatcctcagaagctggatgaatgtgagtttctctacgcctggcgagaaaaccctgcacctgtctgacaggtggctgcaggagaggctctgttgtcggctgcgctacaggaacaattttgatagcctattattcttggtttgttggtttctttggaaggaaaggaatgctagaattttcgatcaatgcttcaagcctgctgttacaatagccgatgacatcaaagaggagttcatctgctggaagaaagcggggatagttgcagaaattagagagtagtcggcttcttatttcggttcagagcgacccttcctctggttactctgccctcctctcccttcctggggataagcccttggcttgttcccgctcggctctcttagccaatgtaaaccaactttgtatttgctcttttcttctcaaattttaatgaaattggttggcctccttcggctgacctggcaaaaaattttcatgtactacaaagtcagagaatgtcgaacatgtattgcacacttcataaaaaattaaatgagcatccaaacatttgaataacttaataatgttaatgaccaaatttggtaatccaaggatcggagataaagaagaaatcgagatggaattcgagatggaaatcgtcccggaaacaaagtgagaatcggctgaagtccgaatcggctacgactgagatcggcagagttagagtcggacgggattagccgattgaatcgaatctgacaatatgacacggcatatgttgtcgggttaggttgacgtgcttcatgatgattgccacgcatggatagagtcctgagaaaacaattgtatctattaattaagatattttatataatttccttagagatatgtttgggcaaaagtctgccgcaaagacttatggtatcttagagtttgttagagataagagtcgtgtccgatatggacatattttgtaattttcgggtataaatagacccgagccccatgtaatcaaactaacacacgttcaatacaatctcggcgcatcgccactctttttactttcgttttgtttcgacgagttcttgctttcgggttgagctgcatcggtttcgatcttcaactagaggtaaaacctgttatggcggcttgcgttctcgggattagtgcttccatctttatgatactctaatcttgtttatgtaattcgtcgagttatcatatatcttacataatctccggcaatatcattatctaacctctagtcggctaacatctgttaatagaaagcagccgattaggttaaatattgacgttgacttagattatataagatatctaccactctatgacacatccaacggcttgattgtctatatattgtttctcttttcatacttatagctgcatcagttgagtttgatcttatgaagtcgtgattagaatctcaatctctagcctgtttttggttgccgattagggtagtatcggggtttcagccgatctcacctgatttagctttatatttcatgtgcttaattgatatgttagatctgccctttatgttaagatttcattacaataaagtatgttaggctcctgtttgatgtattttacttgtcttaatatcttaatatagagtggtgtcggagtattagccgatacatgctagatctatctgatcggctatgctatgaacatgtatagttttgttgttaatatatatttcgatctaagtgatttatactgtctcggcatggcgaccgatctatcccaatcacttgatttaagtatatatcgacatgaggattatatattgttaatatctacagccgatcgagtagatttagttctttctcatttagtcatgactgccgatcgatgcatatatgacatcggctcaaagataaatgatatgtcatcggcacttagccgatcggctatcgtttatgaatttaaccgcggtttctttgtatttgtttcttgttgattgtaggatcaaatcaactggcacgctcgcatacccaaaggcaagttttgaacctgcactggagttaagcagatctcccaggcctcgtgtttttacatcaacaaatagttgacataaaattcatttgtatggaaaagaaagcacagatgaagctctcagatcaaattaactgaccatctgagattgtactattttgacctttgcaattcccatctattttgataagtatgttagcaccaacaacagaaaatacaacaagaatacaaacaaagaaactttaccatttggagcaacaatgtaacactcagacgggcgaacctaatagaattagcgattcagtctatactattaggtaaaaagaaaacaaaaatatgcatatacatcgatgtgtgcataaaaaggtagcatcacagcacactaaggatcaaactaagagaatctcactaacaaaaatgtcaattatatggtctcttaggtcacctcattgtcagaaa

SEQ ID NO: 82482 - DNA, 1381 bp, Oryza sativa
tactccactgcattttcattgcctgaagaaaaaaaatcaggcctatttaattccgcgcacgattgcgacatgccaactacgatgaacgtactcaagacccttgctcttaatgaatatgttcagggaccaccaagaacacggcctcatgtgtttgtgtgtttctgaagcatgtctgtacaattgtcccaagcatgaaggttttttttcccttggcaaactggatagctgtggacctgtggtaacttctgaagaggaaagaacagtaataagaagaaagcacggtcctttttcattgtaagtggatttttgaactattcattttagtctcaagagagacactccgaggggttgttgtgtgtaatcacctaaaccctcttgaagcaaaaaaaaaaaacagagaagagattatacatatatcacaattttcaaagaatagtaaaaaaaatgtacattatgatgatatcgcccatgggagattaatcaatcccttggaaagaaaaccagaattttttccttctttgcagctagtaggaaatcagcagcttcaagttgtaaccatgcatgtacaatgtacaccctcctctcctccggctcgtccagtctcttctacagctcatcgttctatcacctcttgttctgaggagacggttgcgaagaaggtagcggcgtcgtgttgacatgccataccataacctctgaacagtctgaaggaattcctctcactttgctataatcttcaaggaccacttgctgtacgaacttcaccgagtcctgataaaacaatggcaccaaaaacatgttagggcaacggttcatcatgcagcacaatcaagaaaaatgggtagacattttggcatcagaggaagcaatgagcaatgcagagaaagaagctctaacaaccttgcatgattgatctcataacgaaagaggtgcttgctttagtggttaggttcaagtaataagatgaacaatcgattgtacacctaaaagaaggtgtgttttctcattaaaaacaagggccactgtactgctctactactgctaaccacccgctggggcttgccttgcactggacttcatcaaagccgtacactatcctactcagccacgggacccccccccccctcttccttaccctctcccaccaaattagcaccagatcagactaaacccacgattacgcatttgcaaaaatgccgctcaagattcgatccgtttttttgtcgattgctgcagaataaacaatctctctctctctctctctctctctctctctgtgggagaaatgatcacctagcgccattgccattcagccatttagctagagtgggatctttttaatgcagaaaaatcaggttgagactggacaggtgacaaggat

SEQ ID NO: 82483 - DNA, 7284 bp, Oryza sativa
ccagttattaaaccgagtatctgacaaaacggatgttaaaataggaggcgagtgaggggtagtctaaaaatcatgccaggagaggtttaataagctggcatataattcctaaaggcatattccaaattcaaatggagcttttcttatcacaaactagtgcaggattaagcaaatgtctgttcaaacccaaagtagtgtattggaaacatttaaaaaaacagaagaaaaattgggtcatagaactatcagaacaggaaatctgggaataaccaaaccaatacgtgtggtgtctcaattccacatccaagcaacaagtttgaaaagagaaactaaagttactcatggaatctgctgctgccaaaaaacctctgaagagataccaaaagcaagcacagcaagaattcagcgaactgaaaaattgggtcatagctaaatttgtttggtgttctgtaattgaagtaattgagggggttttaattccaacaaacttttgggatagtctaaaagctgtcaaagaaaaactgggggtgaatttaggtcttttcctttgtgccagtctttgctggggtttgcggcttgtgagaaatgacttagtatttgaaaataaattggttaaatcacctttgcaggtggttttcaagtcaatctcattgatgcagagatggaaggtgctgctaagagaaaaagatcacgaggctttgaacgcactgcttgagaagctgaagagtaagatggaggctctgcgtcctgtggatgttttgccggacaatgttattgcctgagttaggtgctgctgttggtggggctgtagttttttagatctgctctatagtctccgggtgctgttaagtttcagttgctgttggttttgggtgttttaagctagcgcgtgatgggtactggtagccccagtttctctgttttctgttttccaatcttttttcctgtaagcagactgtatgttttggctttctcccaaaagcctggtaatcaatttgtctgttataaaaaaaagaatattttttagacgcttataacaatacgattcaaaacgactggaagtagaaactcttcgcaaggctatggaagcaaggaaaaagccttattaggccctgccaatttgatagactccgtgaaccgcatctacgcacaaatcaataaaggaaaagctatacatacaaacttttttcttactaaattattactaacactcatgtgtcatactatgagtgtatctagattttttataacttctatctacttaaatcacacggttgagataattgttagtaaaagtttaataagaaaaatttagtgcgtgtagcagtgctcatcaataaatcatcaggccaatgctcgtgggtttcacaacgaaacaaaaacgaaacggggttatcaaactagtgaatgtctcctcgaaatcccaaccaaagtaagcaacgtttgttcaaaacccaaacaacaactggaaacatttgaaaaaactgactcatacaactgtcagaaatggaaatcctgagaaaccaggccaatacgcgtggtgtctcgactacatgttcaaagcaagcatttcggaagcaaaatgaagttactccctgaacctgctgctcccaaaaactttagaagagataccaaacgcacatgagagttcaacgaactgaacaattcctagatgcttctggcgaaacagttcgaaacaacacgactggaactcgaaattcttcgcaaggatatcgaagccaggggaaaaaaaacttccaatcctgccaatttgatcaactacgcagaccgcggagactatgcgcctacttttccagcacgatgatctacgcacaaatcatcaggccgatgcctgtggctttcacaacgaaaccaaatcgaaacgcgattatcaaaccagcgaatgcctccttgaaatcccaaccaaatcaccacgcgagtagcaaaacaaagcgatgtgatccgttcaacaaaattcatgcagagaatcgcacaaaccagtagaaattccgctcaaaatatccgcgaaattgagcaaacaaaccagagatttttcacgagaacagattaggtgcctcaaatcagagaaacaaaactcacatcgatcaagcagcacggagaaaaaccacacaatcatcatccagtgcgaaaccgaaacggcccaacagttacgcattcaagagacaatgctacacggggaaactagaaaccaactcaaatctgagatacccagaagcttttgaactggctcaactataaccatttggtattgaacgggcggagagcaccagagaaagtgaaacaaaaatcccaggactcatgctccaaaacatgcctaaatccgcacgagaaatcggttaaaatcagcaaaatgtcaatgaaatccacccaaaaacactcgcaaagtgagacgctactgatgcttcgcactggcccaactagcaccatttggtagtgagcggacggagacggagactactagagaaagtgaaaaaccccaaaccccacgattatctccaaacacgccaaaatccgcacgagaaatcggttaaaatcaacaaagcataagcgaaatccgcacaaaagcactcgcaaagtgcgcgggggatccgacacgcgtgatcacaaacactcgaatcaaacccaaatcggacgccagctactgcaaacaccacacgagcgatcaaatccacagcaaaagaaaaaaaactcgatcgggtgaacagatccgatggccggcttgaaccactaagtcgcacgggaatccaacaggagatgggcgaggaaaaaaactcatcagaagcagcgaatcctgctccgtgatgtccgcctccttcgtgttctgagccatcacctgcatcgcaatcacccgctccgatcagcacgcacgcataccagcaatcgcaacgcgaaatagaggcgacaagcaaccatttcgtctctcgcgcgtgtacgcgggcggaggggggaggggagagggagagtgtagtaactgtactagttggagtactagttacccgaatgattttgttttgatgaggaaattaacttgtgatagtcgttaagtttaattgcgcactggcacatcaacgtgctaatggcagaagacaattttcctgcacaagcttaagcctacagctataaatagacgtacccctctccccctccctctcatcatctcccacctcgcctctgcctcccaccatccacgctgcccgtcccacctgggacgcagggcgtctccaccacgcgccaccctgctcgcgtccccgaccatcaccacgccaccccgtctccctcctcccaccactctccaccgccgcgcgacgccgtctccgccgcgccgcgccgtctccgccgcgccacgccgtctccgccgcacgccgtgcccgccgcgccgcgccacgccacgccgtctccgccgcgccacggtgcccgccgcgccacgccgacgccatggtgcggatgaaagcgaaactcgtctacaacatggacgagctgcggactatggtgcgggacgcggttgggcagcgccacgtcgacgtacgctccctcgaggcacttcgagacgcgcccgccgtattcgacatcctccatgacttgtcatcgaccgccggctacgggtggaaagtacggaacatccagcccatgagcgatctctccgagctcgttgggttactccaactgatgaagtgggtgaacattccccagttgctgattcacctctgcaacctcgatcaacgccgagagatgctactggcgttagaggggttccaggtcaggggatcactctccgtgcaggtactcgctcaagacctgatcgaccgagttcctgcctcaaatcctcgtgcgcattggtcgagggagatgtctgcgaccactctcaagtccaggctggaggaagcaactgccaccgcggtgaacacccttcttaacaattcgatccgcgccgagacacttgctcgccagggaggaggcaccgtgatggcacgagttcgtgagcttcggcgactcctgcgccaaatttccaacgcagttctcgccgcggaccatctgccacctacaataggatcagacttggagcaagcgatcgccctcatcagaaacatcctccagctcccggttcaagtccgtgaggctagacggcgagggcgccgagaatcccccagccccatcccctccacctcccggttcaagtacgtacgtctcattcagttcacgccaattgcctctcgcctctcgatcgtaggctctcgatccctgtctggcattcagtttactcctctggatcgcagttttttttatccctctcagtttactcctctatgtagaggctctcgatccctctctggcattcactttactcctctggatcgtagtttttctgttgagttttgcttcccatgcaatatctgttcataaataaattggtgtggcattttgagatacaatatctgttcataaaaaaatcggtgtgacatttcgagatgcaatatttgttcataaagtgtgtgttagtgcaaaatttgagatgcaatatttgttcataaattttggtgtggccttttaagatgtgtctgttcataacactccatgcatctgttcgtgttattaatatggtgtatctgttcgtgttattaatatggtgtggctttgtgagatttggcgtgttttgagatagatatctattcataacactattaatatggtgtggcttgtgaaatttggcgtgttttgagatagatatctattcataacactcggctttgagatgtatctgttcataaactgttattaatatcactcgcgctttgagatgtatctgttcataaactgttattaatatgatgtggcttgttaatttggtgataattttttattaatatgatgtggcttgttaatctggtgaaaatttggtgtagcgttttgagatgtatctgagtgttattaatatgatgtagcttgttaatttggtgtggcgttttaagatgcaatatctgttcataaaatttggtaatgtcagtagtctaaaactctagattgttgattgatacaatataagcattgtgcagcatctcagattggttctgtgaagaagacacttcttctcattccatgaagagtcaaattaatcacgcgacttcacataagaataattgtaaagtacgttgagatccttttcactgaattgggaaaaaagagatcgaacagatgtgactcataattcaattggatgtgactcgtaattcagttgtgtgaagacagaaaacatgatcagttaaaaaactccataatcatctacataggaattatgttaggaaaaaaatagaactaagattcagcaacatggcaacggttgcaaggtttcacaacatttagcatgacagtggagggaacttttggctcgatgtaagtttcaattgccaaaactgctttcttggcttcggtgagcatatccttacccatatggaagcatttgtcgtgtttgcctgtagaacagctaaaaacatcacgagtagtatccagtttaaggtgcttaagcgacgttgtattgtcaagaatatgacatgttagctcgatcaagctctttgtatagcaaaagccaataatctccacgctctggaggttgtcatgacggtgttctagcatttgcctcatatgtgacatatctccaataatcaattcattctccattcggtcctgtgatatctagagatgaaaagccaatatacttgaaattgatggttgtcaccagtcactgataagtttgcagagtgaaaattagcttacctctagacaaaaagtctccaaggaaggagaagcgtcaagaaaagaaatcagagagaaataatcataggctggggaaagtctccaagcaagatcaatagtcaagcacttgagatagaaaaatttgctaggcaacattggtgtatcaaccatctgcataaagaaaatcagactgatgacatttttcgaaggtgcaagtattgttatataaacataagcacgtccataatcatttcatgtttgtggatatacctcgtgatccgagcaaatggtgagaatttcaagatttggcacattggatggaagctctgcacgagcataatagacggcactaggatagtccaaggatagtgttttcatttgcaatgattcaccaagcaagagccgtacctgcctagctccaaggtcaaaactgcaaagatttggagccttattctctatggcttgcagcattctgcattcaaacacttccaggtggctaaggcgttgcaacaggcaaggtatcttcagacaaattattccataacaatatttaagttccaatcgctccaaagcataagaattcgaaagaaggcacccaaactcatctcctgtaatatgtacagtaaccagatgcaacctcgtcaggtttctcaattcaagattaactgtaggatgaaagaaacaactgccaagataaagatgtcgcaatgaacttcctctcccatcagataaaagtgagcacgggaaattgtaatccacattgtatgaagatagcgacagtgtaaggattagttcttcaatccatggtgtaacagcaatctgaagccaattattgagatgatagctgatgctagcgctccttctagcattgcaaaaagtatcatattctaactgtagcgatttgatgccaatgcctgagtggttttttataatacgatcaattttgttgatgaaatccaaccccagtgttccaatacaaaatataagattggggcggtgttgccaggaacgacgaaaagcatgagacacacatgcagcacgggcagcatctttgaatggcatcagggagtgtatatggcaccagatgtcctgcatgcagaagcaaggatataggttagaaaataccgtcaaggtgacagcttgatcaattggaagggaaaacagtactagtagctttgccataacccttcgggtttgtggtagggaaactgaacagcacattttcatttttatccttttccctttcaaagttttattagtggctgtcctaaaaggggtactggactgcagtcagtgactagtaatgattacctaaatatgagacctattcttactgagttaagctacacaaccaataaaggtctatgcgcatatgcataaactaatatgttcatttttgcacaaaagcatcctatagattagtcaaagtagaaaacaaataaaaataaacatgtatattatttataaggtacaattttctatagctttgacggctgggctgtaagagaaaataga

SEQ ID NO: 82484 - DNA, 44402 bp, Oryza sativa
ttcatcttatgcttccaagcggcatagtccgtaccattgaaatacggagctttgccgctataggtactcacataaaatgtagatgtagttggatagtcataaggaaacataactcccttatcaccatctttgccttcccccgtttggcccgacatgatctctccaagtggttaagcctaattaggagattaggctctgataccaattgaaagggtcaattaggcctagaggggggtgaataggctaatttaaaactttatgcggaagctaaaactgagttagggtcggaaagtctgatccacagtcagactatccgaaaatatcagatagtctgatgttggatcagactgtctgatccactaaaggaacactacaagtagatctagtgcacaaacaagagtatggcacaaacagcgactagatctaaagcggcacaaaagcaaagctaaataataggagaagagatatcaccaacaatgaagttcaccgagttgttcccggagttcaaatccttgaggggattctactctacgttgaggagctcactaagagccgggtctttgctaaccctttcctcaagaggttgcactaagcactcctctttccactaaggggtatctctttccttgtggaggcgagatccggccttcacaaacttctcccggccaaccacacgtagatcggtggctcgggagtgacacctagccgtttaggagtcctcaacctccaagagtaacaaacaccacacaactcttggtcaaaccctagtgctcaagatcgagtgaaacacacactaggccctcaaacaccaaatccacaaccaccaagatctactacacaaagaacaaagagggatttgagagagggagagagagctcaaagatccaaaacactttagcaccaagctcaacccaaagtgaatgtgaatgaatgagttgggtaaccctagaaaagggttaggtggggggtatttatagaagcccccaaaatgtggccgttgggagagaatcttttcatcccacctcggaaagtccgaggtgacatcggatagtccgatgtttttgacccccaagcaggccagagacagagaacaaaattctagaggatttcggacaatccgatcgatcggaaagtccgatgtcatattggatattccattatttttgaaccaagaatttcatcctctcacagagactcaagttccattgaatttcggagtctctggatcatcggatactccgatcacatcggatagtctgatttaaaactcactcaaaaggaataaaaagcaattcaaaatagagagtgaagttctgagaaatttcagatagtccgacgtatcggatagtccgaccttatatcggatagtccgatattttttagccaacactcagaccgaagacagtgagcaaagttctgtgaaatttcggatagtctgagcatcggatagtctgatcaacatcggacagtccgacagacataaaacaggaacacttcaaataaatgattttgagcactagtgttctaccaattatatgcatgtggcatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcattctccccctttttggtgattaatgacaacacacttagaagtaataaaagattaggattttggtggagctccccctaaatatatgctagaaatgaaataggagagctccccctcaatctatgcactagattagaaatgacaatataacctcatgcatatgccaatgacaagatatttcacacatttgagcatggataatagataattgcacataacaagacacaaaaacccaagggtcgactagccatcacgaaaggagatagattagagatttttgatgataggtggttctccccctttggcaacaaggcaccaaaagggaaaaaatagaggatcactcatccttatcagaatcctcgccctcctcacttgactcctcagcatagtcaccttcctcctcctcttcttcttcctccataggagccttgccatgatccgcacgagaggagcttgcctcagctgcaaaagggtcctcaatcacatcctccccactgtcctcaacctcagaaccatcgggagaacacggcaaatgggtgttgcgaaggagggtcttgatccgtcgagtgtccttcttccttgctctgcgttccttggcttgccgaactgagatggtcttgcataagttgaagatggacttgaagaacctcaaggacgagttggagtccggcttggtgacggtagcggagggaccggcacgagaagaagcacgagtggttcgtccagccggcacagcagcaaccttgatgggacggacttggtaatcggtatgtgccacctccttgtgaaacttcttcttggacacaatctcaatcatcttcataatgtaaggcccatagccaagtcctcgcttaggcatcatggagataagccggatttcttcaaagatgaagtcaaaggcgtcaaagagctgtgggtgagccttcatcttgtaaagcaaatttcttgtataggcaaggacgttgctagcatcaccttccttgggattgagagttttgcgcaagagcttgttgagataggcatagaagggaaggagacctttgatggtgcctaactcatagtccacatcttggtacaagaagtgaagagaatttgtgtccatgggcttctcatcatgaatcttgacacgattggtgcgagagcgagtcggaaaccccaaaatggcagcaaacttagcatatgtcacggagtatatgatgccatctgtcatccaatgaataatcttttctttgttgggctcaaaataaagtgtggcatagaattgtgcgaagatttctttgcaccatgggtattgcaagcccatgagttccttcaagttttgccgagcacaagcttcaatgacttcatcaataattgaatcatgcaactcctccatatacttccaatcaacccactgcataagaataggccccttcttaggtgcattcactgtctcatagtaatcctgctgaaaaaggttccaaaaccgaggatcagtggacaactgttgaaatttgtagagatctttcttacgctctttctccacttcagtccacttgcggttccaccttatgactctccgatgataattaggatctctagagggagcagtgataaagaaaggcccttcttcctgagcggcttgctgagcggcaatgtcctcttctaaatgaatctcttcctcaaaggatggtgcatgagaaccactaccttgacccggctcagaagaatccgtaggattgcctctccttacttttttagcaggtgcacttgatctttctccactgactcggctgcggcgaggaggaagaggagcaccatgctccacattagccacttgagctgcttggtcagaggcttgagcttgcgcgtcaatggcatctttgcgagattcggacatacgccgtatagcatgacgagccttggaagcgggagagcgacctcgagaactcattgtcccacggcgagagtaaacttgattcttgaactgacccgtgatcatgaggatacactgatttagaacagaggataatgattaagaagaagtggaagaagaatatttaaatgtgaagcaaggagaaatttggactgggccaaaaggaggtcggatagtctgatttgacgtcggactatccggtgtacatcggactatccgacagcatatcagacaatccgacggccttttgccctagaccaacaaatctcgattcacacaaacatatccaatggaatcaaaggatcttctaggtactagatctaggcactaaaacaagaagattcaccgaaggaaatcttgaaataatacaccatgagggagatcgagggaaaacaaggaaatacctcaagaaccactaagagaatcactggggaaccagtgatttggaaggagttgagggagggaaaccaccctaaagtgaaggaatagcaatcggagactccgaaacgaagatttttggtggcctagaactagggtttggagtggagaagaggggtggagagagaaacgactgagacaaatgactgaaggggtaagaaagagttacccccggggaggttaagtccccttgcccttggccccacgtcggatagtccgatttgaaatcggactgtccgattgtagtcggatagtctgacttgatgtcagacagtccgacatcctttgtggcagagacaataaaggatggctcaaggaagatttttttcaacaacattttgataggatgaactcgatggctagactattacttggacaaatgcagcaaaagaaagaaaactaggcaccctcgagagagggaatgtacgaatctatagcaaattgtgcaaggaccaagattcattagagaatgagatccccgtacacatagatttcaagttatccacatagattatgactagtgtttattcatgaattgaatgttcactttgtcatgatatggcaagcaaacctattctagtaaatgaaaaacacatgcatgcaaaagatcaagccacattccgagaatccaagatatttagctcacttctcaactcacaaaacctagcttcatctagaggcttggtgaagatatccgccaattgtttgtcggttctcacatgttggatgtctatgttgcctcttgtggaatggtctctcaagaaatggtggcgaatatctatatgcttggttcgggaatgttggatggggttattggctaacttaatggcgctctcattgtcacataagagtgggattttggacacatttaggccatagtctctcaaggtttgcttcatccaaagaagttgagcacaacaactccccgtcgaaacgtattccgcttcggcggtggatggggcgacggagttttgcttcttggaagaccaagaaacaagggacctacccaagaattggcaagtacccgatgtgcttttcctatccactttgcacccggcataatccgcatcggcataaccaatgagatcaaacctcgctcccttaggataccaaagaccaagattaggtgtgtgcactaaatatctaagaattctcttcacggccacaaggtgacactccttcggagcggcttgaaatcttgcacacatgcacacactaagcataatatcgggcttagatgcacaaaggtaaataagtgagccaatgatggaacggtataccttttggtcaacgtctttaccttgctcgttgaggtcgaggtggccatttgatggcatgggagtgtggattggcttcgcattctccattccaaacttcttgagcatgtccttcaaatactttgtttggcaaatgaaggttccttccttgagttgcttgatttgaaggccgaggaagaactttaattcacccatcatggacatctcaaaacgtttggtcatcatcctactaaactcttcactaaaagacttgttagtagaaccaaatataatgtcatcgacatatatttggcacacaaaaatatcattatcatgtcttttagtaaaaagagttgaatcggctttcccgatctcaaagccgtttttcacaagaaaattgtgaagacactcataccaagctctaggggcttgcttaagcccgtagagtgccttgtggagcttgtacacgtggttgggatacttcggatcctcgaagcccggtggttgctccacgtataccaactcgttgatgggcccgttgaggaaggcgcttttaacatccatttgatatagcttaaaattgaggttagtagcaaaagcaagcaatatgcgaattgactcaagtctagctattggcgcaaaagtttcaccaaaatctaatccttcgatttgggtaaacccttgcgccactaacctcgccttgttccttattacgaccccggcctcgtcttgcttattgcggaagatccactttgtgccaatcacattttgccaaggtcgctccaccaaagtccacacttcattctgggtgaaattgttcaactcctcttgcatcgccatcacccaatccggatcattaagagcttcttccacccttagaggttcaatagaagacacaaacgagtaatgctcacaaaaatttgcaatacgagaatgagtggatactcccttgttgatgtctcctaagatgttgtcggtggggtgatctcgttggatactttggtggattcttgggtgagctagatttatcggagagggtggcacttgctcgccttcttcaccttgatccaagcttgaagtggagggattgtcggcttgggttaatgtaggtggctctacttgtgttgaggaagaggccccttgttgtggctccctaggacgcacgtctccaagagccaatcttttgattgcttcgctagggtcctcctcttcacctaacacatgtgagtcgacttgctctacttgagagccgttagtttcgtcaaatgtcacatcacgcgcgatctcaacaataccggaggtgttgttgaaaacgcggtatgcgcattcatttgacccatgcccaagcaagaacccctcatcaactttaggagcaaactttgaggatctagccttcttattaagaatgtagcacttactaccgaaaacacgaaagtaagagacatttggtttgttaccggtaagaagctcatagggagtcttcttaagaaggcggtgaagatagaggcggttgatggcgtggcatgcggtgttgacggcttcggcccaaaaacagtccgatgtcttgtactcatccaacatggtcctcgccatctcgatgagagtcctattcttcctctcggctactccattttgttgaggtgaatatggagccaagaactcgtgcttgatgccttcttcatcaaggaaactctcgatgcacgtgttcttgaactccttgccgttgtcggttcgaatgttcttgatcttgaggtcgaactcgttttgggctcttcttgcaaacttcttgaagattgcttgtgtctcactcttgtcatgcaagaagaacacccacgtgaagtcatcaacaataacgagaccatatttgttacctccaatgcttagataagcaattggccctgtcggtgacatgggaccgggggtatcgtgactagaggcttgggtagccgcggtcgcccacgtggcctgaccccctcggggggggggggtcgggcccgagggtgacgcggccacccctccctctgtctccccgaggggtcgggccgcacccgtttcggccccgagggctggggcgccccgaccccctgtggttttggcgccacgtgtgtgggttaggtgagcacagcaggcgctcacctaaccgcatttatagcgggttagacgagcgcgccacgccgcattcaatgcggcgcagcgcatgcttatccggtccgtgaccagtcgcggtgtgtgaccggtcaaagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccagacttcagcgcaagaatggcaaggaagtcgccggccattaaatgaagtttgaaatgggcgtcctccggaaaagctgacgagcggggcaggagacgagcgcactgcttgtcaagggtcacttccggctgtagactagccctcattgtaaaaagcatgtttcctttcttaggcagctagaggcccctgtggtgaccgctgaccagataaaaaggaggcccaggcctagaagaagggggattttcttgggggatttttgaggaggagcctgaactctctctggctctcgagctctctgtattccttcacatacagatccaccagaacacaggagtagggtattacgcttctcagcagcccgaacatgtctacgtcgcccgcgtcttgtgcgatccttctcgctgacattcctctgatcgagggcgaagaacctcacatagcgccctcggccgaaccggcaaaggggggcctgcgcggtcttccggtgaggggccccacgctccgtcatctggcgcgccaggtagggggcgcgcgtgtttttcgaagccctcgtcctctttcgtgtgcgccaagcttctcccgctcagcccaatggccgaacgggcagtggcgcacagcctctctccgaacgctagcggtgacgacggggagcagaacccgcgccgtcgggctcgcaccccaccgtccccctctcgccgaaatcttgggcggggggaggcgctcggggaggtcggaggatccgcgacatcgccgcccgcgggcgacgggggaggacggcgagacggggcgcgtcgccgcctcgactacggcgatggcagcacgccccagggcgcgctccaggctgcgggtgcgctcttgcgtcacccgcccgtcgtccccgatccagagactccagcccgacgttggctggatgacgtggccgacttggtcatgacggcgcagcagcgcctaggcgccggtgggcggccctccgcccccgaggcctctggcgctgccgccgccggctccacgtcgtcaaggcggagggcgcggcgagcggcggccgtcacccgccgttcgtccgccattccctcgtcaacgcctccgacccaagaagatgagcgtggggggtcggatgcccggctcgatatcgagcgccagcgcgacgatcgtcgcgccgcccacgcaacggagggcgctttctcgtccggagcgccacttcggtccgggcacgggggccggcccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcctgggaggatttgtgccagcagttcaccacgaactttcagggcacatatccgcgcccaggcgaaaaagcggacttgcatgcggaacagcgagggtacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggctctggcgtggcagctccggccgcccccgagtccgccgctcggtcagggcggcgggacaggaggagaaagaagaagtcggcccgttccgacgacgagggtcatgtactcgccgtcgagggcgcttcgcgggccccccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaagaggcaggagcgccgtgagggcaaggccccagcggctcccgccggcaaccggcgaggtgaggccaagcagaaggcccccggcgaggatattgacgatggcgactatgacctggggttctaggagcctgaggccaccatcgccaccgtcgatgggggagcgtgcgctcacgcttctcgccgaagcctcaaggccatgaagcgagagcttctggccgcggcccctacccatgaggcgacgcggcgggcgtggtggtcggaggttgccctcaccttcgaccagaccgaccacccgccatgcgttgcccggggaggacagatcgcgatggtggtttcccccaccgtttgcaatgtgaagttggggtgtgtcctcatagacgggggtgcagccctcaacatcctttcccctgcagcctttgacgccatcaaggccccggggatggtgctccggccgtctcagccgatcatcggtgtgacgccggggcacacctggccgctgggtcatatcgacctcccggtcaccttcggtggctccgccaacttccgcatggagcgggtggacttcgatgtggcggacctcagtctgccctacaacgcggtcctggggaggcctgcattggtgaagttcatggcagcggtccactacgcttatctccagatgaagatgccgggccccggtggccccatcaccgtccatggcgacctcaaagtcgcacttgcttgtatggagcagcgcgcgtaccacctcgccgcggcgtccaagcccacgggtggcgacgaaaggctcggcacctccgtccccgccgccccgaggcagcggatggtcacgtgcgacgaggtcccggtcaaggaggttgccctgggcgacggcccgtccaagaccacacgaatcggtggtcttctggacgataaataggaagacgcgctcgtctccttcctgcgggcaaatgccgacgtcttcgcctggagaccggcggacatgcccggggtccccagggaggtgattgagcaccgtctcgccgtgcggccgggcgcaaggccggtccggcagaaagtgtggcggcaggccccggaacgtcaagccttcatccgcgaggaggtggcgcgacttctggaggccggattcatacgtgaggtcatccatccggagtggctggcgaacccggtcgtcgttcccaaggcgaacggcaagcttcggatgtgcatcgactacaccgaccttaacaagaatgcaggtcctacttttcaacgtactactcgaatttctttgggtagccaaataggacgtaatgttgaggcctatgttgatgacttggttgtgaagacgcgcaaccaagagaccttactctcggatctagcggaaactttcgaaagtctccgctccgcccgcataaagctgaaccccgacaagtgcgtgttcggcgtgcctgcgggcaagcttctcgggttcttggtctctgcccgaggcatcgaggccaaccccgagaagatacgagctatagagcggatgcgcccccccagcaagcttagggatgtgcaatacgtcaccggctacatggctaccctaagtcggttcatatcgaggctgggagagaaggcgctacccctatttaagctcctcaaacgctccgggccgtttacctggacggaggaggctgagcgggccttcactcagttgaaggcgtacctcagttctcccccagtcttggtcgtcccggagccagatgagccgttgctactctacctggcggcaaccccgcatgtggtcagcgcggcgttgatcgtggagcgcgacgaggacaaccctcactccgcgcatccccaccctgtgtcgactcgacccgggagagagcagggaagagaggcccccgagccgaacggcggcccgaggcccccgacggccggagctggccctccgcctgcttgtccgacggtgccaggcgcccccaacccccaggatggccccggggccactgcgggaaggccgcgcctgtcgccctctgaccccgaggtcgtcggcacagaagccgagtgcgccccgcgtggcctctcggacaaagagcgccctcgagatgcggcccctggcgaagaggatcggccccgccgaaaggtgcagcggcccgtctacttcgttagcgaggccctccgggacgccaagacccgataccctcaggcccagaagatgctctacgctattctgatggcttcgaggaagttgcgccattatttccaggcgcattgggtcacggtggttacgtcttaccccctcgggcaaatcttgcataaccgagagggtactggacgggtggtgagatgggcaatcgaactctctgaattcgatttgcgctttgaaccacgccgcgcgatcaagagccaggccctcgccgactttgtggcggagtggaccccagctcccgagcccgtctccgcccccgaggccacctcggactcctcgcagctgcctcacaccgcctactgggtgatgcagttcgacggctccctgtctcttcagggcgccggtgcgggggtcacgttgacctcaccgagcggagacgtcctcagatatctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccggtgctctgacccgcagatggacgcttacgtgcgccaggtgcggcgtatggagcgccatttcgacgggatagagcttcggcacgtgcccagatgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcccaactcccctagattgattgcttggatcactgagatccaggcatacctcgcagataagactctacccgaataccgcgaagggggtgaacgcgtccggcgcatctccaagcgctacgtgctggtggaagggaccctctatcggcgcgcggctaacgaagtcctcctgaagtgcattcctcgggaacaaggcgtcgagcttctcgccgatgtccatgaaggcgagtgcggagcccactccgcctcacgcaccttggttggcaatgcctttcgccagggtttctattggccgacggctctcaacgatgcggtcgacctggtccggcggtgcagggcgtgccagttccacgccaggcaaacccatcagccggcccaggccctgcagaccatacctctttcatggccgtttgctgtctgggggctcgatatcctgggtccgttcaggagggccccgggcgggttcgagtatctgtatgtcgctgtcgacaagttcactaagtggcccgaggcttatccggtcatcaagatcgataggcactccgtgcttaaattcataaggggcatcactgctcggttcggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggtctcaaaaccaagaccttcaacatcctcaggaagcacggcgactcgtggatcgagaagctgccagcggtactctgggcgaaccgaaccacgccaagccgagcaaccagggaaacgcctttcttcctcgtctacggcgcggaggcggtcctcccatctaagctcaccctgaggtcccctcgggtatccatgtattgcgaggctgatcaagatcagcttcgccgagacgacctcgactatttggaggagcgaaggcggcgcgcggccctccgagctgcacgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgattggcgtcccccggccgggctccgttcggctggccacgggcgacggcacagagctgcctaacccgtggaacatcgaacaccttcgtcgcttctacccctagggggggtcgggtgtcatgtcttgggctcgggccaaccccgcacccctcttgggcgtgcagggttggccgggggctaccacatgcatatacttaccttttttctcttccgtatttcaataaaagcactttcgattccctgaggactgtgtctgtgccatcgttttccttttgaagaatcttggcttgaattagcacgctcgtgctcgaccctgccctcggtggcccgggccggctaaaatcgccaaacggggcccagaaccgagccgtgccccggggcgtggtgaactccggggggggggggaatcggcaaaggcccacaatcgggtcatccataaccctcggtcaccacgctcccggcctggccagtctcgacacgtggatctcctcaggcactagccccgacccgcgccgcttgaggctggggcctgggcacgagccctcgttcaagccaagacacagaaggaccgcggcacagaccaacctcgtctcatacatacaacaaacagaactgacgtagaaattccctctttatttgattacagattaaatcagtctatacaagaagggggcccgaaggcctcggaaaaagaagaaaaagttattaagattggcgggggcctggggctcactccgacgcgcccgggtcgccggcctcgtcgtcgttgtcgttcgcaccgtcgtcaccgccctcctcgtcggagtcgagggcgaacgcgagccgaggggccgtaccctcgaagctgtggacgatgtggtcggcggcgtcccggacctgcgcgcgcgcgccgtcctcggttccgggagggaacttgtccagcgctgcccacggggagaagtcagggtccctggcctggtagcttgccagtacgagctccaccgccccccgggcaaggtccctcgaggatgacttgatcgtctcttcgagctcctcggggagccgctggagggtcccggccatctctgagaggcgctgggcgacgcccccctggttggcggtgaacttcacggtccgctcgccccagaggcccacctgccgcccggcgcggtctagacgggagacggcgtcccgaagcatgccgggccctacctcgttcgccaagcggagggcctcgacctccccggcggacgagtccagcgcgccctgcatctcggcgatggtgtgttcggcggctgcgaggcgggcgactaggtcgccgtggcccgcggccgccccaccgctgtgcgctctcgcgtccagctccttcgcccgcgcctcgagctcagcagcccgctgatccagcgcggccctctcggcgcgggcgccttccagattgcggcgagcctactcctcccgcgccgcttcgcgaaggaacaggctgtccgccagccgctgcgccgcggcctcggcttcctcgagagctcgcccccgctcggtgagcacgtcctcgcggaggcggagcgcggactcctcttcggcgcaggcggcctcgtgcgccgccagtgttgcctcccgggtggcgacagcggcctcgcggtctgccaggtccttctccttcgtgtccagggcgcgggcgcgctcctccagcgccgtggcgcgagcctcaagggcctcttcgcgctgccgggacgccgcctcgatctccgccgcccgccgttcccgggcagcggcggcgtcaaggactccccgggtggcgtcgagcttcttctctagctccgccgcccggctcccgtattggaggcagaggtcgtcccgcacctcctcaagtacggcggtggcgatgagggcagtctcccgctcctcctccacctccctggcgatctccgccaggtccctacgacgggcctcgagctcggaggcgtgccggcggtgtgccttgcggcccgcctccaccatggcctccaccgagcgtcgcccctcctcgacgcgcgcccacgccgcgtcgagctccgcccgctccgcctgcagggcctccatccgggcgcttaacccgtccagcaccgtgctgttcacggcgactaaggcctgcaggaggggctccgcgctcagtggggcagcggaagacagaggggagagccgcctcggtgtgggtgccgcgcggctcggcccgccgatcgacgtgccggacccgggggcgtcccccgaagctggctcgtcccaagcatcgcccgaggggtcgggcccgagcggcgcgtccgcggcctcgtcgtgggtggcctcggaagtcgtcgtcgcctcgggcggagtcgggtcgggggcttggcaggccgcctggcgtacgcgcgccgcctcctcctcccggacggactccccggcccggcggagtctggcctcctttcgagcggcctcctcagcctggcgaacccggacggcctcctgggcagcctcctcggcttcccggaggcggtctgcggcttctcgccggtcagcttcccgcctccgggcctccgcggtcgccgtctcctcggcctcgagcccgccggacttggaatggcggggggggggcgacgggatctcgctgaggcagaagaaaaaccagaagacggaaagaaacgggtgagtgaaaactcgccttgggagatgggagaatgaatgcggtcgcgatgggcgcggggacaaacctgcggggaggtcggctaaacgaccacctcgggggcgagatgaggttcccccggcatggctcggtcccccccatcttgcggagccgtttcttctttcgctccccctcgggctgcggcgtcggcacagcaccctccgggcgcctgctgctggcacgcaccgccccgcccccttggggaggagatggggggggcgtgccctcctgcttcctctttccccgggcgtcggcagggcggctgccccccgggcccccgtcgcggggcccagaagcgtgaccccctcccggggtagattgtttccctctacggctcccgcccgcgccatcgtggcctcgggggacccgctcccccgacgccccgactgcctgcatgatggtcaggatgttggcgcgatccggatcgctgcagagggggaggacaccttgggggataagggatgcctccacggagctgagattcagcacccgttggaccaccatcctgaagtcctcagggacccagtcccatttgcgcccctggtgggtcctcatgaagtcctcgggcccggtgtactcccaggcaccccgggcgcgccgctggagcggcgcgatccggcgacgaaggtagtcgccgaaaaccatggcccccgtaagcccttgggatcacagacccgccaggcggtcaagaacggcgtcgtagctgtctcccagatctaccgtcgcccgccagctggaggcctgcgccgggggctggctcggaagtcggaggcgcgcttcgtcggcgaggggggtgtagaaccaattgctcttccagtcgtcccacttcttgcggaggacgcagggaatgtagcggtgcagcacctgcccccgcggctggaagtagcagccaccgaccaccgtcggcggcgacaccggctgtacagtgaagaaccaccggaacagccggagagatgggcgcaccccgatgaacatctcgcacaggtgcgcgaagatggccagcgtcattattgcgttgggggtgaggtgcgccatctggagatcataaaactccagaacatccatgaagaaattagagaatggcgggaccagcccggccattgcgaaagagaggaagaagacggaccgccccgggtagtgtggcgccaggcatccctcgcccagctcgaccacctcccggccggtggcagattccggcatgaatcggcgcggcagcccggcctgcctctcgctcacgatgcgggaaggcggcagcacgctaccatcaagcggtgcggagccccgtgccatgacgccggcggaggaggagcttgagagcgagcaagtgcggcgagggtagggcacaggaaacgaagagttagagcgcaagtggcgaaggcaaggggaatagtggcgagaggaaggaaacgaatcccttcctcggcgtctttattcccttgccagcgctatgtccggctcctcgcttcccgtgcccactaccttgccccctcgtttctcgcgcccacgcctccactaaccccactcgcccgtttgcggcgcacgcggcagatgtgcggccgtgacggttgagatggggcagatcgtgcgcgcattaactgcgttcgccaaccgagaagagcgccatcatcatgtctccaggcgaaacgaaccggcttgtcccgattcgcgcgctgctcgagtaatgcagcggtcttgaagagaccgctcattattgtcgatcggttttcccttgccgatgcgcgcgatttacgaccgctgggtttctgcccgcctgtagagaccggccccacctgtcaccaggcctaaggagtggcgtcacgcccgagcgcttccctcgaggggggcgatcgccctggcgtaacgccgggggctactgtcggtgacatgggaccgggggtatcgtgactagaggcttgggtaaccgcggtcgcccacgtggcctgaccccctcggggggggggggggttcgggcccgagggtgacgcggccacccctccctctgtctccccgaggggtcgggccgcacccgtttcggccccgagggctggggcgccccgaccccctgtggttttggcaccatgtgtgtgggttaggtgagcacagcaggcgctcacctaaccgcatttatagcgggttagacgagcgcgccacgctgcattcaatgcggcgcagcgcatgcttatccagtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccagacttcagcgcaagaatggcaaggaagtcgccggccattaaatgaagtttgaaatgggcgtcctccggaaaagctgacgagcggggcaggagacgtgcgcactgcttgtcaagggtcacttccggctgtagactagccctcattgtaaaaagcatgtttcctttcttaggcagctagaggcccctgtggtgacccctgaccagataaaaaggaggcccaggcctagaagaagggggattttcttgggggatttttgaggaggagcctgaactctctctggctctcgagctctctgtattccttcacatacagatccaccagaacacaggagtagggtattacgcttctcagcagcccgaacatgtctacgtcgcccgcgtcttgtgcgatccttctcgctgacattcctctgatcgagggcgaagaacctcacatagcgccctcggccgaaccggcaaaggggggcctgcgcggtcttccggtgaggggccccacgctccgtcatctggcgcgccaggtagggggcgcgcgtgtttttcgaagccctcgtcctctttcgtgtgcgccaagcttctcccgctcagcccaatggccgaacgggcagtggcgcacagcctctctccgaacgctagcggtgacgacggggagcagaacccgcgccgtcgggctcgcaccccaccgtccccctctcgccgaaatcttgggcggggggaggcgctcggggaggtcggaggatccgcgacatcgccgcccgcgggcgacgggggaggacggcgagacggggcgcgtcgccgcctcgactacggcgatggcagcacgccccagggcgcgctccaggctgcgggtgcgctcttgcgtcacccgcccgtcgtccccgatccagagactccagcccgacgttggctggatgacgtggccgacttggtcatgacggcgcagcagcgcctaggcgccggtgggcggccctccgcccccgaggcctctggcgctgccgccgccggctccacgtcgtcaaggcggagggcgcggcgagcggcggccgtcacccgccgttcgtccgccattccctcgtcaacgcctccgacccaagaagatgagcgtggggggtcggatgcccggctcgatatcgagcgccagcgcgacgatcgtcgcgccgcccacgcaacggagggcgctttctcgtccggagcgccacttcggtccgggcacgggggccggcccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcctgggaggatttgtgccagcagttcaccacgaactttcagggcacatatccgcgcccaggcgaaaaagcggacttgcatgcggaacagcgagggtacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggctctggcgtggcagctccggccgcccccgagtccgccgctcggtcagggcggcgggacaggaggagaaagaagaagtcggcccgttccgacgacgagggtcatgtactcgccgtcgagggcgcttcgcgggccccccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaagaggcaggagcgccgtgagggcaaggccccagcggctcccgccggcaaccggcgaggtgaggccaagcagaaggcccccggcgaggatattgacgatggcgactatgacctggggttctaggagcctgaggccaccatcgccaccgtcgatgggggagcgtgcgctcacgcttctcgccgaagcctcaaggccatgaagcgagagcttctggccgcggcccctacccatgaggcgacgcggcgggcgtggtggtcggaggttgccctcaccttcgaccagaccgaccacccgccatgcgttgcccggggaggacagatcgcgatggtggtttcccccaccgtttgcaatgtgaagttggggtgtgtcctcatagacgggggtgcagccctcaacatcctttcccctgcagcctttgacgccatcaaggccccggggatggtgctccggccgtctcagccgatcatcggtgtgacgccggggcacacctggccgctgggtcatatcgacctcccggtcaccttcggtggctccgccaacttccgcatggagcgggtggacttcgatgtggcggacctcagtctgccctacaacgcggtcctggggaggcctgcattggtgaagttcatggcagcggtccactacgcttatctccagatgaagatgccgggccccggtggccccatcaccgtccatggcgacctcaaagtcgcacttgcttgtatggagcagcgcgcgtaccacctcgccgcggcgtccaagcccacgggtggcgacgaaaggctcggcacctccgtccccgccgccccgaggcagcggatggtcacgtgcgacgaggtcccggtcaaggaggttgccctgggcgacggcccgtccaagaccacacgaatcggtggtcttctggacgataaataggaagacgcgctcgtctccttcctgcgggcaaatgccgacgtcttcgcctggagaccggcggacatgcccggggtccccagggaggtgattgagcaccgtctcgccgtgcggccgggcgcaaggccggtccggcagaaagtgtggcggcaggccccggaacgtcaagccttcatccgcgaggaggtggcgcgacttctggaggccggattcatacgtgaggtcatccatccggagtggctggcgaacccggtcgtcgttcccaaggcgaacggcaagcttcggatgtgcatcgactacaccgaccttaacaagaatgcaggtcctacttttcaacgtactactcgaatttctttgggtagccaaataggacgtaatgttgaggcctatgttgatgacttggttgtgaagacgcgcaaccaagagaccttactctcggatctagcggaaactttcgaaagtctccgctccgcccgcataaagctgaaccccgacaagtgcgtgttcggcgtgcctgcgggcaagcttctcgggttcttggtctctgcccgaggcatcgaggccaaccccgagaagatacgagctatagagcggatgcgcccccccagcaagcttagggatgtgcaatacgtcaccggctacatggctaccctaagtcggttcatatcgaggctgggagagaaggcgctacccctatttaagctcctcaaacgctccgggccgtttacctggacggaggaggctgagcgggccttcactcagttgaaggcgtacctcagttctcccccagtcttggtcgtcccggagccagatgagccgttgctactctacctggcggcaaccccgcatgtggtcagcgcggcgttgatcgtggagcgcgacgaggacaaccctcactccgcgcatccccaccctgtgtcgactcgacccgggagagagcagggaagagaggcccccgagccgaacggcggcccgaggcccccgacggccggagctggccctccgcctgcttgtccgacggtgccaggcgcccccaacccccaggatggccccggggccactgcgggaaggccgcgcctgtcgccctctgaccccgaggtcgtcggcacagaagccgagtgcgccccgcgtggcctctcggacaaagagcgccctcgagatgcggcccctggcgaagaggatcggccccgccgaaaggtgcagcggcccgtctacttcgttagcgaggccctccgggacgccaagacccgataccctcaggcccagaagatgctctacgctattctgatggcttcgaggaagttgcgccattatttccaggcgcattgggtcacggtggttacgtcttaccccctcgggcaaatcttgcataaccgagagggtactggacgggtggtgagatgggcaatcgaactctctgaattcgatttgcgctttgaaccacgccgcgcgatcaagagccaggccctcgccgactttgtggcggagtggaccccagctcccgagcccgtctccgcccccgaggccacctcggactcctcgcagctgcctcacaccgcctactgggtgatgcagttcgacggctccctgtctcttcagggcgccggtgcgggggtcacgttgacctcaccgagcggagacgtcctcagatatctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccggtgctctgacccgcagatggacgcttacgtgcgccaggtgcggcgtatggagcgccatttcgacgggatagagcttcggcacgtgcccagatgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcccaactcccctagattgattgcttggatcactgagatccaggcatacctcgcagataagactctacccgaataccgcgaagggggtgaacgcgtccggcgcatctccaagcgctacgtgctggtggaagggaccctctatcggcgcgcggctaacgaagtcctcctgaagtgcattcctcgggaacaaggcgtcgagcttctcgccgatgtccatgaaggcgagtgcggagcccactccgcctcacgcaccttggttggcaatgcctttcgccagggtttctattggccgacggctctcaacgatgcggtcgacctggtccggcggtgcagggcgtgccagttccacgccaggcaaacccatcagccggcccaggccctgcagaccatacctctttcatggccgtttgctgtctgggggctcgatatcctgggtccgttcaggagggccccgggcgggttcgagtatctgtatgtcgctgtcgacaagttcactaagtggcccgaggcttatccggtcatcaagatcgataggcactccgtgcttaaattcataaggggcatcactgctcggttcggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggtctcaaaaccaagaccttcaacatcctcaggaagcacggcgactcgtggatcgagaagctgccagcggtactctgggcgaaccgaaccacgccaagccgagcaaccagggaaacgcctttcttcctcgtctacggcgcggaggcggtcctcccatctaagctcaccctgaggtcccctcgggtatccatgtattgcgaggctgatcaagatcagcttcgccgagacgacctcgactatttggaggagcgaaggcggcgcgcggccctccgagctgcacgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgattggcgtcccccggccgggctccgttcggctggccacgggcgacggcacagagctgcctaacccgtggaacatcgaacaccttcgtcgcttctacccctagggggggtcgggtgtcatgtcttgggctcgggccaaccccgcacccctcttgggcgtgcagggttggccgggggctaccacatgcatatacttaccttttttctcttccgtatttcaataaaagcactttcgattccctgaggactgtgtctgtgccatcgttttccttttgaagaatcttggcttgaattagcacgctcgtgctcgaccctgccctcggtggcccgggccggctaaaatcgccaaacggggcccagaaccgagccgtgccccggggcgtggtgaactccggggggggggggaatcggcaaaggcccacaatcgggtcatccataaccctcggtcaccacgctcccggcctggccagtctcgacacgtggatctcctcaggcactagccccgacccgcgccgcttgaggctggggcctgggcacgagccctcgttcaagccaagacacagaaggaccgcggcacagaccaacctcgtctcatacatacaacaaacagaactgacgtagaaattccctctttatttgattacagattaaatcagtctatacaagaagggggcccgaaggcctcggaaaaagaagaaaaagttattaagattggcgggggcctggggctcactccgacgcgcccgggtcgccggcctcgtcgtcgttgtcgttcgcaccgtcgtcaccgccctcctcgtcggagtcgagggcgaacgcgagccgaggggccgtaccctcgaagctgtggacgatgtggtcggcggcgtcccggacctgcgcgcgcgcgccgtcctcggttccgggagggaacttgtccagcgctgcccacggggagaagtcagggtccctggcctggtagcttgccagtacgagctccaccgccccccgggcaaggtccctcgaggatgacttgatcgtctcttcgagctcctcggggagccgctggagggtcccggccatctctgagaggcgctgggcgacgcccccctggttggcggtgaacttcacggtccgctcgccccagaggcccacctgccgcccggcgcggtctagacgggagacggcgtcccgaagcatgccgggccctacctcgttcgccaagcggagggcctcgacctccccggcggacgagtccagcgcgccctgcatctcggcgatggtgtgttcggcggctgcgaggcgggcgactaggtcgccgtggcccgcggccgccccaccgctgtgcgctctcgcgtccagctccttcgcccgcgcctcgagctcagcagcccgctgatccagcgcggccctctcggcgcgggcgccttccagattgcggcgagcctactcctcccgcgccgcttcgcgaaggaacaggctgtccgccagccgctgcgccgcggcctcggcttcctcgagagctcgcccccgctcggtgagcacgtcctcgcggaggcggagcgcggactcctcttcggcgcaggcggcctcgtgcgccgccagtgttgcctcccgggtggcgacagcggcctcgcggtctgccaggtccttctccttcgtgtccagggcgcgggcgcgctcctccagcgccgtggcgcgagcctcaagggcctcttcgcgctgccgggacgccgcctcgatctccgccgcccgccgttcccgggcagcggcggcgtcaaggactccccgggtggcgtcgagcttcttctctagctccgccgcccggctcccgtattggaggcagaggtcgtcccgcacctcctcaagtacggcggtggcgatgagggcagtctcccgctcctcctccacctccctggcgatctccgccaggtccctacgacgggcctcgagctcggaggcgtgccggcggtgtgccttgcggcccgcctccaccatggcctccaccgagcgtcgcccctcctcgacgcgcgcccacgccgcgtcgagctccgcccgctccgcctgcagggcctccatccgggcgcttaacccgtccagcaccgtgctgttcacggcgactaaggcctgcaggaggggctccgcgctcagtggggcagcggaagacagaggggagagccgcctcggtgtgggtgccgcgcggctcggcccgccgatcgacgtgccggacccgggggcgtcccccgaagctggctcgtcccaagcatcgcccgaggggtcgggcccgagcggcgcgtccgcggcctcgtcgtgggtggcctcggaagtcgtcgtcgcctcgggcggagtcgggtcgggggcttggcaggccgcctggcgtacgcgcgccgcctcctcctcccggacggactccccggcccggcggagtctggcctcctttcgagcggcctcctcagcctggcgaacccggacggcctcctgggcagcctcctcggcttcccggaggcggtctgcggcttctcgccggtcagcttcccgcctccgggcctccgcggtcgccgtctcctcggcctcgagcccgccggacttggaatggcgggggggggggcgacgggatctcgctgaggcagaagaaaaaccagaagacggaaagaaacgggtgagtgaaaactcgccttgggagatgggagaatgaatgcggtcgcgatgggcgcggggacaaacctgcggggaggtcggctaaacgaccacctcgggggcgagatgaggttcccccggcatggctcggtcccccccatcttgcggagccgtttcttctttcgctccccctcgggctgcggcgtcggcacagcaccctccgggcgcctgctgctggcacgcaccgccccgcccccttggggaggagatggggggggcgtgccctcctgcttcctctttccccgggcgtcggcagggcggctgccccccgggcccccgtcgcggggcccagaagcgtgaccccctcccggggtagattgtttccctctacggctcccgcccgcgccatcgtggcctcgggggacccgctcccccgacgccccgactgcctgcatgatggtcaggatgttggcgcgatccggatcgctgcagagggggaggacaccttgggggataagggatgcctccacggagctgagattcagcacccgttggaccaccatcctgaagtcctcagggacccagtcccatttgcgcccctggtgggtcctcatgaagtcctcgggcccggtgtactcccaggcaccccgggcgcgccgctggagcggcgcgatccggcgacgaaggtagtcgccgaaaaccatggcccccgtaagcccttgggatcacagacccgccaggcggtcaagaacggcgtcgtagctgtctcccagatctaccgtcgcccgccagctggaggcctgcgccgggggctggctcggaagtcggaggcgcgcttcgtcggcgaggggggtgtagaaccaattgctcttccagtcgtcccacttcttgcggaggacgcagggaatgtagcggtgcagcacctgcccccgcggctggaagtagcagccaccgaccaccgtcggcggcgacaccggctgtacagtgaagaaccaccggaacagccggagagatgggcgcaccccgatgaacatctcgcacaggtgcgcgaagatggccagcgtcattattgcgttgggggtgaggtgcgccatctggagatcataaaactccagaacatccatgaagaaattagagaatggcgggaccagcccggccattgcgaaagagaggaagaagacggaccgccccgggtagtgtggcgccaggcatccctcgcccagctcgaccacctcccggccggtggcagattccggcatgaatcggcgcggcagcccggcctgcctctcgctcacgatgcgggaaggcggcagcacgctaccatcaagcggtgcggagccccgtgccatgacgccggcggaggaggagcttgagagcgagcaagtgcggcgagggtagggcacaggaaacgaagagttagagcgcaagtggcgaaggcaaggggaatagtggcgagaggaaggaaacgaatcccttcctcggcgtctttattcccttgccagcgctatgtccggctcctcgcttcccgtgcccactaccttgccccctcgtttctcgcgcccacgcctccactaaccccactcgcccgtttgcggcgcacgcggcagatgtgcggccgtgacggttgagatggggcagatcgtgcgcgcattaactgcgttcgccaaccgagaagagcgccatcatcatgtctccaggcgaaacgaaccggcttgtcccgattcgcgcgctgctcgagtaatgcagcggtcttgaagagaccgctcattattgtcgatcggttttcccttgccgatgcgcgcgatttacgaccgctgggtttctgcccgcctgtagagaccggccccacctgtcaccaggcctaaggagtggcgtcacgcccgagcgcttccctcgaggggggcgatcgccctggcgtaacgccgggggctactgtcggtgacatgggaccgggggtatcgtgactagaggcttgggtaaccgcggtcgcccacgtggcctgaccccctcggggggggggggggttcgggcccgagggtgacgcggccacccctccctctgtctccccgaggggtcgggccgcacccgtttcggccccgagggctggggcgccccgaccccctgtggttttggcaccatgtgtgtgggttaggtgagcacagcaggcgctcacctaaccgcatttatagcgggttagacgagcgcgccacgctgcattcaatgcggcgcagcgcatgcttatccagtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccagacttcagcgcaagaatggcaaggaagtcgccggccattaaatgaagtttgaaatgggcgtcctccggaaaagctgacgagcggggcaggagacgtgcgcactgcttgtcaagggtcacttccggctgtagactagccctcattgtaaaaagcatgtttcctttcttaggcagctagaggcccctgtggtgacccctgaccagataaaaaggaggcccaggcctagaagaagggggattttcttgggggatttttgaggaggagcctgaactctctctggctctcgagctctctgtattccttcacatacagatccaccagaacacaggagtagggtattacgcttctcagcggcccgaacctgtctacgtcgcccgcgtcttgtgcgatccttctcgctgacattcctcagatcgagggcgaagaacctcacatagcgcccccggccgaaccggcaaaggggggcctacgcggtctcccggtgaggggccccacgctccgtcaggcccagagaggtccatgtgtagaagttccaacggtcttgtagttgtcattacgttcttgaccgggtgatgagctccaatttgtttcccggcttaacacgcgctacacaccctatctttctcaaaaggtacatttgttagaccaagtatatgatcgtgctttagaagctagtgaagattcctcataccaatatgggctagcctccgatgccaaagccaccccatgtcggacttagccactaagcatgtctcatgtttggctttagttgaggaaaaatccacaagataaagcttgcccttgagaacacccttaaagactatcgaggagtcatcccttctaaatacggtcacatcaacatcggtaaaaagacaattgtagcccatggaacataattgagaaacggacaagagattatagtttagagattttaccaagagaacgttagaaatggaaagatcattggagattgcaatcttacccaatcccattacttttccctttccatcgtccccaaagactatgttctcttgcgaagtgccatttggatcaagggagcaaaacattgattcttctccggtcatgtgatttgtgcatccactatcaatcacccaacttcttccaccggagagatattcctacaagagatcaatttctagttttaggtacccacacttgcttgggtcctctcaagttagtgacaagtgccttcggcacccaaagaactctcttgatggaaacatttttgcccctcgggcctacatacttagcaacaacacgaccactaacattcttcttaagaacataagatgcatcaaaagaacaatgtgaagcataatcattaggaaggatacttttggccttaacaaaattgctaagaccttggggtctcttgatcatcacactcttgtccacctttccttttggtggaggaacatacccaagaccctcatggttgaagttgtccctttgataggctaggtactcttttagagccttactacccatatggcacttaagtaggccattgtgaaggagtcccataaacttctcattttgcttttgcaaagcactcaaagaaatagagttagtagcacaagcttcaataacaatatctttgcatctcacacatgattcattgcttgggacaattttggaacaagacggctcgctagggagagagacactattctttaaggtttcgaacttctcttcaagagagaggtatgctttgtccaagccatccactctctcttgaagttgagcgttcgccacttcaagattagcatgagactctttggtttgcttgtagagccgtaccaaagcctcatttttctctctccttggcaagctcactcttgagttcatgagatcgctctttctcacgaatgagcaaatcctcttgcctctcaagagttgcatattggtcctcaattctccctagcaactcactcaagtgtggtagtgattccttagttatggacttggacaattcgtcatccataacctcatcctcctcatcactaacaagatcaacattaaatgatttgagaggagaaggtaccttaggctcctttgccatgaggcaaatgggagcatcctcatcacttgagtagtcgaagagtctcagcggtgatgaaggcttgacggcgaacgtggcgactccttcttcatcacttgagcttgactcggagtcggagccgaagatcatcccaaggtgagcttggcaataatgttcccgcttgttatgcttatacttctccttcttctcatccttcttctcacccttcttatcttccttgatgtgggaaccatccttgaggtgagggcaatccgcaatgaaatgcccgggctctttgcacacatagcacactcttgcggaatgtcttccacttgacttgttggagtgatgcttggaagaatttcccttgaagaagccgcttcgcctcatgaacttgccgaacttcttggggcattgagagtttcgattcaatgtgggaatgactaagacaagttaggcgaaacagatatgcaccatagaggtttatccaccgtaggtttgtagacaagaatagtagtcacagcgagggatgcacataaataagaaaatacaaaaaacctttccatacattttaggcacagaaaacctgctttcaaaaaagatgaataaagtgttaactagcacaatctatcctcctacgtagacagtttgccagcagatgcagttggattctaaaacttctgcagtactctgggtgcttctgctggaccttggtgctagcatgcacatgaaatgacacctaatgcaatatttgaatacatgagaaggcaaatgagtgctgccaaagtccatggcaaatgtcacttcttggttgcgtagctggacacttgatccatatataagacaaatacatactcaaacttaaaaagaaaaggttaagcaagagcattgctacattatgataaaggtacacatcagtcacagaaacatcagagctttagggcatcgcatacctgcaaaggaaaaagactctctccaggaatagtctcatcaaatgcctgaaatcatcagagttgtgtcacttattttatattctcaaaggtacaggcaaaataaaatacatagtactattactatattagtgaaagcaataccgttccatcaatatcttcttccctcaaacgcatgacatattcaagaagttttccaccattcatgtgctcagtatcattttccttctgcttctgagccatcctagtcttgagttccttcgcgagatcattttgtgcaccattgtattgaagctcttcaccagtagtggatgttgaagcttcagccccatgatctcctcgcttcttaggtgggaataaatcatcaaaggaggcatctccaggtgtgcctatccttgtttttgttgcatctgttcccctttatctttggatgtaagtgttgctattatcattatgcttctatagctatagccttacatgaacaaatttatgaagaaaattttggagttccatcaatgtatacttatttttatacacccaacaagcttctatttaaatgtttagctacatgttcctatggatgccctgatgcccaaaatttaatgaaaaatgataccgttccttcttctgtggttagtggtcacatctataatctattgtacttgaaattaaatggttcttgatatctgaaatgtatatacgttcgcaagaaaattgtattgctgcgaattctaagttctgccactttacgcagaatctgaatcacaaaaatattgtgaagtatcttggatcattgaagacaaggagtcacctccatatcattctagagtaagcagttcgcaatcctcatgacagtttcttgatatgattatacctattaggctattagtttttttttttagcttggatgcttaatcttagtaaacaaggtagcaacacgttttccttttagttttgttctactggaaatgctctttagataattgagttccaagtaatttgacaatatatggtgctgcattctcaaaatagttagtaaacataagctaaagtcaatttcccactgtattagcaatgacgtgcacaaagctaggtttttccgaattcaagcaaaacaaaacaattcgaggacaaatgtagaaaggagaactaataatatgcccccactcagccagaacaactcggttaacgaacaattacatttagtgcataactaatcctaatatgagcttcctcttgtattttgcatggctttagtttagcaacattttgcattttgtatgtggcactttacaagttgtgactttaaatatatttgaagtttgggttttttgctggtttgtttagggagaagcatgtcacgtgttgtgattggttgaggtatactatgtcatcatacatcttaagttattttgttcatttatttagggcaagctgtaatagttgtgcaattaatatttttgcaccgaataaataattgttcaattcctttgtacccctttttgaagtttggttatcatgttctctgttctgtatggattgattttgtgtagctctagcttaggcttattatgccataagccaactttttggttttatggattgttgaccgtcaaagggagcttagtcttattctaaaagtgcaatgaccggattgtttaagttcagcctatacacccctgcaatctcacatctgcaacaatccaccctgccctgaattaagagtccacaatatgcaaggggatttaggggcttttggcttgtcagaggctataatcatgaataagttaactaatctgttctaggataagcttttatcttcatcatcgatctcctccttgctcttgctcttgcggctctcttcttcttcttcctttgccttcaatgccaagtcttccttcttgatgcttgtcattgagccttggttgatgtattggatgacctccttggactcttgcacaagcatgtcacgggcaagaatgcgtccgagcaaatcatgaggtgtgagagtcttgtagtccggacgctcacgaatgatggtaaccaaggtagagttccttgaagtgatggctcgaaccatcttcttgaccacaacctcatcggtcatgtccttggagccaagtcccttgatctcattgacgatcttgctcaaccggtcatacatgtcacttcggctctcaccatccaacatcacaaatctctcaaattgccccttgaggatctccaccttggactcacgaacactatccgtgccttcatgcaagttccgaagcgtgtcccaaatcactttggcactctcaatgccatccacacggttgaactcacttccactcaaggcactaagtattgcattggcggcttgagcgttcttgtgctcgttctcatcgtcctccttggtgggatcttcgggattctgcaaaacatagccttttttgactattctccaaatagatgggttaataaacttcaaatgcatcttcatcttatgcttccaagcggcatagtccgtaccattgaaatacggagctttgccgctataggtactcacataaaatgtagatgtagttggatagtcataaggaaacataactcccttatcaccatctttgccttcccccgtttggcccgacatgatctctccaagtggttaagcctaattaggagattaggctctgataccaattgaaagggtcaattaggcctagaggggggtgaataggctaatttaaaactttatgcggaagctaaaactgagttagggtcggaaagtctgatccacagtcagactatccgaaaatatcaaatagtctgatgttggatcagactgtctgatccactaaaggaacactacaagtagatctagtgcacaaacaagagtatggcgcaaacagcgactagatctaaagcggcacaaaagcaaagctaaataataggagaagagatatcaccaacaatgaagttcaccgagttgttcccggagttcaaatccttaaggggattctactctccgttgaggagctcactaagagccgggtctttgctaaccctttcctcaagaggttgcactaagcactcctccttccactaaggggtatctctttccttgtggaggcgagatccggccttcacaaacttctcccggccaaccacacgtagatcggtggctcgggagtgacacctagccgtttaggagtcctcaacctccaagagtaacaaacaccacacaactcttggtcaaaccctagtgctcaagatcgagtgaaacacacactaggccctcaaacaccaaatccacaaccaccaagatctactacacaaagaacaaagagggatttgagagagggagagagagctcaaagatccaaaacactttagcaccaagctcaacccaaagtgaatgtgaatgaatgagttgggtaaccctagaaaagggttaggtggggggtatttatagaagcccctaaaatgtggccgttgggagagaatcttttcatcccacctcggaaagtccgaggtgacatcggatagtccgatgtttttgacccccaagcaggccagagacagagaacgaaattctggaggatttcggacaatccgatcgatcggaaagtccgatgtcatatcggatattccgttatttttgaaccaagaatttcatcctctcacagagactcaagttccattgaatttcggagtctctggatcatcggatactccgatcacatcggatagtctgatttaaaactcactcaaaaggaataaaaagcaattcaaaatagagaatgaagttctgagaaatttcagatagtccgacgtatcggatagtccgaccttatatcggatagtccgatattttttagccaacactcagaccgaagacagtgagcaaagttctgtgaaatttcggatagtctgagcatcggatagtctgatcaacatccgatagtccgacagacataaaacaggaacacttcaaataaatgattttgagcactagtgttctaccaattatatgcatgtggcatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcagtcgcctgcctgcctaccgccgcttgtctagctcccgcccctgcaaaccgatgaagggaagagatagattgatgatgacatgtgggccccacatgtcagtgggtcccacaatatatttttttttcttgtgaatgacagatgggtcccacatatattggtttaattcgaatgccacgtgggacgaagaccgggtcaattttgccacgtcagcgccacgtcagcaaaaccactctccaaaaccgccaagggagtcaaattgcaccggttacaatagttgggggagtcgtcctacccggttttccagttgaggggtacgaattagattttacctatatttaagggagtcaaagtggactttttccaaactcgtaggtaccctccccttctctcatctctattacggtacgctgtagcttaaaagcggtgtcgtactccttttaagtccaccgaaattcctgatcgagtgcatttttcgtataaagggtaccgtttctgactgtactatttttaaattttgttttttttctaatttctttctaaattgtattaatatcggcactgagtagtttaaataataaatatggtcaattattagccgatcaagcgtcgtttccgaagagaagccattgattctgaccgttttcacccatgcttccaacctcctcacaccacgtgcagcacacctacacatgtactccctccattcgaaaataaacgaatctagtacatacatctgttcagattcataatatttggatgtgttacatccattgctatgttaatttttattgggatggagggagtataacataggtataacgattttgctatatatttgttgataatatttttttctaaaaacttgataatgtaaatatagcataatcatagtgtaattatattgtaacttgttgtaactacaaattagttttaaaccgttcgatttgctttaaaatttgtgcaatggaggtaggaaaaaatcacaacccacgcatatgtgaggtgattcggtacaattacctccgttttcactgaattttcatgtcgcctaaggatttttaaaagttacgtataagttaaactatagactatagttatatgtaagtcacactgtaattacatcacgattatactataattacatctgtcaaattttttagttaaaatttgacaacaaatgtagagctaatccctatatacatagccaccatatatattcaatgttttattttctaatcacatttatagtttatccctacttgcatgagactggtctattacaatgtaagataatgttatttgtagtatacttatcccctcatcacacttagatgcgttctacagatgggcaaagagctgaaaagtcactcttttttcgcacaaacacatcctaaactactgaacgaggatttttttaagaaaatctacataaaaattgttttaaaaattacagtaatctacttttaaaatttaaaataactataaacatgtccgtgcgttgcaattaggggtggatgtcgagctggctcggctcggtctcgttatcctaacgagctagaaacctagcttggctcggctcgtctgcaagctcgagctagctcgtttagctcgcgagctttggggacaatagagaaattagccggtgacctcagggagaagctcaacctcaccggcgccgtgaccacggggagagcttgccggcgaccacagggatgagcttgctggtgaccacgagaggagctcaacagtggattggacgagctcgacctcgccggcactgcaaccatggggaggagcttgacggtgaaggaaacgagctcgagatcgtcggcgaccacgggaagaagctcgacggtggatgggacgagctcgacctccgccggcacttggaccgtgaggaggaatgctgggggcgagcggcggcgtcgggcgcagcgggcgggcggcgacgtcgagcgctgaggccgtcgggcgctgcaggcgggcggcgacgtcgagcgctggttccgtcgggcgttgcgggcggacggcgacgtcgagactcgagcgctggggagagcggcgcgagcggctggagcatcccacgcgaaacgcgacgcgaacgcgatgtttgtggcggcggagcgatggagtgaggagagaatagatcaaagactcgagagacatcatcagtattagggtttgctctaatctgatgggcctactgggcttgtgggctttgtagggtgcctgctgctgctggttacaaaagctcgttacggctcgcgagcgtctcgttatctcagcgtctcgttatctctaatgagctgaaaggctagctcggctcgttagaaaaataaaatgagccgaaccaagtcaagccgagcttgtcacgagtcgagcaagctaacgagtcatgagcttttcgtccacccctagttgcaataggtaaaggctatttcaatcatattattattagttttttaatgtaaaaaatagtatattggatttttattttgatagtattgatatctaatttgaattttttatggggatgatggccatatcctatacattgttttcttatgatttggcaagaattctaaaggaaataggagtccgactctcgtcccaaattaacatgaaagttttttaaaaagatttcttatatgacttcttacgtattttcaaaaggtgaacaaacttaaaaactgactcaaatacgaacaacgtatcaaaatatcagcgaaaacattttcaacttttataatagtagagattaatactccattaatcatatgctagttttgcatatcttttctttttctcctctcaaacgtatgataggatatggtgtaccctgttctttctacttggttacgtcaatttcttttttgatggatggagtacagctcaataatccgtagttcctccaatttcaccagttcgactatccacgccatatcctcttccagtaaaaaaaaaaaaaacaatcttcttccagtaaagctgggcgcaatgcttttttcttaaaaaaaaaagagaaaaaaaaaagaagtggctgatgcaagtatgcaacccaagtcgcgaaaccgcgtgctactcttgctaaacggtttcagcccggattccgtgggcaccaccaccactcgccggcagatgccgtcacccatggcaaaatcgtgtcgacatatatgacctgggcacccccacttgccgacagatgggccccactccactgcggggcccgcaccctcgcatgcccgcctcacgattggccggcgggtataaaaggcggtgaagtgagtggcgtgtgcgctctctctctctctctctcctactgtaggccaccaccaccgcgaccgcacgagtcaacctcacggcagccaagcgtttggttggggggatcggagcggcggcggcggcgatgcagtcgctgcaggacaaggcgtcggagtggagcggcgtggcggcgggggatgcgttcgccatcgacgatgggaacgtcttcgaggcgctgggcggcaccacgcagccgttcgtcgacctctccaccaacttctacaccaggtctcgcttgctttcgctcgctcgccgccgatctggttcgttcttcttgctcgcgatttcgggggctctgattcttgggggagtcaacagggtttatgaggacgaggaggagtggttccggcagatcttcgcggggtcgaagaaggaggacgcgatccggaaccagtacgagttcttggtgcagcgcatgggcggcccgcagctcttctcccagaggagaggtaactaacttgatttcactctgcttctctctcccactcgaaagctcagctcgtacttttgcacatgtggtggcgatgctcggatgtctcaactctcaagagggactgatggttgggtgcatcagctagtcgttggctgtggaggaaagagttgagatatgaggaaaattatcgttttacttgttgagaaaagttaacccagatttagttacaagctaatagccaagttccgcaacaattccactagttacaagctaatagccaagttccgcaacaattccgcaacatattttcttgggtacagttggtagaatttagctcactatgatttacatttcttgttctccttttactttagtatcattgctttttcatagtacttgccgttgccggaggtgaatctcagattcagtacagtgatttttttttttgagcaagagagcagaccctgtataaagatcttcattgttctgtaatccaattgtataccagcactgatcagtgatcaccagtgaattttcttctgatctcattcttttaccacatccatatgatcagcaattcagcattcaacaacatctagctgggagctcataatggtttagtgagatgttcactcttcaattggctctgctgatttatcaccaatctgccagttgatctatattggcgcaagaattgtgtgatgatgcccaataatatgtgcttgtacttagtgtttcgcgtaacttgcccttgagtaaattttggatgtgttctctgattttcctctgttacgaaccaatagcagctagatcactctgtcactgtgcacatcagcacatgtatcaaatacaaccgcctgaataacttgttgacctaaaatctgcctatttgatttttctttgtaggacatcctgccctgatagcacggcatcgaccattccctgttacccaccaggctgcagagcgatggctgcaccatatgcagcaagctgtggatactactgacagcatagacgctgccacaaaaaccaaaatgatgtattttttcaggtctgtgctacagctgaattcttgcaagcttacacattttgtcctaggatcttaatactgctctcttcctccaggcacactgcatacttccttgttgccggaaatgagatgacaaggcaaggccatggaacttcctgcaagtgcaaacatggagaaagcaaaccagcagaataacgatcgattcatgcctctggccagtaaggcatctggataataaacgattcgagcctttagcagcctatcctggtgttatagaaaaaaaaaaccatggacgatggaattcagaccatctattcattcacaaaaacagttgagctaactgttgtaggcttacagccactctcgaacacggagcaacccaaaattgatagaacctgcctctggaggaagttgcaaacttgcaatagttatatcatactctctatattgaacaacggatgtgttattttgcgtctggctataggctatagcatgtgtctacagacaggggggagagagcaaggtcctctgtttgaagagtttctagcaattgaagagaaactttagctccttcaaacagtacatatcattatttagattcttaataattatggaatctagaaaataaactaggaaccaacatctttagatctcagaagcttaaatttctttagagaccaatcagttacttctccgaaccttaaatttcttcaaataaggtctgagaagggaagccttggctgaagtttctcttatataaccgcactatcgttggtcccaccctcttgtagagttgtaggcttgcacattagtgcctgactgcctgtaatagcacttattatgatataggatgtgaacaacaatcattatcacattcgatgtgaacttggaagcctcgcataacgtaacggagtcggtttgggtgacattgcctagctatgtcacaacatgacattgggtaaatctggaccatcataaacaaatccaacggatatgccgcctgggcgcctgggtccacctgcaggtgcaaaataatacccaatccatccattccagcgcgtgacggcatcccagatccatccatcgcgcacgcgcttcgccagtttgcctcccgtcaccgcgagccagctgggagactcgccgccgccgccgtgaccggagaccgccgcgagtggggagatgaccgggcgagcaccgcgcgaggcgtccgcgctcgcctcgcccgcgtccagccgtcgccgcgagccagctgggaggctcgccgccgccgtgaccggagatcgactcgccacgcccgcgtccggctttctggccggggccctgtcgtcccgccgcggcaagggaggcgccaggccgccctgccctgccaccgcgaccgagggcgcgtggaggcggccggggaggcgctaggccgccctgccctgccgctgcgaccgggggcgcgtgaggcgccggccaccgggcctgacgacgcgctggtgcaggcaggcggcctcccagcccgagcacggcacatggaggaggctgtgtcgtttgtggagaatgcttcaaattttccagtgcccgcaaggtgtttgtggaaatgcccctgaggctgtgtggttctctattgtgaaatgcaaccgtcagggctaccgctgggaagcctggtcctgccctgcctcctgggatgatacagagtcctaattggaagtgaattgttattgttggcattgtgagattgggcaaattgaatctgtaatcttgatttttgtcatcaaggaaaaggtgccatcggtagcacttaggcaaattgattgagattgatttggatgtatgactcatgatgctgtaattctaaaggtagctaacaaattttgagatgtgtcattgtgaaatcttaaagagatattgtgcagctaacaaatttttgagatgttgcccaggtccatggttctggacttatgtattgtctggtttatactggacatgatatatatactccctcaattttttaatagatgacgccg

SEQ ID NO: 82485 - DNA, 1658 bp, Oryza sativa
  unsure (1)..(1658): unsure at all n locations
aatagaagtcggggtactcaaaatcgttcatatgcttgacaagagagtcgagatgatccaaagtaaaccaaatacaagattattcgattcagattgaaaacattggttaaaagatagttcaaagcaaaacatcggtaataaaagatgatttaaagtgaaatttgctcattattatgataatagctcgtttgatttacgaggttggcgactaattaaggcttatttagttcccaaaataaaaaatttcacgcagtcatattgaatgtttggacacatgcatggattattaaatgtaggaaaaaaaacaattacacagattgcgtataaattacgagacgaatcttttaagtctaattgcgctatgatttgacaatgtggtgctacaataaatatttactaatgatagattaattaggcttaataaattcgtctcgtagtttcctagcggaatctgtaatttgttttattattagactacatttaatatttcaaatgtatgttcgtatatccaatatggcaacaaaacccaaaaattttccccaacttgtttaggcctaagtaatgcatggatagcaaagaccctatctcgcatgtggtatgtatgattaatttgtcccggccaaaattttgttttaacgcttacaaggttaatatcataagttgtagtacagttttagcaaatcttttggacaaaagcatcggccaataggaaaattgacatgcttgacagcagggaaataaactcatactttaactgtttagttgcaaatgcactatgtattgcggcaacaattaacaatggttgcagagaggccgtcctgcaaagcaggtaatttagcactaaaggttccatgcctccaaaaataaatattttctttccagaaggttatggtgtcgacacagtgtaagagcaagtgctgattcatatttcctgcacatgctgttttcacagttgattctttggatgtcatgtcaaaagatcaagttgccacttttctgattatttttcctacaaaatgatgtaattcactcactatgacgtgttatgacccatgactgcactgcaaaggtatgaattattgttctcaaaagactacttcctccgtttgataaaaataaacctaggggatatacagtttagattcgtagtattagaatacgtcaaatcttatattagattttttaatgggacaaatagagtaaagacatgctccaagaatagtactagtattagaatacgtcaaaattatcttttaaatcaataagaacatgtaacaaaagttttatgttgctttaatttgttgtaaaccttttattacatgttctgtcagtcaataagtcgtaaaaaatgaacaaattaaagcaacgtaaaacttttattacatgttcttagtgatttaaaagataattctaaaaataaactattaaaaattaaaattaagttttggctacggctgataacctataagtcaattaaatgatggttatcaccaatgctatttttttttttgccataaaggaccaactaaggataatttcatttcatttcaacatatcattattataaaattatctggtatactttttaaaaatgtatcaagatgtaccatatatataagtggatgtatcaaaattcagtacttggatagnatctcttt

SEQ ID NO: 82486 - DNA, 1485 bp, Oryza sativa
agctatttgcatgcatggtccatagtaaagctaatttggcttgacccaaatgcccttgattcagccactccactcaccgagcaagatccttatcaccgtggggcccgctcgccaggagcgtgttccacgtccgcccgacaccatccttatctcttccggcgaactcatgcaacaatgccctctcttgatctccctcctcgggtgctctcgccccagattgaatgtaaaaatcgactgctctcatcctcctcattagttccccccacaaatcccactcaaatcggcttaattccgttgtggattttgaagtccctcttcaatggcgagctccgccatggctggcgagatcgatagccatactagtgctgctgctgccgcccaaaccgcaagatgcgcggcggccgtccgtcgatcatgatgaggagctccatcaagttctcgttgggcggtaggcaggtggcctgtaccaggaacatgtcacaaccacgcacgcttcctcgtccgtggaccgcttgatctttacccgacccaactccatgccaagatagcacgccacctcctgcgccagcgtcgggttcgctgtgccggagaagatgcgcagccgactgctagagctcggttgcgatagcgctgggactgggagcacgtccgagctatgcttgccgtccggctgcgattgctagaggaagaagacgactggatggagatcgatctgtccctctcatgcaagtcaacgaaatagccataggggcaaaaaagtccgatcatagtggataacatttgcaaataaccgaaattggatgaaatggcaatgtggcaagatggtgacgtttgaagatggcattataacgaagccacgttcggggatggcattctagcgaaaccccaatccgagaatggctaaatgtcaattttctcatgctagagagccgagaggaccaatcatcaacagaacttggcccggcccggaccaactataaactaggcccggcccggcccggcccaactatgtctgggcctctacctctccgcatcacctcgggccgccgccgccgccgcttcgtcgccggcctcgcccactcggaaatggcggaaatgggcgccgccgccgccgccgcggtgccggttattccggaggacgtcgtcatcgagatcctcgcgcgggtgccggacccgacgtccctcttccgctgcgccgcagcgtgcaagcggtggctccgcctcatcgccgaccaggccttactccgccgccgctggccgccgggcacccgggtgccctccctcctcggcttcttcgcgcagcgccaccagatccaggccaacgcgaggcggaagctcaccaagctcttcccgacccgcgcgccgccgctcgtcgcagcgccgagcaggggcacaggtgacccacccgttagcaccgggcgacgaaggcggctgttcctcaccgacttcgtccgcaacgccgccggcgccggcctcttcgaccag

SEQ ID NO: 82487 - DNA, 1781 bp, Oryza sativa
gtcgcagcgccgagcaggggcacaggtgacccacccgttagcaccgggcggcggcggcggctgttcctcaccgacttcgtccgcaacgccgccggcgccggccttttcgaccaggccaagccgttggcggcgcgcggcgggctcctcctcgtgcgcgtcctcccctcgccctcgccggcgccgcagaacgcgctccacctctgcgtctgcaacctgctcaccggcagccacgacgtcctgccccctctacccatggattgcttcgagaaagacggcgccagaggctacgccatcctcacagccgccgaccaccgcgtcagccgcaacccatcaggtggctacaacaccttcttccaggtgctcctcctcagcatccaccatggcaaccatcaggtatacctccacagattctcctcagccgctgccagtgccgccgcggcggcggtcatttttgagatatcctggagcacgcccagaaattgctctgaacaaatccggggctatgtctggggtccctctggaaacagagttgcagctgtcagccatggcggcgcacactggctcttcagttggggagaagaaagcctctacacccttgatgtgagcattgacacagacaacatcggcgcaaccaatatcccaattgatcctccccccactgtcttccaccaatcttggttgtacgtaagcgtcgacgagaggctttcgcttctttatctttgtgacaacaaacttcatatttggaccaagctagaaacacaggagagtggtcgtttgctctggaattgcacccaatcgatttgtgttggcgtgaagatggggttgtttggaacggagtcgctttccactgtgtgcataggggaggagagtggcaccatgctcaccctctacctttcggaccctaacagcgcatatgtgctcgacctcccatctgggtcgattaccagtgtggacgattggaaacgctggttcaactacatgacggctgtgtcctttgagatcaactggcattcattcttcttgactcggctaggggacttctggtacgcatagatgaccagacttttgtaatttgcacttttaatgtgtttaaacgcatgttttgctgtgagattatgactgaatcttgtagaagttgacatattcagctggcaaatgaatcccatctgatctcacttactaatagagtagaatagtagatcttatgcatcttcaggtaagccgtgcatttaagggagtcctttattctgcaaatactgaaccatgttcttttggcgtttattatctaaatgccatgattggaataaagaagtgtccatgtggtttctagttttgttgcccaatctgtgtcaattgtagctgtagttggtgggtttgaaagattgttttcagaattgttccacggtcatcttcacaaatgatatggcaattacatggtttcttcagatatattcatcctgtaaattagttcttcgtatattaaaagagcctcatttctattgcctgcatgtatttcactaaagtcgtaacttgaatcatgattcatgaatatgggacagtttatatgttcaattacactttgctataactacctgggctgctgggcaactgccatgagctacgtcctacagttcctgcatatttaatacaatcaaatttttcttgttactgattctgtggtctagtcaaattatctatcagaagctactccctctgggctgataatacttgtcgttttggacaagggtgaggtcaaactttaaaatctttgattatcaatt

SEQ ID NO: 82488 - DNA, 7955 bp, Oryza sativa
cagctcggcgtgaacgacccgcgcgcggagctgacggtggagtgcccggatggcagcgcagcctgcccgacgcggcagcggtgaccccgcttgtcatgggcggggcagccgagataccgtcgtggtggctaggtgaggcgcgtggccggataacgggggcgctggcgggtggcgctggtctggagcggcagcaccaccggcggtcagatggtagtgctaagggagctggcggcggtgggtcatcttcctcgttgccggtcggcaccctcacccttcctggagctcctccccttctttgcggagagtttctaggttggattgaggcggcagctcgtcagcgggggaagctcaggctgccgatgcaatgccacctagtcccgggttctcctttggccaaaactggcaaggcggccagcgggtggtggaacagaggggtcttgggccagctctcaggggtggtggttcgatgaagtcgaccgacgaaggggcgtcggtgcggtgtggtggatgctacgtgttgccatttgtctgtgtggtggttctgagttggtggacggcgacctgcggtcaaggttgtagagtcccaggcgaaagcctagtccggtggttcaccgggccggcagcggctacgtcttcgggcgtcgtaacctatttggggcattgtcgagggttcccctctccctttctcgacgagcttctctgggtgaaaaccacatctttttcagataggcgatggcggcatcctggatgtcgtgaccaccttggtggcatcgttttcggagcctcgtctctgtgatgttgccgttggcctagcggcgttcggccacgcttagcgggggtcgtttgctgctaggcttcaccctcagcggtttgtgcttgggtggtagtgtgtggtgtgtggcattgcaccttggtgcatttgatgtttttccttgtaacttttactccttcttaatatactcggttggcttccttcggccttcccggcgaaaaaaatatatctaattttgaaagttgtttggtgaaaaattatgggttttgtaatttcgggcgaaaaaaaatgaacttcgaccaatatttaagagttaacttgcatgcggcggcgcaaggctaattacgatgcagaaatccccttttctttcaactgcatattcctcacagtctgttcaagtcacagagacagacaaacaaaatagcagctcgtgaaccagcaagctataggtactagatagatacatgcatggtttgatatgatacagatacgatcacacccacccacacaaacacaccagtaaattaatataccagacagtttcaggagctacgtgtgcgtatcagcacagggacagaaacagcagattgatcacacaaactgcatatgcactatgcatatgccagagcagatatggctcctttattattcattcatcacacgcacggacacacgatcacacagatgataatagccaaataaatggcttcttagcagttgcaagggttgcacttgcagctggagccgcagccgcagccgtgggcggtctcgccggactcggcggccgcctcgaagtgcgccttctccggcgcgacgccgagcacgacggtggcctgggcgctgctgctcttctcttccaggtcagggtacatctttctgcaaccggccacaaaatcaaatcaattaattagcatctagtgggatgatcccgacatcaaaaggttgtaagtagacgggcgattaccgggttattgttgcataaggtcatcgaaaaagatttaaatttttttgtaattgttagctgtgtatatccacttggatatagaagccggatttctattcattttctttatcttataacaaaagttaacgcaagaaaccatgcgtgtaaactgactcatacaattacataaataaacaggtttcatgtgtaaaaagaagacagagaagtgaaaagaaaggagaagatagttgccgatcatgcgcatgctatttgcaagaaaccattaaagctaagcatacccgcacgtgcagttcgagccgcagccacagcttgatccacagctgcaagacatcttgtcgaaatctataagctcaagcaactcaagatgacaaggagatgaagggctttgagatgatgagcacaatgcatagccttccaccctgactccaccatttataggactggacggaggcaaagaagagtgtatccccaagcttctgcgtgccacgatgctatacgctgcctcgaattagtcgctgcagattattgctcctcctatggccatttctggtgatggaatcatctattgacagagaaaatttctttagagcttttggttctgataatgttatttatcattggccacataaatgattatacttaatcccaaccgatcgtgagagttggggttaaaatggcacaagatttttcttagtttagctcaaatgttagaacaactgaaagtaacaataactgaatgacacaatggccaaaactaaaattttcagtgaataaattatctattgtgaatttgaggcctaagagtaatagattacactcctaaaactccttttctggcgaacttattctgaagagagttctgcacgtctgtgtataaaaatgcggttgctttatgctaatgtaccaatgcgtaattgacttctcttcccttgttctcagtacaccagcaacgttaattaagatatatagaagatctagtaagggaatatatttgacgtcattttatatctatgacttctgcaactgcctacctgcaaagaaataggccttcttcttgccttaaagcaacaagctttcagataacatggccggcaaagaaaatagctttcagataatatctaaaatactcttgtatagtagataaataatcactttatcaatatcttttggcatactttttttttcttttgtcatactttagacaacgtgcaatctgtacatatggaataattcaatgacatctagttgttactattttatttctgaaagagagtatttatgaatggaagtactacttataagaaaatgaatagaagtactttcattgtgtcatcttagtttcccctccaacgtgcaggctgtataaaatgttttgtatgtgtgaggtgtcttttttgaaaccgagtatgtgcgaggtgtagtttggaaaggtatgggaagttgacaatttgcatgaatgatgtttgtagatgcagccttgaactcttgattactcataaatatacagaaatgctcattgttcatgtcatttctgaacaatcgtttctatcaagtatatattatttcagtttggaggcatatgcctgtctcaagcagggcgcatagatcacagttaagaactcccaacaaataataattacagagactgcttacaagaaacatttcttgtaacattcaacactaggcctgatgcaacaatgctgatttgtcagttttagttgaccttgctgtggcaacaatagaacttcgcagccagtacaagtgtacaacaacaatgtcgaaagagatatcctttttatatacatagtgatcatagagaatgttattacagtacgttaacaaagattaaactgaatctacaatcccaacaaactttttaaacagttaatggaggtatggaaatttgtgacacgtctccaaatgtactactacatccgtcctaaaataagtacagccataaatatccatgtttagcgctttgaccatccatcttatttgaaaaatttatgaaaaatattaaaaaaaatagtcacacataaaatactattcatattttatcatctaataataataaaaatattaatcataatttttttaaataagacgaacggttaaacgttgaacataaatagtgctaaaactgcacttattttgggacgaagggagtactctatactctttaaaagtccccagtggtggtggcactgaatctggcatccactattgttttttacttttttagaaattagctcctgatatcttctgatattatgaaatagttcaaatattcggttcaaacaactaaacaagtgatactaatatattcaataatattttaatatccattacatattataatatattttattttattcatagcaaaggaaggtattttgctagtccttcaaaaactttctaattgttgcgaaagttcaagggtgaattttacctatatgggcctcacgtcagcctgcaatcgctttctgggcccaatagtacgggccgcacgcaccccgtaatcccgttccgggccagcccaaccaacgcgggccccacgtcattccgaatggcccggcccaagtagaagactacatcgacagacgggacccacacccccacgcatcccccctctctcgtcgtcgtcgtcgccgccgcctcgccgtcccccgccattggagccatggatctggctcccggccgccgcgcgcgactgctggtggcgctggccctcgtcgtcctcgtggccctagccgcgcgatccggcgccgaggtcatcaccctcaccgaggagaccttctccgacaaggtgtgctcctctctcctctctctctctctcgtctcccgccttccccaccggcgacgatgctgttttgttctgtagatcactgaggttgatcgagctaggagagtccaggtcagtacgggcttgctttgttgtagaattatgtaatagattccggagcacttcgtactatagcggcgatgcttggtttcagacctgtagctgttgtattgcagatctattgacaattcaagtttgatgggcgcctgcgcgtcagtgttacttcgcctctgggatggaatcattggaatgatggattatatgagcgtcggggttttaattatccggtttcaatcacggattgggaatttagaatcgggtcacagtgtaaacttttgtcttgttagtttgtggagaatagataccattgctttccaggttgcatgtttgatactagtaaaaaaaaagggtcatagagagccactgctcgtgttcctatgtttttgcaagtcgttcaccgttgtggcgtgatgcttgtatttgttccaactaagccagtttgatcatgagcaatcctctcatttttagataaaggagaaagacacggtatggtttgtgaagttctgcgttccatggtgcaaacactggtaaatctcactcttagctccatgatgaatattgaattaccgtataaatcttgtcattaatggcttaagctaatttgttagatgcttgtcatttgcagtaagaaccttggaacactttgggaggacttgggaaaggttatggaaggtgcggatgaaatagagatagggcaagtggactgtggtgttagcaaaccagtatgctcaaaggtggatatccattcgtaccccacattcaaggtgttttatgaaggtgaagaggttgcaaaatataaaggtaatcttcgtttatgatgcaaattattctatcttgctattgtgtggaaaggtcagcttaatctagtttcaactttctagtctacaatgaaaattgaaaaagagaaaggtatgtttggatctgttagattttctccaattctcttgaggtttaggccatgtgttggaagccatatccccctgcagtctgaattaaagactacaaaccatttcaactaatagaattgtgataatgccaagccccacaaaaaaaaaaatcgaagaccctagtgtttgtttctcaagtgccatttttggagtagcaagtagcatcttctgtgaagattctgccaaatctgctgatgaaaacatttgattatttctagtatctgccagcacttgattctcctctttatatttttccgttgcttgaactcgttatattgttttgtttatgattttctgctcatgacatgacttgttatagttgaagcatgccaggatactgattgtatcctacaattgtacggcatgaagagcatacattacctctagctctaggaaactatgcatgtgctctagtatctctgtcttttcctgccattccctatcttgtgaacattggaatgttactcattctgatacctatcactgcaattcacaacttagagcttgatcttctgctaactgtttgtacttcagaaaatatgcaagtttttttctgacagttatgtgcgtactaaaatgcagattgaatatattgtcatctttttcatcgctgtttcaccctatcttttgtagctttatgctttgttactgcagctttgaggggcaacttctgtctgtccttcatctgaccacccacctgctcgctgatttctgttgttaacgttagatgcctcctaaaggaaatccttgtgatcttttgtgctactgcaggcccaagaaatgtggagtcactgaagaattttgtttcggatgaagccgagaaagctggggaagccaagcttcaggacagttgaactggagctcaagtgttccatcctaccacagttaagcaacaatgtagtactgtttgacatgcttaaactttttgatatagtgagcttgtacttcctcctggcgtttagtagaatgttaaccactgcatgagtcgcatgaaactatgtaattttctgcttcatactgcattcaattacagcatgctatactataaagaagagttcatggaaaaagcgcctttttttttaaaaaaaaagaagaaggcatcatagaagttgcattccatgccattcctgattgcctacaattggttgggacttgggagtccagaaagaaatacgtgctgcgtatattgcttatacgttcatcttaacgctaaattgtttctctctacttggcagtaaacgcgtaaacctttaaccccacgacgaaccattgcaacacataacacaagcttaggcacgaccattctcgatccgtcgacgtcggccatcgtttatggacggactgtagtgcgtgagtttgtgattttttcaatgtctaagtttgcacgagtactgtgtaatgatatattgctatcgctacttcgttggcatgctttctttgtttcccctgtcctccgttctgcaccataatcccatgttcttgtttaacaaaaatcaccagagagaaatcgtccaccataaatgtagtgagatgcgtggtcatggatgaggcagatcaaagtttcaggttcagtctggggaaaatcacttcgatataagctgagatttgatttccttttttgttcagcaaaaataacaagtgaaagcagaaaaaaaggatgctgtgttctaacaatagcatgacattgtagcgccgacaatgtgagccgtttagtaaatcactagcattaagtactaagaatagaatcaatagcaaactagagtaaaactgctacagtgcttcggaatcacattccattgccgataaaacacaacccagtctgaactctaaagcatcgaaattttgccggagctcaaaagtgaagacagtatttaaagatgtacttcctccgttttacaatgtaagtcattctagtatttttcacattcatattgatgttaatgaatctagacagcgttgtgaaacggagggaatagtaggcagcaaccgctgcgatagactatgctgtaactgtaatatacaggcagaagtccggtgtagattagtggacaggtgtagagattcagaattttatttctgaaacttagattcagacttcagaacagaatcgatcatgttcaggaaacaaattccccggggaacgagatgagaagtaaatcttgccaggtgatgcatattcccgggaagcaagcagttttttgttttctctgaatatttgctgataaatactcctacgtatctatcgtcgttcagttacctgtcgagcttgctcctgacatgaccatgcaccgatgcacatgcccgtagcagctcgttactgcagatcgaaagcatagcagcagcaaagctcgtactccctccgtcccaaaa

SEQ ID NO: 82489 - DNA, 5900 bp, Oryza sativa
tatcacctggtgcgctatgcttgtcaaagccacataaaatggaaagagaacggtttacctaaaccagctgctttcttggaccgctcacgctcggccagacttgctgttcattggatgagacttgaactagttgcaagttcattgggtgaaaagttccatggaccagacacccaatcctgaaagatcctatctcgattggtgaataattcagttgattctttgagtccacaaattttcatttatttttcaattacatggaagatgcatcatacacacaaactaccgcacgaacactgttatgcggttcatttctgatactaatgaattaaagatctcgctaaacatcttgaagagagcttcacttggtttttctcatattattggttctatattgagattcatccattaaataattatctaattagattcaaaatgaacacatgaattttgtagaattttcgcgtgagctcatctattccaaggagcccacgaaaggtgtataatatgttgaagacaaagaagctatagctcatggtccattactccattgaacaccgagaaaaaaaaaggcagtgtgtcgcgacgactacggataagaacccacgagcttgtcctggtcataacccacgtgaaaccattggcacgtcgccgtcgatcaatgggagcttatgcgagctcaattgcaacagcatttgttgctgggtcgcaccttcacacagcttcatccaaagataagccaaaaatatttgtttctgtgatccaacgaagtcctctgatcgatcatcatgtattggcgtgtagcttcgcgtgctgatgctctccaagctttgcccagctagtgctaccttccaaaccccaactaggtggcccccttttttttttgtttaatcttaagaaccaataggcaaattgttcgtcaatcgtcagtgctagcaaacaaaactacgatatcgtcatcacgatttcgttttgtttagatcaatttgattgaagttcctgtttggatcttgcaatcgcattgtccaaattttgtacttccaaacccatatcatgggttatggtatgtctattgttgtcgtcgtctatttgttttcttcttcttcttttccggtgaggttagagtaagcccgtgggcacaggaatttttacccaatatttgcaaagaacatatacacacacacacaccatatgccaaaagcttttgactgatttacaccttcagccacacggcttgccgaccgaatcgatcgggaggtaaaggagaaagatcccgggggcgagggcaatgcacaacgctggctcgtgctccacatatgtcgtatccctcccgggccctacaagccttcttatctctacacatgtgtactgaaagctatatatccatggatgaatggatggatggatcaatcctgcattccctgcttcgttttctcgtggatagatcagagatcggcttgtctgtctgaactctgaagagagatgcaggcatcttgggacttgtaatttggattccttggggttgggggtggcattgcagccttttttttttaaagaacattactcttaaatttggtcaggatttaccaaaccatgtaggacgtgggtaccgtcaccccatggtttgacagttaccgcggtaatcgcgaggtatatttcaaaaactgagaagatcaccgcacgtgataaccacgacaacaaccgtacagtttaatttgtaaaccgtgcttcttacatggttggttgatgttatagtacttgtgtcacacttaatttcaaggctttagcaagatcgttgttgaaatgctcctttttaaatacttgtcagcagacactattcgcattcaactttttggacaattttatttgagcaatgcgattcataaaatatttgaaaatacagcatattaacaaagtatgtgtgttcaacaaaatatgaaaatttcttctaaaaatattaacatgggttaagaatgacaagtaaatgaaaacatatctagagttataattaaccttaatttagttgaaggacactaggacagactgtgatttggattaattagattaactttatgcagtgcactgactgtttgacatttcagggatcttttgtaatcatatgatttgtgggggacatggcaattatgttcacacaacattttcactacaaacaataccagactagcacattatgttatactttaaaataggattttatccaccacaaaaattaagaggctaatgagttaaataacaggtgaatgtggcgaccctacaccaccagccttgtgttatctgaaggaaaattctgctgaaagcaactggacaccaccgaataatcctattgtgaaccattttaaagatggaacctatatgtcggctgtcaagtagcgttggcttgagcagaaagttgtttttctttttctttcaagacaagctgtttttctttaaagagaaatatttgttttctaaaaccttcaaaacatctctttctgctctgacacctactagaaataaaaaaactggcagattttttttttctgataatagaaatcaatccagactctgtattcaggatatatccggccaatcaatatctggaagatgatcgtctgatagcattaagcttattagcttaatgtaaaaccaagttagaataatttaggactccagtattactagaaaaaatccatcacatccatctcatcaaagacaactacggctgggaggtacaacaataatgaaagaaaacaataggtggatggcccaaggataagatagttattttcatccgagtcatctgtgatttgattctttcttagctgatgttaccaactactgatgcaaagacccaatttgcttcaatcctcataaaagtcgtagagcactaaagctcactacttctactttatccatcatatagtacgaaagtacttcgaataagcattgccggtacctttgtcaagaaccatcttattactagcacacactcccttttctgcaagacataaacttgttcccctttccgttttactttctttaatgtatataaatactctacatatgtgagtgatcttacatatcttgagatgaaccgaggctagatacaccaaattttgtacttcaaaaaatatgattccttcttataactttcgatgaccgtaaaatttatcatataacaatataaaattgctaagccgttttggtaaaattatcaacatgttctactaattaggaaattcatattatgcatgcatgatgatagaagaggatatataaattgccctttgatcctcataccaagatatgttcagatacagttcacagctgaccaaatgaaaaggggaaagaaaaaagagaaggtggccaagagtacactggtaagctgttgattggagagctctagttaagaatgctaagcctgctttttttgttgctgtggttgttgaggtgtcggcattagggacatccttatcaccacaaaattttcttaagccgcatattggtatatttttatttctctctctctctcattttattggtgatattctttgtccacgttaggagatgtgcgcgagccgctctctccctcactgggcctttgtgccaatgcgttaggtctaagcgctcatgcagcagtccatccagggatagctgacactgagaatgtgatcctgatgaaacgcagtccacaaatcgcagacaatatcaggctatcagccctttgtacgtgtgcgtgtctctgcatccgtcagttgtttcgattcttctcgtaaacctttaagtccaagcttgcgtgatagagcgtgcaataaaacagcaacatcaccatctggaaaacccttctgatcagctgtttacgttcatgcatgagacccacgctgttgaagacggtgtcgtactacagtggtatgagagctacaggagctttggactggcctgtgttcgattcgaaccctctcgtgcacggccgggttgctaagttcctctttagcaatccatatttttctcatttcgaaaaagatgtcttgagttcgaaacatgctccaaaggaagagtttgtaggctaaacaagtgggagcagataagaataatattgttcacctttcctcactagcttaattatatatttatatgggtgaatctgttttaataaagtcagcatgccacatactcgtccaatatagatataatagaaggattcgaagcctaatagcatcctgggtggcatatcaacagttgtaacgttcgagcctggtgtgagatgctggccaacaaaaaagaagtgcccaagaaagacctgcgtgccctgattctcttggttgtttgggatctggaaagagagaaaccagcgagttttcgagcacctagcctactggtgaaaataaaggagaaagcaagaagatggcttcggttggagcaaatcggcttcgggagcttatactaaattctgcataacttactctcaggggttgtatttctcttctactatattaaaaatagcacaatctcatgttgatttcattcaacaaaaatgtttggataagtacccagactaagttcaatgtaaaaaatggtacaaaaagcttgtataatcagaaatgcttatatttaaagtcgaatggaggtagtagatctggttaaccctctcctatgtagccatagacgaaacttttctaatatgaaattatcgaactcttgaaatcgccactttttaactctttaaatcactagtataatgcccatgcattgcaatggtttttttctctaatatattatcattgtgataattttgccatcatttcataaagatgaaaaattctataaatttttattgtcatattttattttcgaccaggtctaacatatgaaggctaagaaaccagtaaagttttatatcatattttatgggttccatatggtagtaggatggtggtagcgccaccaccaccactactactttttacgttagtatagaaattgcatttatactccgatgataatctgcacttctagaagatagtaataagtcagagtgagtgaccctatttttctacccaaactaaagcttaccatccgagcccaagccctactaaacaccggggcccagacctgcccaatcagtaagtaacacaccagacaatgctcgggtagcgcccctcaggccctcacgactggctgcagcgctgcacacgtacgcccctaaaccgtcaacattaccagcattattacagcctcaccccccgtcaacacaacacgaagaaaaaacgcaacgccgtgggcggaaaatgccatcgtttccctgccatttttttccacgatgagtacgagacgcgccgtacgtcccaacgtacgtagtaccaccaccaccggcgcgaaacggtagcgctcgcgctggcgctgcaccgatcgctgtctccccgcgtcgcggaggatgcatacgctacaggacacgggcttggaacctcgtgtcgtgcctctgttccactggctctgcgacgcgtcgccgtgtcgacgcgcgggtggcggcttggggttctctctggcgtggcgtgcgggatttctgacgggacacgggcccaataattggacgacggcacgggtgacgggtgttctcgccggtgagagcatgtatattttagggtctgtttgggaaacaggacttatcatatcggatgtttatacacaaatttagagtattaaacatacactaattataaaacatattctataaccttgggctaattcgcgagacgaatcttttgagtctaattacaccatgatttgacaatgtgatgctacagtaaacttttcataattatagattaattaggattaaaaaattcgtctcgcagattagctttcatttataaaattagtttttttattagtctatgtttaat

SEQ ID NO: 82490 - DNA, 1956 bp, Oryza sativa
atctttagtcccagttggtgagaccaatcgttgatggttacgaacagcagcgctcgtaggttaaactccttctgtttgtcctcatcccacacggggacaccttccttcttccacaacagtttaagatcttcgaccagtggtcttaggtacacatcgatgtcgttaccaggttgcttggggccttgaattataatcggcatcattatgtacttcctcttcatgcatagccacggggggaggttgtagatacacatcataacggaccaagtgctatggccgctgctcatctctccaaaaggattcatgccatccgtacttaaaccaaaccgtatgtttcgtgcgtcctttccaaagtctttaaattttctgtcgatgtttcgccagtgcgaaccatcggcggggtgtctcagcatcccgtcctattgacgctcttcagcgtgccatcgcatcattctagcattccccttgttcctgaacaaacgccttagccgtggtattatagggaaatacaacatcaccttaacaggaattcttttcttcgttagctgcccgtcaacttctcctggatcatctcgtctaatcttgtatcgtagtgctttgcaaatggggcatgcttctaggttctcgtactcctcaccgcgatacaggatacaatcattcggacatgcgtgaatcttctgaacttccagtcctagagggcagactatcttcttagcctcgtacgttgtctcgggcaatttgtttacctccggaagaatgttcttgacgagtttcaataaatcgccaaatgccttgtcactaacaccattttttgccttccattgcaagaactccagagtggtatccaactttttgtgcccctgctcgcaacctgggtacaacgacgttctgtggtcctctaacatcttgtccaatttatgggcccccttttcactttcacaatcctccttggcgtcctgcaacatctaaccaagatcatccgcaacgttgttaccatcagcatccctttcctcctcacccgttttatttccttcaaatccagcgtactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttccgattcttacacttattgcatggacaacaaataaaacccttttgcctgttagcttcagccactctcaaaaaataatgcacaccatcaataaactctttggaccgacggtcagcatacatccattgccgatccatctacatgatatgaaaaaaaatcgtacacacataattattcgtacaataatgacagtcatacaataattataaaataattacaaactctttcaacagtcacacaataatgacatatcattattcatacaaaaattatgaaatattacactgaataattatatatttactatttataaagttttaaactaatattaatgtgttgtacttattttaatttttcattttactttgttttctattattcaagattaactttcactatattttccttctcagctattttataaaaccttctttagcaaataaactaaatttctatatattctttcttctccacacaaattttctctctcatcaactaacaacaaaattttggagacaaaaaagtgtgcaaaacatagctccaaatgtaatatgaaaaaaaaacattggaggataaagttgctaaccttttaggcacctccgatttgtatataatcaccaaaataaattcactagaaattttggcatgacctcccctcttttttgaagaaattttgaagcttgctcgggctggaggaggaagaagacatatatataggggtgggactttagtcccggttggtgttatgaaccggggctaaag

SEQ ID NO: 82491 - DNA, 8362 bp, Oryza sativa
tagcaggaagcagggtttaatgtccttggaagatgcattagtagctgacaaagcaaatatcattaaccataattttacaaggtcccgccccatgaccttgtattcaatatctaacaaatgaccaactgcatcgacaatctcagcaaacattaaaggtagcatcttcttaacgtttgcatcttccaaatgcacagctgacacccagaattcatacattttttcggccattgagactaagaccctgtaaatatcttgcaagaactcaaagtaagatccttccgatgtgtcctctgtaggtacatagattttctcttcaataactgttgtcaataccttgttgatggacttcaacatacaatgaacttctactagctttgtgacccctaaattagaaaagttcttctccgaatatgacttacactctaaaatcaatggttccataaactgcataaacacttcaaaaagtgattccctgtgatgatgaggttcttcagagccctcactacttttctgcaagcttgtttccctgggtcctagagaggctctctgatttccagatcttctaacaaacaactgaagcaagtagccaaacccagccagcatcactgacttgttttctgcttttattgctttgaatctctcaaatagatgcctatggtagcttcctatgacatccctggaagtagatgatttattcaaattcttgaggccaaaatatccactgagatgttgggggtgaaacaatccattggacaaaatttcttcaacaaccttcaacatggttctgtcctgcttgtgcgtgagggaattcacttgtgaattaagcaaaaccaacaactccaacagagggtcaagaatcctatcaacaaaagtgcggaaaatattcttaggatttgcatagaatctcagaaagcttgaaaattgctcaaacagacaatttccaaggttccaaagaacagtacagccattcctctcattatgtgaaaccttctgggcaaggctgataacatctatggcacaagaagcccacgaatcaacacctgcattgaagaaggttcttgtattgatggagaacaccgaggacatgcaccctaaaacgtgtccaaagagatcaaaagattccttgtcatcatataaagcaccagtatcaactctgctcaaaccattccttgcaacacgaccaagcgatttaagtacgtttggggaaatggagatggatggcttcttttcaatgcaaactcttaaaatggcccagcatctataatctagcacaggatcaaaaggttctgacgttttcttactgttctcaggcaaaattaagatagactgcacccagtttccaataaatgatacagctcgtagtaactgcacgatgtctagtctacggccatggtttgaccaatttgactctgtgcttgtaaaattgaaggttagctcaatctttctgcgtgatgtaacaacaaactgtcaagttcccaaactggacaagcataataactttcatccataaatggtttaacaagcatgcccatccaccaataaaagaggaactggaatacataagctaagcagattctgttgatgatttgaggtcataaaaatatacagtacaaaaagttcgtccagttttatttgcgctaattcttttgaaacataagaaaatgactataaactgtcattttgacctaaatcaaagcgcacatttttctatgttactaggtcaagtcaacattgatccaatgaggagacatgtaaacaactaacaccttgaaatccaagctacaatggaacagcatctcttatgagttacgcaatcctatatgaactaaatcaggtatatgtgctcgtccagacacttgcagcagtaaacaaacacttccagcccacatcaaccgagttatctacataatcagactagaatcatagaaattaccaactaattcctgcaatccggatcataatagagttacatgagcactatgttgcatcgactcgcaagcgggaggagcaagagaacgacctttcgagggagagctccttgccctggagcgagagcacgaggtcgaggttttcccagccactcctcgtgccgccgccgccgccgccgccgccgccgcaaccgaaacgaagcttggataacttgggctcgctcggcccctctccggcgggaggcggcgactggctccgccgccgccgccgccgccgcttcctcgccgcgcctggggtcgcggtcgccgtctccatgggagcgcgaggagagcggcgaaggaggaggctagggttctgggttttgcctgcgtcgctgagccccgttttgacgcgacggatttcgtgctgtctccgaccggtgcacgaatcttaaagccacccggtccagagccgctcgccgctggcgcggtcgggtggtcgagcccgaccggtttctccgcatctggttcagggtaaaaaccctagctcgcgcaccgcaagcggctagggaggctagcctgtgtgggtggagaaggcggtgggaaaggggagaagaggaagaagaagaagaaggcgcaaatggcgacgggggagtcgcagcaggcgtctcggcgggaggggcgagagcgcgacgagcacgacgcgtctcggcgggagcgggagcgcgaccacacgcacgggaggcgcccccactcctcgtccaggtcgcggcgggacgatcccaggtagtaccaaccaatcccgcagcgaatcccccgccgctctctcgatctggtcgggttccggttcgagctaggagaattgggggtttgggatttgttgattgcagtgtccaatttgcgttccatacttgttggacgatgcaatctgtgcgcttactaacccatttttttcatcggggattcctgttggtagtccgaggaggagaagagaggacaggaggcatcatgaatcagacagaagtcatcgccacaggagtcgagctgaagaaagtgctaaggcagttgaccgtgaccagaagagggataggccattgcaagatgccgcgcagcccgatgatcctttgcgagcggagacgaagcccctagatgatgccagaaatggctctcctgccaggcatgagagatctcctaggggaaccaaacggtttcctgaatcaagagatgctaggcggcctcgatcgttctttcaggttcttgtctttttctcaaatgtgcatcaagggactacactctttgcttccaattgtttggtagctgttaaccgtgtgcttggtagctactttcagtgtaagcaggatggttcttggttctgcaaccctactagctttgccgaatgtagcatttgtagctagctttagttaaaagccatgaatccattggtcccagctgctggtgctacaatgtgcaaacaatagtgtatatgatatgtcgggtttcttctgagaaaccatgggaaattgtgaaaaatgtggtgtttcttggctctcgagtgcttcattgcgacatattcacacaggataccaatgatcgaaaatgagatatgggtgggaaagagacaaaatggaagttctagtagaccaaactagcctggctttgtatgtttgcatacgtatgcccagacagtaacaattataaatgctggttctacttatataatatctttctgttgcccttttaaaaaatatgcaagcttgcacaatagccaattcatttaatttctatatttagttcacatatccaatatagtattgtctaaacaagtgatcaccactcactgaaatattgggtgtcacaagttacttcctgtgtgtgtttgtagagtatgtagccatatgcccatatatatatatatatatatatatatatatatatatatatatatatatattgttcttctatttcaatgttacatttttcttctattagagtcaagtgtatatattagttagatccatggtctgctagctgttcctccatattgtgatttaggtttacacagaatgagcttaaacagatgttctttcctaagtagtaagtaattcctctagaaaaagcaacaactaatttatctctaaatcatatatttcttttttgggtagtggtggtggtagctaacattgtaattgatcttgtattgttgtactaaaacgaattgacatcttgatctccttctttatacattttgtaggctgtggggagtactttcttgtaatattttccaattttaagtagttgcatatgattttggttaaatttactgtttcctgggtcctttttttatttattattgcaatggctgtcatgttaatgtttgttttctcatagtgttgcgaagttcaaaaatatgcagcgaggatattggtttgttgttatgtctttggcgtcagctcaatatgcatgagtaatatataccttgtgttgttgtgggactttgtttatggcatatacctacaagtgcccactgtatttgacaacattaggctacttatgcttgtatgtacagcacgatgaacgtggcagtgctgggcaaggtggtcggtgctattaccgccaggctagtggtgagttgcctacttggtttttatgttctgcccttatttatttttcagcttccctcatttgcgtttgcttattattgttttttaaagaccggggaagacaaagggatgaaaaggagcatgttggagatagagagaaaaacaaagatgaaggaaaggctatgcaggatgaacaacaaaatgatggtgaatctacatggaagcatgatgggttcttccagttggaggaagaagctcaccctgccaaaagaaggccaccatttaatgagatgggcatgccactggaggggaaagaatctgtgctttctgttacagaaccagattcaaggtcacataaacatgatcaagctgggcctacctctgcaataggagaagaaaggagaaattatcacccacggggatttgataggcatgagggacctttcgtaaggccagatggtcaaggtatgaggaggggattttctgatcacaggaatgctggccaaagaaatggctatgattcatgggggcgttttgctggtagaggaaggggcagatacaggtttaacaactcatatgatgggcgaaacagcatgcaccaggctgctggtgatcaagcagaaaaatggaagcatgacctttatgaacaaacaaatagaagccctactcctaagaccgaagaagagcagattgcaaaaattgaagcattgttggcgctgtagctactgcttgggattgctttctggtcatatttgcaatggctagataggtgatcatctacttggtgtcattggtgttgaatgctgtcagaccgtctatcctgatgctgcgtcactcaaatgcagctggctgaattttggggttgacaatgttttcttcttccatttaagaaaatgtgcctgatattctcggtttacttgatgtaggatccatgaactaagaacaagagtaaacaatttgcctcccattaaaatgcctatcgaaggccgaagtgttcttgtaagatgatgtctactcaaattttgtgtttgttctggctgcttgttctagacagatgctttggcacggctggtcgctatacacctgctaattccgtaacggaatcatgaattaataaccctcctcctcctacccacacaggttttctccctttttaaccctcctacccatacaggttttctcccttttttggatttttgctggcacgttactttgtatggagcagtgctcctggattgggcgaggggaaccggctcctgcataacgttgttcctcttgcgaacacggtcccctcgtgtccggttttatcaactgggtatgagtggcaaggccaaccggctccccttgcgaacacggtcccctcgtgtccggttttgtcaactgggtatgagtggcaagggcaaccggctccccttgcgaacacggtcccctcgtgtctggttttatcaactgggtatgagtggcaagggcaaccggctccccttgcgaacacggtcccctcgtgtccggttttgtcaactgggtatgagtggcaagggcaaccggctcctgcatgacgttgtttcccttgcgaacacggtcccctcatgtccggttttgtcaactaggtatgggcgatgagggtatacatgtaggacacgcaactcctacacgtttttcataaacgcccctaatacttgtgggcggtgagggcagtttatcagttatctcaccttaagctttactctcttcgtccaaaaaaaaaaaagacaaactctaggctctagctccagatacatagcgagagtttgccttctctttttttttttttttgactgagaaagtacgtttgtctctgattttaccagattcggactcctgtatggctccgaatcgtcagtcagtctgtgggtagtaggggatcaggtttccgttatacctcgcgcacgcttgttggagtcctgcttgggtcccttatccaccgtggaagctccctgctcgctctgcatggacaagttttgctgcggctccggaagctcccgggtgcgggtgaggtcagatccgacggactggaggcaacccatcgttgagccatctctcatttcatggcctataaagagagacattggacaatgtcatgttagtactatagcagagacagatgccaagtccatggagatgaggattattgttgccattaccactcaggtggttctttgcgctcaggctcgccagcttcagcattggtatcaatggcctaaatgatgaagcagagtttcagattaaccatgaataaaatgactgttgtggaatggacagaattagtagataaatatttggtgctgttagaaatgattatggggcttgtttggttctttaccctaccaattcattggtagtgccaaaagtctaggccaattttggcactatcaaaatattggtagggtaaaattatttagctaacatttggattgctaccaatttaaagccaaattcttatagcatagtgaagaaacttctagaatatgacctaatatttgaggggcactaccaaatatttggtcacaatccaaactaacacacaaactattcaattcgccaataaattggtagggtatgctttgggcatcaaaccaaaacggccaatggtaccatttgttcagctatatcgatttccagaatcctttttatctcaaggagctttctgttggtgacttcagaatgaatgacaactttgcctgtaaaatagagtgacatatgccataagatggtagtgcacagtagtagtgaatcagtcatttgctcaaagattagtattagttctattagcacaatacatggcgacaacggtcaatctgaaaatataagagtgaggtatctgaagttcctaaaatcattagttttcatctaaagtagcaacagtttcagtatatgtatattgttcaagagaagttgttgacagttcttcatataataagtgaacatgacaaaaggtaatcacttgagttccagttgcacaatccatgtagaaaataacactcagttggcaggttgattcagttatctactttcacagttgtaacagaattgagcaaacaatacataacttgctcctggctaacagactaaaccagaaagtaaataatgtaccatagagttcgagaggctagagattaggtgttacctagtcttcggttggctgaattcttgacatatccgtcttgcaccatttttttcaattaacttacaaaccatgttctggctggcctccccatctagcttgccatgaagcttgcctactgacacgtaatccattggaagtgcatggtacagtgcctgtagcaacgatatttatgaggagaaatgacatgatgaccttcatattgccaagggtaagcgacagagatacaccttcatatacatgagatcaccattgctatttttagttccttcgagaaaggcccggggtcttcccagctagcaacgcaagctgcgagctagcccgtccgggttcaagccacaccccctccttaattcaaaatcaatctagtccttcctaaattggtcccatttttagttccttcagtaggtgagacattttgcatgatgacctctttctttatgtggtgttgtaggatcagcaatctgaaaccactctatgattttagtgatggacagcaggggtggaggcaagcctaggacagcttgggcttaagccctaggcttgcctccataaacttgcctaaatccttttaaatcaccatgtattttttttgagaaagccaatatgagctctacttaagctttaggcgtagaaaatttctggctccgtcactaatagacagtacaatatgccacagggtaaaattaaaataa

SEQ ID NO: 82492 - DNA, 6966 bp, Oryza sativa
atcttccattccccaaaaaacctcgcaaaaccctcggccctcacccgccgccgccgccgtcgcctccaccggtaaacggcagcatgaggtgagcgattgctcccctcctcctcctcctcctctcccatcatcacttcggctcccgattcggcggagaaacccatactccgcgccgcccgcacgcgccgtccagcgccgggagcggttagatctggagggggcagccgctgtgcacgcggggggaagatccccggcagcgcgagagggcccgtggggtcccttccgcgggcgtgggcttgacgctagggttcgtcgtgttttgatttctgtgggatctgtttgttgctagggttggggggttgggggttggccgtaggaagtttagatggtttttggtggtgcgcctcagttcacggccatgtccccgcgcacgtgcgcgggttgcccccagctatcggtgtgttggtagatctctctgctttggtttcccactgtgtcgggttggttaattatgcttgtgcggcagctactgtttaggtgtagctcgtgtggtttattgagctagccagggttttatttggttaattggaggtgatcatctgctcgtatagtcctatagttaacgaggataacttcgcactgacgaccaggagtttaataataaagtaataataagctcaagtttaatagtgggctataagccaagtagccaaatgtaagcttatgtggaagagagagtttgaaaaatgaagagggttgggtctcagtctcatgtaagagctaaccattcacatactttaagatggataagttaattgtatagatgagatagagaggagaagaaaaatatagataagcttatagcttatctactatgcatgtcaactctaatatgtgctataagttcatagttggctttattattaaacttgctctaagttggttcatgccatggtgcgtgcagcttctgataactgttaggaggcaattagtttatctcttattcctagatatctcttattagtagatatttctgtgcctttgtagttttgtctatcgattgtgatatttttaagagattgaaatctggtttgtaatacatttttgcattagtgctttctcattgtaagtgttagttcatgttcagttgtaggtaactctgatactgatgccaatggcaattgtgtctcggtattctctaaggattctttgttggttttgctttatgataggattaccagacaccaccattttatattcattaagaaaactttcatttttatcagtattttgtataatactccctgtgtttcacattataagtcgttttgacttcttttccagtcaattttttttaaagttcgtccaagtttatagaaaaatatggcaatatttccaacacaagacaaacatattaccaaaatatattcagcattacattttagtgaaactaatttggtgctgtagatgttgctaaatttttctataaatttggtcatacctaaagaaatttgactagaaaaaaagtcaaatatgatacggagggagtacttgtcacttgttcatatagcatggatattactggcacacagtaaacttgtggatttttgtaggctgctgatgtatttgtattggagtttaacctcaaagggatctaaccctcattcttttgcttcttgtaaggtgctcagaattgaattttttttatggttttctttttgtttcctgtagtcggcaccctgaagtgaagtgggctcagaggattgacaaggtttacataactgtacaattagctgatgctaaggatgctaaggtcaatctggaaccagaaggtgtattctctttctctgctacagctggaactgatgggaacttatacgaatcaaagctagagttgaacgacaaagtaaatgttgaggtaatacatgctcgtgcaatagctatatgactgcagtttcctctatattaaaatgcgtggttccttatcccgtgtttatttgttttgattctacaggagagcaaaataagtgtaggtgttaggtccatattctgtattgtagaaaaagctgaggccaaatggtggaagaagcttgttcgagatgatcaaaaggcaccacactttgtgaaagttgactgggacaaatgggttgatgaagatgatgatggtaagctatgcacttcttttgcggtgataaactgtggacttgttttctcatgtttgacgcaactagtagcagcataatgagaacaagtgagatgaagcaagtgcgcctaacatgttagaatggagtatcatttgatcatagcacataatgacatgtttgaatttgaagaatgttccatatatgtttctctttaaggcattccatttgtttttcaactggtcatggtaaaaaaaaatcatgcgcaggacaaactgttattactcgttatgttggatataaacctacattgtctcactcgtttagattccacattcaagccccaaaactaatatcagtttagggacctaatctgctcttataatatattattttttaacttaattatatagatattccaggaaatttaatctggccttattaatgtaaataagcccttgttccttatccaacgttttgatatgcatatattttattttttaggtgctgatgtcaacgtggatggaatggacttttcggtaattagttcttttcagatttcatgtttattcctagatttcctttttgctcatgcatatattgttttttaaactaatgtttttctttatgtctttttttatagaattttggtggcatgggtggaatgggtggaatgggcggaatgggtgatatgatgggtggcatgggtggtatgggtggcatgggtggcatggctaaaaagatgggtggcatgggtggtatggccggtatgggtggcatgggtggcatggatgagttcgaggacgagagtgacgatgaaggtttgtcttcctttattgtgtccacagattctcattaatatccacttgtttctattagctatatgatagcataatatgattctgtgaaaatataaattaaggaagcattatttttgcagtttggtaagattagtatggtttagtttgaactgcctgaccagatgagtgatatgactcatgcacgtgacaaatgccattaattgaaaggccaattcttgaaaaatctgcaattgtgtgattcgtactcttaacagcagtgatcaaaatattgcacctttcatgcttggcacatataaatgcaactcaataggataaagctatttttttcatcatacaggactgtttcttgatattgtgattgtagaagtaaaagtgctatttaatggttctcctgcacattttggaatagtttggcccgaattatgttgttcatgctgtaactattatggtggtaattagtctgatatgtttcttacttgcattgattttgtgataggtatgatactaaccttaatcacatgcatcaaaagtttcttaaccattatacttacatactggttaggaaactttttgatgcatgtaaagttagtgtcactaggtgcagattaaggttagtgtcgcgtgtactcgtattcatcatattgtacttacgtctagagaactgaagcacattcccaagaaattgcaaatcagtttgtattcatcatattgtacataaatctagagatttgaagtacctccaagaaattgcagacttgaagtacatctaggcatcaattataagcaatttaaacaactatgttatgtcaattaagttgatataagagtgccagttatctttgtttttttatatatcttagtaccttttaattgtaatcttgcttgttaaaagtcctcatgccatcttttttgactttgttgctcccttgtttagaagaagtgtctaaacctcaagacgcagagaaggctgctgaagccggaaaatcccaggagtcggacgctaaagccgagacaagttagagcaatcgaaggcccctctacataattcctttctctgttgcatcccgtcttttatggatctggtgaactgaagaaaacattttacgttatgacggtagggatgggtgctcccttgtagaacgatgctatgaaactggagctccaactgagtacgcaaaccattcttggattgtttttcttaatgcgctttgatgcttcatcgctctgcaatcatatattaagctttggatgctttaatctgcttttgtgagatactgctgtgcccgtgctagagtccactgagcatgcaacaattcatgtgatctgacgatgcttgtgctagacgagtgaggcagtagcactgttagttcccaagcttgttttgaaaggatgcatagtgaatccctatttatttgtttcacaactctgttctgcgctaattggttgaccgtgagaccttttggccagcgtagaacgactactacctgtttgcatgtggtcttacggtcaacgtgcatggcaggatgtaagtaaggtccctgactcctgctgttaacagagtaacaggaacagggcttttccggaaaagcccgcattcatcagattgaggcgaacgtgaacaaacgtttttaattgaattcagattaaccaacttgttaatgcttgttcaattcaaacgtaatgctaaaaaggggcctaacacaacatttaggagtgttgataagagtgtcaccctattagtactgatttattccctctgtttcgattaaaaataatcgacgtattgtagaaaaccaaaaattatcatcgtcgtacttcaaaggcagcacccgacacatctcgcatatgcgcttcgttttcttatcctcgccgcttcgtatgccaaaaacctcgaattttgttgagaattaatattatttttatggaaaatcgcaaaagtagtggccaaccggggaaaatcgcgaaagtaggtccctgtcgaacgggtgcaattcgatagggcacctatcgaacgacgggcagtcgacaaaggcatgtcgaacggctggcgttcgacacgctcacctgtcgaacggagggagttcgacagggcccaccacccggcgccgcgaggcctgtcgaaccgggggcgttcgacagggccctccaccgaccctgtcgaacaatgggcattcgacaagccggtttaaagccccgtccacccaggccgcgagttcgatttgttttgaggaccacatcgccagccgccgccgagagtcgccacatcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgtattgttcgatgttagtatgtatggttagcacatatttgttattgctaaatgttggtagaggtatttaagtaattgtacggttaaattagttcttagttagtacatattattgatatgttgtgtgttaaaatagatacaaaggtgttatattttatttggattattaaactagttgtttgttactaatagttgtaaattagtacacggcaatatagtataagttataatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaataccgtgtggccagtgaggggtcaacatgaatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcggactgagcaaggtcgaggggaagaagtagtagagggtaatacacaaggagaggtcattgttcgtggtactaatcgtgaggccaacgactcggacgatgaagaaccggattcgcctatgcgtgttgatgcagcggaggagaatgaggtggtagtggatcagatggaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtaggttcgagggttgagcaacatacgtgtttattggagaatacccgtctggtgcacagaaacctgacagcggcatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaactcatgaggattcttatcacaatcttcccccactattggaggtgatgcaggcaagaaacccgggcacacacatggctattctcgatgaggtgaatgaa

SEQ ID NO: 82493 - DNA, 11083 bp, Oryza sativa
  unsure (1)..(11083): unsure at all n locations
cggtcagatagcggtccatggtgatgggtactcctccatttgtgtaccagcaaagttgtaaaaacgccgcctatcaaacaatcaatgttgtaccgtagtaacgttaactgtatagaaataataggggtgttattttaggaaattttaagatacgatagatatatatactactggcctatattttacatttttttcgttttgtattttgtagaaattgaaccattaatatcgatgagagataccatatacataagataagtactcttactactcatacatatattatttgctattatgtcatatatgtcttttttttcttataaagttttctcttaaattacttatccgatatatagtccaattacactattattttcattgcaattaaatctttataacttacatgattatattttgatgaaaaatatttatgtttgcaaaatacttttattgtatatgtatgttactttgatcatatatataaatttacttttagatttgattaaattacttcttatacattcataatgctcttagttgattgattttattattgtttttagtcaatttcatagtttatgatatttaaattaaatttctagatatactcatatttttatattttggatggaatacagagagtaagaagttttgatctaagaatggtggaaattttgtaacgacaaaaaaataataagtaatgtaattatatcaggaagcccaatcggtagaggtaaaggtgaaaagaaaatcggttttttaagcgtgttagcggggggctaaacgaacactccgaagtccgaactactagcacatgaatcatcaagaattttgaattgcggcactgtatttggtgagtggtgtcaggcaagcagagtgacggtgccgtttgtttccgcccttccaattgcctgtgtaaaaggcagcgtgttggtgtagcagaatcagagacggcggcgcaagccgacgcgcgggagcagacagtcgcaacggggtggaccgggctggcggagaccgaccccgaccaggccagccacaccgccgccttctctcagcctcaggtggtccccacccccgagcatcaacagcacgggccacaggtgctaccgccgtatacagaggatcccgactcccgagccacccacgcgcgcgtaccggttacgcttcgggcaggtggtgtgtgggccggaagtgggcgcccaccggccccggtgtggctgttccgcggcgcgggatcccgtgcgccgtggcgccccgccacgcggcgccgtccggctacggtctcgtggatctccgacgctggacggcgtgggcggcggccggtttgcccttttctgcgcgaggattattccgtttccgtacctcgcaccagctgctgcctgctgctgctgctgattcccttcggcgccgctgcaccggcgggggcttagagcaaggttaatggtgcagccggctaatgacggtaaaaatgaccacgtcagcttcttatagctagtgccaaaagttaacgtatacaataagcagggttacaccgactgctatccttttttttaatcttaagtttccccatccaatttatcttcttgcttgttgcggtactgtacctattttcccacctcctgcttgaatgggttgctgccagcaacctagcgaggatgtgttttcacaagctacgagcatgacacagatagataccagttgctagcgaattgacaccggcggagccggagaagccggcggatgagtggagcaagggtgaagtaggatgacaggcagctgcacgggaaacgctgtaccgccgtcactccagtcatcgttcgagctcgcaacttctctctccgtcgccacaaccctcgagctagctgctttcgtcgccgccaatggcaccgttgtgtgacctcggagctttcgtcaccaccaacacagccaacgacgtcctcgagctcagcttatatctcgccatcaacgagctctctctgctatagttcttgttgcctcgtcggcgagctttccgctccatcgtcgtcgagcacttcgcactcaagctcaccacggtggtcgccgttgcgctgcctctgcattctcggccggttgccgttgcttcatcttgccatttccgcttcgcctcaactcgcgtggacccacaactgtgtggcccaatcatagctaacctagtgttgctgcactgcgttggagcgcgtgtatagtcggcgataatttactcgccggctcacgctctctctcctgcccagctcatcaacaaatctgacgtggccgttttatcgccggctaaaacagcctattatacttgctcttatcgtgccacgtcacggcgtgtagcggttagtcctgcgtggacgaacgtggcactgcacgacagcacgagacagtcgtgggaacgtgaggtagtacttgttctcagctcatgttgggaacccttcctccccgacacagaaaacgaagtttgtttattgcatgattaattaagtataaactaattttttttaaaaaaatggattaatatgatttttctaaaaaactttcatatagaaagttttttataaatcacatcatttagcagtttgaaaaacgtgtgcgcggaaaacgagagaggtgggttgagaaaatgggggtaagggcatgtacaatggttgtcaatagtggtctcttagcgttgctaattaggaatacttgttgacatggaggaaagagaaagaggagagacaaaacatcgttgttatgcatgacaacggcttaacaacgactcttagtcactataatatggaaaaatggttgcatgaggataaacatatggaaagaatattaacaaaaggaatttttttgagttaatgattagagactttgttgtctcaactattgtaaagacatggtctctaaataatcttgtattatttaagagaccatatccgtctctaccattgaacatgccctaagaacacaatcctttttcttttctttcctaataaaagtgttgatgagatcgtgtaataccaaggtctcattatttttaaattaagataaagatcttatcttgattttcatgttttttctaaacagttaaaggatgtatttagtgtaaaaactttttatatctcttgaaaaaaaacttttatataagttactttaaaggcaaaattggttatatagcagnnaaagtttacntttttggttttatggcaccaaaagttaccagttcactttaatagcacctaaagttcaccatgttcccatttttaacacttccatcaattctcgatcgttttccgtccgtcttgatccagccacacacgatatgacgtttgtacccctcacaagtacaaatataatgcatgtcaatgaggggtagaaatgtcatatcatgtgtgtggctggatcaataacgatcaagacggacggaaaaaatgacggaagtgctaaaaatgggaacagggtgaacttttgatgctattaaagtgaaccggtaactttcggtactataaaactaaaaacgtgaactttcgatgctatataaccaattttgcctattttaaaatatcaaataaacatattcttcaaatctataataattaatgacatggcataaggatatatatttgttgcatgtgatgtgctaataagatactccctttatctcaaaataaaccaacatcataggatgcgacacatcgaggattattcagattcgttgtggtcatatttttatttagattgagttttttcttgcaatggatggggtatttctgattcccaatttttttttaacgaacaacactagacggtgcgatgattcgttgaatagagcagaaaaaaatacaagactagtaccctggaaggcaatatcctgtgtcagagggtgaactcctcaagcaggggatagtgaggcccccctttgttagttcggtcgggggcagcaggtgagaatcgaggactctatggaatggcgtgaagtggagggggtctggcccctcaggaacgaggagacaaaaggggtttatacaggttcggcccgctgagaagcgtaataccctagtcctgtgattggttgatgagtgtgagttacaaagtacttaagtcgcgagacccaagcatgagttcgccaaagaatcgccccctctccctcaccaagcctggacctccttttatatctcaaggggctggcacgtgggcctagaagtctacctagggatgagggaggacattctctacattaaatgcatgtcttgttgcttgacttggaagccacacgcacgggcgccatggcatggggcccatcaaatccaaccggcacaaggggacacccgtgtcattcaccatttaatgggtgaagacttttgggtcctcacttgcgccggaaaacggaaaccctgctttgactgggttagatgaaccgactccggctaggatcatcatcatgacgtgacggattaggtcagactgcatgccgcctgacaagggagtagtacataggcgcaatactccggtcccatcaatcattcggctggtcacaaaccggtcaggcgcacaacacgccgcatgcggcatggcacgcccgctcatgccgccttaaatgtggttaggtgggtgttaggggcgcccacctaaccccgcacatgcggcgtcatgcagagggggtcggggcagcctgaccccaggcatggagggggccgccgccgccctatcctaggcccgaccctccctcgggggagtgccacgtgggtaccggggacggcctcctccctctggtcctaatacctctgggctcatatcatcgacagcctagaaagaaaaaaacaccaccaccatacaccgacaacgtctttatagaacccaagaaaaagttagcactggaccggccatcgctaagcgttaccgactgctgctagatcaacaaaagagctaccgccgaaccgtccaaaaccaaaacctaacagcgagcaacgcactcgactctatccatgcccaaattaatgacaaggatccccaaattaacatgtacaattttgttgcctacggaaaggaagaataataaagacgccaaaacgtaaaagtaaaaacaacaaagaggaaagctagaatcatccactgtcatgtcatctgtgtgaccctatagagcctggagtcctggatgcgatcgagatagctgcatattcggtaaaatgatagcaagctggcatttttgagaccttcgctttcataattgggcgcagccgattcttgtgctaaagctaggaattccaacgataaggcttggaatttgggcgagtgaacaaatgaaaaatctagtcgaactcttctgatagcacgttttctctacgtatgtacagtactcgatcaacagtagtgccgatcgatttctgaactaaaaaaagcgctctctttagattcttgatctggcgacccctcacggccattccttttatcctgcaaccaccttctagaagcaaaagctgagctgtactgggcaaactaaagaggaaaaaacctctaaagcactactcctgctaatctaaaaaccctttgagattaactgcaattaagacctagcagctgggccagaattccagatcgtcatgcatggggtcgccgatgaggtggtgatgagtcataatccgggcaggagaggaggccaccaccatctatcttatcttaatccggagaaaatggacgggttagatagatgtacatgtcatcctaatgaagccatcgatccatttgggataagatgacatgtaacgacagatagatcgatctagtaaagaatactaacctcctcggcagcccaaccgacggcgcagaacgtggccgtgcgtcggatggttgacaaaagaagccagtacaaccagtagcctataacgcggggcatatgatatgatgggttgggaacatgcgcatgcatacggcaaggccatgtgttgggtagctaagagtctgtttggtttccagcgacttattctaagtctctgtcacatcgaatgtttggacactaatttagagtattaaacatacactaattacaaaacccattccataagcttggactaattcgcgagacgaatcttttgagtctaattacgtcatgattttgataatgtgatgctacagtaaacttttgataattatggattaattaggcttaaaaaatccgtctcgcggattagctctcatttatgaaattagttttttttattagtccatatttaatactctaaattagcgtccaaacatccgatgtgatatgggctaaaaagttttagccccatctaaacaccccctaaagcctcggacgatatcgatgattctgatcccattatccttctggagctatgcatgctagctttggagttggaaggggacaacgcactttatgcgtgaccagtgcctggatggtcatgtggatccgattctctctcgaagtagtagtatatatgcgaattgaatcggccgtgtaagcacatggtagatgatagaatagaccatcagtccatcacccaacatttgctatcatggatggtactatttgtgtggtattgattctaggtgtacattctcagtactttattagttggtgtgggagtcattggtagtttggtacccttgcggaattcgctggcgcgcaatacaacagtaatgagtaagtacctctgtttgcaccgtatgttttctttattagctttgcaatcttatgatgggatcattgtattagtctcttaggcatgcatgtgagcaagcaatgagaaggatatcactgttcggggttaagaatcaagtgagtaaaaataattgggaaaccgacgtgtttactttgtggtcgaccaggggaatatcagaatatctgaatatgcgaatgctgaataaccgacgaggaagaagcattctcgcattcagtgcaacgccgccgaccactaccactagctgctgcagctgcacgacgccgcgggccatttctcgtgaagcaacagcaccggattttaaaacctggcctggtccatctggggagtggagacatcacgagggagtaacgtgctggcattctcggttctcctacccagagcatttgtggttgtgcatccgcgcgtgtacgcgcctaatttaggcctgtttagaaggccgcgttcttttcatctagccggtttggatgattagctatacgataaaacgaaatataattaacgtacgattaattgagtattatgaatttatttaatgttttaaagcatctggcagtgtagttttgccccaaatccttagctccccagttcctgacgatgtatgctactacttatcttcctaaacacgattttagattgggaaaagaacaaattacccttgaattaataggtaagttcgagttatagaccataaatcaaacatctttcactctcaaatattaatacggttttggtcctatatgacagtctagtcagcaattcttcttttttaaatcagcgagtcccacctgtcaatctcaccctctctttcccttcatctttctatctctttatatctccctctttccaaaatcatcactctctctcttccccctccctcacctccgtctctctccatcaaggacggtgacggggagagcttggggcagcatgcggaacttgggatagccgaggatggcgagcggtggccaaggagaagtcacgtggcatggaggaggcgcgtgccggaggaggccaaggaggagccgcctacgccactcgctgcttaccacccctagctgcctccactgctcaccgcctccatctcgttgcttgccgctcgagctcctccgccccgctgatttgggagagaatcagagggataagagggaggggtgagggagagaatatgacagatgagtcccaccgttctttttaacaaaaatattgagtggactgccacgtaagaacaaaaccactatggtatcagtggttgagggtgaaagatatatggtttttgggtctaaaaggtataatctgtactcacccaatcgtttaaggggttaattaagacttccccttctgaattagatttgtttttttctccttgatatatgggctggatttggcattgtcattctgtgtatacttatatcaggactagtaataatgcacgtgcaaggcacgtttttccaaatgtatatttaaattaaaaaaagtaaaagtatgggaagaaacagtgcttgcaagggcatatttatacattgacttcaaaaaaatggcaacggtatgtccacacactaaattcagatacatttcatgtaattctaaaaaaaagatacattccatgttcaaccttaaatgataataggagtatattgtttacacacattgcaatggctaaggtcagacactaaacccacacaaaccttacattgactggagaatttctaaacttccggtacttgagctatgagaaattcataacattcattagctcacagcaaattaaaacattgaacaatatttagatgcttgtcgaagttcagattctaaattcagatgctcctacatcataaggacaagtcagaaactaatatgccaaatgctcagaaaataatatatgaaatgttcaaacactaatctggcaaatgttagacatctaaggttcacacatattgcaaggacaaagactccaaatacagaaaatgaatagcttgtttgaggtatatatagagaatttgtcatcagcacgacagaaaattacaacatttttttttggaggacacaacatgagatgtgattggcaatttttttgctcctaggaaatttgtaacaaaaaaaaggaaagtgttccacatttctaaaggctgtcaggaattattaactcagtgcataaccaatagttcacagggaaaatatatatgcctgtttatgtttaatagaaacaatacattaattacactacacaggatgccatataatgcaaggccaatttcagaatgttgtcaaccaagttcttgagcaatgcaagcccaagttcagaccatgtaaaactaaattcaaattcatatataaagttgtatgacacacaaagaccataaagcctcctaattttggttggagcaacagcaaacatggttgggtagagttcagcgaatataaattcaataggaacttaacagtagattataaggaaaatgacatgtaactctttgaattgagattgagcagagagaaccatcagcatacataagtaaaatgcaaatttcagataattcacaaatagtcaatagtgttgtggtatgcatgtggcaaacaagaacattcaggtagataattttgggatttcatatgtgtgcaagcatatgaatgtcaaatattattctgacagggaattatgtgtaagtaatggcgtccttcaaacctgcaatcgtgattaacttgctccatttaagtcatgtgcatcaccttctctaatgccatcctccagacctacaaccctgattaacgcgcttcattgaagtcatgtgcatcacattgcctaattccatcctccaaacatgtggtcagagatgccaccaggcttatatgaaggttgcctcctctcacaaagaaggaaaaaaggaacgcctcttagcagcatgtgacaatggctaggataatcccggatcaaagccaatataaagatgaaattatgcatgttgtagtagtgctagacttctggagcatcatggaatgtgttttggtcgtgtgcccctgggtagaggttgggtctatagcacatacttgtgcatcaaaataaaatatcttatttttctttaacaaaagttcatgtgtttggagaatatatttgtccttggatctacccaaaacaaaatttgaagcgttaggacaaaatcaccaaaattttatcaattcaccagcagctgctagctaggagcatataaggcttgttaatgaaaaagtaaacactcaaattcctagcccagaaaaaggaagaagttattcctattcagaatcagagttgttccatgcccccttgcatacactaagctgagtttctttaatatgtttatactacgcaaatatatgtatgtacccttatctgaccagtgaccaataaccatagtaaaaattagtaaaaacttaaagcaaagaaataatcctgcatatatgaatattacctttttgttgtgcctatggagtatattaattcatatatatcaaccaaaggccaatcaatggtaaataacagaacaaaatctccttgacccttctcatagagcatcttaaagccaaaagccatcatctgacaagggcctataaaaaatgccttccatcctgttcacccatccccagcatatctgtataagctaaagaaatcaaatggtggaatgcagtataacattagatcagaaattaagatttgctttttattaggctacaaaaataaaatctaaacataaaacatttcatgttcccagtaataaccaatgaaaccaacttttcaacttcaaccgcatccttgagtagcaaaaatgttgtatccttcattttttacgcaaattagctttctttgccagaaatacaaaaataatggtttgttataacatgggaaattgaaccaaaagggacaaagaattagaatcggcaaatacccattatactgatcagctgcacgcatgctcttgcttagcacctgtccggccagccaccgcctgatgcatcaccgtctaaccagtcatgcactgctctacattagacaacatgaacacacatgaactgctatattactgagtactcgatttagataattactttgtgaatgactgaacaaatatatatataatttattcatggatgaaggctcacaataatctgtgctcaagaactaaagtactaaacaaatgaatcagaaagggaacatatgaattctcaaaagtgagccgatccctttaatctgatcgaacttgaacaattctcaaacctgcacaatataatttctctataaagtaatctggaagaggcatggcaactacaagtctacaatgttagtctgtatggagcaacaccagtcaccttgataggatatagcctgcaatgatgcacatatggatcgataagaaccgaat

SEQ ID NO: 82494 - DNA, 5542 bp, Oryza sativa
aaaggctttggtttggccagctaacaacaccacaactaccgtatcaaaagctaggcatcacgcagatcatcacgttggctccccatcaaggcccccacccacagcccacacaaccactctcacacacagacgcgcaccgtagagcatcctaaaacagtgtcaagattgcccacatcgtctgaaagaaaaaaaaacacgacaatcaaattcagatagtaatgctactccctccatagtccatccacgtgtgtagagcatttctaagattgttatgacattattaagaaggaaaataaaagacttttgatgcctcttattcaagtgcggttgccatcttctgattagacaagatgaaaggctgaagcctgtggttcgacgagaatttagtgataggtggttgaaaggagatagaatactttataaatttcgtgtacaaattttaaaggtacttacatcgttaacggagaccgttcaaaaatatagcagattcttctaaatatatcaaccaattacttataagataaaaaaaattaccacttaacttaattatagtcccaacaagtctcgatctatattcctcacttagagcaaggttaagatagcatgttattagctgaccgtgtcatctatagtaagcatagtaactaatacctataatatgaatattataacataaatattttattgttttatgggatccaccatcttttttcttcctcatacctcatcatttcctgtattattctctttctccttttcttaccttcgattcgtcaacgattttgggcttgagcagtcagcgaggatggacgatgacggtgatctggcggatgcaggtgactacggcggtctggcggacgcaagagacagtggttgtcgtgcaagacaaaggcggctgtgtggtggaggcggaaggtaacggtgcatgtgcggcggacgcaaagacggtgacagctgggctagacgagctcagttgtctggtgaacgcgagagacgatggcggctagggtagatgcgggagtcggcgccggccaagccgagggtgacagtccaatggacacgatggacaagggcgttagccatggagtatcgaggagcagcaccaacgcaaaccatggctgatgtaggaatgcttcttcatctacaggcgagccccacaacttctttaagcagcgcgtgcggcgacaaattagtcgtgggcgctctctcttcccccctctcctccaattcatcacaaaatcctacgtgaaactaataccgttcattattgtacccgctcttattttatagagcaatctttttatccatctcgttttatccgtgtgaaaggctaccaaatttttgagatggcaggtgtaggtaaggttagagcataggaatctctcagcaagaacatacttcctccgtatggaccgtaccaaaaaaaactaacataggattgagatgtaacgtaacctaacataacgaatcttggcagaagactatctagatttgttgtgctaggattgagatgtaacgtaacctaacataacgaatcttggcaaaagactatctagatcttggcaaaagactatctagatttgttgtgctagattatgtccgtccttatattagattggatttttttaagaccgagagagtagtggccaactggggcagacaaagctactggtgactaatcaggttggtacacgtggcgacttgtgatttctctggggggccgtaggctgcggttagatggcagggtcaacctccttatcggcgatataaatggcgataagatgggccatgcatgtcgttgacaatgatttgccatcgcttagctgctaccgctcccacaaccgacgattccttgagacgttttaaccgtacaaaaaatgaagggtaatttctacagcagcagtagaaattactgcctaaataaacattttcaaaaatttatattatcaaaaatttgataaattgacaacattattaagttttgataggataaattaaatatgatgttgctaaattctctatataacaaagtaaatatcgttatatatttgttaataacaaataatgatacgatttaaattaattgaacatattagtactacgaagaaaaaattactgcggctagatattgacaaatgaaacgacaagacgtcaagccgggacaaggaggaagaagaaacaaacaaacgaacccgtgtgcgccgtcgcgaacactcgccgtgagaaggcccacggcgtcgtccatcaatcagaccatcaccaatcggcgagtgaaaaaatacaaagaaaaataattgtatgcacgaagcactccagtaatgtaattttttttccaatagagtaaggtaggtaaaaatcgagcactaatgctacagtacactctcggtcttggcaggtcgcgccgaaatattttctaggcctgagaagaggagggtaaaaatgcagtaaaatccgacgcggtaaaaaaaaaaaaacagtagagggatgcgtgtccccctactgggccacacgtaccgtagccgcagctgcggtggtttttttttttctccttcgttttgactcgtcgctgcggctacgcgcacgcgcggcgcgccccggtggcgtgcggggggcgttggattagtaccgggcgagagcgcggcggagcacctgggcgaggaggctgggggcgctgaggtgggggaggtgaccctcggtctggaggaactcgacggtggtgcggccgccgaggtgggccttgaggtaggcggcgacggaggccgggacggagacgtcgcgggtggtctggacgacgacgcagggggcgcggaccatgccgagcacgccgcggaggtcggtcttgaagacggtctggcagacgtggagggagatgtccgggcgcatgttgaagagggtgcggctgaactcctgcaccgccgccggcacgtcggcgcccaccgccagaggcgcgtaccccgtcgcccacgccgagtagttcgcccccatcgcgtcgaacacctgctgtatctcctccagctcgaacccgccgtggtagtcgctgtcgttcaagaacctgcacacacatgtccgtgctccccgatcgcccccgatcagattcaattttaagagcgagaaaggattcacatcagtggaagcgagcgtaccggggagaggcgccgatgaggacaagcttggcgaagaggtcaggtcgtcgaatgaaggcaagaatcccgatcatggcgaagacggagtggccgacgaaggcgcagcgcggaatgcggagcgcgtcaaggatggcgagcaggtcgtcgacgtaggcgtcgaggttgtcgtagcggcggaagtcgaagtggtccgggttgacgctgccggcgcagacgaggtcgtagagcacgacgcggtggtcgcgggtgaggtacggcagcacgcggctccacgccgactggtccgtcccgaagccatgcgacagcaccaccacccgctcgccgctccccaccacccgcacgttcaggatctgcagcagcttcgccccgctcggcgccgccgacccgctccctcctccccctcctcccccgccgcccaccatcgtcttctccgagctcgacgacgccgacgaccccccgcccccgccgccgccgctgctgctgctgctcgggctactgggcggcggatgcgtcgatcgcagcatcacaccagcgcggcggattggcaagccgtggcgcgctccccttttatatactactactactactactatcaccactggccatgggagatggtcttgactcttgcctcgcttcttctctctctttcttgctttgatttctctctctgctttattccactgtcttaagcttcgttgggtgcggtggtagattgggatttttgcagagaaggtgtgtgattgcttcagttatttaggggggtgtttgggttttgtctccatgtccaattatccaatccacagcagataaaaaggagaggcagtgaggcacctataattctctggatttttttttctcaggagaagtttttttttctcttatcgttttgttttatttttttttgacttcacaatcccaaccagagatgccactgcaattaatattactcgtagttgagagttttgacaagctaagaacgtcgctgttagtgtctgtaatgtagcgtttgattatcagcgttaagggaatttttgcagcaaacgttgtagacatattagatgatgttataaatgatttaaagagtatagaggaaaagatgttaagtgaatatgttagttcttctgttaatcaggtacatacttcaaatgttgatagcgagatattggatgatcaggtggatgataattctctacttcaacatttgtgtggtgaattaatggaggaggtgatggattttagtggtgtggatgataattattcttagaccactttatattctttagatacctctcctaatagtaagaaaaagactaaaaggggaaagaaaaaaaaagaatatttttaaatgaaagggttgttctggaattgtgatgggtttaaggtcccgaaaaaacataagtttatttctgatttaacaaaggaacatcaccttgattttattgctttgtcagagactattaagaaagattttagtccggctgttcttaaaaatctgtgtgctggcaaataatttttgtggcattgcaagcctcatagaggtaggtccggtggtttgcttttgggcatcaatttaattaatgttgatattggtttgattgatgagggagatttctacattaagtttcatttatgtaataaagttgataagtttaagtgggctttagttctggtgtatgggccagtacaaagtgaatttaaggatcaattccttgctgaattagttaatatgtgcagtcatgaaaccttaccaattcttattggtggtgattttaatattctacgtacgtagccctgatgaaaagaataatgataattatgatgatagatggccattcctttttaatgctattattgatgggttatgtctccgggagttacagatgtctggtaggaaatttacttgggcaaacaatttagtgaatccaacatatgagaaacttgatagggttttaatgttcacggagtgggaacataaatttcctttatcttctgtggtggctcttaatagagatatttctgatcatactcctttacttttaaatacaaacacttcttctttgagtaatgctcaacatagtttcaagtttgaatttggttggcttttacgtgatggctttgttgatatggtaaaggagatatggtctagtgttgatgaacgcaattctgccatggagcggtggcaggcgaaaattcgtcgtttaagacagcatcttaggggttggtctaaacatactagtggcttgtacaaaaaagaaaaaaaaggagattttagataagttggatttgctagataaaaaggcagaaactatgcttttgagtcaggaggagttggattttagatggttttgtagaaatagattatctacaattctgagagaagaggaagttaaatggtatca

SEQ ID NO: 82495 - DNA, 7556 bp, Oryza sativa
cttaggcttgtaggctccttccaccggtcctgttcggctcagggcttttgttgtttctacaacctcccattccatgtcctccttttcctttgttacttctttgctgcaaaatgcaaatgaagcagcacttaaaattgtgaaacacgatggctaaataaaatcacatatatttattaagacaattggtttagccaagtctagaaaggtaaaaatggtttacctgccctgtataagatgagcgagtcctactgcaccaaacactgtcaaagagataagtggcagcccatatcgaacaaatggatgtttccgtccccaccgtttgaactgtgaggtttgtcgaacaatcttagctgctggttccactggatcagctttctgagttgtttccatggcagaaatttactgaaaaatgttaaaagaaagttaaaagaaatggagcatcttcaaactgaacactgtcagttataggcaatgtaagagagaagcataaaagttcttgcatggtaatattctattttaaaagtgcaaaactatttgactgtatgtatacaaataaacatcaaatattcaaaacattcaaatagcccctcatggcctaggaggaacacaataacatatcaaatgaaaagataaatgcatgtccaaacgtatatgaactatcctgatttatgcagcagcattataatcaacagaaaaaccgaaatgctgccacacagcaagattttgcaacagaatatgatggacaaaagccattattgtagcttcaagttgagccattattgtactgaatagcagaagttgtgccaaagagtatgttggctaagcatcaggagccagcagatgaacctgccccactcattcttgcggctagacggctagtgtgcccagcaacagcaacaaaacaaaacaatattatggtcttctaatttaagtactaaccaataaccatgctaactctgctaaatatgtgcactgataaagtaccaactctgatacaagcctaccaagcttcacaaatccttaaaaaaaatgttcaatcatgaagtaagaaccattcctggattgaaataaaccaaatcctaaatcaactatgaattaaatcctagtttcctaattcattcctaaatcctaaacataaaccatctacgggcagggcagggaatgaggggaagagttaccttcgtccctcgggcttcgtctggagctccggaacggcgccgctggcgctggcgctggcgcatggactggaggcgccgagacacctagagcgggccgccggcgctggcgcgtggaggggccgaagcagcgaagcggcgaccgcgcgactgggacaggggacggtggcaaagcgcgacgcggcgacgggcgacgggcgacggggcgacgggcgggcgtgcgcgggcgcagggcgaagtcgccggcgcggcgcggcgcgtcggtctcctccctggtggcctcggcctggcggctggaacgctggatagggaacgagatgagggtttaggaagtttttgagctttttttttttgttattgggccaatgggcctcaaatagtgaggagaggaggatggtaagccttatagtttgggcttcttttgaatggtagacatttttttatttttctatttttttctatataagtatatactttatatatgtatttttttcttcaaaaatcttggatattcatttgaatacctatgaatcatggtgggcccgcctgagtcgaaccaccaagaaaagtagcaatagaagcagctgtatcggtgtatcgctccctctaccattactgttgtactccctccattccaaattaatcatcataaaatctttttgagaatattccaaaatgatcatcatatttgtgttcattcattatgtttatttgttatttgtgcattgaagtaaatgaatattgatgcatgcacccatgcacaaagtgttttgatttgctattggctaaaaaatagtggggaatgtgtatgcatcgagtttgttgctagaataaatgtagtatgagagagttattatattttcttggtcttaatacacccatgtaatatgattatcaatttggaatggaggtaatacacattgtgctaaactgaactacatctatgctgttcaagagcatgatatagaatctaacataaaattgaatgcctctaatcgttttctccatattctaatccgaaaaggcatgtacttccccttcctgccatattatctattgaaaaattacttaaaaatgagtttgacaaaatagggacagtaaaagaattcctcagacaatgtttgacaaaaatgcttcgaaatggattatttttcgagccaccgaacttgaccaataaagaactcctcagtaacaaactgaggggtcgtagagagcggtcaacagccggagaggtgaggagtgcaggatcaaattaaccatgataactaatgtacagcagacaacgtaattaacaatttttcatccgtaaatatggccaaattagccagaaagagtgaacgacatgtcagacgaacaggaacagccaaactgatagcttgccatattgctataggaacagaaacgcatgatgcaatgtaatctaacaaactgtaacacaaatcaataatgattaaccgcaccatattcttatgttagttagcgaccaagaacactggctgtccctgcacagatgagtgctgtgacccatcatcatagcagcgtgaagaacataggagtatctaaaaacaacatgcaacgtagtaagaagtttaatcaaatgttatatagctatcactgagctctaccagagtagcagcagcgcacccagcaggtgacgtgcagaacttttaaatagcccttttgtacattgaaatgagccggcacatcaaccgcaccgtagcatccttcttcaagaatttgcctatacaaatactagcgcaaaagaagccagctcggtccacccgctgtcaacaatgtccgccggtgagagccgacgaaagctatctttctgtggtgtctgtgttaagtagtatcgtctcgtgtctatactgcttctgatactgatttcctgaatctgaatgctatcaggccaagtccgatatgtcctgctcctcttctttagctttgtcaggtactgttgtttcttctgtgagttcggaggcaacttcaatgggttctggtacagggttgatagggccctgaggaatcccaaacagggtggagaagatctgcctgtggcactcgtcgcagaaacagaagtacgagaagtggccttcatcgagaagtttgtgcactgtggctcctggaaccacccgcctgacgtattcagtaactgacggtggcaccacccggtcatccatcccctgttaagacaaattggtgcgttattgcttcaagaagatattggtaacatgaatgcaagatatcggtagtatgatcttgggaaaggatggtgaagcaagaaatatactggacaattgtagtccacatagtggtaacttgtgtaattaatagtgcctgttcaggattgacttttagcatgtataaaactcaaaatctagattctcagtgatatgcctcagtattcctaaatgatgcaacccaaaccattacaagtggcctctctcctgagctactgtaattcgttttctaacaggtactccgtattactaaagcaagtaggaagcccagattaaagttgtttaaatgggggaatcatcacatgaattgagcaccagtgtatgtacctcgactaatgatgataatggacaaaatgctcatgttttatggaatcacatggtccatagaccaaccctaaacacactaaactcaattctgtatgataccaaactatgacttgagtaattataatctgtttgttttgtcttctatgaacaactgccatcaaaatgccaaatcaattacaaatcaataaatcattttagaacatattacaaacctgccatatgtgtattgggcccagaaatcccacccactcccgttcagcctgacggaatagagatttgatcaattcaaaaaagctcagatcctctctcttctgcatttgaatgtctgacaagctgaatccccaatctgatacttgcagtacagcttcctctacaaaaggctgtgcatctccttggcgcacagactctgcaacatccttttcccaaaatgcattgaacataggactttccagtgaagttttgtcgtgagtaatgcacataagattattatttggcatgatgaagggtcaatgcttttgtaaatcatcatatgtttcaaagcttcatcaacgggataagtgccagggaaaaaggttctaaaattagcatcaagcagccatgcatagatgaattaatagcaccatgcatcacaaaattgttgaaggtgctgctgtcctttgtggaattgatgatgcaattacagtagtactagaaccaaataacagatgttcggggtgaatctgagagcacttggctgtacaggcgtaaaataggaatagttgttaacagtagataaatgataattcacacaatagctgaagcctatgaagttgtgtttatatgataacaataacaaaataagtttattagctgatattgagtaagcaaaatcattggaaagtgtgaggcacaaaatcattagaaacaggtggtcataagttctccatcttcctaaccaccaccctataccaactctactgtaccatcttctgaggtacaaatgatgcatatgctacatgccctctctccaatggataacgacagagatatatagtacagcaaatatttatagggcaggcccatgtcatttcaaagtagtaccgtaagttagcattggcaccttaagagtgcaattagcattgatatcagcgtaccttcttccccagtgaaagtgacagccaactctcaggctgcccttgctttccagaaaggaagcttcggtgataaaagagaggtaatagggccggaaacctccgagctaaaatgtgcattagtttccgcttggttgaccacctctcccatgttttgcgtctttcttccttggtcatcttagagtcgtatggatttgccataggcgcgaacattgctgcacctggattcataacagttcattatgagcattcaatcaaaagagcagactatcatttgtgttgttctaatacacacccaaaaagggttttaacttttaactgagaaaataaagattgagagtataagatgaaattgagatgaaaatagaacttgtcctgatcaaataaaaggtggtgctatgttgttgtttgactgtacccaaatgtactcatgcttgacaaacaaaaaaaaaatccctggacaactatagatgttgctaatctgattcaatagaacatttctgttcttatcaagccagcaagatgattgcacttgaagtactgaaatatacctaaccatcataagtgctgcaggtaacaagcctactagcatgtatactttgtctggaattagggtaaaagtcacaagtatttctaagggcgctcccaattctagccatcacatataaactacaatagaaactatttgcccaatccatagtttctacataattatatgggaccaaataataaatttctctatctttctatccctattatttgttttgtctctagtcttgtgccataaacactacttcaacccccaatgccatttgtatagtgtctcatgcaaaacatagtttcacttcattaactatcttgccacatcatattcggtcctatatggcaagctatctaatgcaatggacactagttgacatggaccattgggagtgctctaagtgtttaaagtcataagcacatgtaatgtaaagatggcctgcctagtgtgatagtgtgaagtcagcgccgtcatcaatttataaaatcaagtagcgtctaatatgtacaggacaagtctacagatagagaaaatcaaataaagacggcgaaagtatctgaggcaggttacctgccactcggtcaggaatgtggcgaagagcactccaagcatgaatgctacctgcagaatatcccacaacccagaacttgtccacaatcctaagggcaccagccaagtgaagcatgtcatgtgcagatgaattcagatcccggcctgggtgaggatcactttcaccaaaaccaggaagatcataggtcacaagtcgtgccccaaattcctccaggagggatggtttgattcctgggattcctgcacacgaacaaaccatgtagatcaaatatgtgatgttgtcatgctgtgatgatacgttaaaccaaacaatgcaacatttggtcttacctgctaacctcgatgaaagaaaagaatgaggagcaatcagtgaaaatcttgccctgtcagctgtgactccttgttctttataagccagatgccttccatcaggaagttgaattgttttggcacttgggggacctatgtagagtttctttggcagttctactggggtatcatcaacactccctacacctaatactgcatacaaaatattcctgttaatcaagcgataaaaaaatgatcccttgcattaagaaattgtttacttggattttgcatttttcgcgaatcaattaaagtccatagcgcattgacaaaatgattgtacaatgtgtagcaggtatataggagggtaaggcagcacttctgggtagaattccacatgctagcatgcatcgagttcgcgtataagcaaccaaatgccataaattcaaaagtaagagggcaaaaagaatccacttggcgagcaatctgttggcaccaaaatagtaacatctataaagccaaaaaaaaaagcagcttgactcaatagtaaacgattgactgaccaatgaccacaatattagacattaggttgacccgccatgaatttcaaactgcccgtaggccactgtgcgttgtaccccatgaaggcatgaacacaagcgcactaggcatggatcccacaataaaaaaaaatctccttgaaataattacacgctttaaccaatatatatatatggagtaacgttcacaacagaaacgccgcataaagagacagattgattctaaatccaaacaaaatcttaggggaaaaaaaggagcaccaaacggttagttagatccatcccctctaatgaccgaacactaagcgtgcacgctcatatcatacatcgtgatgcgcgacggcataaaccaaaactgcacgctgagccgtagtcagagcctctcgcacgcaaggccgagaagatcgtgggtgggggggagagatcagcgggggattataccgatgagcgtgacgaacgcgacggcggcgacgacgacccagcaccagacggggtcgcggtcctcggggaggtactcgttcatgaagctgaggcgcttccccgcggccgcggcggggcccctgagccgccgcgcgagctcgctgtcctcggcgccggcgaggctctgcgcggcgatgtcccacagcccgcggcccagcacccgcagcatctccgccgtcgactccaagaaccccctcgcctgctgcgcccacccttcctcctcc

SEQ ID NO: 82496 - DNA, 3664 bp, Oryza sativa
aggaggagagaaaaaaaagaaaagaaagagaagggtggagaaatagaataaaaacaacatagaaattagagggagattaaggaggattagaaaatttaaaataattagaaattaattatagattaattaaaatgtaggatttcaaaatattactataattataggttatttttggtaatctctataagtaatcaattcgcggtaggaaattagatttatttaaagaattaaacaattaggttgaattcttaggaatgtacttctaaatcacaaaatgacttaggttaaaagacccaacaattcgaataaagtggtttcgcaaactttgtagtcaatatagaaagatcgattcgcgttcgactttttgagttatttggattttaattgaattctaattgaattcaaatcatttcctcgcacgtaattttagagcccgagggagttgcggatccgagcgagggtcaagacccgcaggactacgagcaaggcaagtcatcactattccttgaacatgttgatcccaattgcgaaattattttgtttacaaataaaattgcatgcaatgatgaacatcatacttgtgattatgccatgccttgattattgtttaccccttatgtcttcgtaaccatgtttacgtatgagtccttagtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgataacatgatttgtgaaaagggaaataaaattaaacaactgttttcgactggggcggacggaggatttgggtggtgtccggaaaatgctagtgccgtccccggttaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggcactacagtggggcagccattggtaggaccgcgaggcgggtgtctactgtggtgtcgccatcggtaggactgccatgtgagaatctaaacataattataacttaatgcatgtgtgagtcttcccttcctgggtacgccagaactcctctcactgctagaaaccgtgtacgcctagagtgcatgaggatgtaaagttcatggagcgggcactgccaatgcgaggttatcaaaaagctttgccgtgacgcgtctcatgtgttggaacgaggctcatgtgttgggcagttgtggagtgcgggtaaagtgtacatccactgcagtgtgagtaaaccaaatctattcgaatagccgtgctcgcggttattgagcaccgggacgtgtattacacttggctagactctaaattcttaacttgtgtgggatgagatagtgcatgatgatttttatactgatggagccacttcctgagaggagggaagatggacgtcctcagaaaaccatgacgactcaatggcgggaagctatccttgggattacaatggatggtggacagaactgtcattgtttaacatgaacactaaaactaaaatttggtcagtttatgctaggtcttaggcttgtgaaaagaattacaaaacttgctttgcgcaaaagaaccatagccattccttgaatacccctatcatgtgcattgttgctgtggtggcttgctgagtacggttggtactcacccttgcaatatataaacttaatcagaggccggagatgaagcttcggaggatccctatgcctattaccaggagggtgatgaagacgatggcgctcagtaggtcttagttacggtcgttgcctgtggcaatggcgtgccgctgccttaactccgctgccttatctacttctgcttttggaatgtattccggaccgctcggtccgatgatctaagactatgcctgcgggcttatgatgtaataattcgcactagactctcgtgtatgtgcatttggtatttcagctataaactcatgtgtaccagactacttgatccagggaaatggtactatttacatgattgattcctgttataaaaacgggggtccacacagggagatgcaacgttgtcgtcgaagaacaggagtagtcgcgtttgaagcactacccaaaaacttgatcgcccgcctacccgtgtagacggagttccggaggcacctgctcgtcctgtacacctgtgcgcgcaggtgaacagaaccgggaaaggattatgtagctcaggataatacggaatcaattcgcgttttatttcggagcagacggagttccagaggcacctgctcatctcgtacacatgtgtgcggaggtgaacagaaccgggaaatgattctgtagctcaggataatacggaatcaattcacggcgttttattccggagcggacagagttccagaggtacctgctcatcccatacagataatacggaatcaattcgcgttttatttcggagcggacggagttccggaggcacctgctcgtctcgtacacatgtgtgcggaggtgaacagaaccgggaaaggattctatagctcaagataatacggaatcaattcacagcgttttattccggagcggacggagttccggaggcacctgctcgtcccgtacacatgtgcgcataggtgaacagaaccaggaaagtattctgcagctcaggataatacggaatcaattcatggtgttttattccgtaaccgacggagtttcggaggcacctgctcgtcgtcccgtacacatgcgcgcaattcatggcgttttatcccgtaaccgacggagttacggaggcacctgctcatcgtcccctacacatgcgcgcgcaggtgaacaaaaccgagaaaggattctatagctcaggataatacagaatcaattcatggcgttttattccgtaaccgacggaacgttttatttcgtaaccgacggaatcaattcacgacgtgcaagtgaatagaaccgggaaaggattatgcagctcaggataatacgaaatcaattcacggcgttgtgcaggtgaacagaaccaggcgagcgcagcctgcctcgcctcgcctcgcgcgtgcatgtgtgtagctgtccgcccaccatctcaattggtcaatagagactctcaactagccccgtatttaaattgagacctcttcacttagatttccaagatggtattattacccatagcacttactgtaggccaatgaaatttattatgatttaattggcctagcccattaatctaacacaaaaaaaatccataattaatgaaaaattatattggcagacgagtaggtgatggagtattaaaggaataaaatttcttgatttacaggcagatggtaggcaagaaaatagaagttgattcattttttaagacacaattcaaacttcggaaattggtttattttgggataaagtcatgttgactcatgagtcagacggagtaaaaacgatcggaattggtagcatctattcgaaaacgacagtcgatcggtcggcaatggaccatattcatcatttgaactattcgttgtcgatattaatatgatatagaaagaaattagaaaaaaacaaaatttat

SEQ ID NO: 82497 - DNA, 24221 bp, Oryza sativa
cggcccaagtccctgaagaggccgccggagcggtggaagcggcgtgggcgcggcagcggggacggcgtgtgaaggccgagggttgtcggccccttccgtcccgacggcggcggcgacagcgctggacatcgtggaggcacaactccgcgcgcttccgctcggcgggcgcggcgacggcgctggacgtcgtggacgaagacgacgaccccaaggtgcggctggcgcgcgtggagtggaagctgaggctggacggggcgacgaacgagctggaggacctcgtgggggagatggaggaggccgtcgaggcggagaagaaggcgcggtgctgggcgccgtggcggcagcggtgcaggggggcggcggaggtggtggccgggtggctgcggtccgaccctaggatcaaggtcaggttggagcttgacgtgggaaggctcacagtcaccggcgtgtacgtccaaggcggagagctcttggttcttggatgatgtgactagcgacggtgaaggaatagctgcattccagtgaagcgatggctgcgctcgacgccaaccggtcgccatgacaaccaaaacaaccgaaccgagggttacccgacgacgacggacgcgtcgtcctcgccgtcgccgctcgccacggaagtgactatgctagcgaggagaacttagatgacatgtaagtagcgaaattaatttcgcatcgcagagcatatgcatcgtaatttcgtcgctcgctgactcgcttgccatgcattgtaattaaccaaaccttaaactcttgtttgcatgggcctcaaatcaatcccgaattatccagcccggaatgagggccatcccgagaggatgacacgtgggtcccacacatatttattttaaaaggaaaaagtacgaattaccccacgaacaatcgcggtcgtccaaattatccccctgaaccacaaaaccggatattcttcacccccaactatgcaaaccggacgaattacccccctcgaaccaattcagagtagttttgtccaacgtggcgcacatgtggcaatccagtcagcatttttgtaataaaaaattgtgggacccgcctgccatactcttcttcctctctctctattctctctctcgctcttttctctcgcggctcgcgcagcgcgcacgacgaggacggcgcggggacgggcggtcagtgtgggcggtcggcgacggcggaggcagcgagcgcggcggaggaggcagcgagcacggggaagcgaggcggcggggcagggtagcggtggcggaggaggcgagcggcggcggggtgcggcgaaggaggcagcggcagcggcgaggcgagcacggcggcggaggcggcgaggcgagcgcggcggcggagccagcgagcgcggggaggcgagcgacggggcagggcggcgaggcagggcattggaggaggcgagcggcagcgggagctcgcattgctggaggcgaggcggcggcggtggggtgcggcgaaggaggcgagcgcggcagcagaggaggcgatcgtggcagcggaggaggcgaggcggcgcgcggacggggctcgaggcgacggcggcgacgggtgacggacgacagcgcatggcgcgggcggggctcgaggggagatggcgacggcacgcggcgcgagcgacgacgacaggcgacacgattggtcccatctgttcctccgcttcgttgcgggcgccgtcgtgggctggggctggttgtcgcgcatggcgtcagccgcctcgccgccgccgtaccccgccaccactcgcctcctcctccaccgccgccctgccccaccactcacctcccggcgctcgctgcctccgctgccacctcgcctcgccgccgcgcttgctgcctccgccgtcgccgaccgcccatgccgaccacccgtccccgcgccgtcctcgccgtgcgcgctgcgcgagccacgagagaaaagagcgagcgagagagagaatagagagagagagaaagaagagtatggcaggcgggtcccataatttttttattaccaaaacgttgactggattgctacgtgtgcgtcacgttggacaaaaccactctgaattggttcgaggggggtaattcgtccggtttgtatagttaggggtgaagaatgtccggttttgtggttcggggggtaattcggacgaccgttattgttcagtggtgtaattcatagtttttccattttaaaattctaatgccacgcggaacaaagaccatgtcaaaaccgccacgtagacgccacgtcatcgaaaccgccctttaaaaccgtaaagagagtcaaattgtaccggttttaatagttggtggtcgagatatccggtattgtggtttaggatacgaatcagaaataatccgtccgcatccgcactggcttcgaatccacttagaaaatatagtatagaatatcgtatgacaactatccatccgaatctgatctgttttcatccctctagacttctatcttgtttttatttccacgtccgccactgattgactataaagcgaaccaacctgatttgtgcccagtgaccatatgctgatgcaggctataaactttctgcggttcattcacggaatttccaaaccttcctgatgaagcatctcttggtgggggagcacgaatcgcaaagcactacttcctccgtcccataaaaaactaatctagtatcagatatgacacatcctagtattacgaatctaaatatacatatgttcagatttattatattagaatatgtcacattcggtgataggttcgttttttaaaggacggagggagtagaggagtaaccgccaagtttcctgggcttggtgggccggtcgccaacagtttgtttgaacccagtatcctttccgtggcaaccaagttcccgtgagcccatcctcagccacccgattcccccatacaactcaaatcaacggcccaaaaacaacggaaccacccctcccggaaccttccagaacaccctatagcctcttgaaccttcccgaatcccacctttctataaatccctccaccttctccgacctcctcatcgtcaaaatcacatacacaagaagagcgtggaagagagggaggagaggggagagagcaatgccgacggggaggttgagcggcaacatcacgcaggactgggagccggtggtgctgcggcggacgaagccgaaggcggcggaccttaagtcgacgagggcggtgaaccaggcgatgcggacgggggcgccggtggagacggtgcggaaggcggcagcgggcacgaacaaggcggcggcgggggcggcggcgcccgcgcggaagctggacgagtcgacggagccggcggggctggggcgcgtgggcgcggaggtgcgcggcgcgatccagaaggcccgggtggcgaaggggtggagccaggcggagctcgccaagcgcatcaacgagcgggcgcaggtggtgcaggagtacgagagcggcaaggccgtccccgtccaggccgtgctcgccaagatggagcgcgcgctcgaggtcaagctccgcggcaaggcggtcggcgcgccggccgcgcccgccggcgccaagtgaatccttcgtggccggaatcgcacctccgatccctcctagttaggcgttgatccgtttgtgaatgtgcagtttgtttgtgttcttggcttaattttggggggaaactatgatatgctaactggctcagacgcatgtgaagtgatgatggctagaaattgaatttccgttggatttgtgaacacatagtttagttgaagcgcttttcgatccggttgtgttcaatcgtcgttgtgctctgcttctagttgtgactagctttgttctctgctcatatttcattgattgatccaagtgattcttcctgggaatcgcaagttcgcaactccgggcctccctaagttcctagttataggcgttgatccgcgttgtgaatgtacagttcgtttgtgttcttggcttggtttggggaaaccatgaatccatgatgctaactaggcgtatgtgaagtaatttctaatagaaattaaatttaccggccgaatcgttgtgctctgcttcttgtgtgttgtgcggtgcctagcttgttccctgttcatgtctcatcgacagctcaggttgctgctacctgtccggagctttggcggtccgtaaaattgatcgagtcactaactcggtgggttcaattaaccaatgtttattcgttcatttttctcggcttgaaacggatgaactccagaagagcatttttcggcttacatatttgtaacaggcttcacggctgagtttttatcttcacttttccaaccaacatctctcgtttttaaactgctaaacgatataatttttttaaaaaaattctatataaaaattattttaaaaatcatattaatcaatcgattttttaaatttattttaaaatatttaattaataatacctaaatgttgttttgttttgcatgctaggaagtgaggttttcatccctcactttcgaacagagccttaaagtatgttgattacagccactggtggatcgctgctctcgcaataggccttgtcacttaattctgccaaattatggactagttatgttttttttttctttttggtacgcagaaaaatatgtttggtttgctacattgacaaaatatgactatgctaaattatgctaaataatatttgtgtattatttgtgcggtattggaagtattggtagtagtaaactaagcgttgccaaaaattaatgcttaaaatgcaaatattttggtatggcaagttttgacttccaaggtaaaaaggagaattttggcttccaaaggtagtataaaaaggaggagaacaccaactggcatatacaaggaaaataatggataatgcaacttattgactctctgtaataatcttccaccgttacaaatactccaccacccagcaaatccaacaacaccaacatgtgtacatacgcatggccgactcgatcggcgacgagatccagaaagaactcagaaccagggggagccatggacgggggtgacgacggacttgacggcgaggaacttgtcgagcgcgtgcatgctgtcgtccttgccgaacccgctcatcttgcggccaccgaacgggcagctcctgtccatggcgaagtagcagttcacccacaccacccctgcccggatcgacctcgccatccggttcgccacgtcgatgtccctcgtcaccagccccgccgccagcccgtacctcgtcccgttcgccctctcgatcgcctcctccaccgtcctgcacccaaaattaatctctcttaccactatagtagtttcttagataataaacattttgaattgatatgacatatcatggtcagatcctctgcgatcgaaatcacgtaactttgtcacttacatgtggatccgatgatccctggatccacaagttagtgataaaggtaccgtgtatttgactagagaggatggcgatccatatatatagctgggtttacttgaacttcatcaggcacatgacggggccgaagatctcctccctcgcgatgaccatgtcgtcctgtcgttcagaatcgcaagcgaatcatcagagataagactgtgaagacacatggtgtgttcgtggtaaattctaaaggttaatttattttttatctttaccttcacattggtgaaaatggtgggctcgatgtagtaccctttcttaccgcagggcttccctcccgtgagaacagttgccccttctgccttgccttgctcgatgtacccgagcaccctctcatactgagccttgtccacctgtatgaacatagtagcagggcaacacagtacggtgatcagtctctggttcagatagttaatcaggcctgaatcatcactgaattattggaactcacaagaaaaaaaatgctcgttggatggatgatgattcagatttttcggaatttaatttcagactcactcacctgtggtccttgattgacgcgaggatcgaaggggtcgccgacgacccagctcttcatggtgtccgctagcttctgctcgaaccggtcgtagatgccctcctgcacgaacacgcggctcccggcgacgcaggcttctccctgcagattgatcagatcacggctatggctctcatcagtcaattcaatcaagatcacggcaatgcatggcgctctgccaattcggatgctcaccttgttgaagaagttcccgccgatggcgagctcgacggccttgtccaggtcggcgtcgtcgaagacgatgaacggcgacttgccgccgagctcgagtgccaccggcttcaggttgctcttcgcggaggcctccattataagccgtccaacctcagtagatcccgtgaaagccacctgcaaaaaaaaaaaaagttgtaagaaaccgatcaatgttcatgtgctaattgacagctgaatgtatgatatcttaccacgtcaacatccatgtgagatgaaattgcagctcccgctgttgggccgaatcctgtcaccacgttgatcaccccatccggtactcctgcctgaatatcacattccgaaaaggtcagagatattcagagttttagactaccagcaatcacacagcacaaaatgcctgatgcaagaacagagctactactatatcgtttttcttttttcaattttgcgtcctgttctaaattgaagattggattagctactttcttgattttcattagcacgttttccaaactatcaaatgttatgttttgtatgaaaattttctatataaaaggtactttaaaaaaataaataaatttatttgtcaattttctataattaataattagttaatgttaatcacatttctcgtttgtgtgactaatcttacttgcttattttttttttaaaaaaaattcttacttgctttgataggtgggcgaggaacagggcgctgaggggcgtctgctcggcgggcttgacgacgacggtgcagccggcggcgagcgccggtgagactttggagaagaacatgatggccgggaagttccaggggacgatgaggccggcgacgccgaggggctcgcggagggtgtaaccctggagctgcctcgacatcttgagcgtctcgccgtggatcttgtcggcggcgccggcgaagtagcgcaggatgccgacgcactcgccgacgtccaccgccctggcggcggcgagcggcttgccggcgtcaaggctctccagtgccgccagctcatccgcgtgccgctccaccacctccgcgtacttcgccatgaccctccctctctcctgcatttgacaaatgcgccattgatcggtcactttccagccattttttgcacgattgagaggaagaagaagatgaccgtactgatcccgacatgcgaggccattcgccgtggtcgaatgcttccctcgccgccttcaccgccaggtcgacgtcctccttgtcgccttcggcgacgcgggcgatcacgtcgccggtgcgggggtccctggtctcgaacgtcttacctggagaagaagcacggagcacggcgaccttccatgatcaggatgagattatgtaaagataaaattaagtgaaaatttcagtaaacctcacatttcatggttaaagttatataaaatcctaggtatcataaccttgatgaagagagttagttttagtttatgactctcatcaagagcaagaagtctttaattttagattggactgctatagaatttgacccatcgtacaaaaagtttctgatgataagaatcatactttcatggaactccataggggcatagggctataggcttcaacacggtagatgttttgttctgaattattctgagcaaacttacgacccaacgatacaatggttttttttctattcacaaagaaaataatttggaaatcgcaatgcttctatacgcttccagaggtgacacataaccgaactactattgttttaaagtttttcaaaacaccacctctatatatatttagtaaatatttacttaaaattgtaaaatgtagaatatatgtggaatttttagttgttgatttttttattaaggttttcggtttaactcttcgctactttgtaaaatattatcttagatatgttaaagtcaattgaaatattgtcttggattttgttagcatgcttttacatttcattaaaaaactttctatataaaatttactctacaaatatcaaataaatatattttttaaatttataataactaaatttaattaattatattctaatgacttcttgattttctgtgcactaacttcaccttaatgaggcaaaccccgaatttgatttttcttcagagcacgaaacgtgtataaaagtacacaagaaaataggatctctagtacggaagcatttatcttcttctgaaaattcagaaatgttccaaatctgaaacgtgctactgctagagccacatatgggcagtcccaatccataacactagacatggtttccataaactccacatcatcaagaaactagtgctagacactactcttccaatgcaaacaccactattccatactttaatttaatgctatttatctcacatgatgtcttagatgttgtgtagaaactatgtctcatacaagacatggttttcttctctttcctcatttattcacttgccacatcattttttgtcctaggtgacaacttatttaatgctatgaacactatcctagtcattgggttgggaatgccctaatgatttgatttgaatagttctttactacttagtactattagtacggagtactagctaatcattgagcaaaaaaaagatgtgagatgaaaacagcaactagccggggacgcgaagcacatggtataacacgggacgatgggaaaaatagatgccagaggttggtagagactgaaactgcaggcccgttcatgcttctttgtcgtgttactccttggcgaactgcccatgatctcatctcgccatcaaaccgtacgatgctaggagcaccacaagtttacggtaactcttcaaaatttactttctcggttataaaaattagcaatatagtactaaactttcttttttaaaaaaactatttttataggcaacacatgcagaaacaaatatattaaaaatgatgtatatggtttgctcccttcgtcccataaaaacccaccagtatgagaggtgatattttcaagcacagtgaatctgaacagaagactatccaaattcgttgtacttgtaaataccatatccaatagttttcagaatgagggagtatggcttatgaaatatagcaatatagtgaattgtttttttcataggcaacacatacagagaccaatcatattgagaacagtgtatgtatatggtttcatatagataaaacccatttcatctttttcatattatttttttcatatttaatgagaatggattttttagtgggagtggcctaagaattaatctaaactggctggtactaattaattatggagagaatcattaagagcaagtttaatagtacagcccactgctagctccaattcatctatatatagtcaatctaacagtcaattcatacaatagttgcttacgatactataaatatttggtcccacatgtcatacacatactgtgtcttggagtccgtgctgcagctggctacagatctgtagtccgctgctcttctctgttatcttttatctcattaaaatatatttatagctcactaatagtttgctattgtacttgctctaagaaacagcactgattgcgataaggaattgaatccctactagtatttggaagaaaggaaataaatcgaagagagcaataggacaaccacggcgattatgaattggatcccattactaggttttggtagagtacaattaagtcctccagtaattaacgcaggtgggctggacgtagctagataaccacagcccacggctagctagcgcgcggctaacacacacgtacgtacgtaccggaggccgcgtcgacgaagcgcccgttgatgaacagcttggtgtacctgatctccggcgtcgtcctgggcgtcccgccgccgtcgtcgccgccgtggaggcaccccgcgccgctgttctccgcgcgcgcctcgtcgccggcgtggtggtggccgttgctctcgctctcgctcgccatggcgcgcggcggtgtggctcgatcggtctctctctccgcgcgctgctttgctgttgcgtcgctaagcgagaagcgtagtcctactgtggggggggggggggggggggtgatttgggcgaggcgatacgccgatttaaagagaagcgtgcgccctgccctggccaggtgctagttgggctagccgtccttcaaatttgacagttttttttcccattcacagatttgactggtctagctgactagctagtcctttaaatttatcctaaattatagatgattttataatctgaagatgatcatttattgcccatgtacccacccctccctcccatttcaagcgcaaacatgagttgtcaaattttaattgtacgtcttattttattttttttgaaaaatagtacttttaatgttttatcatctgataataataaaaatactaatcataaaattttttaaataagacagatgattaaagttagacaaggaaactcataactacgtttaatatgggacggagggagtatactttatgagtctattaggttgatgttattttaaatctttttggtaaaattgagaaatacgtggatacatttaatttattcccaaacattggtaatgcctagataattttggtaacaatacatctatcctatcctattaaaatttgataatattaccaactcaccaaaactttggcattaccaaaattctagaaatgtttattttggtaataatttgagccagccttatatctcgcttatccactcttttatagtttattcctccacctacctatttttactttacttaatcctcacctatcatctattattcccattcgttctaaaataaacaaacatatcacacccctgtattaggtttgtttattcggatgaaaggagtaatacattattttatctcctatcatcatttttcatcacttgtacttttgctatctccttaataatcattaaaaaagggaaattattctatttgagacgagggagtatttccatcaccttactttactccaagacggcaaggcctgacaggcacccgcacatgggaaacaaacggacgagtcaaggagtgtactcatgtagtgtggtcgcgcactcacgtgattacctgaagaacttgcaaggattgggatctggtctctttttcaattcatcatcgatatgtatatatagagaagggttaattggatccatgccacgcgaattgtggcaaatcaaaaaaaaaaatgctacacctattccggaatccgggtgcaggccacaactgtttcgtcaaattggaaccatgccataatgtacgccctgcgcgcgctttgccaccgttttagggtaccgtattttcgtatggacgtttctgccctcgtgttcacgtgtgcttagaccagctccggtccggctcgaacaacccggtcgccattcgttccccacaccgaaaccctagcttcttggaggcggcgcaggcgacggcgccggcgcaatcgacggcggcggagcaggcttcggtgccggagcagggcggtggcgcaggcgaaggcggcggcggagcagggcggcagcggagcagggcggcggcggaggctacgacggccgaaggggaggacctccaccgatgggaggatgagtgcgcaggggcctacgcctgcatcccccaccgcgttggcaatgtatttgggcgaatcccttgtacgggttgcttccaaaccgtgagtaccttcccccatgaactctttatgcagataaaattacgatttgagtttcgatttgaactttgtatgtgcgatttgagttattgttttgtcattcgttggtaggcattggttttcagtcgatgttagggtgcaaccctatgcgacagtagatgctgatggtaggaaaatcatcagtaaaggaggcactgggcattgggtaatcgattcagagagtttttcgtttgatttcctaatggaaagtttgagggttgagtttaagtggggctcgaaccagtctccctcagtgtggtattttaacaaaaatttgggtgaggatgttaggctcataggggacactgatttgccagatattttcgagatgtatgcaaccgaggccagtttccacttacttgtagcagttcttgaggaaagcatggatgttgcttctgtgtgttgtgtgcatgagcccattgctatcatcccacctgagaacccttcccacaatgatggttctagacaagctgctactaatgatggttctgcacagcctacaacagtggaagcagatgttagagagcctgacatgtttgataattaggaagaatatgttggtgttaatgatgagcagttgtatctgcctccaaaacctactcagccacctgacacctctagccaatcctctcagcctgctgccacagggtttgtgtcacgaccggaattaacccaacgggcgttccttacgtgcatgtattattccttgtcccaggaggcaaggtacaccaaaagttgatacatttcagagtttatcaagcggaagcgtaaatagttaatttattacatgggcggcgaaggcccagcacacacaaagacaaacgggaaagaggggaagactagggcgacgaccacaggcgcttgacggcaggcacgagctagacaccaaagccttcatcttctaggaactccacttctgggtttgggaaaaattgagcaagactgagtacaaccaccgtactcaacaagacacacccacaagtgcagaataaatgcaagggagtacaagggggtttgcagtaaacagcattaaaagacacttagttgctcaaagctattttgtaaacacgattctagagctatgcaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccaagggcgcggctattcgaatagattatactctgatcagaggtgtacatctttacccacaagacacatcttcctcacgtgtaaccatgtgccacataccaccacggtatacggacagaagacgtgacatagtttccaacccatcctagccatagacaagagtaccgacccaaccccacctacggccggaacccccgggacaggtaggcaggactgagcctctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtagaagtacggtagtgctttgcaacagaggcccgaagaccggtccttatatggccgaggtgctactatcaaaaccatgcacccgagcctagcctaaaaccattttgagggttttgaatagagggggaggtgcaaatccaattccacaataatccaaccattccatagtgtccaggtgatgagaatattcccaaagtctagagttataaaaccacctaatgttgcctaattaatcagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcggtaatgcaataatttaaatcaaaataattttataaactgggattcaatatgttcaaggatgatgtgacttgccttgctcgctttcccaaacgtcggcttcaacctccacgaagagcggatcttccgaagctgcagcgtttacacgaccaacggaaaagaaaaggattttactctaataaactccatataacaagcaggaacaaagcacaaaaatgggttcttgacttcttcaggaaaaattagagacttgaatggtccaattccgagttcaaatggccaagttatggccatttgaagtttatatgctctttaaatgaatatttgcgaatttcttcatttaaattttaattttaaaagggtttattgcgtcagccgaggggaggggacgcgcggaccgggtccacgggagtggggcccacgcggtagcctcacggtccacggtggaccgggtgcacccgggctcacaccggccggcgccgtgggccccacgcgtcagccgcaaccgagggcgcgggcggctgacggccgggccccacgcggcagccactcggcgcgcccgagggcggccaagccggcgcagcaggcgggaggcggcgcccgcgcccctatggtcgccggcggcggccataggcacggcggagcggcggccgagagaggggaagggaagggggaaaagaggcggcggtccacggctcaccctaggtcgacggcgacgacgaaaaaggcggcgggagcggaggaaggcggcggcgcggctcgggtcgacggggtcgacggcgttccggcggtcggtgagcgaaacgaaggggtggacgaggtcggcgaggatgcggcgaagccgaaggaggcggcgctgaggtgggaggtggtccggggcgacgacggcggcggaccggagctcggcggcgacggcggagagagagagcgacggcgggagctcgattccggcgaggaggaagggcggcgagaggcggaaacggacggaggaggtacggggagggtttaaatagagccggggcgagagagggcggccggggaaggaaggaaaccggcgcgggaggtcggccgccatcaatggcgccggcgagatttgcgggggcaagtccgcccgtttgaactcgatagagagagagggaaaaatggggggaaagggagagggaatcacggggaataaatccccctattgattgcacgcggggacgacgggatgcggcggattcggcggcggcggtggcgctagggcgcgggcgaggcggcatgagcggcgggaggaaggggatgacgggtgggccccacccgtcagcgagggtggcgggcgggcctgcccgtcagcggcgcgcgcggggagaggccgagtgggccgcggggagaggagagagagggggagggagatgggccgagccggcccaagagggggagggagggaaaggggacctttagggtttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaatttttggaggctttcacacggattttaattattctaggcataatttagaggatgtattttagagtcgttttgggacgtgacagtttggtggccaatcctctcagcctgctgccataggggttagtggtcaatcctctcagactgctgccacaggggttgaagctcctgaggtagaagtcactgatgaagctcaggttgttagagtgttgcatgatccagagaatccaaatatagtgaagaatgctctattccctgacatgatatcttttagaaaagcagttaggcattatgcaattaagaaaggttttgagtttgctgatttgaagacagataaaacaagattcattgcaacctgtcgcgctgaaggctgtccatggagaatacgtgcttccctaatccatgataagaaaacaattaaggtataaatgtattattttagttaatttattttttcatctcctgaaagtagtgttagttttagtaactttttatcaccatgtcatgtcatgcagattacagttcttccctttgaacacaaatatgcatctaccaaactaagagagggcaagatggctacacagggctgggttgctgataggcttggtgattggttgaagaacaatccaaagaagggtgctaaggatgcaagagggaagctgcaagaacagtatgagatcaagttgaagtattcaaaggcatggtcaggtatgaagttagcactagaacaggtacatggtaaatatgaggaaagttttcagttgcttttcaactggaaggctgaaattgagaggaagtgtccaggtagtatagttgaaattgaattggagaagttaggaaataaaatgtgcttcaagcgtttgtttgtagctctaaaaccatgtatagatggctttttgcaagggtgtaggccatatgtgggtgtagactcaactaagttgactagaaaatacactggacagttagcttcagccacctctgtagatggtcacaactggcttttttatgtatcatatgcaatttttgatttggaaactaataacaactggttgtggtttatgaaacaattgaatagagctattggttgtcctgaagggttagttatctcaaccgatgcatgcaaggggttagaaaaggctgttagtgctgcatttagtgatcatgttgagcatagagaatgcattaggcacctctatgctaacttcctaaagaagtaccatggttctgttatcactgagcatttgtatccagctgctaggagctacactgaggagggtttcaagtaccatatgcagcaaatatatgcagtgaaaccagatgcaatagagtttcttgagcaacatcattcaagaatttggtacagatgtggctttggagaaagcagcaaatgtgactatctgacaaacaatgtttctgagtgctttaatgctcagatcagaaatctgaaaggactgcttcctcatgaacttgttgacagcatacgagagttaataatggagaagatggccactagaagagatgttggcaagaaaatggatgatggaatcattccaggtgttatgaagcagcttaatgatgccacatctcttcttaaagtggtgaagattaccagaagtgatgatgggtttgcagaggtcacacttgtggatactgacaacaagactagaaggcatattgttgacctagacaaccaaaaatgctcctgtagggcttggcaaataacagggaagccatgcaggcatgcattggcctggatatgcagcagtggaggaaggatacaagattttgtgagcccatattatagtgtgcaaatgttcaggacagcttatgcaggcagagtaccacctatgactgataggacacagtggccagtagttgatttgggcttcaaggtgcatgtccctaagcagaagagaggtgctgggaggcctagagtacagagaataaggggatttcttgagcctggaagaaagagagtgaaatgcaagagatgtaaaagatttggacattttgagaaaacatgcaagctagctgaacctgtagatgcagatgatatgagcagccactgcaccccccaaaaacggtatattgctgtcattgtgcttccattcttaattagtctttgtgcaagcggtttgtgttctttaactccaacttgataaaaaaaacccaacttgataattattgttagttacactcctgatatattgtgctatgttgtagtcactaagattcaggcttgtatgcttgccatatggtctaaaaattctcacttttttgtaggaagagacaagtgtgcaggcaaggaaatgatccaggagtgtcaacaagtgaagcaagctgctctgcaccaaagaagaaaaaaacacctaggaaaaaaaagacaccaaaaaagaagaagactccccagaagaggaaagacctagcatcctcaagtgcaccaccaactagagtagttaggagcctatctacctatcttctactgtaatgccagctgcctcctctctaagtattttgctaattgccaatggctgtgatgaacttgtaatgcacgtgtgcctgtgaacttgtagtaacctatttgcagtgacaatgtagcctgccccatctcttaagtattttgctagtaaggctgctatgaaccagtaatgttgctcatgtatgtctatactgttgtatgcatatgttgagcctgaaaactgaaattatggaatgcatcaatgatctcttttgctgaaaatttactgtactcatgtgctctctccttttgtaaagatttctgtgctgtaaactgaaattatggaatgcaccaatgatctctttgctgaaaatttgtgatggacaattgtctgcatggcactgattctatacaggaatctgacaatttttcccagcaatctgcaaattttatggttctattattgtaacaattcactactttcttctcaaacatacactttcattcatattgttcagcactgcacatacacatactttcttctgaaacatactctttcattcatataggtcaccacagtacatacacatgacaatacatccatatttccaatccaaaatacacttgttgacaatacatccatttttttcccatctaatttctacctaccattaagcaagcaaataagacagtgatcactaaggtaaggtatagaagtctagcacggctaaatttaacttcttccaactgcttcttcatcgctaaacactccagcctacactggttgagtgtctcaattgttgacttcaactcattttcctttgcatcaaggacctcacaaatcttcgctttttcattcttctcatcatctaaatattggcgaagaatgtcgattgtttcttgcatatgatcgtactcgccggcgtgacagtacgcaaccatctcctcagcatactcattcagcaggtcttcccatatccataagaagcaacagccctaagcaaacaactaagaattaagacaccgaaatgaaaccaacgaaactaagcaagttcttaccgaattgccgcattgtagccaccagcgtcgaggattccttggtgtgttcgaaatctgcacagtggcggaggcaccgcaagcacacttcagcgtggggatggaagaaggtgattccatcatcgccttgccgtcgcgccaggaaggaggtgattccatcgtcgccttgccgtcgcgccaggtcgtactcgccgccggtcgcctgcgccgtcgctaggagctccggcgccaccgccttcggccggcgtagcctccgccgccgccctgctccgccgtcgccttcacctgcgccgccgccctgctccgccgccgaagcctgcgccgccgtctgcgacgccgccctccgtcgccgtagcctgcgccgccgccctgctccgccgccttccgccgccatcgattgcgccggcgccatcgcctgcgccgcctccaagaagctagggtttcggtgtggggaacgaatggcgaccgggctgttcgagccggaccggagctggtctaagcacacgtgaacacgagggcataaacgtccatacgaaaatacggtaccctaaaacggtggcaaagcacgcgcagggcgtacattgtggcatggttccaatttgacgaaatagtagtggcatgcacccggattccggaataggtgtgtcatttttttatttgccacaattcgcgtggcatagatccaattaaccctatagagaaagatcctccaatccgtttaattttataacctgctttgtttatacgtgatttggtttgacattcatcgatctttgccaataaacccgtatcatatttgatcacagaaaaaaaaaacttgtcgcgtttggcgattttgacgagctttggtataattttaacatcgtcaccgttgcctgccctccaacctttgcagccacctgacagctcagtatagctttgcatatgaccccacttagctctatgcatgccccatacatggcttggcacatccgtgttattgttgtctcatcttctttttctatatatccagcctagcttgacaagtttttgccttgttctgtcctcgtactctggttttaacagttacaagcctaccgttatactccctccgtctcataatataagggattttgagtttttgcttgtaacgtttatcactcgtcttattcaaattttttttaaattattatttattttatttttgacttactttattatctacaatactttaagcacaacttttcgtttttttatatttgcaaaaaaaaattgaataagacgagtggtcaaacgttgcatgcaaaaactcaaaatcccttatattgtgggacggagggagtattatttgtttcgaaaaatgttactgatatgggttgccagttgcccctcgcacaatattcacttatctcttttagacctatatggtactggcaccactgccatacgtactccttttatctatcgttgtgtataagatccatctctattcctatgttccaataaattaaaaacttttcaagtttttttaaataaaccggtatctttaagtgggtctaccagtgtaaggggtcggtccatccaactataaggacggttttaagttaagaaccggtacctacaaatgagaataggcataggttccaattaaatcggtacatatgagcatcatctatagcagtgtacgcgcataatttttcattagcaagtacgcaatgtcaccttatttccttggggtcaggttgaatccagcgacaccgaggctagaggagctgagataggacgtaggatttgaccagctttataaccaaaaggttaaacgaagtggacgattcactattgtttccacaaagtcttcggttatgatgtaaagtgaccagggacatgacatggaaagatgattctttacgtagttaatgatcagatgatgacaactatactactgtctttgttttttaatatataagatcgtttgacattttgacaaatgtttgatcatctgttttattcaaaactcttatacaaatataaaaaatatttaacttttataaaaaaacatttgatgataaatcaagtcacaataaataaataataattacataactttttaaataaggcaaatagtcaaacgagtattttaaaagatcaatagcattatatattaaacaacgagagtacttagctaaagcaaagaaaaataaacatgtacgttttgtttccttgtgtatttacaactctggtaggctcactcaagaaaggacagagtacatataaactccaataacgactgcacgttctaaacgccaaactgtgcaaacgtacaacaatcaataataaatctcatgttactgttttgacatcttctttatagcctttatgtacgttatatgcgtccattttctagcacgcacaagttgggagaagaaacttagctaaaattgcgtcagtgccgtaattaatttcttgtatcatcaacaagcaaaattttctccgagatctgaaaatgcacaccgacacactgtacgccccataacagatgccgcacgtgggagctattataccgttgaaattttcaagttaagaaatactagctctgtttcattttaaatgcaactatgtttttccgtacctaattttgatcgtttgtccatcttatttaaaaaaattttgaaaaaaattaaaaacataagtcataagtaaagtactattcatattcatgttttatcatctcataataacaaaaatactaattataaaaaaaattttaaataagacggacgattaaagttggacgcggaagcacttaaatttggacggagggagtaataccgagtctcttttatactaggtactataggagtaccattcaagtgcccatattttagatcaaaggtagcatcctaattggctgtgttttgtgatgtatggttgattgttgagacttgagacttgaggcagtaattttttttagataattaaacttgacgaactttgaagcacaatatgaaggaatttttatttcgataaattttcgttaccgtattcgagcctgttcctattcacttcgttctcatgtttaccaatcactaagtcgcgcgttgcgcaacaatgaatatacactcctaagtgttaacctgtacatattcctaagttgtcttgtaagtgttttatactgttattttagaaaagtagaaattagtggcacatcgttttgttgcccaatattaggatacaaccattcaagtatttgttgttggtgcatatgacacacccttctctcgatcactatattttcactcaacatattgaactttcatcacgatatatatattataagtatttctaaggcattttttatgctgaatggaatataaatgataatttagataacataatgttataaaagatgcttttgagctcaactataaacacaacactttagcgattaataaaaaaaatcaagcgtatactccctctagtttttaacggacgacaccgctggcttttgaacatgcttttgactattcatcttatttaaaagccatgtaaatatgaaatatacatataagttattctgaaagtacttctaataataaaataaataataaaaataattatgtaattttggtcaaatatatatttaaaaatcaagagcatcatatattaaaaactgaaacaaaataaagcatatcgaagtccatctaatatgctagtactttgtactattcgtaaatacattttataattttatttgaatttgagttgtgccattcttttttttctatggctgaccatgtgcctggcagctttgagacttcctcgttggaagtctagaagtttcttgagggcagctcctgtgccttgaaattttttttctggttttttaatagaagtatgaatctaatgtttcattttttgcttgctgtctgcatccaacagtggttctttcgtgacctagctcgattgcaagaaactttagttctttaaatactttagattcggaattttcccctgagaatcatgcttattttggcccggaaattccttccgagggcccccacacatagcgtttatctggccttcttttcccatgacaagccaacaaggccaaatacggattccatctccatacgttcatcatgttacgatggaccgaaatccaagcccatttatgtgttaacaaggcccaactatgctaaagttgtttcatatctggcccatcaacacgttgcagttatgggtcgtcattccacagtgggcttgtcacaacaaaactcgtaggaaaaagtccaatttgactcccttaaatataggcaaaatctaattcgtacccctcaactggaaaaccgggtaggacgactcccctaactattgtaaccggtgcaattggactccctcggcggtttcggagggcggttttgctgacgtggcaatgttgacccggttttcgtcccacgtggcgcttacatggcattagaattaaaaaaatatctgtgggtcccatctgtcattaaaaaaattatattgtgggacccactgacatgtggggcccacatgtcatcctctcttctctacctttttcatcctccccctctctttctcttcacgagagtgggacgagggccagcggcagcagcggtgaaggacgggcgggcgagggccggagcaggggccaaatcgtcggcggcggcggcggacgggggccggagcggcggtggccggcgcacccacggcgctctggagcgcgtaccgaagcgacgcctccacgacatcatctcccttcccgtcaatctggaccacgccaagccaagccactgcgtcgtcgactttgcatcgtcctcctctccgtttccccacaaaaatcccggagaatggcgcaccgaggagggagatcgacttcgtcttctccaactccggccgctggcgtaaatcttcgattcccgccgctccggtgagtctcgcgtcgattccttgcgcatgaaccaccctagggacctcactaataacatcagagcacatgcatgtttattacatcggtggatcaagccgtcgccgttcaccccggaggttcttgccgccgcccagcacgat

SEQ ID NO: 82498 - DNA, 14494 bp, Oryza sativa
aagggtacccggttttccgcaccccacagcagaatgctgttgccgcgatcaccctcctcgacaccctcctcaaggaaaacgagctcaatcagtctgaccacgtcgtcaacatcttgaaccagacaaagaccatgattacggcttcggtcccagttaactccggaagcgtccgcacgccgagcggtagccgagtccctcatcttcgatctcacgactaccaccagccaagccttagcatcgctggcgcatgatctaatcgcaggagcaggggtcacgacgagcgatctgtccactcgctcccgaccatcatagggagcgccgagtggaacgaccccgttcgccacctcgtcatcgccccgtcgatcttcgcgacacgatcatacagcgccgggcaactcgaggccatcatcattcaccggatcgccacgacgatgacctagacggagtagccgctttcaccaacgacctgcgtcgagtggattggccagccggctttaagccgactggaatagagaagtatgacggtaccaccaacccggaatcatggcttaccgtctacggtctcgcaatccgcgcagcaggaggagatagcaaggccatggcgaactatttaccagtggctttagcagattccgcccggtcctggatccatgtattgccccgtggtacaatcggatcttgggccgaactacgcgaccacttcatcgccaacttccaaggcactttcgagcgccccggcacacaattcgatctctacaacgttattcagaagtccgaagaatctcttcgagattacatccggcgattttctgaacaacgcaacaagatctctgacatcaccgacgatgttatcatcgccgcattcaccaaaggaattcgtcacgaagaattggtcgacaagttcgggcgtaagcctcccaaaacagtcaaacttatgtttgaaaaagccaacgagtacgccaaggctgaagacgccgtcatcgcatcaaagcagtcgggctccagttagaagccaaaaaaggatacgctggctacgggagcgggtggaagtaacaatcataaggaccgcaagcgtaagcctgaggaacttgttgcaaccgctactcactcttctcgacagcgttcacgcgtcaacacattcgacaagatcatgaactcccaatgcccgcatcatcctaactccaaccacgtggccaaagattgtttcgtctacaaacagttcgcggaacaatacaccaagactacacggaagaactccgacgaagaacaaagcacgtcgaagaagaaggacgatggcgaccccccggcaggttttcaagaccaccgcaaggagcttaaccacatcttcggtggcccccttggcttatgaatctaaaagaaagcaaaagttgaccgaacgggagattaacgctgttcagcccgacacaccccaatatcttcgatggtcagagacagcaatcaagtttgaccgctcggatcatcccgaccgagtggtccacccggggcggtaccccctggtactagacccagtggtccgtaatgtcaagcttcgcagaaccttcatcgacggtggcagtgcactaaatatcctcttcgccaaaaccttggatgacatgcagattcctcgctccgagttaaaaccaagcaatgcgccttttcacggagtcattccagggttatctgcaactccactcggccagatcacccttccggttacctttggcactcgggaaaacttccgcacggagaatatctgcttcgaagtcgccgatttcgagacagcgtaccacgccatactcagacgcccggcgttagccaagttcatggccgtcccacactacacttacatgatgatgaagatgcctggtccccgaggagtcctatccctacggagcgacatcaagcaagccgtcacatgcgacaaggaaagttgcgagatggcccagactcgcgagatggcgtctgcccgagaagatatccgactggctgcaaccacggcaagcgaaggagaagtgcccgcgaccaaggtctcaaagagcggagaaagcgaagctaagactaaaaagattcccctagatccttctgatcccactaaaactgctgtaataggcgccgagttagattgtaaataggaaagcgcgctcgtcacctttcttcaaaataataaagatatctttgcgtggaaaccatctgatatgcctggtattcctagagaggtgattgagcactccttacatgtcaaagaagacgctaaacctattaaacaacgactccgccgcttcgcacaagacaggaaggacgcgatcaaggaggaattaaccaagctgttagcagcaggcttcatcaaagaagtccttcatcccgacaggctggctaacccggttctagttcggaagaaagctgggcaatggcgcatgtgtgtcgattataccgacctcaacaagtcttgccctaaagatccttttgggttgcctcgcattgaccaggtagtcaactcgaccgccggctgtgagctactcagttttttggattgctactcggggtatcatcagatccgactaaaggaatccgactgcttgaagacttcattcatcacgccctttggggcctattgctacatcaccatgccattcggactaaaaaatgcaggagcaacttatcaacgtatgattcagagatgcttctcaacgcaaattggccgcaatgtcgaagcttacgtggatgatgtagtcgtcaagactaagtagaaggatgatttaatctcggacctagaagaaacctttgcaagcatccgcgctttcaggatgaaactaaaccctgaaaaatgcaccttcggagtaccgtcagggaagctgcttggttttatggtgtctcgtagaggcatacaagccaacccggagaaagttactgctatcctcaacatgaaaccgccaagctcccagaaagacgtccagaagctgactggatgcatggcggcgctcagccgattcgtttcacgacttggcgagcgggggatgcccttcttcaaattaaagaaaacagacaatttccagtggggacccgaagctcagaaggccttcgaagatttcaagaaactcctcaccgagccaccagtcttagcctcgccacacccgcaggagccattgttactttatgtatcagccacctcccaggttgtgagcacagtcttggtcgttgagcgtgaggaagaaggccacgtccagaaagtccagcgaccgatctactttgtcagcgaggtcctagctaactccaaaacgagatatcctcaggttcagaagctgttatatggtattctgattactaccaggaaattatctcactacttccaaggtcactcggtaacggtggtcacatcgtttccgctcgtcgatatactgcacaaccgcgaagcaaacggacggattgctaaatgggctttggagttgatgtctttggacatatccttcaagccccgaacttcaatcaagctagccgacttcgtcgccgaatggaccgagtgccaggaggatacccccgcagaaaagatggagcactggaccatgcattttgacggatcaaaaaggctttcgggcactagagcgggagtggttttaatttccccaactggagaaagattaagttatgtgctttggatacatttttccgcatcccacaacgtcgcagagtatgaggcgctcctccatggactacggatcgcgatctccctagggatcaagcgtctaatagttcaaggcgattcacagctagtcgtcaaccaagttatgaaagagtggtcctgccttgacgacaacatgacggcatatcgacaaaaggcacgcaaattggaagacaacttcgatgggcttgagcttagtcacgttctccgacacaacaatgaagccaccgatagacctgccaactttggatccaagcgcgaggtggcgccctccgatgtattcgtcgaacacctttatgagccgaccgtacctcagaaagaaacaactcaagttgcggacactcatgacatagccatgattgaagccgactggagagagcccctcatacgatttttgacttctcaagaactcctccaagataaagatgaagccgagcggatttcaaggcgaagcaggctttatgttattcatgaagccgagttatacaagaaaagcccttcaggaattctgcaacgctgcgtatctctagaggaagggaggcaattgttgaaagacatacattctggaatatgcggaaaccatgccgccgcacgcaccattgtcggcaaagcttaccggcagggttttttctagcctactgcagtgtccaacgccgataaaattgtgcgcacgtgcgaaggttgccaatttttcgacagacaaatccatctaccagctcaagagttgcaaacaatcccactgtcttggccgtttgcggtttgggggctcgacatggttggctcgttcaaaagggcagtcggcggttacacgcatctctttgtggccattgacaaattctccaagtggattgaggctaaaccggttgtcacaattacagcagataaagctcgagatttcttcatcaacattgtgcataggtttggagtgcctaatcggattatcaccgataatggcacacaattcactggcggagtttttaaagacttttgcgaagacttcggaattaagatttgctatgcctcagtagcgcatcccatgagcaatggacaggtcgaacgagccaacggcatgatacttcaagggataaaagcgcgagtttttgaccggctaaaaccctatgctggaaaatgggtggaacagctgccatcagtactttggtctttgtgaactacacccagtcgggccacaggccagtcaccttttttccttgtctacggggcagaagcaatgttgcctagtgaagttgaattcgaatctttgcgctttcgcaattttcgcgaagaacgctacgaagaggaccgagtggatgatctgcaccgattggaagaagtccgcaaagcagctttaattcagtcggcccgatatttacaagggttgcgacgttatcataatcgcaatgttcgatcccgtgctttcctagtcggcgacctggttttgaggaaaattcaaactatacgagatcggcacaagttatctcctctatgggaagggccatttatcatctctgaagtcacccggccaggttcctaccgactcaagcgcgaagatggtacacttgttgacaattcttggaatatcgaacatcttcgtcgtttctacgcttaagtttatccatgtatttccctatcttgactgtcaacatcaagctttcttcttgaggttgtcagtcgggggctaccataataataatggagtgtgattttttatcaattcaatttgcttacttggtctatcattgccttgtttgatttttctacttagtttacgaggactgaaagtttttaatagcttttgcgggttttaggctcaacaaagcttgataaaggcttttaagaaatcaacagctaagccagaaacaccaagcacagcataaatacaccggtattatacaaattgtgcctccatcattcgtcattcgaaacatttacatttaatcagtatcagtcttctcatcatcagagttattgttaccagtcggcctaaggtcggtatcctgaaaccgatctacgacgtcaccagcaatcttgtcggctgctttttgagcgtcgttgataagatcaagggcagcctcttcgcttgtcccgtccgcaaaaccatcaacagtatcaatatcgatcttagggtacagggatttggtcattgctaacgctaaacctgctcccatgcttccggcttctctaatgttcttgaaataggtgtccgaagcgattctcagcttgtcaaacacttcggaagcatcgaatctactcgggccattgttattatagaacattgcctggacaagcggggtagcagcattggcgacctcatccctggctccttcaagtcttttgatcttgccaaccaggacgtcgaactgggcttgggacttgatcttgcggtctacaataacaaattcatgtcaataatctgctgcatcaaagagagaaactcaggttgttggctaacaataccttcaacctccttcaaagccgagtccctttgtgcagccaattctgccttgttattttctaaggcttgaattcgtttctccagttgagctatcttggcagcttgcactgtttggattccagacggttgaggatacaattataacagcacaaattaatggggcagatcttgaggttaccttttgatgagccacttagttcaaagttcgaatcctggagttgggtaatccggtcccttagatcatgctctgtctttttggcaagctctttggcttcgtgtagctgatccctaaccgcttcaagggtccctaaatgaggaaccagcttttctaaagttgtggttttggcctcattacggagatggattctctgcgcaatgattcacggtttagtcttgctgagaaaaaacaaggtcaccaaaggcagccacctggaagacttacatttacaatgcgggtagcttctccgagtgctttcttcaactggcgcacctcttcgtcttctttctgtcgatttatgacaatgcctgcaggttgcaagttctcgtcccaccatttgattaagatggggggacgagagtcagcagctgcctttatgcgagggatttcatctctgtcaccgcctagtggtcctgatgtattcccagacattagacaagcaaatcggagttattcagattggcattacttgagaagatgggttacctgaggtgatttccggttgagcgtgaggtgatccttgccctttatctggagacccaggcgttgggtcgttaccagcgtccggtctctgggaagttgtagcctgaacttcaacttcaggaatttcttgatctggacctacttccgactgattgccagtcgggggctcttggtttgttgcggtttctgcttctgccgactggtttccagtcgggggctggtcgcttggattgaccttatcagttgaagtctaggctccagtcggctggtcctcagtagtcggcccagcttctttggatgaacctgtctctgtgttagccggatcagaatccttcccggatggatctatgtcagacggtttcctgcaaagtttccttccagttttcagtattatcttcatgagagaagcatgtcgaagtgaaacggtaccggatggtttatacctggaggattttctaaactttggcatggggcggttagacagtttcttcttcggagcagtgtgctttggtaattttttgggtgatcccttatccccaaatttattattgtcgtcgccttcgtcgtcattcatcacaagctttctcttgcgagaatctgtctgcccagtcggattgggagttttggattaggagtctgacctgatttttggtcctccactcccctgaacggtctgatgacgaggggatcagcgttgagcgattggggggtcagactttatcaaagcaaattcctgaatgaaatgcctccatggtcagttaattcaacaagaagacaaaattatgttttgatcacggtttgaagtgttctgatacataccagcggaggaggattgaatgcattatatggcacgactggcagcagatgcgaataactgacgacaatggcatttgagaatatcttgtacatcctctccttcatgatcttaaagtccagagaatctgggtcttcacggtttggatcatgtttgccgtcaaactcgaatgctgtacgagatctctctttgattggagctaatcggcacttaatgaaatgccgagtgatttgctctccctgtaagccttgctctttgagcttcaacatgcgctccatcagttctaaggcttgggcagcttcatctcccatgggaagagagttccaggtatcttggtatactgggggaagacaggagtactcgggaagagcgggctcgggattttgaacataaaaccagttggcgtgccatcctttgtttgaagtcttgaagggcatagaaaaatacttttggctcaaagtccctctcagctgaaatccagcccctccaactacgcatggtttgtttttgttcggttggggcttaaggaagaagattcggcggaacagagcaaaatgaggcctaatgcccaaaaaagcttcgcagacatggacgaaatttgcaatatggactatggagtttggattcaaatgatgtaaactgattccatagaagttcaatatcccacggaagaactttgaggttggaagagcaaatccgccatagaaaaaatgagagaaaaccacgacctcatgtgtatcgggggttgggaaagcttcaccacatgctggccgccatccgataatctccttggctgggagaacgccgtgcgccaccatctccttcaagtttccctccgtcatgtcggacgacgcccattggccttcaaagctttctttttcttccgccatcgatttgatccgaatgagctgatttgattcgagggatggctggggagagatgtggaattgaagcggtgagtcgcggggaggattttggtgaactttttggaggtggattggagcggaatggtgaaccctagtttcgccggcgcagttctgtactatagcacggaatggggaaaatggcgagagttccggcggggaagacgaagcgccgcttagacttcgggattttttgttaagggtttcgggggtgctaatgggcctaggcctgataagtacttcagcccaatattattaacagtgtggcccgttgtgctccttagggacttaggcatttttgctttggcaatttatgctcgcaatggtgtggcccaatgctgataaaatcctttttaatgcggttatataattcttcggaattattgcaatgcaaattaaaaggtacccggcagaaaagtgttatactatttttgtaagcttttttaggctgcaaaagctgtctgggttaatttgggatgacttgtttttacaatggtcattctcttggcgtgttatatgcctattttaattatggtgagagtcatagcctaggctattagacttatcaattaccatgatttttataatatttgatggattatctttagagttttttactcagatgcctgtcaaatatgttcatttgtgaactttttagcgtgttattcactcggatactttttactatggctgaaaagcagtcggctgaatgccttgttgggcgccgcatatgcttttgtcatatgatacatgattatgctattattttgttctcgactacatgtttagtttgttaactaatcatatagtcgggggctacacctaattaggtgcatctattcgatgcaccatgttttttatcttttcgccctttacagtctttgtcttcgctactcggcaggccttagcagggaaaaattaaagcactcggattattatttttgagaaagctatgttgttgactgcaaaggtctcgggggctactgtggagattatggataccccatatctacacggcgattatatttagactggatataggataccgaatatagatagaatatctttatttatatctcgggtttgtttcttaacttgtacgtcaaggaaataccctaaggcttagtcggttacgattgtattttatctgtactctcgtattctgataaggatatgagttataccttgtaatacggactccttcccctttataaggaggggtccgagttcttcctgagacatcaactttcttggagattatacatccaataatacactcggcggattcatccccggacaggagtagggtattacttgttgaataagaaggcctgaacctgtgtaaatcctttgtctccaaacccatccacttttctagcttgatagccaccccttttagtattgccgaaatcttgtttcgacagaaacttccttcaggtcgtcacggagttcaaaagttcagacttgagagacaagacatgattgacgactaccgtgtctaacacgaaattctaataccttgaatcgtgagggcacattgaagattttgattcaattgttggcatgatcggcaacactttgtgaataaaatggtgaatgaaatatggaggaatagttcatgaaagctaaaagcacagttgcaggaaataattaatcaaggttcagatcccctggtgagttgtaagcagaatttcaggacacgtaagttttagagtcttcaggttgtggttgtaacttgtgaagaacgacaattggtatatcatgaaaataatttcttgagaattattcatcttgaagttgggagaaaaaaaaaatgttgttccctcgtgtggcaattatatgaattaagttagctgtccccaaaagctgaattggtaaacacctgttaattaatcccccgctgtcagttatatatcaggtcaaaaccattttgcgaatgtcagtgcttgtagttctgttgcatgttgaatatagctcaagtgcttgctagctcagtatggtgcaagctgagttgctgacgtgcaccctcttctggcttgccgaccaacggcgcccgcatggcggagctttccgccgtgcctaccaccgtggggcgagaagcctgctagcctacttaccgttcaatttgcatccctatttccttttgggagctcctgtatttccgtggctcgatttcgggtgcatcccaatcctatcttagcagagctcttcatactccattggccgtgatgtatgccccatttcatggtccccctagtggtaaagaccagtgatttataggctgactatcggctcgtagacgccattttaaagtcgagatttgctccggtcaaaaaaaaaaaaaaaaggcctcgagatactagtacctcacagtaccaaatcgtttctgatcattggatctaacggtgtccatcctgtccagctagatccaacgatcataaacgatttaacactgtgaggtaccggtatctcgagatactttttgttggaccggagcaaatctctttaaagtctatacttgtagttcaaccagtattttctttttaggaaaactagttcagacattcaggactggtgtaggtggctactgggcatgacgtgcacgttgttcgctcctttttttttctgttcatctcagaaccacaagttgcttgtagcacaacctgccctctgaagttcttcttttcttgcaaggccagcaaaaacagttatggcaatcggtcttcaacaaattatacggaatattgcaacctcaaatttagtttggaccaagaaatatgtgcctagacgtgtatgtatgaaactacgagcacaaacttgccaatgttagtattagaatgggttgagcgtgtccaatagagtggattgagaacatcctaaaagaatttggggccaaaacacttccccatcactaagagctagcatcactaaatagattggcttaattgttcccaatccaaaacttttgggatttaggacaaaaaattactccaacagattcccctgctactaaatatttgaagttctcttacctgggtttgtcggtctctacttgtaggactgcgagggcttccaatccatctcattctgctgcagtgctgctttcctgttgcatctatgacttcccacatcgggctagggactaggatggttgtgcgaggagattgcccgttgacgaggtaggatttcagtagtttagcagagggctcactattttgttttagagaatcggtttagttttatattctctttgacagatgagtattttcacttcctatattcagtttaggaaaccaaaataaaattttgggatggattattgccaatctgttggggtgctaaggctaaaaaattagtttgttcgttggccactttgccagtaggatgggactggtccttgcaacgatcattgtttttttttctttttgttaatttcacaaaattacggatacattaactaaactatcacaaaactatatattttaagatgttatataaaaaaatacatatttaacatttaatttatcataaaactatatatttaaggtcaaatatcataaaactatagatttattaaaaaacttaccatgaaactagaactttcggatccatttaatcacaaaagcagagcataatttggtacgcgccgccaacaccgccgtgttgagcatgctcctccatgttaacagatttggctcctattcccaatgcgtcgcactcctaacaagtaatgccctccacacaaacaagcatggattcacaaacaatgtcaccatggcacatcgtccacaagtgaggacgcactccactgccctctggatgggccatcaacattcgagctcttggcagctgtggcacacaggaacaggttggagttagactgaataataatatgagtagtatggttttttacagacaatgtcattaggctgttctagctctctgaaaggacatgtatcctagtggttgtagcgacctgatcgagtagcacctcaaggtcctgagttcaaaatctgcataggagcggattttagattggtttatttgaggactaagttttctgattgatagactaagtttctagtttaaaaagactgcatatatctagttggatatagaggccgggtaaaaaaaacttctctaaaaaaaagtaaagctctgtacatggtgctatggctggctgatccctcttttggcctgtccctcacaactcaaggtttaccaaataatttccatttttatgtattttcacggatgcatgttttgttgtataacactcatgcaacaacagaacgaaaataattaatgggacactttcgaagcaaacacaaggattttcagtacttttgcactctgttttcagttttctcccttctcgttactaccatggtaaaggtcatcactgtctgttgaagtttcccagctagcatagcttccgttcactggccggctagcatagaaatggacttgttctttttatcttattcttagggcatgtttagatcctctaagatggtaaaagttttaccattttggagcatttttgtctattttatctaaacattagtagcaaaagttggcaatttggcatttgtcatttgctagtctagggtagcaaattttaccaaaaaatgttccaagacaacgcgctttctctttctctttctctctttagtgataaaatggcaaaactttagaatgcatctaagcaccaactccataccaaatcttttgccatcaaaacttatgccatttgctatttgccattccgaaaggatctgaacaggcccttgaattcagattcctgctgcgtcccattctcaatatgtagcccacaccacggaatcaccattttcacatgccttaatccctcggaattcctcatgcatgctcgataccgcttaattcgatcacacaactcaatcaggtaggcatcaatacttagctaggccccagtgttgaaatcagctactacatgtgagtgcagtgcagttatttatagacaaggtgtggctgaatcaataccaccacagaccccctcatctctcaagggttgtaacccatatacttgtggtgggtataggcctggttacaggtgggtggccaatgatgacaaatctcaatgaacacccgtcatagatgagtcatatgtgactggtgagtaagtcatctatgacggatcgtaaaatgtcacctgtcatatgtgagtcatcggtgacgtgtcgtaacttcccacccatcattaatgactcatatctgatgggctataacttacgaaccactactaataataaatcacgaatcatgatttttaaaatttaaatgcacagaagaactcaaaaaatactttggagttttactagccatcttatacataatcacacatcactacccacaaatctatgattttgtgactcatctctcatgggtcataacttatgaaccatcactaatgacaaatcaccaataactatttttgaattttaaatacaccaaaaaaactcaaaatatcttttgaaatttactagcaatcctatacatgatcacacatcactagccacatatcaatgaaatttcaagcaatgtacacacctatgtgtttgatgagttttgaagctgatgccttccactctacaaagagcacccttgccaactcatctattattcttttgacttttgactattccactctgaatcatgtaacatatatttaacactctaagtgacttcaaatgaaaacgtcttgttctacaacttttatatccggaagatctccatccgaggtcattaatagaatatattcaacatttcgtttttctcaatataaatctcaacttataatagatatttgggcttataaactatctcaaataaaaatattgtcaattataatattgtagatctagttgagttctacaacttcaataca

SEQ ID NO: 82499 - DNA, 3093 bp, Oryza sativa
ctagggccgtcgtatagcctccccaccgccgccatcgcgatccccggtgccggccgctgcttgttcgtcgctcgattgccgcgaatcgccaaaggagctccgattccctcgcgtcgccggtgagctctccatttttatccatctccggctggccactttgatcgtcgcgatcgtcctctccatccctaactcctctcctcaccttctttaggtgttgccgccgcccgtccgccgtccgtgtcgccggtcgtcgccgccgcctttgtttccccgcgccggccgccaccgcctcctcggtgaggaccggtctccctcccttcctctctctctctttgtcgcgccgcccaccgcttagcgccgccgctgtccgccgctcaccgtcgtgcgccgccgctcgccgccggtggccgcgccgagccgccgcgcgccatggccgggccggccatgctgtgcccgagcgccatgcccgggctagcctcggtgccgcccgtccccagccgcccgatcggccctcgaccgatcgtggccgtccatcccgtggcccacgtggccagccacgtggtgccacgtcggcgccacgtggtacacccccaccccggccccatggactcggtccacggcggaccaccccctttgagccactgacccgtgggccccacttgtgggcgcctccccctcccctcgctgacgtcagccctgggcatttattgcacaataaataattaaggacttttctttattagtaaaaacacagtttatcttctaaaattcataagtaattcatccgagctccgtttaagtccattcaagtctcagtaaatcaagaaaaatgcaaagaatccattaaaaatggtttggtttcctgtttcagtagtcttatagcatgttttgcttgcgtgctttgtttgtcgcgtagatttcggccgtttcgtcgatccgcggtttctcgaagacgttgctgtggtctcatcagttcgagagcaaggcaagtcatgcaatacgtttgatcatattgtacccaatttaccaatatctcgcatttctgttaaatgttgcattcttttgcaatgtcatgtgggatgggtcctattactcagccgtttattgtttaccatatgccattgataacttgggtatcaaaatgactagatgttggtttaggaaatgcttagccatgcttagttcaactagtacacaaatggggatcacattattacattgactatgaccatgagcatagctttggattggtgccaccgcaatggtgttaggtaaataaaatacactgaatggtgggctgtgggtgcatagttttgctggtcgcacccatggcagttaaggaccggttcacgggaaaccctgagagacttaccgtgcttaccacaagcgggagtgggtaactgcttgatctgaagtatagctcgacccttttctaggcaccggtggcgagggtgggcgtgatggagttgggtcggctggggtgtccggttgtccagctgctggattcaccgcggcacaagaggggaccgcccactgccttttgaggggtgggggtgaaaccttagcgtggtgtggatggttaggggagggttatgcggagggtcttgtcacgatttccccctttgcagtatcatggtgatacttcggggcatggtgacatgtgtggaatcgtgtcttgtggatacagttgtacacctctggccagagtaaaactattcgaatagccgtgcccgcggttatgggcgatcaccagattcaccgtgattagtctcacccctagtttagtttattgaactggtgtagttcaggtggttggttgggcctgttgcagcgtggtgtaacattggacagtgatttggttaatactgcttaattactacaatcgtttcactgttttcaactactgctttgaaatgcctgctttatgcaaaagaatctctagcctcctttggttatatcctgtatcatacctactcttccggtatgacttgctgagtacagtgggtagtactcagtcttgctctcttttcccccacaccagagttgaagttcttctcagttggagtcatctcagagaggttggtttcgtcgctgccgtcaaggtttgcctatggagtggagttgccccgctgctgaagtcaactttccaagtctagctcgttttatcttttccgctgcatttataatcttttatatttttgtaagacgtggatctgtatgtcaacaattgtcgtttgtgtaccctggctggtcctggacagggatttaatgcacattcagcttagaaattctggttcgtgaatttctaggtgtgacacaatctaaccaactaagatggatgcactaaaccaactgagagagtagtagttgcttgtttgaatgctacacccaaccgtatttaatatggacaaaataggaaacaagaaccctgcttaatgacttcttggttttcgaaattgtgtccgaaatgactaataaaaccaacccggagggagtagcatggttttgtattagcttagaagtgaagatttctagtatttagtatttaggattaggcatatctatcagactcacgtaaagttgatggacggtaagcggacttattcctaggagagatcctaggagagatgttcacgattccataaaagcgaagtgcggatcccgcacgatgtgcctggtctacgggccaaaaaccgtgtggtaaccatgaagctgcgtagattagcaatctcgcaatgtttgtaagcatgtttagctgtagattgtagattttagagaaccactgtaacattgtttataccttagggtatctgcatatacattgatttgtggtctgaattcaaagaaaaaaaataatatgtcgatttagataaaaacatggttaaattcatttctggaacagtggcatggcactatgctagaggagaaaattgacatttagccatcctcgggttggggtttcgccagaatgccatcttcgaatgtggtttcgttataatgccatcttcaaacgtccccatcttgccacactggcattttagccaatttcagttatttgcaaatattttccattgttttgcttatttggtttga

SEQ ID NO: 82500 - DNA, 4116 bp, Oryza sativa
tagccttctctttaggatctgttttttttttctccttcctgttagtgtgttttgctgctgctcagtcagtttgttctgaaaggttgtgatgttgtgagggttgatccctttcacccttctgcttttgttttctgtgcctatatgtcaagctggcgaccccagcgctatataaggatcagtttgcaaatacttcatgctttctataaaatgcagggcctcgcgtggcctttcctctaaaaaaaattacaaaacaactgagaagttatgttggtgtacattccttaggaatataatactgtgagttttgtttcattggagcagttatgttctgtgcaatcttgcatgctatgtatttcctcatgggatataagatatttgtgagttgtgctctgtattggtctgactttttttcccatttcgggaaaaaaatttgaaacctatttggtaactctatatgtcacatgaaactttgtgcagattgtatccaattggtaatgccataattcaataatcttgtgaaggtgtatcttgttagtgtgagttaaatgttttgtgtgactactagagctgccttgttcctaatgaaacatggttgatttgtacctgatttggttgattgcaacatctttgtttccaaaatccggggcatacatcctcgtcagattgtgtaaaaaaacagaagggccaatcccttccgtccatctcatcagcttttgtgaaaagccctttgacgctgtccaagcagaagggcgatccaggcggcaagttcaattgttttgaacaaaatcattttggaatgtgatagccagattctcaaacaagctattatgagcaatgactcccaactttgaggtgtcatttttttaggataccgaaagcttctttttgttaatgtttaatgatgtacgggtaacacattcccttgtgtaacaatgtgactcacttcatatgcctatgtgggctgtgtacgaaacaatatgctgtgtcttttatggattgaccggtccccgtcttatgtaagagaaaatccaaaatatatcattgacaaatgttcaattaaaaaaattgttatcgacaagtacaagttcttgaaatgttattatacaagcgactttatcctaaaaataacacacctaacagctctccgttaagtgctataggataaacaatgcatttaacgacgcgggatggacgaaactctaacggcgatgatattttttggacaaaatcgcttatatgatagtactttatagaactcacactcgtcgatagcatttctttgatttgtgtgtttgtcgatagcattttttagattctctttatgtaatgtgtgttggtgaccaatgacctaggctgtgttcttttctgcatattgggtgagccagttcctcaattaccatagcacgtttatcaaagtgttaattgttaaaccatgcaatctttaaaaacttttcatacgatttttttaaaaaataactaaaaatatcatttttcaaatttacaattgtcaccctattttgcctcccatatgttgccaatgatcaaatcatacccccaatcacaaagctaggtataacgactccatctttaaaaccggtgcaaatcaactcctacagtggttttggaaacggtttttgctgacttgacaatttaactatgaatgactcgcttcagtcagcgtgtgggaccatcttatcatcttccaatagcagtaaaggcagggagggcacatcggcctaggataaggaccatgtcctctatccaatggtcctgattgtattggtggagtgacatggtgaaatccccaagggggttgatagggtgggtagggagggtagtagtatggtgaaataaaaggtcgatgcatggaatttagatgattgtaaggtggggtgccttgccaatttggtgggaatggattgtgtggtggaattggaggtggtggtggtggcatggcaggaggtgtgtcaaagaatactgatgtattccattcaacattatgactctgtgttggagtggcatgaaccgttggagtgaaaattttactacccaaactagctgaagcggatgcatcccaaaatcagtcacaggcatcaaacaagaaatgttcctaaaatcaaaagcagacgcctttggaggaaacaaagcattgcctttagctgcctttgccttctgtgtcatcgagaaaccgacccctggtattcttgaagtctctcctacttcgattccctgacaactcttggacagccccaacatctcctgtatcactttcaagttttgcattacctcatccttatgtgcctgagcttgcatcccttgattctggatcagctcgtgaaagaacttgatgtcttcttcagatttcctctgaaactcctccaaattgattcaccacagctacccactccggctcctcctcaactacttgatccaccacctttgctcccctcaccatggtgaataagaacaaatccggagattttacaaagagaacgaatctccccaaccctctttgttcctactccaatttcgcctctaactaagttccttgacctggttacggaatttcacaggagatacttattctctcaaccctcatcagtcaagaacactcgatccacaggcttggtcaagaaccagactggctctgataccaaattgtcaggacccgagcctgaattcacacccaagtctgaacgtttcttcagatttggctagtagctacctatctgggttcggattggaagggaaaatagggaatttaacagtaaattgcaaggaatcgaaagtggtagccgcaagacaagtgaaagatagagttagggtttatattcttgatacccaaatacgtggatttgatcggcttatatggagtgcgccactgctaggatacaaaatagctgagctcgcttcagtctcaagccattcccttttcggccacgattacagaaacaataattactactagcggctcttcagcgttggattcacatcagtgaaccggtatggagcaatctcagccgtccatctatcgcatcccctgttcccccatccaatacttcagagattagcaggttcagaattacagagttctaagttcaaaaaaaaaaagaattacagagttctctgaagtaggagagatggggttcaatatgaacccactgtatgaatagtactacaacgggaggatagaattttagggaattttattgcaaacttgatgtaagaaatggaggatgttagtggagtgccatgtgaaactcttgcaaaataaccttaagcgggtatgtaatttccttcaaattttgtgtttgaaacgatgccaaaatctactgattatttgtgctagctaactcaaccccttatgtcagaatagttacttcagctgctacattgcttatatgaatatcatataaatataaatggagaacgaattgtttttttttcctttttgttgttctgggtggtcatcttgtttatgttgctatcgaatgtcatacatgcctttgtgtcaaagtgccagtttagaaaacagagctagtttgttctttccatggtatatatcctttgtattgtattgttaaatgcagaacataatgtatatcaatttaatgaaaacctaggcgataaacctgccgattgtgaataggattcaacaaacaatttaaggtgaatgaaacacagctgcatggtcaaactatttttcacctgtttcagtgatatccactatagctcccaaaaaatcttgatacaaaatttgtacttgaatattaaaatcagttaaagcagacaaaaataacaggcgaaaaatattggaatcgtcatacttgagaagttctggagatgggcaccaacatttcaagaaattggtggtaccagctattacattggtttcctgaattctgcttctgaatttgtaagataaggtcataagggaatttcacgatcaactgaacgttggaaccaaaacatcacttagttcgcattaagattgaacatggaagtgcacatatgcgaagcactagatcattggcatttgaactttgaaacagtatataaccatacaaagtagtgctgaacaattaaaattgtccgaaaagcatcatcactccaata

SEQ ID NO: 82501 - DNA, 2455 bp, Oryza sativa
ccattgtctcttgtactgcaccagtggcaccgtcctccagtcctcatcctcctctcggccgggggcccatataaacccccaaggggagcgtggcttccattcgcccaagcctttcgagtcgtcttctccccttcttctcctcctcctcctcgattcggagctccacccgcagccatggctaagaactaccccgtcgtgagcgccgagtaccaggaggccgtcgagaaggccaggcagaagctgcgcgccctcatcgccgagaagagctgcgcccctctcatgctccgcctcgcgtaagccgtcgccctcgcactcgctcgcttctaggttttgtgtagaggcggatttccgtagactgatccggtttttgtggagacggatcgcgcaggtggcactcggcggggacgttcgacgtgtcgtcgaagaccgggggcccgttcgggacgatgaagaccccggcggagctgtcgcacgccgccaacgcggggctggacatcgcggtgcggatgctcgagcccatcaaggaggagatacccaccatctcctacgccgatttctaccaggttcgccgcgagccccggatagatctggatggacggccccgatctggtcaaacggacgtggttctgatgttttttccccgttgtttttgcgcagcttgccggagttgtggccgtcgaggtgtccggtggacctgccgtccccttccacccaggaagggaggtgagatttcctattacctttcaactcttggggtttttctcagggttctagttaggccttgatatggcagtggtaaactggatggcgtgtggatttgtttgtgatgccacgagattagtcgtaatttgttagtgctccattgatgtgtgtgcttttcatttgtggggactgggggttggtggttcctagagagtagacaaagtgatcaccactaatctaaggccagcagtataataatattttaacagtacggacttttctatattatatacccggataataccgtcaaattgggtttgttcgtattcttgttggtgggtcggcgttacttgacatcctctagatctagaggtggttaaatatccgtgacctcatttacatttccgtaagaccttgtttatttaccataaacatgctaattgttattttttagttattgttggctcatgtgtttgtgtcagttgagtcacataggattcattttcatgcatgctgtatggtgtgaagtttgttatccattcatgcacaaggatattatttttaaggatgtcgccttatcctttttctttgtagtctggctattctcaaagtagtcactgatttaccatggttgtttgcggcatttccctgttcagggttttgatagttactgatctttcattttatcatttttattttttactcaggatagtagttctcatcctaatcgatgtcatactctaaaccatgacaaataaacaattattttctgaattaatggaagaagccttggggacctggaagaagccttggggaccggggttgtttccgttctctatgcatgatatagtttgatctgttggattgtgccatgtaggatatttgttgtgctttgtgaatataaacttaagaaagcatccattatttacaagtctagttggttcagataaagtatattagggcctcccaacttattgcattgacataaaatgataattaggggttcaatctgaaggcagttggaaagcttaatgaaaaaacagtgggccgatatatatctatatgttatgttttaggaaactttagaaaggtgacttggtgcttgttttaggatataataactgttatggatatatctttttttataaatacataatgttcagtaattattatgcaccttcaacaatatcaccgatgatagtaatatatatcatatatgtaacattatacagtgcttaaaatttgcttgtgcatatctggctcatctttatatttatttctaaaatggagagatgattaagtgtttttttatgttccattttatattcattgtgttgttaattgagattgttttcatccttccttgaccttttgcaggacaaacctgcacccccacctgagggccgtcttcctgatgctaccaagggtatgttgccagtttacactactagtctcttccaggaactatagaaacattcaccactattgccataaaagaaacccttgcaaataagtcatcctttaaaatgtttttgtttctgcaatagttgaggtgttatttctgtgtagcacatctaaaatgcttagttatggtagaagtttttcccactgcacacttgacaaatgattcctgtgttgtagtaggcatgttgtatttttctgcatgcttcatttctgatatgatcctgctttgaccttgttctagtaaacctcatgtaaagcaccattgcttacactttgagcttgattgctt

SEQ ID NO: 82502 - DNA, 736 bp, Oryza sativa
aaggggtcggggtgcctcggcctcggggccggggcaagcgcaaccagaccccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacgccacttgagcagcgcgcgaatctgggtgagcagatttgtctcgcccggagatatggtaacgccgcttcggtcggcgagcgtaattaacgcgcgcacgatacaatccatttcgattgccacaaccgcatatccactcaatgcgccgcaagcgggcgaatgggattagtggaagcgtgggcacgggaaacgagggagcgagatagcgagatacgagggagcgaggtagtgggcgcgagaaacgaggagtcaggcccagcgatggcaagggtataaaagcatcgagaaaaggatttgcttccttcctttcgccattgttcctctggggggatccactagtggagagcggccgccc

SEQ ID NO: 82503 - DNA, 3674 bp, Oryza sativa
tttttaatgggacaaatagagtaaagacatgctccaagaatagtactagtattagaatacgtcaaaattatcttttaaatcaataagaacatgtaacaaaagttttatgttgctttaatttgttgtaaaccttttattacatgttctgtcagtcaataagtcgtaaaaaatgaacaaattaaagcaacgtaaaacttttattacatgttcttagtgatttaaaagataattctaaaaataaactataaaaaattaaaattaagttttggctacggctgataacctataagtcaattaaatgatggttatcaccaatgctatttttttttttgcaataaaggaccaactaaggataatttcatttcatttcaacatatcattattataaaattatctgttatactctttaaaaatgtatcaagatgtaccatatatataagtggatgtatcaaatttcagtacttgtatagtatctctttgtatatatatttctgctttttttacacactgcactatataatgtcaaattcattcatttgccaataaaatctgacagaatataaacacatgcatgcacaatgatgtaggctaccaatatatgtacctatatataatgttgtggagtatgtactgcgactggagagctacatgcatatatatatactcccaacacaactgcagcctttgcaaggcgtttcaaaaagcctccaaaagtcatggataaaaaccttaaattccttttcatgcagtgataaaagtcgttgtcttcgtcacagcatgaggcagatacttgggtgctactcctttggctcctagttatttgttgtacctactgataagataagaagttcatatacatccgtttgaaaaaggatgacgtcctaataaaaaaacatgtgagtaaaacctcaaaatcttaaattattaataggtaaactatatatgctttatattaacagatttttgattgaaacactctttcacttggttatacttttagtaatatttataaatgcataatttgaaaattcaatggtacactaccagactgtcgatgtcgtccaaagcgctaagtaaaaaaaaggaacgtgggaagtaattatactgatactttttgtcacagacaagatatagtcattttcacgctatatataaatcgtagtaagatttgtgcatacattggcgaccgatgtacctctccgcgatagaataaatcaacttttgtacacaaatctacacatagggtctacatccatatatatttaaaagtttgatgatatactcgcatatacagtacgacaaatcgacgatatatatcaacataaatcgaactatacgatttttccgtatatcagtggtcgatatattcctctgtcccaaaataaattaacatttatatactaatctagatatatatgtgctatatatatccatatattcgtgtataaaagtttgtttgatattgtgctcgcatagtacgatgaatcaacaacatcgatcgatgtgctatttaaccagctaagctagatagatagcctccgtgtttgtttccggtgagagaaatcaagagatgggtggccacgtcatcgtgtggatattgctctcggtgtgctcatggcggatttcagctgctcaggctcagcaaccaccaagaaccgatcctgtagaaggtatagtaatcaatgtcgccgcgattgattaattttacttctctcgttgcctcaatcaatgcgagtttgatcatttttaatcgatcgatgcagtggcggcgctggaggcgatcctggggagatggaacaagaccaattcgccggtgtggagcatgagcggcgagccatgccgcggcgtccccgtcgacggcgtcaccggcctcgacggcaaccccaagaacaaccccggcatcaagtgcgactgctcctacatcaacggcaccgtctgccatatcacccagctgtaagtgttactatgttttttctggttcttgtttgcatgcacgccaggtgctcgacgcagtgcctacaagagaggccatggcgtctggaatctggatatatgagttcttgtggaaactaacttggaagtgcaactttgcaagaccaccactgcaactatgcataggtttcacttgggagtaactttttttatgtcgccaaataactgctctgctgttcaaatttcaccatgatcactacttggagtaattagagtaaattattttttgtttttacccctcgaacttgcgaaaccaggttaatctgggaccttggtcactggtcagtagtgaaatctgaggttgacaacacatctgtacacaactagctaacgcccactgttttctgccctcttctctctacaagctacaatcacgagtgaaaattggacctaagcagagtttcagtaaccaaccagacatggacatgcttgttgggctgtgtatgtgtgttagtggcgcatgagtatggtaacatactaacatatgtgcatgtatatttggagtaaacagcaagaattttcgtacttatttccaatttttcttactccttgtttatgtaattcaggaaggtatacgccttgaacgttgtcggtcagatacctgcagaattacagaacctcacctacctaaattacctgtatggtatctaactcttatcagctctgcctagatgctgaaacaactgtaggatatgtattaatatcttgcagcaagccagcaaattcaaattcaaacccatgtttgaaattctttgctgctaatgactggatgtttctggtgctgtttcagggacctggatcaaaattacttgtcaggccccataccatcattcatagggcaattgactgccttgacagaattgtaggagttatagttcaagttttatgttcttgcagtattaatcagttgatgtgttgtctgaaccatccttcgttcttttgtgtaaaaaaaaataggcatgtgggattcaatgcactctcaggaccaattccgaaggaacttgggaatctcacgaacctcaacttgctgtaagagatctcttcttgtatacctggtcagttttcaactatagattaatgttggcacaaagtatttaattatatagaaaaatccaaatccagaacattttagaaaattctaaaattcataacttacatatataggcacctcagtgtaatttcacttttcaactggtgtttcatatgttcgaatgaaatccaaaatgcaaaaattgtggatcaaaagggtgtgtttggggtttcgaaagtggatgcctgttcgaggaaaactaaaaggctcatcagggcaaacaatgcccgttttctcagctagtagcatagcatgcaaataaattatatcactcctgaaatatttcttttgtttcagaggcatcagtttgaccaattttactggtcaacttcctaaagaattgggcaacctgaccaaacttcaacgattgtaagtttgtaagccccctctttctaacttgacagatgctacttctagaagaacaaagtttaatttggaccagcaagatacctattgttgaacatgcatgattgttgcatttcattaataacaggtacactgatagtgctggcttgagtggtccattcccttcaacgttctcaaagcttaagaacctgaagctcctgtacgttcaagaacagagccacagttg

SEQ ID NO: 82504 - DNA, 797 bp, Oryza sativa
ttcccttagttagcctctgcctaggagttcaaataatctagctctactcagaccaaagtaagcaagcccatggggacaatctgctggtgcattttaccagcaacttgtcctaaacaaaccccatccaaataggtccaaagtgttgcatgtttcctactacctcggtcctagaatataaggagttttagggttggacatgggttttcataaagtaggtggaattaaatgtgggaaggttgtgattggtgagaggagaatataggtggagaagtttctatattctgggacaaattttgaaagctagaagttgttgtattttgggactgaaggagtgccttttacactcgaattaaaagggttggtattttctacagcaaacaatacggagtagatagcaaaaggcagatatgcatagtcattacttactagcatgtgatatgcagaaggtgcttgctatttaagcttcatttacatctgtaggatagcttccaaggactcttaaaaaggttgcaaactcctgtaaataaaacaagatgagtcacactgtttgcttgacacaaggtcatgcgaatgaagaaattgcaccttcaaatttccaagagcattctgagtttttggatcagccattgatgcctcaaggtccatatagaagaggtagtcaaactgcctggttcaaaccaggatcaaaagggttaagaagatataaacaacacaaagcagttctcagtttttttcttaggtctggaaaaaaaaaacttaaggaaaccaaaacgacaagtatagcaatcattgggttg

SEQ ID NO: 82505 - DNA, 601 bp, Oryza sativa
agggtagctggtaatgcagttcagacctctttgaaacaagtaaattcctctatgaataacagaatactccagtgttccaaatggggccagtttgtctcacttactaggcatgtcttgtaagttacacttgaagtatccggaacaacaactgtcttcatcagttggaggctcaagaatggacactgggcttggttgcccaacctctttcaagcttttatgagactttgccacataactatgatcagaaacagttattgattcataatcacggcaattgaaaggtgatgctgaaacctaaaaaagggaacacttgagtgagtggtacaccagaaactaatgcatgaaaattgattctctcccagtgcgtcattatattgataaatgaaggcaaagtaaagcatcctagtactacataaaccaggtactctaacatactggaacagtacacttctggactcaagaaaaggctaaagaaagagaacctactattttcaaagaaaaaaaaatcaggaaaagagcaattagaggctggatttatttccatataattatcaaaaaaagaaggaaaagagcaatttcgatttctgggttctcattagaa

SEQ ID NO: 82506 - DNA, 7169 bp, Oryza sativa
tcattcatattatcttctagttataaagatttgcctatgttaatttacaggcttggagcttgtatgaaaaggagcaagcactcgggattgttgacccaagacttgaggaattcagcagggatgaagtgtatagagtcatccatgtcgcactcatctgcacacagggctcaccctatcagcgaccaccaatgtcaaaggttgtggcaatgctaactggagatgttgaggtggcagaggtagtgacgaagccgaactacatcaccgagtggcagttcaggggtgggaataccagctatgttaccagccactcaggatcaactacccctaagctcagcaggcagaaagagattgatcctctcactcaatcaccaacaatcaccggagttagccatgagcatgagggaaggtgaatgcaaagttgaatagatgcaggtgatcttggtttgaagtgacaatactatatgctattcgtgcttatgtgactatatgtaaatgtgaatcagagcaaatagcggaacttatttattctgaagtctgaactatgtgtcatgatgataaaagtattgctccttgtaatttgtaatggtgaaatatagtgctatatactaggatgtttggagttgatcactgcgtttgcatgtttgtgaacacgttcatttaatccagtgaagtttaattatagggtgccttttttgctatagtctagagagaatggatcttaataattacagagaatcgttgtccttaactctgctattcataagcgattttggatggccaaagaagcatagaatttacatttcgctagttataacttacaacgaattagtaacaataaaaagtcttcgaacttattaaattctcctgtcctcacttctcactatgatctttgactagctactttttcagatcacgtttagatcagtttgtggagccgtgcaggttgctggtaagtgtggatgattattctaactttccaagggataattggtttagtgacaccaaaagattatgtgtttagaaattaaatataccgtcgaaaagttgccgttacacctaaaatgcgtaatgcttcggtgttatcaaacaaaatttcccccttttttttctagataacagggtttttatatgtacaagtcgcagttgacatgcttgcatggatctcttccagctatgtcaccatcagttcttgatggggatgaattagtccatatgtcgtacaaattgtaaccttaattctccactcctctcgctatctagttggatacggaaatgataccttagcaacttagattacaatatctatacatcgatcatatgtttatggtcttacctcgtcttgcgacttgcagtctatggcgaagcaaggagtggcggccaaattggaccacgtgcgagcatctacggtgtctgatgttgatgttttatgatggtcaacacagactcacctaataacgattcgcagtaaaaacaatagagttgccaaaattaaaagatcaaaactagttagtggagtcaattttaaggttaattcactttcgtggaatcacaaaactaatttacgagtaaatcagaagagaaccatattcgtatttaaatgaccactagcttttgagcaaactagtaaaggataacctccttgtttttcaacataaaacgacaaagatcaacttaactctagggttgctagagcttaaccatgagaaagaatagactctcacgagctaccatcagagttcacaaaacctattggttttaatgaaaccgatagggagaatagctactttagtcactaaagtttctctgtaggatcagtttagtccctaaccttttaaatggtccaaagaaatccttaacctttatcataaggtctagaatagtccttgggtccatcaaaaatcatcatatggatatgccatgtcatcattcatgcaaaatctatgatgaattgaccaatttacccttacgtatatcatagaaaaataaatataagggtgaattagacataaccataggaaaaaaatacttctttttatcacccttttgaggtatatttttgctcttacatataccatatatttttttaacttattccttttttctccttttcctatgtgtaaggatgaattggacaaatcatatagattttgcatagaaaggtgacatggcatgtccatgtggcgattttggtgggaccaaggactatattagcccacatgacaaatttaaaggacttgtttggacaatatgaaagattaaggactaaaatgactcaggagtgaaactttagggaccatattagctattctcctaaaccgatatggttgttggtttgggaaagcaatatttgtacaatatttaccgaaagttgtcggtttacctttttttattttgttcagttttcagtaaaccggtgggaagcggttttcacttcaaaaggtaaaccctggctaccatacatgcactcgcaacaaatctacgcaatactcacatgagctgcatctcaccatataagtgatcagcaccaacacaaaccaaaaaaaaaaaaagactcaactgatcaacacatcaccatatatatcaaattaaacacggcagcctcatcccaactaatttcctttcctcggtggatcacaaattcctacacgcacaaacttaatttggtccctcaaaatgacgattgttccagctatcacaaataatttggcatttccatataaaactaattactagccaaattatgccacaaacatctaggggaattggagggcctgatgaaggacgagccatatccaccgtgaactcctcgccggccggagcggaaaagctccgcccggcacggctacttcttctaattgagtaggcaaaaacatctactggttgagatgaagctcaaggcgcgcaagggatcaccgagaagatgcgattgcgatacagcttaattagaatgtgcggccggcgccgaccaagtgctcaacgatatgtcggggctctggcgtggccgctgcgcttctcctcctcggtggcatggagatcctagactccgtgaacaagatcttcgttaccgcctctggcatcttcaatggcggcgcggcagaatcgcacccgcaggtggtgatcgacaccccacgccacgcacagccagctgctgggctgctcggtttgggctagtcccgggtcgaacacctagatggcaatgaacagtgtgctttgaatttttgtgagtaataaagagggaatttagatagagagaaagaaaggggataaactgcaaatgcaacagccaagatttgatttgaattacgagattgcaactgtgagtgcaaaatgcgccgctagaaattgggttttgatattttatttttaatattgatttaaacactccaatgacaccactatcgaatttaataatgacttatttgcacgacaacttattttcatagttgggttttttgaatttcatttggattattgctattttggttttagtattacgatggaaacaaaattaactttccaaaatagatttaaatacttaaatttaacttgtattttgtatgttacaaattgataattagctttcctttaattgggttgctcttgctgtagatatggtccaatttactcccgtaaactattttattgaatcaatcatctaaactatttttcgactcattttaccccctagctaagttcactttactggttaattacattttccttatttgtttctctttatacaaattatattttaagcttaaaatttttaaagccatagatgacaccattattaaagttataaaatagttttaaaatttttcatgactatttacttgaaatttaaaacctctacgtttaaattagtcttagtagttacaacctatgtaaacaccgattaaaaagtttcaaaataaaatattgagagataagttataatgtatatatcaataccacctaatttccctaaatattgagagataagttataatttatatatcaatccaccaaaatttcattgcaaaatatgacctatacatagatcagagacgaaaaagacaaatattgttagggagtaaggtgaaccattttcaatattttggggtgtaaaatgagccaagaaattatttaggaggttaagtgttccagtgcaaaagttcgagggagtaaaattgactttttttttctcgatgtaatgagttaacattaatatatatatatatatatatatatatatatatatatatatatatatagtaaatttgtttggtgctccatggtgcccgggcatcattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcatatatatatatatatatatatatatatatatatatatatatatatatatatatatatatatatatatatatatataaaatgtgaatctcccactgtaatcttgtagcgggagattcacattatatatattcctcaactttgattttggactttttactttccatttggcttggagatttctattatttgagtttttcattattttgaaaatatcacgcaattatgcaaacatacatactcaaaattaacaaaaatgattgtatagtactttgtacgatattaacgaagatgcctgcacgcggattgacattctagttaaacaggtgtgataaaatatgtgtatgtcctataagcaatacgcatatctaagtttgatcacacttacagaaaaaaaaaaggtatatttatatcttataggaactgttcactactgaattttatcttttgtttctccgaatgtacaataaatctagtctttcatgtatgtatataaacttactgcattatatatattctacgttaccaatttcttaagacttttttacattatgtgagccacatgtaagctatatatagatatacatattcacctagatgtaaaaaatcgtggtccggtattttactgcaacccttcattagtatgaacacagagagagatgtcgttgttgttgttgcagtagtgtgcccttggccaacttgtgtgaccggtagttggtacatgtgcgtcaagtaggatgaaagaggacaaataatggagcaagatgaattgaaacattgatatgataagtcgtagaaaataaatgaagcatctaataataacttacgagtaaaaattttatatacatgtcatagctatttaaaagctaaagctggaaaatagatcatgatgaaaaccctcaaatcaactctaggttaagttttaaatttacattttatcagcagttgataaaccaatagtcatatatatttatattaattggacactccgagaaagctctcacatcaataaaaagatatggccattagttagttggctcaaattattagaaccctatatcgtattaagaatttatattaaacacaatgtttaatagatttttaatttttactactgtatggactctttggatttcgctatcctacaacttgtatatatgaaattccacccatttgagctctcaatttagtagattattttttaattctgaaatccaaaattaataattagtaggttaattgcaaatgcgctatgccctagggctacagttaacaataggtgccgacaggcagtcatcgaaattcgaaagtgggtaatttaaaataatgatttccattccttcaaaaataaatattttctttctataaagctatgtccacaaatataaggattttttaacagataaaacataaggatttttgttatgtatctaagagcacattctataaatataaatccaagtgcatgtatccaggtgcgtagtaaaacatcctatccatggacatggacagaggtactgcttcatattttcagcatatctagagcgatcttattttcagttgattcattggatcgatgtcatgtcaaaaaggtcatgttgcatctttttttgattattttttccacggaaaatgatgtaatcttggaccactctctgtgacctgtgttatgacttatgactgtgctgcaaaggggagtatgaattattgttctcaaaactagagatcactcatgctccaggaagccttgaatttgtcttgatttatactgaaagtaacctggattcataaaattcttgtgttcgaagcgaatggttgaggaattatcgtttcattgagagagagatttcatctcagctagaaaagttaatacataaaaaaatgttgctagatacctcattgaagacagtttaacaccaatggaaaaaaaatgttgcaacatatacctcattttatttcaacattgcagtattaaaagaaatcttttatatatgctccttttaaaaaagcatcaagatgtacaagtttttaggggtttaacttggtcaggaagagaatgtgcatcattgtcaggaagacaacggtgtgaaacctgtcatgaatggtagcctcccgagacttgagctagaggacctagtaacaccgaggcatcaactagccagggatgcaagtaggcaatcaatcgaccatctctatgagagcacgcgtgctaatttagtttaacgagtttcagatactacctatgtcctaaaataagttaatttttcatccatcacacatataccaatacaaacatcaaaagattagaataccagtcactagatgaatagaagtcggggtactcaaaatcgttcatatgcttgacaagagagtcgagatgatccaaagtaaaacaaatacaagattattcgattcagattgaaaacattggttaaaagatagttcaaagcaaaacatcggtaataaaagatgatttaaagtgaaatttgctcattattatgataatagctcgtttgatttacgagg

SEQ ID NO: 82507 - DNA, 1230 bp, Oryza sativa
tagggggtatccagtaacttggttcaaaaattttttttatctatagtttatctattttcatcatgtatataccccgtcagtttaaatataggcaccgtaccaagctaaatttgattcaaaccagagtaaagcaagtgagtggaacaccccttcattttgttctagctccgcccctggcaatgctgtcttgcaattaggcttgttctcggttaatctctctctgaggattaaaggaaaactagagaaaattaatttcataactatcgagatgttggaattaatccttctcaatcttcttcaatctctttcttaagggaattaaccgaagtgggcaatatttgtagaccgcaggcataaaacaacacttcattgcagctcttcttgctgtcctggagaacacaaggacaaggtggggcaagcagattacacattattcagtacttagggcatgctgttaacatgatgccagggtttatgtactggaaattcggctttgattgacttgattggagcccacaactcatgttggaaaataaataacggtaacagctgtcatttattcaaaacaactccttgttttatgtggacttatgttcatcctaagctccctttgtctaaaacatgcacgcgtcaagtgataaaatctacacaagtagaagaaatggcacattgtatccagaagtcagcttgcacaccttaatgtttcaaatttccaataattattcaaaggtgtttcaaccccaatgatatgttcctaattttttaattcactatcttgtggaaaatctgacaaaggacgatctaatctacggctatagggtacgtcagttaggtccaatccgttcaatggacgtccttttttattctcttctccaagatcacgttgccctgggacatcatgatctgttcatcattaacaaaccaacacaatcattgtgtggcaataagatgaattagttaggttaagggaagcttttcatatggccgcattgaacattctgtgcctactcaagtctaaagccgtaaacttactcttaccatgctggcctcgtgcaaactttacaacgcacaggcacagcaatcctaaagcaatcgatccatactgtttagtcttacaaaaaaatgattcatatatactcttggaaaataatggatcatttttgtttgaagccaaaatatgctctggctcgttaaatagtacattgtctatgtctagtttgctaaaaaaaa

SEQ ID NO: 82508 - DNA, 17525 bp, Oryza sativa
tccccctccctcctcaccatccccacccccatccccacacccttccccgccgccaccgctgcctccgccgccgccccgcacctcccatcatccaccgcagccgccctcccgcacacgcaccccatgcccgctgcctacactcactccgcccacctcccgcgccggcgccgccgccacgggcgcggcatgcggaggccgggatcttcccggggtaggtcgccgcgccgccgcgccgaattggggcgcgcgcggctagggtttggattggagtggaggaggaggaggaggaggaggaagtggaggggagtagcaaaaaccagcaagggagtagtagcacactagcaacggccaggagaagaagacagcgagaggggaaggggagggacctgtttgtaatttctcggttttgtttgtaatttttttcaggggtgtttctgcttaatggcttctctctaggtctttgaggggagggacctgtttctaatttcgtggttttgtttgtaactttttgcagggttgtttctgattaatggcttctctctatgtccttttgcatttgaggaccttgaaggatggatatttttgaaatggaggtaaatgtcaataccttgattcctcttggtcacatttctctcctctaataacaagttaagcaaataaagttaaggttttccgtaaataggcttcgattatagataaagaaatgtcgaatttaaagtttgtaaaagtaggacccctagataacatgcaagaagggatttgtgtcattggcatattgttcgccaaatttctagatgagggctatatataataattttcttgctgatattagcgactatcatcttggagagaacggtagagaatagcaaaattatccacaataagctcacactgtatgattgattggttaatatgataagaatgtctagatttgccaacctttaacaataaaaatcagtcacgctttagttgcatataaaacccacgccatgctttcaatgaacactggtgcatgtatgggatcaaaactgcattgcgacactcgatactacgaaaacacaacaaatgtataacttgatcaaacttgactaatcacaagtatgtctatttaaccacgtggctcctaagcccaaaagaagaaatactcccatacttgaggggctcaaagagtcaagaaccatagcaacacagttcatgagcggcaaagacaggaagcttgtgagacaacttaaaagctgaataatcaagcttttggggggcatatatgcagatccctttttcttgcccccacacttctttaaaaattataaataaataaacaaaaatacagaagctgttcttccctgtggtgtctctgcaccggctcgccaacttttcctaccctccaggatctcactgacacgtgagtcccacatatccgggcccacccgtcagcgacacgtggcgacgcgaggggtatgatttctggtgcgggtcttcgagaacggcgccggccgttaaactgttgtcactgggctaagctagctagctgccaatttggctcgttgctacgcccacacggtgccacgtacacaggatctgggcatagaggtgtgtgtatgacatggtgggcccaccagctgaactgctactgtttgtgtattgtgctgatttggcaggtggttgtggtaaagcttcttcacgatgggatcgagatcgagtttttttttaactcaataatcctcgtgggcaaaatatatgtttttgtcacgagaaatgcatggtactacgtgtcctagaggattttttttcttactaattaaatccaagctcgtttgttagtacacaacgagagctttactactggccactaattcacatgctaaagctgatttatacaggacttttggcatttatatatactgtcatggtgtttctatttttcttttcattgcaaaaaaaaaaaggacgctccctgtcgtccacgcgcgggcgaccggccgccgccaccggagcgcgccgccggaaaccgcgcggcccgccgggatggcggcggcggggccaaaacccggcggtggcccgtcttcggcgtgaggaggcgatgcagcgtgccgggaggccgcgcggcggcgcggcttgtggctgcggatccggcgccgccgccgccggatctgatggcggcgcgaccgggcgacgggcgacgcggcgcaaccgggcaacgggagacgcggcacgccaggagacgggggttgacggcggctggtggaggggtcggcgacgatgttggagatgatgcggagaccggcggcaggctggggcggcttcgcggtgggcagcagcgactcgtgccgaggtcgcggcgtcgacgggaggttggcgccagggcaggagacggcgcggagacggcggcaggcaggggcgacgtcgccgtgggcgggcagcggtggctcgatccgtccgcgcgcaggcagaggctgtggcggcgtggtggtcatgacgacgacggagctgcagcggcgcggacgttgagccggcttgtgccgccctggctggatccggccatccacgaccggatttcgcctaggtgggctccagcggggttgttcgctggcatctcattggcgacgagcctcctgccgagcagggggcttctttggccagtggaggtttggtggctcaagggcggcaatgcatggatgtggagttggcgggacgacggcttgtgctggcgtgaagcaggaatggggcttgatgtccgcggcggacttcctcgttgctggccgagtgtttttcccttccttcggtttccccccttctttggccggacccttttctggtcgtggggaacgctagggggagggcggaggcttcggtttgccgtaggagtttgcggcggattgatagcgttttgagggtggccaagggcccgtctttgccgtttgttacgatcaaggtatgaatgcttgtgagacgtcatagactattctatggccgtcgatgtggggtgcttgtgtgggtaaagtgaagatgctagcgaaagtcttgccgtgcctttggccggttcgacgacgacggcgctcgtggtcgtcgtttcccttcttggaggcgttgtcatggcgttctttcatatcccccacaaatcttcaggtgaaaaccttgttccggctttcggacgagcggcgacggtgttacgcgtcgtgtcctccttgggggcgtcgcttcagagaagtttcaacgcattgacgactgttgatggtctttttcgcttcgaaagctttcatacattgtgttcggcgaggctttcgccttcttgggtctacttcgtttcttgtggtgagtgtcacgctctttggttgtttctgttgatgaagtcgaagctgctcgctgatggggtgcggcgaagcttggcaacgatgacatgttgcagtctcttccaaggagttctggtgctagccgtgtgaaggaagtggctcctcgatggctaggctgatgtccattgttggatgccggagctgcttttcgctttggtgattttcgtggattcagtgtcgctgtggttgtgaagtcggcgctgctgggtcgcttgggcggctagctcgacaacgataacacctcttatgtgatatgggagctgtttagtcgcttttgtgttcagcttggcggcgacatcctgcgtttgggctccgccgtagttgttagttatgtagggtggttttcagccggttttcctgtaattaaccgtgcaattgtatggttttcgggtccgattttccttataagctgggtcaattctcttcttctaaatataaaagtggagcaaagtttcgccttaggtttttttttaaaaaaaaccatgcgtctgagtttttacaaacatcctatgtgtgtgtttttggcagtatgaggatgtctgtttcctcgcactgacatcttacttgaaatgtcgtctctgcaggtctgcagatatactgtattgtccatgataaaattaagagtagaatataaacaagcagacagctaacagcttgctaccatgagcagtcaagagacaatgcaaattaagattgcaagtgtgtgtgccttgaaagttgaaaccatgcaaaagtacagacacccaatccatacattaattacacaactcaacttgcatcatcatggtaagtattggttcatttttaatccatccaagcgatgacccaaaattaagtcagctagccatcccaatgtacacaaaattaatgagatagagagggagagagagagaaaaataactagacaagcgtggacaactggacgaccgaattagagcaggtacaatagcaggctataaaccagctataaacatattttaaagagataaaggaaaggagagaagagcagcgggctacagatctgtagccagctgcagcacagactctaagacgtactgtgtgtacgacaggtaggaccaggtattaatagtatagcaagtaactactgtatgaattagctattactagcaaaagtgcccgtgcgttgcaccaggtgattactgagtgtgtatattgaccaaaagtgttgtttggtttagcaaaagtgcctgtgcgttgcaacgggaagcgtatagatcagcagaatatggaattaattaaaatataaattcactgaaatatttggtatttttaagtaggtatgtatataattaaataaaaatttacaagtaaagtatgtgtgagaaataaaatgatatggttaaatttaattttattaaattctccatgattagtttcgctctttgaaattttatagaattttcagagcttaattgctaattttaataatacaaacttcatttaacaattatttaattggaaatctaatttaagtttttgttgggccgaccgacctacgtgtggcccatgaagcgcgtgtggcccatcactgatgcggcccgatgatggaggccagcccgacgcgggagcgatctgagccgttcattttaatggacggctcagatcggctcctaatctatcaaaacccccaacccaaataaaacctaaccctaatttcattcttccccttcctcccctccacgcaggccgcctctctccctgccggcggccgcgccgcacccccaccggcgcacctctccacgctccttcccaaccggcgacgcctcttgcccccctccccaccgccggcggccttccccaccgagcagcggcgacgacggcggtagcggcgccctgccctcccgcgagcggcggcggcggtgacggcacactccctcgcggcgggcggtggccgccgcaccactctctcggcagatccggaggtggtggcggcggcggtagccgccggtggatccgaaggtggcggcggtcgtggaccggatgcggctccctcctcccctctcgcctccctcctgcccctgatccggcggtgatggcggtgtcgtaagttcaagtgccttaatttggtttcggtgattaatgacaaatctaattatatgagattaacgtttttatgagcctttctttgactagtcttatttggatatgaaagtaaaaatgatgggaggtatgtattaaacttcgcatattctaacttggtctctcttgtggatccaaaatatagtgtgagctccctcattgatcttgattgattatgcacatatgtgttcctttatatccatatgtatgtacacttgagggggagcttattctatattttgtttattataagatttctatcttgatttgaaaacatctttcatctcatctctctatattgtttatatcgggttattatccatcaccaaagagagaaaagattgaaagatcttggattaaacaatttgtgtaattgttacgttggtgatagatgataaaccgatgtttatgggattaacctctcttttgcataagttatctactaggtcatttcccgataatgagatgtggaagacatgcattcttttgtgatggaccttaatcatgacaaggatgaaatgcatggagataaaatgatatgtaccacttcttatctcttactttttgataggttcatatatatgatttccatgttattgatatataagtgtgagactaatgtttacttgaatcttatcttatttagtctcgtttacattgagaacatggagatcatgaaggtatatgttttatgttggtctatatcattactacatatgccttctctctatgtgtataggataaaccccaattggtcattctctaattatgcatacacttgcatctcttgtatttatttgtatgcatatatttagggggagtaaatcctatacatttattgtgcatgttctagatccatgttgttcacctattatttatatcggatctttgcacttaaggttgcatacgagtatatgacacttgtgatgttaatgaatactcaacaaacatatccatatctttcatatgtaaccggttggtcatcaagtgaaggatgacaactgatttgttgagactaatgttctcctttgatatgtgaaaaggaatagatcccactatgatgaggctaatggatgacaccatgggttaatagtcaccaagctaaggacatcgccatgttggcaagaatgaaatcaagcttgtgatgagaagaaagtcttgacaaatgatggtaaataccttggtataaacatggttgaatcaaatggtcacaagtgttgatctcaactcaagcttgaccctaagatggatggcgcaaggcaaaggtataatgtagctaagaatgttttcttagtcttttcctggtcttagtgtttggtgtagaccggatttgctagataggcgctgtactatcaagaggggtctatgaagcgagcttgtggatgatcttgtgccatattagttcatatgcatgtaggtgtatttggtgggcttgtctagccaagtgtggtgagttttctcaagtcctaaacaaagagagatgtgggcaaatcctataggtttgggtagcctcatgtggttatgtccggtggagtatcctttggagtgtgagccctttctccctgagaaaatttgtgtttcttggatggattgttcatgggttggatagccctttgaataagctttccataaagccaagaacgccaaattccgagacccgagtcaagagatatgttgttttactaacggtcggttgagctgaaaagtgatctgcggtctgaccgggcctgttagccggtctaaccggcgtggtaaggccgatctgaccggccccagtggtctgttgcacttgtctggtttttggtggcgagacagagccgccaaagccacaaccggtcggaccgagccaaaggcagtctgaccgagccgtggaaggtctgaccggccactacactgcggtcagaccggccaggttgagtgggctcaatgattgccctgtaacggctagttttctagccgttacaaagtagtccggtctgaccggccactctatggcggtcggaccggcagagcacagagttggggatttcgaccccaacggctagttttggtggttgggggtatatatacccactccccagcaacaagggtaaggttttggcactccattgcattatattgaacccttgcaagagctctcacacccttggacacttagtttatctagtgaggtgttagagagtgagttaagccaatccaagtgcattgcttcattgttatagctagtgtggcacttgatcatcctcggcaagcatcctagacttgttactcttggaggttgccgcctcctagacggcttgtggaggtgttgcccggtgacctctctgaggagattgtggaggaggccaggcaccggttgtgagtggtttggagttcaccaccttcggagtgaaggaagaactaccctagtgatcgaggctttggtagtcctctccgtgggccagctcccgccttacccaccccttgacgaagggggcgtgcggtggcttcgtggttgagcggtggagttgggctcgcctcaacggagattaggaaaccggcgagtttctgaacctcggtgaaaatttcttgtctcttgtctcctttattttatgcaaatttactttgagcaagtttacatactagagtttatttgtgctattatcaccctaggcttgcaaacctcaacataggctagcttctttgtgcacttacttgagactagttgatttaggttttgaattgtgcaaaaccattttgatttacgcttccgcatataaaactcggttttagctaaaagtttgaaaaaccgcctattcaccccccctctagtcggcctccttgatcctacaggtgtcggcggcgtcggcgggtgggttcgtggccgacggcgaggtggcgaggagcagcgcgctgcagcctccggttcggctcgccccttctctcctagtcatctcgtgttaatatgatgttttctaatgattccgatttagatttggacttggattttgtgtttgatttggatttggattgtgatgatttgagattggagagaaggtgtgctcaatgtgggattctatttgtgtgatgatggaattccgactgggttttttgagggggggagggacgaaaaattaccgtatggatgaggtaacgaccggaaaaatccgaatatttatattagttatagatattggctataaatgatttggagctagtagttagctatactattaaacttgctcttatagtaacaagtggagggacgctgtcacatgaaacaaactgaacaggcggactgctatagattacatagagagattattattgtcctcgatatggttccaaatcatgtatagttagatccgcaatttatcattaccgcgaagtgcgcgcgcaaataaactaaaatagccaaactaccgagaatagcagtagcacttgatgacgatgaactcagcattacagatcgaggctaatataggcatatgcaatttgatgtaattaatactacattcgttccaatttaagtgtagttatagattttcgtgtccaacgtttgactgtccgtcttatttgaaaactttatgaaatccttttaaaaaaattagtatttatattttatcatctaataacaacaaaactactaatcatatttttctttcaaacaggacgaacggtcaaacattagacataaaaaaaaatataaaactgcaaccttttttttgacgaaggtagtactatatattccaatactattatagtacatccgttcttatactgatcgagtagggcattaccgagtaactaaaaaaatctataggtgatgttccatatatattttcatttgatttagtcaccccctgtatatatggagctcgatagatcgagcgagcgtgtattcttggtttgttgcgtggcatgtagggacaaagtatatatggtagggcaatagacgacgcctggttgctttgctttgcttgctcaagcagaggcagaccacatgcatgcatccattcgacgatatatggatctggccggtagatcgaaaaagctaagccaaccccaaccaccgcgaggaagtggcccttcccgatcattaatgcatgctgctagctactccctcagtcacataaaaaaacccaattacaaagacgaatctgaatatagcatatgtttaaatttatccttggaatttaatttttgttaaaatagaggagtagctgctacctgtatatacaaacactagagattatcttcttgttacgatcattaatacatttccgaggtatagcaggcaacaatgactctgaagaattattgcaaacgttttagctacatatatatagctcatgatctgttactaatggagacgccgtacgtgatgtgggtatgtatatatggaatcggagcatcgatcgatcgatcacagtacagtccctgcatgaattgaacagaggaagaaaagagagtacggatgctgctgctgcttgaccgggacatcgatcgatcgagaaagagaagagagacgcagtgcagtggtggtacgggttgatttgggagacgagctaagctacactcctactactcgtagctcggccagtgcactgcacagcatgcgcctcttctcttgtctcgacgcatgctggtgcagagacgacgagacgagagagagagagacggcaatggcgccatgcgtaggagcatctcggaggcaagagatggagttatactccctccttcccatagtactccctgcgtttcaaaatatttaacgccgttaattttttagcatatatttaattgttcgtcttattaaaaaaatttaagtaattattaattctttttctatcatttgattcattgttaaatatatttttatgtaggcatataattttacatatttcacaaaagtttttgaataaaacgaacgatcaaacatgtgctaaaaagtcaacggtgtcaaacatttcgaaacagagagagtattaaaacctaggactggatgggatgtttcatagtacaatgaatttggacattggacatgaacatcttttatatatgttgtactatgaaacattccattcagtctaagattataatattataggacggagagagtagctcgcagagcaggtggtcacatggcacttcgatcgtgtacctgcattctgcatttgcagccgcccgcgactgcaaaagctggaccctctagtttctcgtgttcctctctcacacaggccacggcaatactacatactgcttttttctttatttaaatttaaataattttatagtatagtatagtaacaattttcatacaaagtaaacattgtatcaaaatatgttcggtgttaaatataataaaactaatttggtgctgtggatgtactattttttttataaatttagttaaatataaagtagtttgacttaaaaaaattcaaacgacttattatatgtgaaatagtcagtagtactagacacaggtagtagaagagtaagctttgctctctttctctctctgtactacggcccaaccaaatgggcctcgttgttggtggcaggagggcaggcccagcggggaccatttttaattctggccccgatggactcctcgatcaggagccgactatcattttcttatactctatcaccttatcagccaaataattcaaattccatgactaaattgaaccggacactatgatttgccggttgataagttgattgatcttgtgtgactccgtttttgtttcagttagccaatatcatttccatcctcccaactcgttgttaatttccatacctttttcgtcgagagatgcatttaacaatgtagtgataagttgtggtaattaacccccaaatcccaccgtgtacgattctcaataggttgtccacattttttttcatatcttttgtcgtctgtcataccacaattttcatagcccaaagttacctctccattttttttgccttctttattgtgtttgttgttcatgtaaaaaagactttttttagtctcttctcctaatatgaaatggcagagctcctgcccgctccctccaagaaacaatttgcaggggcaacgcgccaggaaggtgctaccatacaagctctctgaagcacaaatagcagatgtgtccaggttttccactattccggagtcgtttcttactctgacactacatcgtactctctccgttccaaaatataataacttttagcccttaggatttatcctaaaatataacaacttctccaccaacattctcttaccaaccaatcacaaccctccaccattcacttttcctatctacctccactactcatctaatcacaaccatacaccactcacttctacctacttttttaaaaccgtgtccaactttaaaactttttatgttttaggacgaagtgagtacgtgctgaggatcatcgtttcccagcctgctcttctttgatcctgagcacgcagctgcaagcctgcaatagccagccagcaagcaagctatagatggccaaaaggccagaggcccgatggcccggcccacggcacggtgttttggcccggcccaagcacggcacgacccgtcaagggtcgggcccgtgccggcccggcccgaccatcgggccgtgcctgggcctctccgccggcacgttgggccagcacggcacgatgggccgcatgccaggcccgacacataaacaatagggagtaaaaataaacatattatatgtcacggttaaaagaatagggacgtaaaatagacttatttacctatatatatgtcagcccaaagaggagggacgaaaaatagacttattttcactatatatatgtcacagcccaaagtggagggatggaaaatagacttattttcgctataatatgtcacagcgcaaagaggagggatgaaaagtagacttatttaaaaaaggcacgatgggccacccgtgccttcgggccggcccggcacgacccgacagctggtgggccgtgcctgagcgggaggcgcagcccatgggccaaagtgccgatcgggccatgccggcccgatggctggtgggccgtgcctgggccgagccgtgccgggcaggccttttggccatctataaagcaagcaaggacactggtgttgtggtgccaaattaaatggcaattcaatcctctcacgtactccatccgttccataaaaacgaatctacgaccggatgtgacatatactagtactacatatgtttagattcgtagtgctacgatgtgtcacatccggtactaggttggttttttatgcgatagaggaagtaaggctaagttgcaaatattattacctaggatgaaaaatacattaatagtatcgcctaccattggtaatttagtagagatccaaaacaaggcccttttgcataatttcggaccactagcaatcgaagccgtctagttcaggggcctacctgcattatttcggacctctagcaacagtaccaatatggatgtaaacggtcagaaaaatgccaaactcattttcatactatttttttgatgaaacggaatggaaaacgatatattcagaaatagaaacaaaatcgaaacaaaaaataaaaaatatacggatgttttgaaaacatgtcaatatcgattgttggatcattggaacccagtaataaatgtacctcagaaacattgagcttcgaaatcacatatttaaattaacatgatgaaataaattcagctttgctattcctgctatgaccaacttttttttgttggcatcaaagtaaacagaccctaaattacaaatttcctcttctttaatcatttgctcaaattggagattggtcgaggagttgatggacttctcatcttatattctggcccaacctacatgggccgcatgttggtggcgactcagtttcaggcccaacaacatatagggctccacctttcgctggcaaaaccgtcctgtttttccgcaggacgaaagtctaatttaaccaagcaaactattccatcagaccataaccaaagtggttcactttactggttaattatatttctctttatttttcctttatacaagtcgtattttaagcataaattttatagagatatagatgacaccattattaaagttttaaaaattgtcatgactatttgcttgaaatttaagacatatatgtttgaattagtctcagtgctatataaacaacgattaaaaagttttaaaaaatattgagagatatgttataatgcatatatcaatcccaccaaattttattgtaaaatatcgttagggagtaagatgaaccattaaagacgtaaaatagaccaagaaattgttgaagttcgattgagtatgatagacctttttactaggcaaaccacacgaatacacgattgattaatttcactgagaatagcacgggtacatcacatcacacaaattcatacgttgatacacgcatagtcgccgaagcgaccagctgcttaattaatcgataacacacgggtttaattcagcaataatcagcacacacacaaaccacactcatatgggtggtttttattgtggactaattaaggtaggtgactcgccggcggcgagtgttcggttgcttcgtgacttcacttgccgcacttgcagtcggtgcaggagcagctggtgccgcacttgcagccgccgttctcctcgccggcggcgacctcctcgaagtggctgcacgcacgcacaaagcaagcaaataattaaggcgtcaggtaaaaattgttgagaactatctaatctcgtatgtaaagttcttactatttttctgttaattttaaaatatttttgatgaagtttttttatggtggttgtagtatatgctacagaccccatcatttagcttattcgtggaataagtcaaacgatataattgcaaacgaaaataatttataaataaaattcatatatatatttttagcaactaaaagtagagggtgaaaaataaattttaataaaaaacttaaaatcagttttaaatttaagattgaaaatttaaattttgtctgataaatataagcatgaacgaatacattaggccgtacgtgtctcgtatgcgaacgtcaggatcgatagtatcgtgtgtgtgtttgagagcaaagacgaagaaattaaaactgtaaaattcagacgagaaatatgctttggttgatcgatattgagttagttagttacctcttctcggcttcaactatgacgacgccatagctggtacctttcttcctgcaaattaatcaccacgtcaatcgaatcaaaccgatcagtgtttcgcaaaattcaaagaaatcaacatgttaagatcgaaacaaaataattattgactgatctagatcgaggaggcagctagtaattaagtacttacacgcactggctcttgtcagcacagtcgcagttgccgcacttgtccgacatggtcgaagatttaattagctaagtgagtgatgagttaatcccttgtgttgcttatgctttcttgtgctctggtggtgaggagcaatggctgcttcggctggtggtatatatatcggctggatgcagagagagagaagaagacgacaattaaccaaaggaagaagaagaatcatatcatcttctggagacgtagcagctggatggaggaggacacacgcctcgatcgagaggcacgcgctccaaaggcgccatccgcctcacgaaacgaatctctagctcccccacaccggataatgccaagctttaggtcccgtctggaatgcgtcaactttccgaatatttgttgggggtaaacttcacggagaatatcggctccacctcttcttaagctaaagctcggctaaaaatacgagcagagttgtgtagaactctctcataaaataagctagagaggtggacctgagtttaaacagcttcacaactccactccagatctaacttcctgaagctaaatttaggagttgaaactctaccaaacaagccattacttaaaaaatttataaaataaatttaaaaatagtcgcatataattattattcatattttatcatctaataacagtaaaaatattaattataattattttttaaataagttggagagtcaaacgttatataagaactgaaaaatgcattctttatgggagatagagggagtagctcgttttcacgagaaacggagaaaagcctcacagttaaatataagaggatactatagtttactgggtttttttttatactagctacttagctagtcgtagccaagatgttttagagtttaaaaaaaaagtagcagctagcaactcaggaagaatacacagttaaatcacatatgcagcgaaaaccaactattgtggaaaaaaaatagacatcttaggatttattcatgtcaacataagtaaaacattttctctaacatcaactttttatcattttccattacatattttttcagcaactcacgttttcctatttactatgtctatttcatattataaagtcgttttgaggtttgactaaattaatttatagacgatatttttaacagaaaatatcaaaatatgttcaatgtaagacgtaatgaaactaatttaaggctataagtgttgttatatttttttttataaacttgattaaactttcaaaaaaaatgattaaaaaaagaaacttaaagtgacctaacacgaaatggagagagcatctgcgagttgcttcagcttacaaggaactaccagagcctgtgtttggtcgaaacacccccgtcgcaaactgccacaataatttttgcatccatatatcgatcaatatcatcttccatctctcatcagtcgacaagctactagctactagctagcacggcatggcaaagagcgaatattattgtggctgtatgtatcagcggccttatcacctttggcgtcttgtcgaagattttacagtgctcccctcgcgtccggtctccgtcgtcgaccatcaccgtccggctcgatacagagcgatcagcgagaattttcaaaaaaaatttgacgcagatatgaattccaaacagctctgaatatattctccttttcgttggacccggacgtaaagtaacttcctaaaatcagaattcaaattcatactacctccgtcccgtttcgattttttttggtaatatttgattattcatcttactaaaaaaatttagaattattatttattttgttcgtaatctgtttcctttatgtcctcttctttctacaattctttctttctttatttatttattttccccagtcagtcaaggactcaaggtgttgctgcccttttctttttctccctttcaaaaacctgtaaatttcactggttttatgagttttcatcttctcgtggtgactactagggagaaatttcgaaattttatgttttggcgatttgatgatccttatcgtttcgacgtcgccaggaggaatctcgttcagaatggcgctcgtagcatttgtcgaatcctaatcgatacgtatcgccggtcaaagacttaaaaagtaatagtagtaagagtaaggaggaattaaagtttgatggcaacattttgtatcttgctctttgtttcaaagaatatattttcacccctagatagaagttttttttttaaaaaataagggttttcaccgctccaaaatacgcgacgtatcgcctttggaagccattcgaaatcccaaattgaagcttgtccatctgttccatttttgggcacgccttctgttattcaaggcaaattggtgggccgctattgatggtttctttgggccgacattgaagtttcctttgggctttcaaatgggccgcaatttatggtttctttgggccgacatgacgttctctttgggctttagaatggcctcagttgatggtttaattgggccaaagttgacgtttattcgggctttcaaatgggccgctcttgaccgttttctttgggcttcgtgataggccgcgttttttcaccggaagcccgtaaagatggcttcaggcccagttcgtcaaacacacaggccccagttgtactggccatcatggcctttcactgcacagca

SEQ ID NO: 82509 - DNA, 42465 bp, Oryza sativa
ctctactctctcttcctaaatccccatcccctctctctcccctccctccctgctgcagcgagcaacggtgattgcttggttttttcctcgccatggcggtttcttggccatggctgtttgatttcttggttggcccgcgcgtgcgcaccaacttcccccatgacgatgtcaacgaggccgcgcagccgccgtcgcctcctcttcgttcctctccacggcgctcgtcgccaagctccaccgctccaacctcgcctccgtccaagccgcgcagcgcgataacagcaatgactcctccttctcctccctcgcctccaccgggctgccgctcaccgcccatggctgcacaccgtcgtccaccaggcgccgccgctcgctgcatcatgggagggaagagagaggggatggggatttaggaagagagagtagagagagattgagaggttagagggggagagagagagaggagagccttacaggtggggcccgcactatgttttttaaaaaaattgagaagcccacactatttagcccgtggactggcacggcacggcccggcgtgtcggtcaggccgtgccggcccgattagcctcgactcaggcacggccgggcctgggctgtgccgtgccgagcagcccagttggccaactatagtttccagccctgtggtgaccatccaccccgcccgccatcgctacatcactcattcggctacaactggcttcatctggtcacactcgcgcgaggaagaagagcaaagaagaggaggagagaagtccttcctctgatccctaacatgtggacccccacctgctgacttagcaagtcaaccacagtcaacttgcactggtttttgaagatggggagacatatccaattttacggatgagggagacaactagcaactgtgaggaggcaaattagacttgttctaattagagaatatagagaggggtaaccgggaatatgagatgaccatggtcgaggcctccagggccccatgctatgaaatttctcatccttgtgtttcattcagtacgattagttaagaaatattaaaacagaaaaaaaattcgaaagtgaacaatcttattatgtatgtggcataacagagtactgtgggtattgctgctcctgcgccagagggacagtaatgccaacagattagacaagttttaggttataagatccctatttggttaagttaaaaaaaaaggcgcaagaagaacacctagatgtatcataatactaatttcacttgccagtgatgaatggatggctgagtgcttctggcacagtaatcctcttctttggatctagcacaaatattttttccaggagatctttgaagctggaaatcatttttggatcatcgccggggcagcttgaaattgcagaaccaacaccctttggtttaatgttcaaaagcaacctattcacaacctgcaacagataaaggtaaaattaacaattaaatttatttaacagacaattgtaaaaagttatcactgtcagtgtaaataaaaggcgtaccgttttcgtgataggatccttctttctagcaagaaagttcaagttctggtcgaagtgttgcattgtgaaggcaccctgtttaattaggaacacacatcagtatgactgtatgagcagtttaatattctaaaacaaatatgcagactaccatacatattatcttctcggtatacacagaaatccaaataagtaatggaaatctaactttttttaaataaattcttacctttcgaagcatcttcttagggaaggggcccttcaattccatgtgaaggcgaagcatgtcattgttcgttgaaccatcaaataagatttttcctgtttaagttcagataagcagcacccagctgaccacatatccagtggatgatcataaggcaacccaagaactgcaggaagaacaagaaatcactaatctgtctgcaaaccattaagaaaccaagcattgaaaaagaggggatttgttttgagtttgactgcaaaagaaaacagtgtcgaagtcaagaaagatagtcaaataaggaacactgaacaagtatgtaactcacttatttcaggtgcccggtagaagcggctcacaagatacggtgtgatctcattatttccagcagacatagcactaccgaagtcacacagcttcagcaaattgttatctttatttacctacaaaatgacaaacatcaaaaaagctatgctaaataattcttctaccatatatacaaaagaaaagggggtgtaagtcatttttagccttttcctttctcggtcatcaagtacataaaactagtcataatttgtccaggaaaacaataagagtagactatgatactcagcaagattacataccagtatattgtctggtttaatgtcacagtggagaacaccacagtgtcttagatgcttcaacgcgataaaaatatgctttgtgtacgcccttacagcagtcagtttaagcccagtgccatgaccaaatttctttataacctcacgaagattcatatgaagagattcaagaactaaacacagatgattttgatgcataaaactagaaataatccgcacacagtgttgtttgtcttcacgatctgcagttcccaatttttccaatatagaaatttccctcttaccagacctgtacctgtatagtgaatgcccaaggtcagatggtactcttctctctattagatatattgccacaaataatgaataatttcaaagacttacttttcaatattgttgcatataattttgatagctacttctctacatccatccttttgagctttaagatccttcgcatgaacaacagtcgagaaaactcctttcccacggcgtgctgtaatttcataacggccctgtagcacttctccaaaatgataaactgtaaaattgcccccaaaaataagtcaaataatatagaacaaaccagtatataacttgagaagctgcaagattgataaggtataaatagaagtcagtacttactgtaatatccctcttcatcttcccagttgtcatgaagagtgtttttcttggcaagcatactgttttcattgccctacaaaacacaaaatagttgagcacaaaagttaaagtaaatgggataactttggcaataacataaaatacaaagggggcaaatagaaaaaaatatttgaagaattttttgttgaagtaagtagtaacaattgttattattcagaagtacaagtagtaagaacgtaccagcttgcgatcaataggttgttctccatcaataacgttgccaagaataacttgtttacctctctgtggaaatatcaaagattccaagtaaaatttctggatgatctagtgttacgattaccatcagaattctaaacaaacaatcaacttaacgagaaatatcatttaccatgggaataccctcctgaagacctgaagcacttgtcgtccttttattatgtgatatcctcgagcttccctcctgaagacctgaagcacttgtcgcccttttattatctgatgtccctaagctgattgaaattttaggcaaagtaggagacttcctcacattgtagaattttgcaccgacaaatacatttgataattcatgatcatttgtaatatcttccttggctcttaaattgttcgatctctgttttgtagcagcaggatcattgtttatttctgtcattcaaaaaaattggttaacaaaacttgaacaccttttaaacaacagagaaaaactcccactgtttctttttataaggcatatagtttcttcaatctcatttcaaacatacaaggcactgtgtgaatctattacttacattccttgtttacactcatttatcacatattctttattttacattgatcactgaccattatctttcctatttccaagacattcaggtacaaacagcatagtcattcgaatatctctcacatggtttcctctccttaatcattaatcaagataagccttataaaaagaaaagaagggtgtggggcagtaatttaaatccaaatgacagtttagggaaatatgttacctttattgtcaatgtaatgagcagatttttcctgttgcttccgatcctcgatgttctccaggtagttctcttcatcttcctccctgacatagtttgaagatgatttactaaaaaaaataaagcaactaaagttaacaaatatgatatacgagttaatcatatgagaaacctcacctgtaaggttctttcttctcttcttcaggtctccttttgcatttggcctttgtatcatccccaccaaagcttgatccatctttgtaaatgccagacataccatagtttgcatgcgtgtagctgatactcccttcgttcccatttactgctctagaccaacaagcatccatttccttacccctaaagcctctcttatctctcttatctatactatcattgagtttctcctctccatatctactgccaactctatctgtttctttgtaactgttcctagccgtatcatttttccgatttctccattcttcgtctttcttccttgtgctactattccatctatccatctccctaccttctccatgcccatgatgtgcactcgccttttgatcaaatctaccatcgccacttcgtctctcatgataagcaaggccatgcaaatcaactttcttttctaccaaactgccatgttttctctcgtccaggtgtttttcctcgctattacagatgtcagtgtgcctaccaatgtgacagccactctttttccttttcttatagcaccctctttcttcagtctcccacctcctgtttgaatacctatccggctcaccatgtctgtcatcaatcccatgttcataatcaagcctcacactgtttcttgagccatcagtttgaaagccagtttctctgctagcatgacaggatcgtaagcagtccttggaatgagcttcattatggtttcttgagccaggagatcttctagaatgatattccacaatggcttcatgagcagcatgatctgactttgctggataatcatgctcttgagatgggtttctagctagctgggaggtatgcaactcatttacatgtatattcaagtctgcatcggagttatcaccatgctcctgtattagaaatgaattaaaatgtaagtcaccatagaagagaaaattcaaaagcacgacgtgaccagtaaaaaaggaagcaagggagatctccctccttaacacaatgttcattgattatgatactacaaatttgttcgtaagcagttcaagctttatgtcaggaagcttggagcttctttcaggtaaacatttgctatcagcagcgcagtggagtctataataattcagacatgcctaaaattactttttttttttgcaaaccagtgaatattaaaagttgcatcaatgtggcaatagaagaacagaataggctgcggtgagacatacagtactttgaattcctgttacacaaaagttattcccttattcatagttcatacaggacgtgaattaacaatcatggcaagctagattagcttattgcttacaaattagtttagattaaattaacaattgtgtttaattttaactcaggacaaaaaaaagtgcatgccatctacccacaaagactgaggcatatgttactaataaaagttataagtaaaagacttcgttgataagtaacaaatgcagacatgttcttcacaaaagttaaattaaatttgattgttttagttcctatttcctagggtggtcttgcctgtgctctgacaaatgataacaaaacacaaatgaataggtgatcgagcatgccttcattgcttgttagttgcttccttaatataaactctacctccaaaattgttcgtcctatgactcgtattcctatcgctaacaacagcataccgccataccctacgcgctttgtgtacgattaagtccagaacaaaacagagcaaaattcgcccaaattcacatgaaaattaagaactccggaacaaaggatcaaggggtaacgaaaataacctataaccaacggcaacaaaatggatggggggcttggaacagaccggagcaggtagaacaccttgcactgagcccgtctcaccggcatcagcatccagccccctccccacacccacacccacggccgcggtggcctggtctagtatctcaccgtcctcggcctcgccctccgccggatccgccgcagccggcgagaccctatggcggtggcgatggtggccgcgcttgtggcgcttcggggaggaggcgccgtcctccgcgtcgtcgtcgtcgtgcggcgagcggcggtgcttgcgcggggagaggtgcgagcgggcggcctcctcgctggccatggagacccgagggaaccagctagggctagggtttggtacggaggaggaggggatcccgcgccgcggcgaggaagggtatgttggtttggagttggaagaaggaatcggatcgagcccgggaacgaattcccctcgtgatcaattcggccaccgttttgtaggaggaacggtcgattggagcagaccgttcgagttagacacggatgaggattgaggcggtgaggcctcccttcgagcttacagatttggggagatttcaaatagttcgattcgaaaaatgaaattgggaggttctttgataattgaaacgcagagatccttaagattattttatataaaaatagttcgaatcgtacaaaatccttcaaaaatttcacgttcaaacggacttcttagaaagcaagggaaccattggcttgggccattgtttcctttccggaataagttcactttgggtccctctatttgtcgcccagaccgattttcgtcccttgaccgcaaaactgggtatgacccgtcccccaacttacgaaaaccggggaaacatggtccctcggcggttttaaaggcggttttggctgacgtggcgcatacgtggcttgtttgattaggtctccgtcccacgtagcattgacgtggcgcttacgtggcaactatatctcagcaaaataataaaaagtgtggccccacatgtcagctgcaaaaagaaataactttaaaatggtggggccatgtgggccccatatgtcagcatcactcctctcttcttccctctcccttctctctcttgttccctttcctctctctctcttcttcccgggcagaggacggcgcgggtggacggtggagcaggcgagctccggcagcggcggtgggcgtggtcggcgccctggaagatgccatcgatgccgccgacctccacgcgcgccaggacggcatcgccgagcgcttctacaccgcgcttgtcgtcctcccgccgcctacgccgcgctagagccatgccgagctccctcctctcccgccagcgagctagaagggcggcggatggctaggcgagctccctggtctaccggcgagcgcgcgtgagtcgctccctcctctcccgccagcgcagagagatggggagttgacttgaacatataataaacattcaatgatgatacaaactgcaaagacagcttgagaggaacactagaacactgaactctgaaccattctgcacgaggtagtacattgtcataaacaaacgtcgcaaacgaccagtctaatgcgtgctctaccactcaaagtggcaaccaaatcgatggcacaaccaatcgaccaaacaaattcatatctcttcctctttgatctcttctccctgctcaatctcaagaacatacattatgtgttcaacaaattttcatcaaaaaatctcaagaacacgtcgtgttcaggcaaaagaacaacagagacaagaggcgatcgatggcaatggccatggcgaagctgttcatcacagggctgagcacggtgatcgcctactcgtccgcggtggtgttcaagggcgccgccatggctgtcgtgctcctgctcatgctggtccagctcccgggctacctcagctgcctcctcctctgcgccatcagagcagccgtcgagagggccgtggcggccaccttcgccgccgccggggacgccgtctcagcggcggcggacgctgcagtggggtagagggacgccgcgtcgtcgaacagcaccgcggcggtggcattcgtgtaggccgccatggggaggcccaaggcgctgcttgccgagatgctcgccatattcggcctcgtcgcctcgctttcgtgcagtccagcgacgacgaggaggaagacttccttgttgggtccgccccgggcgctgccgcggcccgccgccaccttcttctccggcgcagttctcgctatccccttctctctatccctctctctctatcctctctccttcctcttctctctatcccccctctctctccctgagaatggtgagtggcgacggaaggcgcacaggggcggcgacggagctgagacttgagaggcggcaggtagcttgtggagcggcggctggaggacgacgagcgcggcgtagaggcactcggcgatgccgtcccggtgcgcggagggtgtctgggtggtcggcggcggcgacacggatagtggcgaagcgacggagaagaaggtggcggagaagaggagagagagagagaggaaggagagaggatatagagagagagggtagtgaggatgacaggtggggtccacgtgggccccaccattttttttaattattgtgtgtgaaactgtcatgtggatcccatagtttttaatatttttcggatcaaattgccacataagcgtcacgtcaatgccacgtcagatgaagaccgagtcaaattagccacgtaggtgccacctcagccaaaaccggggtcaaattcttccgagggaacttatttaaacggtttcgtaagttgggggacctgttgtacccggttttgcgatcaagggacgaaaatcagactgggtgacaaatagagggacccaaagtgaacttatccgacatgcctaggcgtcattcgggtgtcatttcttaaaataggcgtaactttctcatacggactcggaatcaggcaaatgatatatccacggacatctacagaaaatgttacatccgattctcctcagctctctcccaaggggcgacacaacacgagggacgcagtggcgtgagtcaaaagagagagagagagacaaaaagagattccttcctttccacggtctaaaatccttggcccagttaggcagaccatccagccaacccactgaacagcccatgccatgacggagctgagacttgtcggtgactcgcgacacgaacgttctggctagatcgctggacctgaccaaaccaagaccaagaccaccccgctacgtgtccacccacgattggacccctcacgtggaccgttttcacggtgccttgtgatgtggagctcgtacagggccagaacactccggcgagtcctactccgatctcctcaccataatccagaacctatttaagccccccgcatgtacagcaagcatcgaccgatcacgatcattctccaagcctaaggctgtgttcgctatgggttgttcccaatagcacggaaaacggagcgatccattagcacgtgattaattaaatattagctatttttttcaaaaatggattaatttgatttttttaagcaacttttgtatagaaactttttgcaaaaaaaacaccgtttagcagtttaaaaagcgtgcgcgcggaaaacgagggagataagttgggaaaatggacgtccgaacacagaccgactagatactccattacacagcttcaccaaatcgcacatcgtagagacaagtgttgcatgagcagagcaagaaacatggcgagagataagcaatctgctttaatcgtcgcagcgttcgtactcctctgttcaggtaagcaccatggaatgatgcttggtttgatttgttttcaaaatttgcaatgtgctcaaatttgatcggttttttacttctttttttttttggttcctgtagggtgtttgtgcggagttgcagatggggcgaagggagggaggaagacgaaagggccggtgatcggcatcgacctcgggacgacctactcgtgcgtgggggtgtaccggaacggccacgtggacatcgtcgccaacgaccagggcaaccggatcacgccgtcgtgggtggcgttcaccgacgacgagcgcctcgtcggcgaggccgccaagaaccaggcggcgctcaacccggaccgcaccatcttcgacatcaagcgcctcatcggccgtaggtaaatgttcctcactagcttttcttcttcttcctgagctctctcgatgcaaatggagaagctagccgtggttgattgattgatttgggtggatttttccggcctgtcgccggcaggttcgacgacgaggaggtgcagcgagacgtgaagtatctcccgtacaaggtggtggacaagggcgggaagccgtacgtcgaggtgcgggtcaaggccggcgaggtgaaggtgttcagccccgaggagatcagcgccatgatcctcgccaagatgaaggagacagccgagtcctacctcggccagcgcgtcaccgacgccgtcgtcaccgtgcctggtttgtaatgcgaaagcttctggccgccgctccagaggttgacgacgacgacgacttatgctaagtgtgctctgcttgatttgcagcgtacttcaacgacgcgcagaggcaggcgaccaaggacgccggcacgatcgccgggctgaacgtgccgcggatcatcaacgagccgacggcggcggcgatcgcgtacgggctcgacaggaagggggcgggggagatgacgaacgtgctggtgtacgacctcggcggcgggacgttcgacgtgagcgtgctgagcctcgaccacggcgtgttcgaggtgctcgccaccagcggcgacacgcacctcggcggcgaggacttcgaccgccgcgtcatggaccacttcatccgcctcgtcaagcggcagcacggcagggacatcggcggcgacggccgcgcgctcggcaagctccgccgcgagtgcgagcgcgccaagcgcgcgctcagcagacagcaccaggtccgcgtcgagatcgaggcgctgttcgtcggcgtcgacttctcggagacgctgacgagggccaagttcgaggagctcaacatggacctgttcaagaagacgctgggacctgtccggaaggccatcgccgacgccaagctcaagaagtccgacatcgacgagatcgtcctcgtcggcggcagcaccaggatccccaaggtgcaggagctcctcaaggagatgttcgacggcaaggagccaaccaaggggatcaaccccgacgaggctgtcgcctatggcgccgccgtccagggcagcatcatcagcggcgagggcggcgccgagaccaaaggtaacgcaaatgcgtttgaattaccagcgtgttcggctggtcacgccatgagtcctcctcacacattgctgttcttggtgaccagacatcttgctgctcgacgtgacgccattgacgctcgggatcgagaccgccggcggcgtgatgaccaagctgatcccccggaacacgaggatcccggtgaagaagtcgcaggtcttcacgacctacgaggatcaccagaccacggtctcgatcaaggtaagcacatttcagctcgtgcattgacctgataacattgattcttcagttcttgagactgacgaagctctgaatttctttttcaggttttcgagggcgagcggagcttgacgaaggactgccgcgagctggggcggttcgacctgtccgggattgcgccggcgccgcgcggcgtgccgcagatcgaggtgacgttcgaggtcgacgagaacggcatcctgcacgtgacggcgtcggacaaggcggcggggcggtccaagtcgatcaccatcaccaacgacaagggccggctcagccaggaggagatcgaccggatggtgcgcgaggccgaggagttcgcggaggaggaccgccgcgtccgggagcgcgtcgacgcgcgcaaccgcctcgagaactacgtgtaccgcatgcggagcgccgtgcgggacggcggcatggccggcaagatcggcgacgacgacagggagaggatggagtccgccctgacggaggctctggagtggctggaggacaacgacggcggcgcacggacggcggagaaggaggactacgaggagaagctgaaggaggtggagcaggtgtgcggcccgatcatcaagcaggtctacaagaagagcggcgacgcgtcggccggcgccggagacgacgacgacgtgaatgagctgtagagcattttcgctgctccatgtatagtgtccgccacttcagaaaggaaagatgttgtgaagtgtaaacggatctcttaatctcttatcattagacactaatcttttttgtgttttaattaccattaatcttatctggaatgcatcaatggacaaattttgaggtatccctatctaagtctctaagctgttcatcagctagaggattaacgaaatgcaagcctcccactacgataactttgtgtttgctcctacacttacacgggcccacgtaatacaattagctaacttgctcgagctaacacgccagcaagttgcaacaatcttggatccgtaatactcgatccgacacacgagatgacgaggacgcactcacgcacaccgacatctacacatatgcatctgcggccgcgtggccaaggcaactcgcgtcgcgtgctcaaccgcacccgtcatggcgcgccaccacgaggacccggcggctcggcggcgggggcgcgcgctcgtcgtcggcctccgggccgaacacgaaccgcgcccactcccttgcccgcgcctccgcctccgcctcggcctcctcccgttcccgcgcgctcccagcccccgacgccgacgcgagcaccgccgcaacgagcaccacgacgagcaggggagccagcagggacaccacctgcgccgcgctctccgcgatcatcgtcgtcacagcgagcgagcgcgcgcagccgccacagaggagtcgcagcagcgtgtgttcggctgctcttcccgggcgtctcggcggcggcggcggccggcgccccactacatatacaggttcgccacgcgttagctttctcgtgcgcaaccaccgcgccatggatcgcgtgacgcagctagcgcgcgcctcgccgtctttcggcttgccgggtcatgaaaagtaaagccaatagcctgggaatggagaagagcagcgttctcatgcgtgtttgtgtccctcgtcgtcagctttacggttgcctgcgttggcgggaattaactctgctcccggtgatcctcggtctcatggggtaactgggtgatgcaattcattactggttgggagtttggtagtagtcgatacgcgcaatacacgagccgcacggactgaaaactgatgcagttcttgaattcgcaagaattgaaacagaaaccgagactgctttgttgctgtcgccgaaatgttgcattggattctgcaggtgactacagcggctgcggaagcacttcgtatagaaggagatttgccagattctttcgataattagtaggaaattactttgaaaataattgtcttttaaactatattaaacatttaaaaattgtctataaataatatctactttaaaaacataggataatatgtatagattaatcttgaaaattacttcagtataatcatatatatttattaatagccctacatatattcagagtcatttttaggataccgtgttctcgtctaaaacaattttttttttctaaatcgacattttttaaaaaaaatctggagagactacagagtatacatgcttcgttgactgagcccctttcagttgaagtatgcaaatcattcaggcacaacaagcatgaataaaacccactgctgaatttcataccgctatcatctatattcttgttttctgatctccaacataggatcatccaggggaaatttagtacacaataatcgccagctaattatcataaaaactacccctttccagctgagtgaatcttgttcttgtaccatcacgtacatgtcttgctgacttgtagaaccctatagctccaatagccaaccttcatttttccatttccgatgtcttcccgacgtcctactcaagagccggtgccacctcggttgggttaccttcaaacacatcagagcctgatgattctgactcttccgggaactcctgtgtttggaccgattccttgtaggaaggagtttctctgaagtctgtcgctccttcgttatacgttgccacagcgaacccacatgcaaccagctgcaaaagtatgcaaggtcaacagatacaaagtgagaaccaacatacaattgtaattttatcaggtcctcgagagataacatgaatataatcgatcaattgatggtaagaggatggaatggcatgcaaagttatctctgcagatcaggcggagacatgctgagaataatgttgaactgatgcgtgtcaatgaaaaagcaccaggtgctatcatcagtttaactcaattaagaaatgtcagatgatgtcttgctaaatagcatgtaaagaaataacttcatgtattcagcggctgatttatttccactattgaaataaatgtattcagcaaccgagcaacacacactttcttttccatccactagatgactagacactgcaatggaatcacttgtggcaagtaatcagtgtgctaagtgctaacaagcaatgcgatcaaatcctatatatatttttagaaggcgcaaaagctttgtgcgtcaatatattaaagatcaaatcttacatatgaatgaccgtaaatgaatttgaatgagtatgatgtctgatactctatattttagttggaacatcaagctcatacaatcactctaaaatttgaaacttgtaacttcagccccggacagtgccatggcatctcttctcatcacattgaagggcttgtccggaagttgtacttccattatcgaaggttttgtcgcatgcagatttcctttttgcacaattgcacattttgaagtttcagaatagaagcgtatcaattagctgaaatctaagtttcactaactgcaccaagctaaagatttacttctgagcacttgagcatggattattgataacaagttactagtttcccaacagcagtgcacaaaacgcatcaactgcagtaaagcggcaaagtaatggaggaggaggaggaggaggaggaggaggaggtgctcacgccgaagaagacgccgaacgcccacatgtactgcacgaagaagccgagggcgtcccactggggcccctcccagaagtcgggcttctccgggtcccggcagctcgggcatcggcgtcgtcgacacctcgaaccccagcggctccccttcccagtccaccccttccccggcggcggcgtcctcgtccatgtcgggcggcgcgggcgccgtgacgctaccgcctccccggcgcttattcttgccgcgctcctccaggcgccgctgcgtgcgggacgagacgccgcctctgcgcgcgcgcgccacgtgcagcgcggcccggctgcccaccagcgggaggtcgagccgggtcgccgcggcggcggaagcgggaggggcgcggcggcggacggccgcgccgccgaacggcgtgggcgaggtgaggagagacatgagccggcgccggcgatgtgacgtggaggctcgagaggctggagctgctgctgcgagcaactcctcttcctactggctgtcgacgcttctcaggatctgtgagggctgggagtgagagggagatgagataagattttcattttttctttttctccttttgttttctagttccgcttctctatttttcgtttttcatcgtttcagtcgtgtagcaggagcgctaaaagccatgaagaaactcgggtgttactgcattagatttcgccgaaaaaaaatcatgagctagttttgtctggtactccatttcaaaagagacaaaattatatgacattcggtgatttaggtacttgtataattaaagtaccctctctatttcatattataagtcatttttccttatttttaaaccattcttcttaaaacttctaccaggtttatagaatatatatatatatatatatatatatatatatatatatatatatatatatatacaccaccaaatcaattttattaaatctaacattgatcaaagctaaagaaacttgacttttaaaaaaaaagttaaaacgaattataatatgaaacggatgtagcaattttttttatcaaaataggtttgtttaatgcaataagtttgtaagatggcccaatagaaatatttttcaataaacaaatctaacatgttatttttatgtttttaaactactgtaaaattcattagtggttaaaaattttagagtttgactagacctaattcaaaacatcaaggatttatgattggagaggatagatttattaccataatataaatatagtgcttacgttgaagagttcattcttccttccttaaatataccagaaaaactatagaacggtctcccgttctaacggaatgactcaatataatagagcacgactgttttccagatccatttctcagatccgttttcttccccatctttccctgagctgatcgccatcctccacctccctcccttccccgactcctccaacccatatcgatcccatgtccggtcaccggagaaccaattgacgtcgttcctaaccctaaggcgtccttcatcctcctccccccttcatacaccagattggacatcggtgagagagatcggcgaggtcatggggccatcgggaaattggtgacgtcagcaagcggaaggtcattgcgacagcaagatcggcgttgtcttcgttgaggacggagaagaggagagaatgcaaggctgagagtgagggggacgcgcgaggaccagtgcactgacgacaaggtgcttcctacgcgtctcgagcttgccgcactgtgctcctcgctgctcgtctccattgtttgcaggtacgtcatcctcagttgataccgggtaccaggcctgatacctcaggtgtcaggtactaggtatcaagcatgatacctcgggtatcatccttgatacctcgaggtatcaagcctgatacccactggtatcagacttgatagccaggtatcagccgatacccataggtattaggtgccaagtactaggtatcaggtatcatgccacgaggaggaagcgcgggttgtcacttcctaaccagccagtgaaccatttaccaccgatttctcctctcctcttctcactcctctcctgttctccctctctcccctcgacacgctccctcctttactactgttgatgcggcccgcgaggggggtgagggacgtattaaatcgttctaattatatttgtgcttatattttttaaatcatgattggaagaatgattataaaaaattgtgattctaagggctcctttaaattgcaataatttaaaaatgtaggaatagaaagtgataatatatgtaatccacaagaatatgtcgaacatgtattgtaggaattttagaggaagaatattatcaagattagacttgaaaggagagatgatgcattggacttccaaaaggaaaccaaaaccaagaggtttgggctcatgtttgaaattccccaaaatatagaggaaaaaaggattcatatgcaatttttctagcaaatcctccaaatggaagggctcagaaaaattcctataggaatttaatcctacgaattttctataaaaacaatgtgttccaaagaagccctagacatgataatattttagtttcatgccctgataatatatatttttgtctctggtatatttgacgtttatgataagatttagataaacttcttcaagaaaaaaaaaggcatcaatagtttctcaaataccacttaatttaaaaagagataatcgcaacacacataattttcacatagcaccatccaaccaccattcctctgtgcccaatcgctggcaaaacaggttatccatgatcgtactgaatcaccatacagttatacattacacatgactctgcgaagggagtcagggtgagcatccaccagacaaccacacccaaggctacataatagctatgaaaagaacaaaacaatggcatcaacgacagctttgtcagcagctgcaaatatgaactccagttcagtttcaccagtctaggctaatgctcctcgagaggaaaaggttgtcgatgtagtctatgatagggctagaggcatcgatgtatctcctcatctccttctgcacggagcaatctgcagtagcaacacagcaccatttaaaatcacaagaacgcagaaagatcttcacccaaaggagaaatactcatttaaattcctgacaaacaacattcagggatgtcgcatttttgcgtaccagtttcgttgagcctcacgatcagctgctccctgcttggaagagtgtacatcccagcaccaacagccttcctgaccgcccagctgtgaaacggcgcgcaaacctgcccgtaagctgtcgtagcagcatcatacagcgaacattccctgcagaaaagaaaaaaaatgaatgccagaaaggccgtaagctgtcgtccattagagcagaacagaactacctgtcaactgtgtcttatatgagttacggatgccaactggccaataattctaccaacttagccaccatcggctgaatctgaatgtatatgtagtactaacaattgtcgccggccagccttgcctcagaggaggacaaaaggcacaatgaacaagttgatgaatatttattggtacgagacaagtttcagactgtcctggaatcgcctgatatgcttcagatttcatttcgaattgaaaaaaaatatggtgtgcttgggtgagagggaggcgacgtactgggtggagaggaactgctcgaagagaaccttgatgaggccgaggccgaggcggaccctgcgcaggttgcgggagtggctgccctgcttcttgacgcagtcgttctcgacgtctttgtccaggatgtcgttcagcgtgccgtacgacttcgccgctccgatgaggtcgttcacctgcagcagcagcagcagcaggattggtcattcacaagggaaatcgccgttagtacatttcttgccgccacaagtacatttcttgccgccacaagaattcttcgtggccaatcagaaaaaagaaagaaagaaagacgcaaagtcgcaaacgcgttttcatggagcatcgttgagaagtttcggtttttttttcctttcttggtttgcttttctagcgcaagaaaataacggaaaaggaatattccaaatcgggggtaggaggtgaacgctgcaagatctaatggggaacaggggatcaaacaggaataaatcgaaatttaaccagagtcaaaagcgaaatttcttgatgcgttgtgatgaagagatccaagaaacaaaataaagaatgagaaagacaataaaattaccaagaacaacaaccacgaacgagatcgagagcggtgtgggggatggacgagggtttaccttggcgacgtactcgatctcggcgaacctgaaggccatgccgaggcagctgaagaggacggagacgagcgcgcacgtgtcgccgaagggcccgaggcggagctccccgccgtcggcctccatcctccgggccagctcctcgaacgcctccgccaccgccgtcagcggcgtctccatccccttccgcgccgccaccacggccgccgccgcgtcgccgcaaatcggctccgcccccgcccccgaccacggcgtctgcgacctgaacccgagcatcctcttcctcctctccttccctccctccctccccgcgcgcgccggccaaactagccaaggcaccaccaccaccaccgccccaccaaccgcgcgccaacggacggtgcggtgcgagggtgcccgaaggacgcgcgcgcgcgtggcgcaggtggtgggattgggacgaggctggcaatggcgtacgcggcgacgcctatgtataggaggaggagaagaggaagccgggagaaatggagaatctctttgcccgtgtgggagacgaggaggaatggaacaacagggggtgagctggtcggcagatcggacgcttcctttatataggcatcagcgtcaagattcgtgctgggatataggagtacgtgccacgagcacgagtgcacgaggtggagtcagccagcgaaatgggaacacacaaaagtcacggggtcggcaaattttacacaaaaatataaagtgcatgttcttacaaaagggaagcattgcctttcatatacttgtcactcgttactatccagtttttaacatttgggacatgttcactttaatgacattttcaaccttaccaagttttggtatagttgctaaaaagaatggctacatttaatttgctgccaaattttaataactatataagaaatcttgccaaaatttggcaagttaccaagtttttggcatcaaagtgaacaggccatttatcactcatcttctatgtagaagttttatagtactatatacttagattgagaaaaaaatatttcttaatgtgatatccaccgttctttttcgcattattcaaacaattttaaaaatttaaaattaacatgataaataaatattaaatatatcatttcataaatatataagttcagatttacaatatttgagttgtaataaaaagaacaaatttatatgtaaacagtatatacaattttttttatatttttaccttgcatgtttataaagtgatatattatatattaatctattttgtttctttttgcaatttttcatgactgtttgaacgttatgcaaaaaagaggggatatgcattaacaatataaattatagcataaataaaactttcaagaattttagttaatcattttaaatgtattaatggttaaaatcgaaacactaatgttcaatgtaggagagtatatgaccttaatttgttactactgctactcatatttttctacgagtaaagaaaaaactaagggaagcttccgaagatgtttgcattgagccggaatcgaccgttgaataaagcacggagaatcggagatgcatctgggagcttcttcctaaagtgaccttgactagtgtaaccgtgtgagccatgacctgtacccaaagtaatctaggagcatcaaagcgaatatacttctctgattgcgcaaaaacctttatatgtttatggacctgtctagatcctatttcaaatttttttactctatcacatcaaacgtttaaacacctatatgagatattaaacatagattaaaataataactaattgcatagtttactactaatttgtgagacgaatcttttaagcctaattgctccatgatttaataatgttgtgctacagtaaacatttgctaatgatggattaattaggcttaataaatttgtctcgcgatttactgacgaattctgtaattagtttttttattagtgtccgaacaccccatgcagatatgctaaaattttacatcccttatgttcgtgaatgtactcgttcccccaaaaatattaaggaaaaaacaaacaaacaagagtactcgttccagcatgaaagcaatgctaaacaggcagtagacagtactactaatcattatatgtgttacactaaaaatgtagttttatggaaccgtgccagaacttcagaacgggtccggctcctcctgcgcctcgttgtgaagcaccactaaaacagtctggatatatcattgtcgtgtacaaaaatgattacgagtcaagaaaacgacccgaaataatgaaaaacaacatgatataacaggtgaagattcaggcatttcttaatgctcgagagcttcgcaacgacctggatttctttttgctacctatcggtttcggaatgcttaaaaactcttgaacatttcgcatcttcgggcaggcgccgtcgtatgatttttccgacgcaaccgcaacttgcacgctggaatgctcacgcgcgaggcccagtgacaccgcgaaaagcacaaccgtctaaactgtcgatgagctggtagtgtacagctgcacatgctgcgcattattgcgaaaaattctgggcaactgttattgagcggtacgaattcaaatatcgatgaacaggttatttgttctattttttaagtttggtttagctatgaagcaaaattcagaccgcatatgctttttgtttagtggtgattcacatcggggtgctttagacccagtttgaagcaagcaaaataggagcatgaaacaaaatcaggagaagagaatgcctcatcagttccgttttgtaacccttttattagttccgagttgcaaaccggaccacgaatccgagaaccgggtgaaataactgggattatctttagtcccggttggcggttggtggactaaaatggtagcaccacgtgcatattggtggtttttttctttttttattgtttttttttgctgtttccatcgaatgaacatcacaaattcacatatcaagatttcttttcattgttttttcttaaattcacatatcaaattcacaaactcacaaatcgaacatcacatactcaaattcacagatcgaacatcatagttcaaataaaaaaaaattactgatcaaatagacactacaacagattcacagaacatatgaaaaaatgttcatctaaaaacatctaaagtcacaaattcacaggccacctgccgccgcccacccccctcgtgtgccgccgccgccgcggcccgcgagaggggaaggggaggagggtagggggcactgtcgctgccgacgcccgccgccaccaccgcggccctcgaggggggaaggggggagggggggagatggcaaggggggtcgctgccaccgctcgccgccgccgccgtggcccacgagaggggaaggagaggagggcaggggagccaccgccgctgccgacgcccgcgagagcggaggaaagggaggagtgaaggagataagggagagatagagtgtgggaggcgtgcgcagtggattccgagaagataagggtgagtgagaggtgagcggcaacggttttgtttttaaatttttggtatctggatacaccaatcgaaactaaagatttaaataatctttaatcccggttggtgttaccaaccgggactaaagtgaggatcttttgtcccggttggtgccaaccgggactaaaaatccttagccccttgacaggccgttgaaccggttggtatcatatagtccctttggagtttttttagtccggttaccataggaaccgagactaatttgatttttggccaacccagcaaatatggtttctccagcagtgaacggaactccaaatcggaaatatttgccgggagtgaattgtagtgcttccttcataaagaaaaccttaagcataagcatatttcatttttctgtttctatataaaatgagatggtcatttatgtggtttttgtgtattcgagacttagataagaaaatgtgtttaaaaaaatcatctttccatttcgtttaatagtgctattaaattattgatcgaaacttgtacagttatttattttattacttgttttttacatttatgtacaattttgttttcttcattactcccccgtctctaaatatttaacgccgttgacttttttaaacatgtttgaccgctcgtcttattaaaaaaatttataaaatatgtaaaactacatgtatatataaaaaaatatttaaccatgaatcaaatgataggaaaaaaataataattacttaaattttttaaataagacgaacaatcaaacatgtttaaaaaagttaactacttaggagacggagaaagtatatgcgagcgagatattttttttaatgaagaaatatgtaatttttagattgaggggaatatatacgtacatccacgcgttgccacgcgccccagcgccgtgccgtcgaggcatcgaaattcgaaccacgcaacacggcaagtcggcaaccgaaagtgtcaaactgtcatcaaccacatttacctccccggtcacgatgtatacagtatacgtataggtgctattcgacgctgtttgtttgaaattgaacgctagctagcgcttgcacgttcactgttgtgcacttgtgctcacctgtactccatactttttatataaaaaacaatttcttgtttgacattttttttagaaagttcatcgggggagattttctacctgaattttttttagattggaaaaaatacttgtgcgtcacaacgggtgaaaactattttaatcttattattgttatagttaaggtgaaatatattgtgataactcgtttggatatatatatatatatatatatatatatatatatatatatatatatatatatatatatatatatatatatatagaaaatcatgagatgtaattaggagtccgatcgtcttaacttagtatgcgagttttttaaaagagattatacgattccttctatatttttaaaagcgaacgaatttaaaaccgatttaaatacggatctgtatttctaaaaacgaacaaacttaaaaaagacttattcacggatggcgtaccaaagtactggcaaaaacatctttaaaggtacttgtttgacgtgttagaagtggtttttatagaatgaagagaatatgcacaaacaatttcatcacactcattattaacattgccttacaaacatgcaagccatataatattactatactataaaaacattttaattggggatactggtcaggatctgaatactttagttggagcattgggagtttgagactatcgtcaagtgtgtccaactcacctcgacaaaatgaggggaattctgctgggagactgggaggtgagccatgccaattgccacggttcttgatagtaagtgctctctctctatctctaatacaaaactatagtatgacacaaacttttatttagatttacagtattagttttgtttttatgagacggacggagcgtacatcttctatcaaatatatacttccgtcattttagccttttttttcaaaatgtatgtcgttttcatatttcaaaagtacgtattttagacatgaattttcctttatgaaaatattttcgaatgtaaaaacagcatacattttaatcgttactttgacaaagacaatcaatagcgtgtggtttttgtttcgactttcagagcagtcagccagtcacaactcagaaaaccgaaaaccagagtcctgataatgggactgcatgatgacgctttttgggccatcgacaccctctcgcctcgctgcctcctggtgggtttgaaatctagagttgctttctcagattgggccgagagttgtgcatatgacaatttggcctcaatagatctaagcaaccgtttaatagtctaaaaacattctgcatcttcttataaacggatacaaatggtttataagtcagacatactaatgcatataagtatgtactactactagaattatagcacgacagtactaccatgaaaataaaaagaaaaagagaagcacaaattcatgccttctcaaacacgctgccattaattaggaaaaaatattagcatacgaagaatttctcaatactccactgtatggtactctccaaaggttacttctgctacaggtttctttcatttaccgatttcctggcaaactcaaacagaaatctcgttcacaaatttccgcgcctctgattaattacacatgaatgaagtgctgcagattcctgcgacaaaacatttaaaacccttttgttccaaatgagtactatattttgatgacttattttcttcagagttcagacattccatgatcctttgaaatgcaagattgtaaaatcaaaaaaacataaatgcgcatggataaaatgtcatacgcccattgaattcggatatagaaataaaagacaagtgaaagttttcatatgaaatatcctattacatagaaattccaaatgaatctatattcctttgttccaaaggagcatattggaatcaaactcttcaaaaactcttcaaaaaacaatttaattttctctcgttacaaaggtgcacttttacgagtttctcttaacccaaatctaacagtgacaaagtgagcgtagctcgactagttagatccttgttgtggcactagcctatatggattaaaattctagacttgacagttgacgttagtacccgtatttatgactaattattctttcagtattaggcgaggtacctgtcaataacaatatgcccgtcatgtctgtgggtttataatgtgtttttttaaaaaaattaacagtggtttttatactactagtatgctggtacacggtcggtgcacttgtttagccgcgcataccacgtgacgcgatcggcgcacggttccctccccggtccgtaggccgcagccacccccacccctccaggtcaaagccgccggggcagccagccagagcccggccggtccaatggcgccttgccacgtgccccctccctccccaccggtccactgcgcccatcccacgcagcccccctcttctcctcgcgcggactccccggtttgaccgcgcatcgccacgcgtcggctcaccattggccggggccgcgccaaggagaggccaggcgagcttcccgaggagccgcacccgtcgctttctaattttttcttttctcccaccctctctctctctccggtctccactccctccgctcctccgctcctcgcctcttttacccgctcttccccccgatctccccggactcccacagccgcagcgaacaaatcccgcgcgggttgggaagagcgagctcgtgaggagagcagagggaaagcgcgagggggaaggaggaggaaaggtgatctcttctctcccccctttttcttttttttttttgcttgtctcgctttttatttttttgctacctttacggttgctgggatttgggggagttggtggttggttggttggttggtggttgcgtgaatccgaggggtgaggagaaggaggtggagtgttcgttcttgatctttcccgcagttgcacttcgatttgagattgctcggtacggatctgcagctgttgtttttgtttggaatcgtgttagatctagggttggagggtatggctgtgtggggttcgaggtcagatctgatgcgaaagtttagggttcttggtgactgtgagatgtggctgtgtttagttcacgccgaagttgtaagtttggttgaaaattggaacgatgtgattgaaagtttgtgtgtgtatgacaggttgatgtgatgggaaaagttagaagtttggaaaaaaactttggaactaaacacacctcgttttattttcttgccatgtttactggagatcgtgttggggactgtagtgaagactcgagatctgcgtggaggaagcctgtatttgattattcacacgaaatatgcacgcatagctgttcccctttcgagctaattcggttcatcgatctatcgtttttttacctattagatgcagtatgcctccgttgaactgcagatctagtcatttcgctgctgttcatgttgttttgaactgttagtctgtctgcttgctcttctgtggaagaagcagcagtggcgctgtcgttttcttagcttgaggtctggtggtattggactagatcactggtttggcagccactttcttgttgatttgtctgacggaatcactcgaaaagtaagaaaataaaatggagaaagtactctagtgaaagggggatggactagaatatttagttgcctgagaatgattcctttcgttcatggaaaaggcttgcgcttgttgtctaattgggaaaatgatgtgccatccacttggttggaatctggcaaagtcgtgtgatttgtatgatcttcttgggtttcatccattgttccttgggtggatggtgtctattatgcttatctccacttgggctagttttccgagaaccgtatatgttcttgtaaatggtccacaagtgatatagtaggttgtatctgtgtaagtgctgatatgcattatttgcaggtgcacaaggtcagactaagtttgcgttgaagaacaaaggagaggaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttctggattcccaccttgtcccatctgccactgctgcagagtccaaggtgttctacctgaaaatgaagggtgactaccacaggtattgatttctggtgtttcaggaattagcagtagctaacagtttaccttttttgtgtttcctaaggtttattttctggttttgaatgtataggtaccttgctgagtttaagtcaggagctgagaggaaggaagcagctgagaacactcttgtggcatacaagtctgcccaggttggcctccgtgtacttttgccaatatatatggtgtatagcggtgatatttagtttgctatatcattatatttttcttggagtagctttataagttctgatatttttatgtcattcctaccagtgattttttatcctccatgctgtatcttcttcaccgtaggaaaatacttccagtcttgatttattttataagttcaattttcatttatgggatgcatatttgctcatgtttgagacatacgctgctatttatggcatgtatcatgtggcaacgttgagttatttattgcagcttcatggattttgatgcatatttatcagcagaaactgcacacgatgacacttgattgcttttttaggatattgcactcgctgacctgcctacaactcacccgataaggcttggacttgcactgaacttctcagtgttctactatgagatactgaactcaccagaccgtgcttgcaaccttgcaaagcaggttagtttttcatttttttcccttttgaagtttgtatcttcttggtatcttgtattacttaataacctgaatatttgaaactgaaggtgcttgattgctagtttttcatgaatagttatgcattttttttatgtagcaaaattcacgtgcaagcatagaatttaattttgtttggtaaattgagggaaaataactgatgattgcttatagtatgcctgttactaagtaaagtaaatcttctgtctttgtattctgttcaaccttaagaatgctgttcactgtgttttattatgcattcagatcagctgtgatgcgccctcttgatttgttttcagtatgtatttatctactccgctgcgtgtgttccatgtttcttctagtttgttgcatgctttttctagtttttagcacatcacattaaattagctactgctcaaattaacatactgaacgggctaatccttcagtttttcatctagttacctctgtgaaaaatgttgatcctgtcaataaatttctgttcatatctgaattgttttgtcccctagctttgatctggataatactgctttttttaaaaaaaatctgaaagatcaccaattaaagcttcgtgtcccttgaaactagagcttgttttctcacttggtaaagtctgatgccctcttgtctaggaatatactgaaagatgctaacttcatgtctttattttaggcgttcgacgatgctattgctgaactggacactcttggcgaggagtcttacaaggacagcaccttgatcatgcaacttcttcgtgacaatctgactctctggacctctgacaatgcggtatttgctctaatatgcttattatttttcctttcattcatttatactgtaattgttatcaaaacgattttctggcatctaatcttatgttcctctgttcttctcccttcaggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccacttcctgtatttgcagcacattattagtatcgctgtattagcgttttccatgggctggttatgattgagaatacaggccaggcattgcatgtcctttatttgtaagctcgatgtggacacgttggaattcgtgcttttcttattgtcatgagagttgagatgatgtttggattggcggcatcctgtccgtccaagggtcaatgttattttgaaggctagttcatttgacccatgaactcttcagtttatctaaatacaaccataaacacagtttatctaaatatacccataaatacatttggccccctgacgcaggatgccaagcttacaaatctgtcatctcagcagcccggaggctttcggtgggaggagtcgatctttgaactttttttattttaaaaataaactcccctaaaacttatttttaaatagaactcttttggcatggcaaagtaatgctaccatgccagctagtaaatacgttatttgatcacacctgatttggctatcctgataacgttgtttcgtcgtgccactatggttgacgtgtcatcataaaattatcatattacatgtgacatgactattattttgttgtttcgtcgtgccactatggttggcgtggcatcataaaattatcatattatgggtgacatgactattattttgtcatgttaggtggattggcgttaaaaaagatttaaattttagaaataagtttttagacggattatttttaaaattgcaaagacaaataaataataaaatttcgagtctctacctttaggctaatcggatctatatatcagctaggaagcacttgaataaaatgcatataaaatcatgacgatggcgatggttgtttttgctcaattgctccaagcagaagcgtcgatcccatacccaatcctacacctcttccctgatagcctctcgtcttctcttacctccattgacatagctattgtatgagattgaatttttcttatgcttcttgcttcgtttcaggttgaatcacaaacatgatgagtcgtacgctgttaatgattatattgtagtactagttcataccccatgcgttgccgtgagactttatggttataaacatcttcataacttttagtttacagaaataaaaataccaaacatatatatctaaatataatcaggttgcgaatatcaagtgcataaaaatgcttagttgcttctcatgccaaatgcactatgggtgtatggctcatcaaacagctaggatggctcaaataagagaaatgatataatctaatagtctatatttataggtgatgtgacttcttgtatgataagtttacatgagttagggggtgtttagatggggctaaaactttttagcccatgtcacatcggatgtttggacgctaatttagagtattaaatatggagtaataaaaaaactaatttcatgaatgagagctaatccgcgagacggattttttaagcctaattaattcataattatcaaaagtttactgtagcatcacattgtcaaaatcatggcgtaattagactcaaaagattcgtctcgcgaattagtccaagcttatggaatgggttttgtaattagtgtatgtttaatactctaaattagtgtccaaacatccgatgtgacagggacttagaataagtccctggaaaccaaacagccccttaatgctctaatgggttaaactacgtaggaggaatagaggatttgctcttattgacaaccaatatttactatttattcattttatgtagacagagttccaccagagccctagttttagttaaaccaaatcattgaacttctatcaagccaaacattcaatttagtcacatgattattaagctcattgctcgcttaattctgtctcctctgataaactgatcccacaacctgatcgaacaagttagccaaagaaccgaacgagacatgtctcgtgccctcacccacaattggactcatcgtaacgctattgtcaagtcaccgccataaccatggctgcttcctttccttacgaaattggggagatggggattcaaagtatttacaccatcacatagctatggctgccggtggtggatgagtcttctggatcacttgaccttttggttgtgaggctcgtatgcatgtcagccactcaaagttagagaactgtatatcaaagaatttgttttcgccaacgtcttgaacctatacgagtgaagatccagccctcgaataggtggagagtagccaaataacattttatatattcaattttaggtgtggtatatactactcctctgtacttaacatagttataactacactactttatagtataattacatctgaaagtttttggagagcttttctgtcgaaagtcatatacatagtttttgaacaaatactacttcaattattaaaatgttggattttgcctaattgctctcatgccacgggtttaagtgttgttgtacaaatatcatgtccgtcagtgtattaaagacctactcccatatccaaaaggaaaccccgtatctctttttctcctcttctcctcagcattcgtgtttttatcttcttaccataggagtgtgaaggatatataggtaaaagagaagattgtttcttattttactataatattctatttagagagcattttactcttagttcatggtgagtgtcctactttccatgacggtgtaagctggttggagatatatcgactagatatgagaaatttcagttcatttttccaaaaaattccaatcatacaattcaaatgcccaatattccactaatgacctcaagtttcaattgaaattgcaaaaaaaaaaaaaatcctcttcaagatatgaaacaaactttcaacttagaaccatagaaagtatcggctcataatattgatatctcaactccaatcacaaaaactttgtatctcaaaatccaactcaagtttggcatcgttcttttctgaataagatgtatgttttatctctgttctcattaccatgattttcatatcgctaaacggtgtattttgtgcgaaaactttttatatataagttgctttaaaaatatcaaataaatcaaattttcaagcttttaaaaattataacttaattaaccatactaatgtctttcttattttctgcgtcgtgagtttatcttcaatcagtttcttattatttcccccataaaaaaggggacaactttcgtttagcttgagaagggagaagccacgcccagaacgtacgccactgacgcgttgcggtggaaccaccgaaccaacgggtttggcccggacgtacgcaccagaccaggctcgctgcaccaactgcgccaaaaccacttcggacttcgcgcagcaagcagatcgcgatatcgcatcgcttcgccgtcgccgcccgccccaccggatcccgcgcagatccggacgcccagatcccacgagccccatggaggcctcgccggccgcggcggagcgcgaccgctcgccgccgccgccgccgcctcccccgcccccttcctcgtcggccgccgccgcagcggcgatgtcgtcgccgctcgccgtcgtctccagcttctggaaaggtccgccctggtcttactcgccccctcgtgatgatgatggtttgagttggtgagaccggtggactgggttggattgggtcgtctcccgttcaagctttcggggatagtgattgccacgactctagaagaatttgtctgggtttgttactgatcgcaagtggagggatcttaatctcggtgaaatgttggcctacattggcacttccgttccaatctattgctagcatttgcgctctctacttcctcaattagagtaagacttgcgatatgcttaacaataagtgtgggaagcaatttcagtagcataggctttgaggatgcagttatcatcctaaactagttctgtatagccattcgatctagcaacagcctttgtacaatgagttagttatgaatgtaaactttcaccatttgcttaatgttaagaggttagtaggtatgatttgtgagggtagcatgctgctttcctgctaactgtagtttctgttagggacttataatgtgaaataactaccgagtatgaatggccgtgcactataggagaaaatcacggcgagtttgttaagttctcttgcatgtcgatgaaggttgatacaatgtaaacgttatgctatctattgcggattatctgactcttgcttactttgcactttagactttgatctggagaaggaaagaggtggtttggatgagcagggtttaaagattgcagagaatcaagagaccagccagaaaaacagacgccggcttgctgagagcactagggatttcaagaaggcgtcttcagatgataagcttagtttattcaattctttgctgaagagttatcaagaggaagttgataatctcacaaagagagcaaaatttggagaaaatgcatttctcaacatctaccagaagctctatgaagcccctgatccatacccagctcttgcttctatggctgtatgttctatctatcatctactgtagcttatttctaatccccccttccgccttagtatttttgccaaaaccacaaatttccaccaatgcttaacattttgccttgtttgttttagccagtttccatcttgttatttcctattgacgcctaagtacatgcctgaagaattgtacttgtagttgtatgtgacataaatggttatagtaactcttattgttctgtaactatgtacaaccgagcaagttgttgcaataatatgtccagttacttatttgaaactataatagtaattttgtcagattgcaaaatatagataacagttagtttgctccagcatagtagaagtagtaaattgttgaaattacaaagccggatactgcaattttgtataacaaagccagatgtctcaactttaagtgcttccagaggagagctttcaacttcattgttttgtactgcaatttcgtgtaacaaagcaagatatttctaactttaggtgctttcagtataatagataggcttcaattattttatggcactgacatttctccccaacctgtcctgtttatcatccaatccattcaggagcaagatcagaaactatctgaactggagactgaaaatcggaagatgaaacttgagcttgaagagtaccgggcagaagccgcccacctaaagaaccaacaagcaacaattaggcgacttgaggagcgaaaccgccaactagaacaacaggtctgttctgattctactcagttgcttgctctcttttcttagctagaattaagtctatttcttgttctttccatgaaggaagtaaaaaaagataagttcggtcggatactattgttttttcactcgtaaatagtgacttattatatccacatactgtatacctttgaatggcagtccatttttctgacaatttggaacctttatctgtagaaattattttaaatctagtttcagaaactcacaatgagcaatattttagctattcttttgcatagattctacattctagagacagaaatgaatattttacctaatagcaatataagtatgtttttgttctgctgatattctgacctattaataatgtacttctgagcataacacagtcaatcaaaattatgcgataaacatgtctctattttacataagtatgtttttgttctgctgacattctgacctactaataatgtatttctgagcataacacaatcgatcgaaaataataaaaatgtttctatgttatttaatttgtatgaaaagtgaaatatttttttttcaaatatgtgtgttgcggataattattattggcccaataacttttcttcattaaattcctgctgatttcttccaatttatttcaaacgccaaacttccattgttctcaagttcttcttttctttttgcaatattctttcttccatttaataattttagatggaggaaaaagtcagagagatggttgaaatgaagcagaggagtttggcagaagatagccagaaaactcttgaagccctgaaagacaggtactgtgaattaatggtaactagaaatataactgctctatgatcatcatgtttccaatgcttttttttttgtctgaagcatattttttttaccttttagtttttcatggttgtagggagcgggcattgcaggaccagctaagacaagccacagaaagtgtaaagaatatgcagaagctacatgaatcagcacaaagtcaattgtttgagcttcgtactcaatcaggttacttttattacaactgtgtaaccttgaaggtctttgtgactttatgggagaaacatgttcaaaggtttcgctgttgtgatgaagtatcatgtttctttcagaggaggaccgggctgcaaaggaaactgaagtcaatcttctgttggatgaagttgaacgggcccaagcacgtttagttagtcttgagagagaaaaggtagccttttgttttgaaatgcgagcttaatgtgtttgactagacaaatatttgaacataacattgataacagtgctatctgttttctacaaatcatgcaatgaccattattaccaataaccaaatacatggatgctactaagttctatcatcactgaacctttgcaattgaaccatatacaggttcttgattcatgcaattcctgcattaagaaatcttttaagacatttggtatacataacattattgaaattactgtctaattttatatcagaaaatcaatcgcataaaactagtagagttactaagtaaaccaaattagggaattggacaatgaaatatctagaatatctacatcagaaagaagttgcgggacttacatgagactgtagctgtagtttgcacagctattgcttgccagcgtctgatctggaataccatgttttatgcctttattgttttcctgcagggtgatttacgatctcagttgcaaacaacaaatgaagatgcaaccaatagtaggttagtttatttgcattttccatatatatgatgtattaagccttattgatttcgaaagtgtagatttgtcagcatccataattcatatattagtaacacgtggctcgcgcctttcaccagtattgctgtttattagcattttatttgtttttttctgtgcttacccaaaagtaaatgctgaacttattgtctgaatcatgttattctacagtgactacgtggactcaagtgatatacttgagagttccttgaatgccaaggagaagatcatctcagagctgaatgcagaactgcgtagtattgaaaatactttatcttctgagagagaaacacatgttaatgaactgaaaaagttgactgctttgctcagtgagaaggtactcgtcatcaaaagaccttactgtgtaaagtcgataactgtttcttgaaataactcatggcaggactgtagtagaaaacaactttaaagcgatcatttacctgtctattactcatttatcacaatccgttgtcgaaattttgttgaatataggttaatttctttgcttctatcactatcgatttctattatgctagcctcaattgttatgtgtgggttttatagaatgtaccattatatgtattagtcacatttttggtgtggattgaagcatcaaaaccatgcatatattatttggaatgatttctttctttgcaactgtttgttacccactattttactttgctaattaacttccaatctgtaggaaaatgctctgacagagttgaagaaagaacttcaagaaagaccaacaagaagactagtagatgatctcaagaaaaaggttcagattttgcaggtatttagagaaaatactcatgtcatgaaattctttatgatattttctgtagtacctgtattacatccaccagttggttctgcactcattgcatgcccatttaatgtaattgcaaatctgaactgtacatgatttctgctttcctatgttgcttcctgtagctgtgtaagtagtaccctcatcatgttgtacaggtggtgatcctaaaataatatcttcgtggtagcattatgttcttttccatcatttctctacgaagacctctctcccccttgttatgcttattcctgatgacataccaggctgtagggtacaactccattgaagctgaagattgggagctagcaacaaatggtgaagaaatgagcaagttggaagctttgcttcttgataagaaccgtaaaatggagcatgaactaacacagctgaaggttggttggcctttagtttggatactaaaatgcatctaggcgattcctcgtgcatacagaaatgcaaggtgaacttgtttctctgttctgactagccatgttcttataccttgaaggtcaaaatatcagagaagtcaaatcttcttgaggaggctgaaaaaaagattgctgagctaactgcaaaggctgaagagcagcagaagttgattttgaaactcgaggatgacatactaaaggtttaatcagtagcaattgatccttatggatatagtactttaccattttagtataatatgtcaatttgaatcatgattcatactgttacaattatgtaatctcacaattcagaaaatgaaaaaccaaatgatttattattttagtttcatcttctgaaggacatgcaactaatatatattagctttattgcagggctatagttcaactgataggaggacttcacttctgaatgattgggatcttcaagaaattggctcaaatgaagtagcagaggtaatttccaggttgttcagtatcttatttgtttaaagcttgtgctggttgaagtttgttttggaatacaaactaccaaatcccatcctcaaagcaccatatttgtttattatatgatgtataatgcctgctttaactcagcagtggacaaaacatgcaagagaaactcaattgaaaagttcaattttaaattcttatatacatcttgaagctgtcataaagatctggatttaccatgaatgttgtcagtgtacagagatgctgtactaaacctctttatctgacgtatggattaatcactggtcttttgtatacactattttcgtaactattggtttgtaaacttatgctttaatctaaaaatcctgtcttgcctttccaagtcaataatcaagctaacaaactatagtagccttgttttgccatacttagacaaaatgcgctaaaaatttccttctctattcattcccaattcgtagcaaacatgtgttattttcagttagttgctataatagaatagccttcactcccttgttaatacatattttcagggtactgatccaaggcatgcaccacaagaccaagaccaaagttccatgcttaaggtcatttgcaatcagagggatcgtttccgtacacgtctacgtgaaactgaggaggtatatttcatgaaattttgaaaagggactgtaccagtttacaatttagagcaacgatgatagtgtagttctcatgtgaattagatgtgaaatgacatgatgtgctaatttcttttagtcttttcgatctgttgtcctttttactatattaatggatagcgagatgagagggtcatgcccttgatttttctttgaagtggggatctgtatatgtttatttatgatttcatttttatctatgtgcctctttgttttgttttgttttgacttattgccattttgtgtctcctaggaactaagaagactaaaagagaagtatgaaatgctagttgtagaattggaaaaaactaaagcagataatgttcaactgtatgggaagattcgttacgtgcaggactacagccatgagaagattgtttccagaggaccaaagaaggtttatacacatcctttcaagggaaaatagcaaaatccacagcattctagcttttgacctttgttacattgtgttttgcagtatgcagaagatgttgaaagtggttcttcagatgttgagacgaagtacaagaaaatgtatgaggatgacataaatccttttgctgctttttcaaagaaggtaacaaaatgtttacgttttatgataacgtgttatatacgttactctatagcttatacatacatttaattccatatccaggaaaaggatcaacggtacaaggaacttggtttaagagacaaaatcactcttagcagtggacgttttctccttggtaacaagtatgacaccatcgttttctccctttttttctttgggttcaatttcaggctttgcctcttccttttcatggcacatactgatctttgatgataactggtaaacactagttagagctattcatggcaaacttctatgtttcgaccataccaaatattatgatcttgtgtttaatgatgttaggacttatgagtctagttaatgtgccttgcggccatgcaaacgacactctccctggtagcatgtttaaaccagccgcttcttattaatgttagccgtttaatgggagagtaattcttttctggaggaccaggaaacacctatcaatctgtcataatgcataacagatctgctggttgagttttcgttcacttttcctttttttttaaaacttatccatgtagcggaatgacaagtagcttatgtaacatcttttctatttgtattcacagatatgcccggacatttatattcttctacactattggattacatctccttgtatttacattgctgtacagaatgtcagctttgagctatctcaggtatgcatgcatcgccttttcaaaattttaaactctgttcctgagcatgggctaacatggaatatttgcacagcacaacacctgcaaatgatgaaatcatcttggacgctggcaatcagacgctaccacatgcgctctaaatggaagttccatgtgtctggtattatcacttcatcacgctgaaaaccaaaatctggggtttgatctcaggaaatctttgcataggaccatatgactgaagccatagttgacatgtattctttatgtccattagacgtctgaatacgttttctgtagataaaaattttccagatatggagacggggtggatgggaaatgacaggatgaggcgtggtcgtgcgtttgagccgttattatgtaaactgttgtatcactaattgtcaattctgtgggtaaaatgaatgcacgcctgataatgatggttgtacaaatgccaaaaggataaagtcaaacaacttgagtaatgaaatcaaagttgtcactaccattttcaaatgaaaaattttaatgcttagaacatccactacaattctagtggtctaattctttttagaggaattagtggttcagctctaatgctccttactccgaaaactacaaaccagacctgatgagctttgcctgaacaggattcaccaaacacagtactacacaacttgtccaaagtcacattatcgacagtatatttgcttgtcttcgccacaccaatcattaattctgttctctcgagctgctggctctctcgaactaacccaaaaaaaagaagagaaaaacaagcaaaaaaacatgtaaaaactaacttttccttttttctcatttcggtggggtttggatcaggatttaactaagtctttgtatttagacactaatttagagtactcccttcgttttttaacagatgacgccgttgactttttctcacatatttgactattcgtcttattcaaaaaatttatgcaaatgtataagatataaatcacacttaaagtaccatgagtgataaaacaactcataacaaaataaattataattacgtaaatttttttaataagacgaatggtcaaacatgtgagaaaaagtcaacggcgtcatctattaaaaaacgaagggtgtattaaatatagactacttacaaaactgattacataaatgaaaactaatt

SEQ ID NO: 82510 - DNA, 25377 bp, Oryza sativa
cacactaccacgccatgaactcgtggcgtggcaaagttatttggccacgctaggcgggatggcatggccaaaaggttcagatcctaaaaatatgttttgggaaggtctatttttaaaattaaaaaaataaaaaggttcaaaaaataaaaaaaaagttcccagtttggctggccggttcagatctgggaaataaattttggatgggtttatttttaaaattaaaaattaaaaaggttcataaaataaaaaaaattctttcgctgccgagccaagggtggcgctcccatcgtattgttgtttgtcgttgccaccacaaggtgagaaaaaggatgcagccaggtttttttcctggacgtgatctttggttcctgtgagccaacctatctgatcgtgttctcgaggttcacaggcaggaagatccattggattggtttgatttgcaatttctgtaactttacctatcagtcttaccaagtataatatataaattagctctgtgttgctgtttggaaatattcagagagtttttattgtgttggtagctattggtaccgtgaaagagagggataaatcagggcgcttgctgtagagtgctcatcagagattcacattcgcggagttctctaagggttcaagttagggatattagtggtcacttcaaatctagagaagcttatagggatgttgagttgaaaatagggcacctcttcctagggctttgttcggtgaggttaggggtaatcgagacccagctcgttagaggtccccaatggagagtaggattcatatgatcccatgtctcccctcttatgcaaatcaatgtatttcgtgtgatttcctgctttgtggtgctaatatgtgtcctctgtgaggttggcaagtgttggggttccgtgagaatcaagactttgtctcgtgaggcaagaactccagaagttttggaaaagaaccactgaagtaccgggcagacctctctgtcttcggttgatagctgccgaaaaatttctgtcccccccctcttctaggctacaccttggatttcaggtgcagcttctgtacataagattataagtattatggatggcaatgcaggaaacaatcaaatttttaggctgaagaagatactccgaagactgcttttagatgttctggagcaattggcttatacgagtgggttgttatgactttttgggttaagactgctggtgctacatatcaaagatctatgaattatatattcatgatctcatcggcttgttgggtgaatctatatagatgatgtgattgtgacgtctaaaagtgttgatggacacttagctgatttatgaagggtgttagataggacaaggaattctaaaaataactccatttatacggctcttaatccaattttcgctagcgaaggctaaagaggaccacatggaaaaaaaccgccctatatatcaaatagctccgcaccatctcaactttccccacatcccaacttcacgactccttctcttctctcaagccgctcctccctcctcctctcaccatacatcttcacctgtggagcgacagcgatggcgacgagggcaatgggaggcagatctgatggtggtatgggaggaggctggtcgcggtggcgcaataaagagtgtggcggcggtgaccctcccactcccctctcccatatccagcctccaggtgcgtgctctcgacaatagcggctccctccagcctcaacatgctctcggcaacggcgtccgtggtggcgatgggggtcaaatctggtggcaggatgaccggagaccgttgacggtggaagtagtagaagtggcactgacggtgacttccccactcccctcccatcctatccctatcctagatctgaccatagggaggcggccgccggtggcggtagctcgtccacggcggcttcagcagcctccaaggtcatcgttgatgacaatgagtagtgttgatgtttgcatgtttaaaatgcagtgagaaatcaatgtagtgatcttggatgtcaatttgaatatggattggatttgaatctagctttctagacgtggatttaaaatttgaaaatgcaacaatgtctctagatgttgatttttttttcccaaaaggatatcgctggcggtcctcttaattagttgtgtctcctgcgaaaattgattttgcaggcgatcttcttaagtgtctgcaagcaaaattctattatcgcaagtggatttaaattttcatgggtgatcatattaagtggtcgtaagcaaaaatctattatcgcaaccatgaacaaaaatctattgccggctagtagtaccgccagcgaaaatcggtttaggccaccatgaagaacactcttttaagtagtgattaggagtttgtattaaggaagctcttcgagtcatgcatcgagagaattttagtcccgtgaaatttcctcctcactcgtatcgtaaaacttcctccctaatttcatggagtcatcaactgcgttaggggatcgagcagaatcaaaaactgatcgagatcgatattatcttcgtagaccaaatcacagtaccgcacgttacgacgtccagggaccgcgtcagttggcgacggcgacgtgacggagtcgactctatcgtcaccgaattgatcgatggtggccttccggaggatccggatctcctactccgacccggacgccaccgactccgactccgactcggactccgccgacgccggcgaccacgatatcagcagccgaagcagcaggaccaacgccgccgcacgccggaaggtgatcgtcatctcgctgtccaggaagaagggaagatcgttatcgcagtccggtcgtcattatcgtcgtcgtcgttccgaaattccggcggccgcggcgaaggcggtggaggcggaagattggccgtcgtcgagcgacgggatgcgtcgtggcgccgtagcggcggcgaggtcggcgtcggcggccgccaagaagggttcccgcggcggcgtgtaccagcgccagcccgggcggtgggcggtggacttccgggacagccagctcaaggtccggcaatggctcggcacgttcccctccgaggaggaggccagggccgcctacgacgccttcgaggtgcaggtccgcgcctccctgtcccgcggcggcgccggcgcctcctcccccgccgtcgccatcgcgccgtcacctgcccgcgtcaagatccaactaccggcgccgcggcgtgcatctggccgccggaagaagacgcagacgacggcgacggtgacgacaacgacgacgacggaatcattatcgcaagtgacggcctcatcagcgtccccgtcgtccaaggaggcgccgccgccgtcgtcgtcagcttctgccgcgacgccgccgccgctgaatccgccgccgttcgtcgtcgatacattcctgggggaggatgaccacctcgccgccgacgaggatgaccgcttcggcttcggcctcgccgatcttgggcacctcccgctgccgttcttggatgacaacgacatggacttcaagctcagcgacagcgacgatctctccttcctcttcgatatcggcttcatgtgacgtacgtgacaaacccaacaccaacacgtacgtacacttttgttgtgatcgatcgattcttcatcgatagatcgatctctgcatgccaatccatgcatgatcgagttacatattacattaattgtaaatcaaccaggtaattcttccatttacctacaatcaactgtaaactgtgtaacatattattcatctcaatcagtagtagtaataattaattctgcagtaattggaatcatcctctgctgaattatattatctatggctgagttgacgacgacgacgcgagctgtgacgacatataagctagaaggagccggggcactcgaaggtgacgtggcagccgtcgacgggagtgagccggacgacgtgccggacggcggtcatgaacgccgggagccgcgccgccgcctggcagacgcacgagttgtccagcgacatgaggcgccggcagcacgccgtgtcgtgggggtcctccctgctctcgtcgtcgtcgtccacgttgcgccggtgccggtggcgccgccgccgcccacgcccctcctcgtcgccgccgcctcctccctgctcctcgccgtcggcgtcgtagtagtagtcgccgtcgtcgtcatactcgtcgccgccgccgccaccgccgccccgagactggagcccgtgcctgcggctcccgccgccggtgaccgacgtctcgttgagcttgagcgggcgcggcggcacgagcggcggcctcatgacccccggcaaggtgcgcatgctgcacgcctcgttggcgaggttgaactgcgaccggcacaacacctgggcgctcgccgtcacggcgagcagcggaagcagaagcagcgccattgttagtgctgatctctccatgcttgctttgttcttgtcttcttgtctttgctgatgatccagtgagctaccagtcatcatatcaagcggcttaaatagccacggatcctactaaactgtctcgtgatttaatttcaagatgcatggaaaatggggtcaaggagaatcagtgttttttagtgtgattttcaagatggattcgaggagaatcagtgttgttttgtggatcgcaaatgcttgttggtagaagttaggaggagaggaagttttcctatgacattagattgaaatttcccatgcttttctttggctgtaatgacgttttgaagaagatttaattccatcttggaaacaagaacacgaaggctagtttcgaatgatattcagctttcaaggatggaagataagcattgctcgacacgtgaattatgtaatcaattgatcaatataatagttagtagtttagtaccaggttagtttgccttgctgctgcataatgtatctttggaggtcaaaagtaggtagattcagagacttaatttaattttggcgtggattaacaccaaatcaagtaattgtaaattcgctatggttccatttttcaagcatttttcagagtaggcatacaaagaatatgggaacattttcatttcccaagacaattttacaatggtgacaggagaaattttgtcgtgtggcaccatacatctcaattatgaagcttattttctagttagctttagcaagttatagatttttttcaccaaattgccatgaaacgcacgacaacacatattaaaaaaaactaacatttgggcaaaatacttcacataatatcaccactacagaaatgatttttctgaacgagatcctcgttagattgcagacagaccataacaacccgcacctgtaaaaatcgagcaggcatttccgcatacgactccttaataggcccgcaaaaattcatttttgtatgcgggtctctttaggggccgtatgctcattttgcatgtggacccttaagaggtccgcataagaaaatcatttttgaatgcgggtctcgtaagggtctgctaagtctgatttgtctcatcttccctctccactacttcaaaaaaaaatttcacaagcagccttatcttctcttctcggtcctctctctctccaccacttctcctcttctcctcttccctctccaccacttcaaaaaattttcacaggcaaccttatcttctcttctcggtcctctctctctctccaccacttctcttcttatcctcttccctctccaccacttctcagtcctctctctataacctcctcctctcctctctctctctctctcggcagccgacggtgggcttggcgcccgcacgaccggtggcggcagctactaacgacggacgggcggtggttgggcgggtgacagtgacagcactacggagggttggtgatgacggatccaccgcccttgaccttgggcgggggcgatggggcgggtgacagcaggcgcgatggcgagcggcggcaaaggcgagaggagcacgatggcgggtggattggcgcgtcgacaggcagacgagcggcagcgacggccgtcctccgcccggatccagtggcagcgacaaaagacgcgcgacagcaggcgagtgggtgtgtcggtgggtggtagcgaagggcgacagcgcatgacgacaaggactcgaggtgacggcggtgggcggccggagcgggcgtccggcacgtggtgggatggctagagttttttttttttttttgccaaaaaatattccgcatgtagttggcttaaggtttcgtatgcgaaaattacctttttgcatgcatatgcgctaaccacatagaaaatagggattttcgcagacattttctcgcatgcgggccagacaaccgcataagaaaatcgattttgtctatttggaaaatcattttttagtagtgtgtacaaagttattcttttatttttctttccagatgattttgtgaaaacagaattaattaatttctcaaacagaagacaacgaaactgagagctgcaaaattacccgtacacccatgggcgagtaaggagtctggcatgcgcgcgaattgtctcgggtatatgtcgtgggcggaagaacctaaccgcaaccactcaaggcgcgtccttgaggaggccgaacttgtaggagtcacggtcgagcgggttgtggaggaagagatcggcgtgcgggtactgcggcgctagcacattccacgcaatagacggtccggtgagctcgaaccgctgtgccgctccgacgaggcagaccgctatccgcccctccacgacatttgtgccacctgctgcagctgctagcttcctgtggtctaacttgggcggtttctcgttgattttgacgagggaggaggagaggaggatgaggaagaagaaggccgcggccaagaggagggtgatggtgagaccatggtgatcccccttgtgcaccactagctggccatggttggaacttggaatggcaaaaggctagctagcttgattaatttgcttatgttgacgacgataacagtgttgacctgtgtatattaatttatatgctgttgtattgctatttaattagataaaattactaagtaacactactggagaaacgatcttcgatcggtcggccaaattttacaatagtctcggttctcttataaaccaggactaaacgtcattatttagtcctggtttttaaggacaacaggactatatgatctttagtgtcggttcgccggttgctagagggtgtcaggccggatctttagtccactaaagatgcttataagctgcatgttggcgagagagcgtgcatgtggtggttcgatcagagctaacccttgtgcaatcatgtacgtgttcatcgtgcttattttcatcgttccatgcgtgcaacgcgttactcgtgcttaatttctattataaatttagactaatctagatttggtcggtggatattagttttcactagaaaaaatacctgtatgttgcgatgggtaaaaatatttttagattctttagttttggaccaaaagctccctatacattttactctttgctttttgaacaaaagcttattccctttttttttcttttcagtttcagcctagaccgccacctcctttgcttagactgcttctctttgacctaacccacaagtagagctgtagctccagctcgtatagctgactgtcgtcttcaacctctggaaaatggtgaaaacatctcatgttcatataatgccagaactgatcctccccatcaaatccggtcaaatatttctagattttccaaaattggttgatggcttttatacaatcgatctgctctttcctttttatcaaaatcgaagcgaatccgcaaaaatcgggataaaaacattgacttttaaataaagactaaatccggtgaattaaaacagaattgaaaggtaaaaatgggaaaaatgataaaggagtaacggggaatcgatttttgcaattaattgaaaaataaggtgacgaaaaaaaagagtaaaaaagcagctgatgaagaaaaactgaaaaaaaggaaaaaaaaggaaaaagaaggcgaaagagaaggacagaaaaaaaagaggaaaaaccggcgaaaaaagatggacggaagaaaacggaaaaaatggaaaaggaaaaaggaaaggaaaaaagggtgaaaaagaaaaaaaaagagacggtcggatggaagaaaacggaaaaaagggaaaagaaaaaaagaaaggaaaacggcgaaaaagacaaaaatgggaagacggagaaaattttttagctgaagccttacgtatttctgggcgtggctgatgggcgatcgctcgccccatcccctatatattcctctcccccttcctcctccccttcttctcttcctactacaccataaatttaaaaaaaaataaaaaaaattagaaaaatttatgtatagaaatactatatataaaaaatatttgaattcaaattcaaatttgaaatggaaaaatatttgaattcaaatttaaatttgaaacgggtatataaactttttacttataaattttgggcctataaactaatatttgaatttaagttcaaatttgaatcgggtatgtaaacttttgacttataaactttgggtctatagactagatgtacagaaatactatatataaaaaatatttgaatttaaattcaaatttgaatcggatataattcaaactccaatttgaatcggatataattcaaattcaaatttgaatcgggtatgtaaacttttgacttataaactttgagtctataaactttaggtgtataaactttagatgtatagaaatactttatataaaaaatatttgaattcaaatttaattttttttgtggagataattcaaatttaaatttgaatcggatatataaacttttgatttataaactttgggtctgtaaactttagatgtgtaaacttgaggtgtacaaacttcaggtgtataaatttactaaaataggaaagtaatgcggtgcaaaaaaaaaaagaaaccacgtgaaggagatggggggcaacccgatcgctagggccgatcgatccccatcaggagtttcgcgtatttcttaattaggtactagcaaaagtgtccgtgcattgcaacggaaagaaaaaacgagaaaatttaattaaaacatattaaattctaatttgatgaaatatcgcagccatcgtttcactaacaaaaagtaatttgtgaataaaacttttatatacgtgttcttagcgatcaataaaaaaaatctcaaaatcagctccaaatttaaaattgaaaattcaaattttggttgataagaaaaaagcacaagtgaaaagatgaggccctatgactgtaagctttttaaccattatttctatatttgctgaaactgaattctaccctattatttaccaattgatttttacatccttatttctcattgatcggtcaggattgtcccaatccaacgcccgacgacgctcccacctccctcacccccttcctctctccgccctcccagagacccggactcatcctctctctcgcgttcatccaaaaaatcatgctgccccaccctcacaccaactgcacagcgacgcctcctcgcaacccctccgcccacgcatcgcgccgccgtcgatttctgcctcgagagcatcgttgcacgccgcgtgtcaccagatcggcgtcacagtcgccgacatcgatctcgctccactatcggagtcacaaacatcggcaatcaacccgaggctcagcggagtcggcgatttcgctgcttgcagtaccctgatgcaccagtgcaccactagccaccaatccaccagaggctctcttcatctcttttatgctaaatgcaacatttgtgtgctaccttgaaaacagtagtaactaattatgctaaatgcatcattatagaaataatgattttttattatactggtagggattgccgatactttccacgagtaattcttttcgctttttcttccgttctatttggtgtttttcagggttttcttacctgtcaggaatgtcaacaagccacggtgcccaggcatatatgcacatgcataaccaggtgagaccaaggaagctataacctacattagggattttctttttttgcaattatacacttcttattatgccaaacatttatcaaactatcgcaaattgtatatttggtatcattggttgttttccgtttatatgacacattgtaaacggagagatatgtggcatattaaacttcacatttatatggtctgtttaatatgcacagtgggaaaacataataaattgagataatccattgtatgccactgagtttgtcataggtctacaatttgccactgattttgtcacgttctataatatgccatcgatttttgcttaacttctacgatttaccaccgccatccggttagtctccgttagtactgtacactttcatccaaatgaccaaaatacccctgagacaaaaactttcaaattttggataaaaattctgaaatgtcagactttaagtttttggacaaattttgaatgtttacaatcttatgtttataatatggtatttcggaatttttgtccacattttggaagttttatcctaggggtattttggtcatttggacaaaattgtacagtactaacggagactaactggacggcgatggtaaatcatataagttaagtaaaagtcgatggtatattatagaacgtgacaaagtcagtggcaaatcgtagagctatgacaaactcagtggcatataatggattgtctctaataaatttgcaattatatgtgtgggaacgagcctcccacgtgcactgttactagttgttactccctctgtcctaagctactttgatcaataatatctataaaaataagatgttttaaataataagatttgcatattatgatagtttgtttaattataaatatagtaacgtcaattttacatgattgacttttttttattttttattattaatagtcaaagttaaaaatgtttgacttactattatgctaaaaatgcttacattttgagatggagagtatgtacgaaccacagtaatcgagtattcatggtctatgtggtatagctaactcatgtcacaaatatatattagagcagtggcaacgtgatatacgtatgcagatatatatggtcattacttggaagctttgcttgagattatattacaaaccaaaagccttacaaaagagagttccgcatgcaaacaacgtgcatgctaatcttgatggagactatctagtgaagtactagcttcaggcaactcatcgacccagcacggtgtgtatggaaatgcctggcttatgtattcatgttgggcgaagtggttatagtgttttgggtataagttacccaaatgttgaagctttgagctattcaaatgataggccaatcctttccttgatatagaattcagaaagatgacctctttataaggatgaaatccaagcaactcaaggtagtcgccatcatcgtgctcttcacagttaccttgattttctacaatattatcatcatcggaataccattcaaagttattttccgccggtgcatcatcatttggagaatgaaaatgagagggatcatagttcccattgtataactcccactctcctggaaacttttgactataaagatggtagttaacatcttgtaagatctacggtccgtgatcttgtttactattattcaggcgtagtagcatgggcttaaggttgttttggtgcttcaatacccacttaaactgaccacatgatttattgaggatccaaattaaaaggcaacagtccagcatatgaagtgatgcgaggtacactcctttctctgattttcctatgtaaatatatggtggttgtttgctcttgtaaattttgggatgcttgattacttgataggtcgtcccatcagacatgataccctacgaagaacaaaataaacataagaatttatattaacaaatatgaaaacggaatacaagttgaaactaaataaaaatattaacgctaaagttaacatcatgacaaaatacgagttcacgtagagtgctcctcgccaatagacagtaccacactgctccggccggcacagcctctgagcgctagccacggttccggctgcatccccttctctagagaatgatctctcctcccatcgccctgtcgccgatgagaagacatggaggacgagcggcgatggtggccattctgatttcttcaagacgggatccatcgtttttacgttgtaccatccgacgtcaacaaattggatgttaaaaacctcatagtgcggcgataaggtagtgtcgaagacgatgaattctttgtcaaagaacccagattccagcttggcgaaggtgcggggcaatggtggcaagcgcgcccaccttcgagtggccgggtttaccacaaggagagagaaaagcaaaaggaggccgttgcagtggtccccgatgtcggggctttgttcttcgggtggcaggaagtcgagcatgccccttacggttgtcggtgacgaagatggacgagagaagaactccgggaacgtgagggcgttgaagtggatgaaaatgccggcgagcgacagcgggagggcgtagcagccggcgggagtcgatggcggagcgccagtccgtgcagacgcagcgcgacgcagcgaggcttcgcgggggcaagcggcggaggatctcggcgagcacgtcctccggtagctccacctcgcgatcgtcgtcgcctcccgctgccggcggcggctcttccatgatctccatcgaggtacgtattggtggaaggaacgggcggcaactactgcgggttaatttcccgttttctttctctctgatctgtcttttcttggtcgcacagattgtgcattgcatggtcgactagataggctctgtgtacaggctgaactggacaccgatccggattggattggaatgatcgtgtacgtgtacagctccatcggaaatagcgacagtgttttgttcgtacgtatgacgagtactgctacctctcaccttaatttgactttacatataacggttgaccattcgttttagtcaaaacccaaatataaatatgtaggagtatagtacaagggctaatactacaaatggtttctcaaatactcaaatgttgtggttattgcaattttcttgtattgattgaagtgggttggagcggttgcttgttggaaaacgcctgccgagtgggcagcgcaagcgcaaggaggaggagagagagagccggcaagacctcatcctggctgcgttgtttgcgggagagtgattggcatgatgaatcacacgaagaaagctagtaagcagcagtacaagatatttaataatttgatccttcccaagtcgggctcccattatttaatatatcttagcccgcttatggtcccatatatctgtttacatctaaatttggcacctaaaaataaaataggaaaaattgtcaaagtttgaaagtccgccggttttcttctaagagggttggtctgaccgccgtatgtcggccggtcagaccgctgctagtagactagtcagaccgacagtgtgtagtcagtcttaccggtagaatccgagtccagttctgtttttgtcgggactcgagtttccttgctcggaaagacatattttgggtttccattggtttttagcccgagttggacgtggaggagagcctgtagagggcaagaccaacccctatataagagacaagtccggttcattgtaaaaagacaatcaaccatcaatcaatcgaatcgttcttttacttttgcttctaattctagtttagtttgtccatctttgttgatttgcgctgtaaatcatccgccgtcgctgcgagagtgcgacacatctttgtaggtttatcctgaaaaccttccgttttgcccacgagacgggtagttatctatcgttctatctagatcggctccggtagccagtttagtttatcaaaacccatcttgatttagcttttgctagattgaggtggttggcgactctaggatcaccgcaaagctttaggtgctgtgatcgtgcttatcaaattgtcaaaaaagttaccaacaatatcatcctcacacgtgttagttaaagtaaattggaaactaaaaagtgtccaattattgaatttctccgtgtttcacatagctcgaacaaacaaaaaatatctacaatgattacttttttaatatataacgccattgaatttttaagatacgtctaatcattcatcttattaaaaaaatataattattatttattttattgtgatttgatttatcatcaaatgttcttgaagcataacttaaatatttttatatttacacaaacattttgaataagataaatgtttaaatgtttgtaaaaaagtcaacgacgccatatattaaaaaacgggggtagtataaggggtgttccgtactactgtggttaccggacccgggtaatttttaatacttggatgttttagcttatattaactatattgtattagttaaaaattaaagtattatatgtgttatgacaggttaaggaccctggataatttccgttctaggtttgccactgtgtagtactccctccgtcctaaaatataagaagttttggttggatagaacacatcctagtatgataaatctagactgacaatctatctaaatctgccatgtgtcccatcgattcaaaactatttatattttaggatggagagagagagagcatgtagtgagaggataggagatcatgaaggatatcacaagatcatgccgctagacaccgtagacctgtgctgggccttgcccatggatgggcctactctacaatccggcccactcgagccagccctattagtctgcctgggttgcacgagcctaggctgggtggtaagggcttttacatgtttggaggtgtgctaggccggactgcctcgttctagagtggtggaaattgatgagttcacataactgaaaaggtaagttcctctaaaaaaagtaaaaaaatagactgaagagttggtcatgcattgtttgattaattaatattattttctctggttcttactctctctgctttatattagaagacgctttaaaaaaattttagtcaaacttttttttacgttctactaaatttatatttaaaacatagcaatattttcaatataaagcaagcgcactattaaaatatatttaatgttagatttaataaactaatttagaattttagatgttgctaaaattttctataaacttaaataaatttaaaggtttgacaatgagaaaaattaaagtgttttataagtgaaaaggagggagtacaacttagtggtgtaatatttttaatggcaaccatatttaacatcctcaaattttaaactaaaatttgactgcatcatgctggcttttgattaaatttgtttggtttaaaaatctatttgattcttaaattggttcaagtatttatttcttagagccctactaatttaccctaataattccctttattccaaaccctagtgaatttgagcaaattctctcaaatttcaaaccatagattattttcttagttcatcgaagatttgctatacttcaaaccctagtgaaactctttcaaattcatagattaaattcattctttttataggaaatattcaaaaattctgaaattcactgttcatcgcacacaaggtgctcgatgaaatgtctagcccaactagagcagcccaactcctacccaatcttgtgcaaagtctagatttggtcctaggggaccacaacccactcaaaaccgtggctttctttgcctcatcctccccttcacgcgcaccgcccgagcatccgacttagccacgcgccgtgtcgccgcgcgtcggcctcagggccgcttgcgcgtgcctgaccgccttggcgcaccgtcgcccgtccgacgccctcagcccaccgccgccgcaccaatcttgacgacgacaaagccgggacgacgaccgccgcaagaaatcgccgctcgacgccgtgcgcgcccgtccaaagctgccgccgagtacgatttcgcttctacccagggtgaatcgcgccaattcttgccgcacggttagattgaagatagacggtggtatctcctctcacaattcaaaccattcacccctgagccagccgttttcaccctcgccgccgccgcgcgtcgcgcccggattagcgccctcacgtcgccagctgattccaaccgcggtcaagtcaatacttcatcggtaagtattcgaacgtggcctcccgccactcaaatcgatctttcccgccctctctcagcctttgccacctttgcctcatccaaatcccaagctcatccatggcgatgacggtgtccgagctcatccgctcctcctagccctataaataggaccccaatcccttccttgtccatcatccatcatcaacaatcaaagccctacaaccccgaagctctgcttcgccaatccaccccatcaaccaccatccctcgtcggtcgaacaccttgtgcgcgatcgactccacccctctccatccatcctccgccctaaatatcccttagaacaccttatatcaaccatgttctagcatagtaagccctaaccgaagctctgcgtcgagttttacctcgccgcaccaacccgagcaccgccgcccccgcgctgctctgttcttcaccgccgcgaagtttttctggccgcaatccgtcgtttcaaccgatctcggtgagtttttccgtttcaaccatctacatactacctagattccattttagcaatccctttgcactaccatgctcccctctaagctgccgatgtgagcacggccgccgcctatggaggcgctcgtcggcaactattctccgcaccttgccaaaggtcggcaagctgccggaatccctctagacacctcgtagatgctctagaaccccctcccctagccatgtctaactcatatcaccttgatcaccattacagcctaaccgtaccaccgccgccctagtcgccaacccatccacataccaaattagctcctccgccgccgatcgccgtcgccggagatacctagctccctcccctcttcggccgcaaccactttccccctccatcgccgccgtaatcccaaaccctagcaccgccggctgcatttggggaaacggccgaaggtagaagaagagaagagagagagagagagagactgacaggtgggacccgcacacagtgccatttcacttttatttgatttttaaactttagaagctcatatcttttaaaatatagatccaattccaatgaaacttggaccaatattcttctaaaatcattctctatcttttgagcccctttttgctatttttgcattttattttattttctctatttttcatatttttggatttcatttgaattccttttaaatttgaattttacatatgtctaaccctaggtcttgaggattcttctgactcaatagataatatccatcaatctcaggacatcgagcaaggcaagttaccatataccttttgatcattcaagcctatattttataaattatttacttatagccttctattcaatattctattttctatgcataaatcaatcatagaaacccagataatttagtattgcttattttgcttacaatctggttaaaataccctatacttagattgggacagtacgtaagatttggctgatttccgggtggctagtactgtctcaatcaatataagttttaccagatacttatgttgaacgaacgagtacgaccgcagtttctagaatagggacagacctagttattatgttaattagcaatatggcacctctgtatagtggttcttatttttaagtcctcgtgcaggaggcaactatagccgcgaagggaaactttaaccattaccatgtacaggtaaatggtttgtgatactcgagtataaactatatggtatatttctaaaccctgatcgagatgacgtggtgtcatacgatcagttccccttaaataccttgggaacgccagaactcctcttgctgctgttaacattacattcagagcatatgaggatatgagttcatggaacaggtgccacaattgttaatgacttaatactggaccatgactaaagccgatgattatcagcaagtcatggactgcgggtaaagcgtacatctgctacagtagaatatctttgaaactattcgaatagccgtactcatggagttgagtactgggactcatatggtaccctggttagaaatctaaagtttatatgttttataaattcttgctataacttttccagattgtctagtactgctttttgcaaagaaccctattatatgtcaatgcataacatattcccatgataacttgctgagtattgtaaatactcacccttgctcttataacccctttttcagatctgggtcaagaggaggacccttatgactattactacgaacatcccgataacttagagaatccctaaaggttatacctcactagtcagaatgtatagaaacttctgttgtgtattaattagttaggtgagtacctattattgtaaaacccttagtattgtaagactttttaacatatgcaatgaagaaccggttatattgtatgtatcaatatttactgatccagggattgattcattaatctcagtcggattcaagttattagttttgggctccgacaccatatgtgcctttttcctctataattattccatcgcaacacagggcttctcaggtctcagctacactggtggagaaactgtttgtagtctcggttggtaaccccctttagtcccggttgtccaaccgggactacgaatccgggactaaagataactatctttagtcccaggtgaaataaccgggactaaagatcgatatttattcccggttcgtgttaccaaccgggactaaagattgatcagccacgtggccggccaaaccatctttagtcccggtttgtgttaccaaccaggactaaagatcggtgcaccatttttttttatttgcaaggccctgtttgctgcatggttgattatatatatatatacatatatatgcataatatataggcatatatatatatatacatatgttacaatacatatatatgcataatatataggcatatatatatatatatatatatatatatatatatatatatatatatatatatatatatatatatatatatatatatatatatatatatatatatgtgtgtgtgtgtgtgtgtgtgtgtgtgtgtgtatgtataaatcatatattacacagacatatgtataatttaaagcacttaacattttatgtgcatatatatatgttaccaaaatatatattaacacaaaagtaaatgtgtacatatataaatatatatatacatgcatatatagtacaattcatttgctcggtagctatagctacgactttgacgccggtgttatgtcagaagaggaaggaccgacgttatgaattgtcgatccgtcgtagtagaattcaccgtcgagattaaggacttcttcgttgatgaatcccatcagttgttcttgaacagccgtgataaaatccttgtgtgggagattatccctcatgtgaatacgctatcgttcgaaaaataatgacgtatgaatatatgaaattaataaacaacttaacaaatcgatacgcaatgaaattttgaatggtttatgtatacgtacatcgagctctcgtgttgtgcatatttggtttgataggcagtgggcatactcgcatacgtagtagccgcataagttagttccctggtcctgctttgcacactacatgagaaacgatgagagatttaatatactctttatattaactgtaattagagattcaatccaatataattttggatcatgcatgtactcactggaaaatcaaacctccgtccaagtttttctttccaagtcccgcggaccaattgacggaaccgatcccaagccctacatatgcagttgcaagctatgattaattaattattacttgagatcaacataatagcaatagattccccgcgactttggaatagatggcattatattacctgtctatcagtttgaagaccttatcaaaaatcttctcctctttattcattgagtcgtacacagtgactctgcatgcgtccaagtcgaagaataacaggacccagtggaatctggaatatgcgtgagaagagatatatatgatcaaaaatgtacatgctatatgtatgggaacaaaatttgttcgaacgacaataaaaactcactctgtgttgtacggcagtagtatgtacgtcttgaaatgttgctgcgttaggagatggacgagattgtcctctgtgtctttctcgtacttgtcgatcatttcggtgttgattttccgagggtcgatgaacccagtatcgtagaccctccgccgtcgggccctttgaatctccattctacaacgatgaaaggaaagtattattgcttacatatatgccaggagctaattattgaacgaaacaaatcgaactcaaagatactcacaaaatccatgcgctcagaagagagacgtcgagggcgtccaactggtacagatcgaagagatccttgaaatggatccagagaacatcttctccttgcaagaagtcggggtttctgatcctcgctccgaacatctctctacccttggcactcatttccatgtaccattcatggaatttgtacatctgtgtcggtagggactgcagctgtttaggtttgacaagcggtttaccgagttcaaacttgtatgccacttccgccttcgggattggtgctcctccaaccaactgatccacagttagaccggtgtctgaaatgaattccgttatgccaaaatcttcgccggtcaccaacggctcgacctcttggtttggttgttctccaagctgagggactggtttggacttcttgtgataggctctctgaagtgttcggtcatagtccgatatctgtaacgcctccttgtttgttgtggacattcccttgaagaagttcttcacgctcgggtcaataggtatcttcttttcaggactccaaggcttgagttgcctcttcacctctcctgccacataagcatcaagctcctcttgactgcaatcgtacggtggctccttgtctttggtggcgtcaactttcgccttctttgttgcccttgtgcgggcaagcagtggagcttggcgagaccttgtcttgggaggtgcaggcgaacacggtggaggcggaggagctagaggagccggaggagatggtgcagcaggaggtggcggaggagccggaggagatggtgcacgagacgccgcttgtcgcccaggaaggatgatgtactgcttgcgccatagtatgatggcgtggcttgtgtctcgtagatgcgtctcaccgtctcctcctgggtagtccaactcgaggtcctcgtacgcggcttccaccaactcaacttcgacactcgagtatcctgctagaatcggcctgtagtggtaagtcccggaagggtccgttgggatggccattcctgacgccaccttcacgtgatgagaggttatctattagtaatcaacctaagcagcaacttgcggaatgtacaagtcaaaaatcatcaaactatgagcataccttgattgataagttcttgaagggaatatgcagctcacatggtgtccgctgcgtgatctcatcaacggggcaggtggtttcgtcctgggtttgcatggcgtccatgctctgtgatccgacctgccccgttgagacgcagctgctacgattgcctgatgggctgaccattgcaggatgaatgtacggctggggatcctgggaccgatgtgcggccatacgttcatccaccttccttgccacctcctcttgcatgctgagctcgtagctcgataccctgtactcaagatctgcaatcttcgcctcggtatctctcttgctcctcatccgactcctgtacgtgtggatgtcctccttaaatccaatcttccagggaatcacacatttccctcgtgttcgtcctggatgctcgggagtctgtagggcgagtaacagctcatccttctctctgtctggtcggaatgtgccctgacaagaggctaccactgcgtccgttagtcgactggcggcctcgtgtatctgatcgctaaagacaagggagccatcaactagattaagcgttccaccgtgagcatagtaccagaacttcgatcgatccggccatttagtggtggccggttcgatacccctctcaatcaaacttgcctccatctcctcccacttcggcattgcgacgctatatccgcctgaccccaagtggtgatggtacttcttcttggcggcattttctttgtttctggccatcatcgcttgcccttgtcgccctgtcttgtaagcaacaaactcatcccaatgatcccttagctttgggaatacgtcgaagttcggtgttagtcccttcaggatgtatttcttgtagagatctcccttgaagctctggaactgttccgccattttcttcagagtccactgtttcactatgttctccgtacccgcgggtagcgtgaacgtctcaagcattgtggtccacagcatctctttctctgagtccgggacaaagctgtcattatccctgcgtgcccttgttctgtgccagtacaccgtgctgacaggcacgttgtccctcacaacccaaccgctgtggcgtacaaaattcttggctgcttctgccgaggcactaggtcggccgtcttcgtccacctcagttatgatgtgccgaccctctatcttcttcgcggcacctcgttgtccgagtgccctcttctgtccagcggagggatgacttccactagcctcctcctcatcgttcccctcctcgctcccctccgcatccctctccacgttcccctcctcgttcaagtactggtttggatcctcgttcccctcttcttcgttccagtactggctgcttctctctgcgattgtatcgtatagtatctgttcctcatcgcgatcagccatctgtgcatacaaaaaatacttgttaggtatataggatgtatttgctaaccgtaatattaaaactctactaatcttatattaaatctctaataatcttatattaaatcgctactaatttcatattaaaattgtaataatcatatatatatgctaagtataacaatcttatattaaatcactgctaatcttatattaaatctctactaatctcatattaaatcgctactaatattatattaaaattgtaataatcatatatatatgctaagtctaagaatcttatattaaatctctaacaatcttatattaaatctctaataatcttatattaaaattgtaataatcatatatgctaagtctaacaatcttatattaaatcgctactaatctcatattaaaattgtaataatcatatatatatgctaagtataacaatcttatattaaatcgctactaatcttatattaaatctctactaatctcatattaaatcgctactaatattatattaaaattgtaataatcatatatatatgctacttctaagaatcttatattaaatctctaacaatcttatattaaatctctaataatcttatattaaaattgtaataatcatatatgctaagtctaacaatcttatattaaatcgctactaatctcatattaaaattgtaataatcatatatatatgctaagtataacaatcttatattaaatcgctactaatcttatattaaatctctactaatctcatattaaatcgctactaatcttatattaaaattgtaatagtcacatatatataataagtctaacaataatatattaaatctctaacaatcatatatgctaagtgttacaaacttatattaaatcgataacaatcttatattaaaattgtaataatcatatatgctaagtctaacaatcttatattaaatatctaacaatcacttctttacatcatttgcctgcgcgaattccttcgatggctagctaccacttcggcttgagggacgacgacgatgtcttctctgcaacattatcaggaaaatgtattagtctaaacgggccaagttacatatataatcatatatgtattaccagtaaatcgtattagtataaacgcgttcgttctcacacttttagtacaagtgcatacacgttcgtaagcgtttcgtgcacgttcgttcgcgttccgtaatcgtttcgttcacgttcgttcgcgttcattaacgtttcgtgcatgttcgttcgcgttcattaacgtttcgttacgttcgttcgcgtttcgttacgctcgttcgcgttcgttaacgtttcgttcacgttcgttcgcattcgttaacgtttcgtgcacgttcgttcgcgttcgttaacgtttcgtaacgttcgttcgcgttcggtcacgtttcaatcacgttcgttaacggtcggcaatgttgggcgcgatcgtcagtagcgtggcggcgcggcggtggcgtcggggcgcagtgggccggcccggcggcgtgcgggcgtgacgacggagtcggggcccggcggcgtgggggcgcggcagcggcgcgcggcggccgcggcgtggcgagctcgaggcggtggtggcggagtggcagtggcgacggcgtggcatcgcggcggcgtggcgagctcgaggcgggggcggcggagtggcagtggcggtggcgccgtcgcggcggcggccgcgtcgaagtcggtcgttggccgtggagagagagatatatcgagatcgagatcgagagagagagaggcagcggtggctctcacccaagagatgcggcggcggagtctgcggcggaggcggcgaggaccgccaagcgacggcgagagacgacggcggtgtcagcgcggggttgccctaggcacggtggcagcgaaggagaagccgagatcgaaaaacgtctaagtgttggtggagaagacgagggcgcaccgggaatatatacccccggatctttagtcccagttggtgagaccaatcgttgatggttacgaacagcagcgctcgtaggttaaactccttctgtttgtcctcatcccacacggggacaccttccttcttccacaacagtttaagatcttcgaccagtggtcttaggtacacatcgatgtcgttaccaggttgcttggggccttgaattataatcggcatcattatgtacttcctcttcatgcatagccacggggggaggttgtagatacacatcataacggaccaagtgctatggccgctgctcatctctcca

SEQ ID NO: 82511 - DNA, 9009 bp, Oryza sativa
ctttagtcccggttggtaatcccacccgggactaaagatggctcatccgtcccggttggtgttaccaaccgggactaaagatcgagctgaccttttttttttgcatggccctgttgctgcatggtttatatatatataaaccatgtttcagtacatatatgcatatataatatatgcatatatatatatatatatattatattatatttatatatgtttcaatacatatgtacatgtgcataatatatatgtatttatacatatatatatgttatgcaaatgcatatgcatatatatatatatatatatatatatatatatatatatatatatatatatatatatatatatatatatatgaccaaaatatatttacattatagaaaatgtgtacacatgcatatagaaacatatgtagtcatgtattaattacaatatattatatgtcctagctagctacgatttcgacgtaatagtagtcactagctcagaagctaaggacctatgaattgtgtttccgtcgtagtagaattcacccttgggatcaaggatttgttcgttgatgaatcccatgagttgttcttaaaccgccgcgataaattccttgtgcgtggtcaggttatccctcatgcgaataaactatatgaatgtatgaaattgattagtaattaaacaagaaatcgatacgaatgaaattttgaatttatttgtacgtacattgagctctcttgtggtgatgatttggtctgcaaggcagtggcaatactcgcacacgtaatagccgcacaagttagttcccttcttttgctttgcgcactacaaataaatgacaaacaacgagaaatctaattaatatacacttgtatgtatttgaatcagagaaatataaatgtagagcatgtgtactcacaagaaatttgaacttccgcctaagtctttctctccatttgccgcggaccaaatgacggaaccgataccaagccctacatggagtttaaagctatgattcgtagtagcaattaacataacaagattttcttaattaacagaggaacttatgacggtacctatctataagttcgaaaaccttgccaaacgtagactcttttttatccattgagtcatatacgttgacggtgcaggccgacaggtcgaagagtaaaagcacccagtggaatctgcaatgtgcatgggatgcattacatataaaacacttagcaagttcgtacgggaatgaaatttgatataggaagacagtaaaattaaactaactatgtgttgtacggcaacagtatgaacgtcttgtaatgctgcgccttcaggagatggacgagattgtcctgtgtggcttgcggatattggtcgagcattgcgacgtttactttccgagggtcgatgaatccagtatcgaaaaccccccgccgtcgggccctttgaatctccattctacaacgataaaagggagtatattattttctatagtctacttatatacaaggacctaattaattaaaggagacgtagtaagaaatctaactgaacgatatacttacaaaatccagcaactcataatagagacgtcgagggcgtccagctggtatagttcgtagattccattgaaattgatccagagaatgtcatctccttgcaagaagtccgtgtctctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattcttctatcgtcatttctttaccggtcaccaacggctcgatctcctggtttggttgctctccaagctgagggactagtttggactttccagaagatgctttctttagcgttcgctcatagtccgatagcttaatggcctccttggcaggtgcagacatacccctgaagaagttcatgacactcgggtctataggaatcttcttttctggacttcgaggcttgaattgtctcttgacttctgatgccacgtaagcgtcaagctcctcttgcgtgcaatcgtaccccgggtccttgttcttggcggcgtcaattttcgccttcttcgttgcccttctgtgggcatgcggtggagcttggggggcccttgactttgaaggtgccggaagaggagcttgcggaggagtcggtgtaggagaccgaggaggagtcgatgcaggagcctgaggaggagtcgatgcaggagcctgaggtggagacggtgctggagcatgaggaggaaacggtgcaggatcctgaggaggagatggtggagccggaggagatggtgcacgagacgccgcttgtcgcctagggaggatgatgtaccgcctgcgccatagaataattgcatggcttgtgtctcgtagatgcgtctcaccgtctcctccagggtaatccagctcgaggtcctcgtacgcaccttcgaccaactcaacttcgaccttggagtatcctgctggaatcggcctgcagtggtaagtacctgaagggtccattgggatggccatgcccgacgccaccttcatgtggtgagaggtgatttattagtaatcaacatatataagcagcaactagcggaatgggcaaatctaaaatatataaactacgagcttacctttattaataagttcttgaaaggaatatgcagctcacatggtgtccgctgagtgatgtcatcaacggggcaggtggattcgtcttgggtttgcatggcgtccatgctctgtgatcctacctgccctgttgaggcgcagctgctacagttttctgacgggctcaccattgcaggaggaatggtcggctggggatcattggaccgatgtgcggctatgcgttcatcaaccttccttgccacctcctcttgcatgctgagctcgtagctcgataccctgaactcaagatctgcaatcttcgcctcggtatctctcttgctcctcatccgactcccatacgtgtggatgtcctccttgaacccaatcttccaaggaatcacccctttccctcgtgttcgtcctggatgctctggagtctgcagggcgagtgacagctcgtccctctctctatccggtcggaacgtgccctgagaagaggcttccactgcgtctgttagtcgacgcgcagcctctcgtatctgatcgccgaagaccagtgagccatcagctgggttgagcgttccaccgtgagcatagtaccagaacttcgatcgttccggccaattagcggtggccggttcgatacccctctcaagcaacctagcctccatctcctcccacttcagcatcgcgacgctatagccgcctgaccccaagtggtgatggtacttcttcttggcggcattttctttgttctttccatcatcgcctgcccttgttcacctgtcttatatgcaacgaactcgtccccgtgatcccttagctttgggaatgtgtcgaagttcggtgtctgccccttcaggatatatttcttgtacaactctcccttgaagctctgaaactgttctgccattttcttcagagtccaccttttcactttgtcctctgtacccgcgggaagggtgaatgtctcgagcattgtggtccacagcatctctttctccgaatctgggacaaagctctcatgatctccgcgtgcccttgttctgcgccagtacaccgtactgacaggcacgttatcccgcacaacccaaccgctatgacatacatagttcttggcggcttctgccggggcactaggtcggctgtcttcgtccacttccgttatgatgtgccgaccctcaagcttcttcgcggcacctcgttgcccgcgtgccctcttctgtccagcggagggttgacttgcactatccccctcctcctggttcccctccacatccctttcaacgtgcccctcctggttcccctccgcatccctctgcacgttcccttcctcgttcaaatattggtttggatcctcgttcccctcttcttcgttccagtactggctacttccctccgcgattgtatcgtacaatatctgttcctcatcgcgatcagccatctgttcatacatgaaatagctgctaagtcatgagacatttatgttttaacaatcttatatgctaacaatcatatgctaagtctaggtgacgtatattacaggaccctagctagtcaataaattatatagtaagtctaattacaaatctaataatcttatattaaaacttaaataatcttatactaaaactcaaatagtgataaatgctaagtctaggtgacgtatattacaggaccctagctagtcaataaattatatagtaagtctaattacaaatctaataatcttatattaaaacttaaataatcttatactaaaactcaaatagtgataaatgttaagtctaggtgacgtatattataggaccctagctagtcaatagttatatattaagtctaattacaaatataataatcttatattaaaactcaaataatcttatactaaaactcaaatagtcatatatgctaagtgtaactgtcgtatattagaaccctacacaaccttatatgctaagtctatttacaaatctaataatcttatactaaaactcacatagtgatatatgctaagtctaggtgacgtatattataggaccctagctagtcaataaattatatactaaagtctaattacaaactataataatcttatattaaaacgtaaataatcttatactaaaactcaaatagtcatgtatgctaagtgtaactgtcgtatattagaaccctacacaatcttatatgctaagtctaattacaaatctaataatcttatactaaaactcaaatagtgatatatgctaagtttaggtgacgtatattataggaccctagctagtcaataaattatatactaaagtctaattacaaactataataatcttatattaaaactaagtctaagtgtcgtatattaaatctaatagtcttaattgcattacaaatataacaatcatatatataattacgtcactagcctgcacgaattccttcgagggatagctaccactctggcttgagggacgactccgacaacgtcttttttgcaagatacaaaaagatgtattaggataaacgcgaagtaacatatattgaatttgatgttcacgtttcgttcacgatcgttcacgttcgcgttctcgttaaggtcacgtttcattcacgtacgttcattcgttcacgttcattcacctgcctatattgcatttcacgttcacgttcattcacgttcacattcgttagttcacgttcatgttcgttgacgttcattcacactccttcgttcacgttcgttcgctcgttctcgttcacattcgttcgctcgttcacgttagttcacgttaattcgttcgatgccgtggcggcagctggacggcggtgtggcgcgcggcccggtggcgacgttgcgcggcggcggcggcgaacgcgcggcacggcgccggcgttgcgcagcggcggcgtggcggcttggcgcggcgcggcgccagtgccgtgccgcggcggcgtcgtggcgtctcgtcgtgtcgtgccgccgcgtcatgtcgtgacgacgttggcgtcggcgtcgaggcggccggcggcaaccgagagggagagagagagagatcgagatcggagagagagagagctgatgagagggaggcggcgtcggctctcaccccagagatgcggcggcggaggaggaggcggaggcggcagcgacgacgacgagcgcgagacgacggcgagatacggcggcggcgttggcgcggggatgccctaggcagtggcggcgaaggagaagccgagagagatcgatcgggcaaaaacttctaagtgttggtggagaagacgagggcgcgcatcgggaatatatatacccctagatctttattcccgattgatgagaacaaccgggagtaaatttactcccggtttttctcaccaatcgggaggaaagttatctttactcccggttgttctcatcaaccgggaataaagatcttttcccgctatttccaaaattttttaaaacccggttagggtcaagaaccggggctactgataagtgcactgagtattattttccattacatatgtgtttctaaaatagaaaataatgcattaaatttatttaaagtacaaaaattaatgacaattactacggaaaattagtactgtctgtaataaattaagtggataaaacgtaataagcaaatattacgttttaaaattaataaaaattctaataatcatatatacttagcatatgaatgatattaaattgttaaaaactctaattaacatatgtatatacatacgacatgatttaaaattaataaaaaatttaataatcatatataattaggatattaaattaattgttaagaactctaattaacatatgtgaatgccacatgcatgatttgaaaattttaaaaattcgaatagtcatatataattagcatatgaatgatattgaactaattgttaaaaactctaattaacatatgtaaatgccacatgcatgatttaaaaattttaaaaattgtaattatcgcatataactagcatatacatgatttaaacttgttaaaacctcaaataatcgtgcgtaattaacatatgccatacatcaattgatttatatggataatcaatacatccaaaatagtttacatcgtgtacacaataattacggcaatacatcagcggggatggttgaccgcacgtactttctcctcactattgttccctccttgtgatcgctacgtgagtaaggggtgtctttatttgataggaggatgctagggtcaatcgtcaccgtgaaagggggttgcccatccaactgatcgtaatcctcgtcagtcttgtcctcaactccgacgatttttcttttgcttgggagaaccacgtgacgcttaggctcgtctggccctctgcccttctttcctttgctagacatgtccttcacgtaaaagacttgcgttacatcattggcaaggacaaaaggttcgtccgagtatccaaccttgttaaggtcaaccgttgtcatcccactgtcatcaatcattacgcctccaccagtcaacctaacccattggcaccggaacagagggaccttgagaggaccacagtcaagttcccatatggcctcgatggcaccgtaatacgtgccagttgttccatcgtgtcccatggcatcgacacaaacaacgttgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagattgttgcagaaccgtgaaatgggctttatggaataaattgttgtctaccgtcattattgctttccttccgagagttccctttccccgtagtctcccttcatggcatgattcaggtaccccgattgggcgaaggtcttcaataaattctacgcaaaattcgatgacctcctctgttccataacccttggcgatgcttgcctctggacgagcacggttacgaacatacttcttcagaacgcctatgtacctctcgaaaggaaacatgttgtgtaggtacacaggcccgagaatactgatctctttcacaaggtgacaaagcagatgcgtcattatattgaaaaatgaaggtggaaatatcaactcaaaactgacgagacattgcaccacatcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacatgcttacagtgtatctttcgactttccgtatacacctaggaagccaagaaggtttacgcaaaggttcttagtgaggtgcatcacgtcgattgcgtggcgtacgtccaagaattcccaatagggtaactcccaaaatatagagttctttttccacatcgccgcgtgaccatcttcgctctctataggctggcttccaggcccctttccgaacactacttttagatctttaaccatagcaaacactgttttcccgttgcgatgtttagacttcgtacggtggtcagccttatgttcgaagtgcttgcctttcttccgtaccgggtggtttgctgcaaggaatcgacgatgacccatgtatacaaccttcctacagtgcataagatacgtactttctgtttcatccatacagtgagtgcaagccttgtaccccttgttggactgtccggataggttgctaagtgcaggccaatcgttgatggttacgaacagcagcgctcgtatgttaaactcctcctgtttgtcctcgtcccatacggggacaccttccttcttccacaacagcttaagatctttgaccagtggtcttaggtacacatcgatgtcgtta

SEQ ID NO: 82512 - DNA, 743 bp, Oryza sativa
ttgtaaatggtgaagttcaattttgttgagctgttttcaccaactttagttattacaagggcatttttatttattttcaattaaggagcatcctgttctctgggagttgcaaaatagtagcttggaatgggcagtagattttaataggatctattttagccaaatgaagaaagaataacctgtcaggatggaaagagactgtaggaggcatgtgtattctgaatcatctatttagaacatccaagtctgagaatacagttgaggcctgacaaggatttaattgatagatatccatgcacacagcaaattatatggtttgtctaaatcataggtaactctgtttgatgctcaccgttgttgttttatctgccatggtaaaactaatcatgctttgttgtgccaccttctgacccactttactttctaaaaagtcctttcatgttcttcataccaatgggctgacaaagtataataatattgtactagttgcagttaaacctcgtgctgcaataataatgggttctgattctgatcttcctgtcatgaaagatgctgcagtagtattgaagaaattcaacataccttttgaggtttgatctctgaaacccttccattgacaagttatgaaatgtttacatgctaagtcaaaattttctaaggatgcaaaatgattgactgtcgaattttgtagcttacaattgtttcggctcatcgtacaccagagaggatgtaccattatgcat

SEQ ID NO: 82513 - DNA, 2323 bp, Oryza sativa
cgtcacgcttcatcaggaaattgctaataaagcatgatactccacaggttctcgattctttttcttttttcagaactcgttaaaattggttgatttttttccctgaaacatcatcataagatccgcatgaacatttcaggcatcctctaaaacaaacatttcaggcaggcatgttgttacagttatacaagcaaagttttatgatactgagatgctcatgcgccgtgcttcgttaacatctttcactttgtaagtcggcacgccctctccaggcctccactaaagaaaaccaaatttcaatgagcggagaaatttataaattagcgagaaaaaagagaaaagaatgaaaaggattttaagaatgtgccacaaccatgggtcaatctgcttatgtcaacactggatcaaaaagaatgacaatacaatgggcaggcagggatcaatgcttcttcaagtatagcttagtatattcctcccaacctagttcctcaagcctttttgctttctccaacaccatatccctcagatcatgctggcattcagttgccctgaaagcaagtcgggtgctaacatctactttttatgaggcaacttaattagcctacatcagacaggtgtagtgtaacaactgaaaataggtccctaactgaaaacatgctagccaaataatcacttgtgctcccagacaatgtaactaggttttcagcaggtcaaggcaaaatgagaaagttgtactgatgactaatgacctactgcaaatttcgagcaactgtaacgtaacattgatcattcttttcgaacagattgatcaattgagaacttttttcatgattctacatttctactgactagctttgttggcaatttggtacattaccaaaggtctcatcagtctactcagttactcactggcttgctgcagcctggcagatatcagctcaaaccactgcttatgtataactccaggaattaaggaattaacatatgtgagccaggtcgaacatatgcaacttactgctatgaggtatctattatcaattgcatacatacatacagttaccctaagcaaacttcgaaatttgcaggagaattgcaaaaaaagaagaaatcatacttgtcccccaactcaggatctcttgaggccagcatcctaactgccaataaacctgcattttctgcatttccaattgcaacagtagcaacaggaatacttttcgacatctgtcaaattagtgagagtatcagcaccagaatcaactccgttgggataaaaacaaaagcaggccgttccaatagagatcatgagtagaccaactgttttagtgttaaatgatttaatcactagtttctctctgggctttccgcttcattagttaaaaaagaaaaaaaaatgcttgtggtaccaaatgcttatattaaagaatagcaataggtaggtcaaataacaacacttattaatgggattttgaacccagcaggtgcgccaccctcactctagcttccaattcatatatgtaacaaagcaactgtggcttgtatccttctcttttcatcagcccttcctccatctagcatgtgttcttaacggcactaaccacctacaatgcccggcaacacagaagccttgaatccatcaggtggccagtgtatgaatcagccactcgattgataatctagtgcaatataattatatattatctgctattatacagaaccatgtagatccaaaaggaaaaaggaattggtaaattaccaaaatctgtaaatctcttctcggagctacatcatcaatgataaacagggggaaaatgctctagtgatagggagatcaccaacgcacctgttagtactctagtgaatgcgtccgtcatgtcaggacctatctttgtctttccccttttcccccttatccagtatctcctgcaatgaggtcctcaaggcatggaacatcatcaaacatgtcagacgaaggagcttcacctcaaaaactattcaccccacaagctcatggcaaatcagcttaccctaggatctatgggaatatcgatgaaggaaataccagcaattcacaaagagaatttggcataaacaataaacaaacatactatttattagttctgtacgctcatacctctgtttgcatacagtatggctagtgatgcgttgcttattcatattatttacaactttcggcttcattttcttgacctttatcagaactgcagcaaaagaaacacataaagatcaacatatttttcctgggcaaagaacaaaatagaagaagttgtgcatttactgatttgcaatgaccacaaaaaaaatc

SEQ ID NO: 82514 - DNA, 1793 bp, Oryza sativa
ttatgtagaacaatgtctgacttcgcttcagctagtgaatccctcaggttctgggcttgtgcaggcccctgaaaaagcaaaggtaactctgttatgcacaatacaagtgggttttcttgtcctgaacccgagtagcatgagaaatccatgtaaaaaaataaattgcaacccattcaccacattggtcacatcaatttgttcgttattcaagcaatttgttgtgcaattgatcaattagtgattggaaaatgtcacatgtgggacactgatcatctaaatgaaacgggaaaataagtttgaagacaagaaagaaaacgattatttttttaagacaatcattcatactccgtatttgcttgatggccttaaacgcctagggaagcagcgggaacaggttcctcccacccctcactataatatatactgtgacacaatcaattcagcgagataaacaaacccccaaagagagaacaaatccaaaagggagaagggatgcaagcagagcgaacctcctcctcgtggccggcgaggaagaccttctccttgttgaagatagatgtctcgaagtcgagcgacgtcatggcggcgccgcatggcagtgaccgcgcggcggcgagcggcgcgcaggcggcatatgagaccgggaaggagacgctgaccggcgcacgggggtggtccgatcctcatcccccgaccacatggaggccggagacggcggcgacagagggagaggggaaaggtgttttgcgaaaaaacccctcggccttcacattttcaagcgcagtcctagttcgcgttgtttcctctcttcttcccggggaatatccggctttagtaagggcttaaacttaaaataacatctcagaggtaggtactgttcgtgagggatctagatcgaatttcacataaactcaagtcctatttcgttttcaagagattaattaattttctcaactttgcaagggcagtcagttttaaaagccgtggagtactccagtagtatatcttccccttccccttgcgtaaggaaaacgaaaatcttaaaatctcctccccgtctctgactcatcttctagatcagctcttctcctccttaatttcagagccttaacctctctcttaatttcagtttgtttgttcgttcgttcccccaaaaaatttggatccgcctctgcagattggtgccttccttccgctggaggcaacccccccccccctcccttgtacgcttcgtcttcgtctccggcgacgagcggaagcaaaccttctccggcgagcagcaggatgcaggtgaagcagaaggtgtacgagctctacaaggggacggtggagcgggtcacgggcccgcgcaccgtgtcggccttcctcgacaagggcgtcctctccgtccccgagttcatcctcgccggcgacaacctcgtctccaagtgccccacctggtcctggtagctctctcctcccctccgttgctccccctcaattgctgggtttgggtttgggtttgggtggcgtctcatcgatccccctgtgtagggaggcgggcgatccgagcaagaggaagccgtatctcccacctgacaagcaatttctcgtcaccaggaacggtatgctgattctggattgcttctatttcatcttgtacatgcgatggaatggaatgctgcattgggtggcatgattgttatgcttagtttccacttcctagtggtcttgattaggccaccatgttttggaatgctatattggaggataacaactagtaaagttcggtttccttcgtgttttagttgaaa

SEQ ID NO: 82515 - DNA, 62917 bp, Oryza sativa
gtgagactcggaggcggggtaggtggggtgggggaggagctcgtccttgtccaccatgagcgggtactcgaggtagtccacatcctcgagggagcagctcgccgtggcctcgatgaaccacacaccctcgccggtacagtcgacgacgagctccccaccatccccgcgctccgccagccggccggcgatggggtagtagctcacgagcgccgccgcgagcgcgcgctcgatcgccgcggcgggcgccacggcggcgtcggcgcggcccttgaagacatggagggactcgatgagcgcgcgctgcgtcgggtagcggtcgagccaggacagcgggagcgcgcccccaggcgtcgccgccgatggggccaccacccgctgagccacccgcgtcacggtcgccgccgccgccgccgcggagccccgcatggtggtggtggcggcgaggtggggatctgggtggtggtggtggtgggcttcgctggctgggctcggcttggaagcaagcggtgaccgttctcttggattttataaggtctttcctgtaaattgtagtgtggccgctacgactagttctttagtttttttcttcttttttttttctttttctctgcgtgtgcgtgtgtgtgagggtgtgtgtggtgttgttgatgactggatgtgaaagggattgcccaccgcacgatgcagagatggacgaatcggatccggccatttaggggctctaatcacctccagaatttagggtcagaataatgctacagtgcttgctttacaagaaaaatgctactctcggtttgtcacatggtattgtcaggtcctccctccgtattaggatgtcgttttggacagtgacacggttttcaaaacacaactttaacttattatttcttaaaaacatttattgaaaaatgatatatgtataattttatgaaagtatttttcaagataaatctattcatttaattttcacatttttaaactcaacaacttgagagttattcatgatttatattctcaaggtttgacttaaacattatcctaaacgactttctttacgagtacggagggagtactaatcagtatggaaaatctattaatttattaaaggaatagaaaaaaagagcttccacgttcgctttcacggcttagaaattctcatattaatcggagaaaaagaaacagagtctacatagaaatacaatttagaaatagttgaaattcggaattaaaaaataaggaatattgtaagagaagactagagtccatatagaaatacaatttagaaataactgaaatttagaattaaaaaataaaaaaatattagaagaatagtataaagtatatatagaaatacaattaagaaataatagaaatttagaattaaaaataaagaatattagaagtagagtatagagttcatataggaatctaaaacaaactaaaattcggaataaacataataaaattaaaagtagagtttagagtccatataaaaatacagtttacaaataactaaaatttgaaataaaaaaacatgggaagaagagtctaaagtcaatataggaatacaatttagaacttagaagtaattgaaattcgaaattaaaaattaaataatattgaaagatgagtttagagtacatataaatacaattagaaaaaatataaaatttcagaattaaaaataaataatattggaagaagagccgatagtctatatagaaatacaatttcaatttacagataacgaaaattcggaattaaaaaataagaaatattgaaagactaagtgtagagtccatataggaatatattttagaaataactaaaatttgatataaaaataattaataagtaacacgtatataaaatacaatatgaatattacacattagtagtttcataaagttagtacaaaatttaaaattatgttgtcattttaatatattttaataataaattgagaaaacatatatgctattatataagagaaaatataatgatactatctgcgcaatctgcggaccaccatgctagttagtactaaacagacagtatgaaaaatttggtgtactagctttttaaggcactgttcttttttttcaaccccaaacttcaattttctcgtttttcgttatcacgcttttcaaaccattaaataatattttttaaaaaaattgtataaaagttcttttaaaaaaataaatttattttaagtttataataattaatatttaattaatcatgtgctaatgagttttctcattttgcgtttacaaaaatttttcctccaaactaaggcaaagaatgtaaccaagagtgaatgtttgttgccttgataaaatttggtattaataagaggttggtttcgtcaacgaaacaaacagtcttttactttgtactagcagagtacatcgtacttgtgcagtgtatttactgtaaaacaaattgaaataaaattgtactgagtttgataataatgcataaacttactgtccatgatgccaactcttaaccgtatgagctctgctcaggaagcagtaagcggggtaaagcgcgtggcacgaatttttcttcagtttgaatcagtacaaaccgtgtaattaaccttttctctgagttcaatttgctgctattttttcaggccagtgtacgtacggcaagttgctgtcgacgaccgtgtgtatatattcagtgttctgaacgcgaagttgtcgttggacagcaaccagtgtcttcttctcaccctgattaagcaatcgtttctctgcctgcgaaatggacttcatcaaagattacaagctttaagtgtaaaaaaagaagatcattggtcagtagacctaatcaagcgtgacaattgggctgcaacttcgctctccttttattttcttttttgcttttgttattcatactcactttgcttctttattcagcttggaagcattaggtatttgtcacagcaaaggtgtgcaggtgatacttgaagtgaactaatataatccctttcctaaaccagaaatcgctaaatccccagacggctggtgatcaccagggggtggctggctacactacacgtacacgggaagcaactcgaccccactgtgatcaggatgatcggtctcaattgctttaggccttgttcggttgcttgggaattaatccccaagggatcctatccagggagggattgagagaatccctcctatctcactcaaatcatgtggggttcgaatccctgcccgtttctaatccctgtcatataaaccctgccttcgtttagcacagggaaatataaagcagcagctgtacgttcccaagcaagcaatgaaacaatatgcattctcccagatcaaatccataggacgcagtaaaaaaaaacattgttttagcacagggaaaacacacatgcatgctgtacgttcacaaatgcatacatgaaagtgtcacaaagtaataaaaatggttacagttcagttgtttttttagaataaatagaagtagccagctaagagctaaactacaaattgaatgcaagtgtttaagcttagcactaatgccaccatgagcttcagtcacccagctgcagtgttcccatctctgaaaaaaaatggagcaaaattggatcaattccaaaaagaaatacaccatatatgttctttcctgtcaaccaaatatcaaattgaacaaatgtagagtacagattacataagagcaaacaagtaaagcaaagagccacactaatatccaaactaacgctgatgcactacatggaatgctaacagtctgatagaaccaaagatgaaaagagacctaaaagttcaggaactaggaagctaacaaaaaaaaaagctaacaattcagccttgacaacatagtaataatgaagtacataactagagccacacggtaccttaaaaaacattcttttatcaggagcaaagcagatgcttcaaagtaaataaaattgcactgctatactgcttaagtttagctttttcagatgctaaaagtagtatcagttcagacttgagtgagctcatcagctcaagaaaataaaagaaaggtgagtagcccataatgtaaatcctggtttacagccctaaacaacatgcatgtaactaacaacagagagtcacacaggacagagtgaagcccatcttactcgcctagcagaccaaaaaagatttatatggaagagaagcggtacctttcaagccatctcacttcttaaccaactcaaggcagattctggatcctcatcacaagcactcacaaaaatctctctgttctctgaattcttgaagacggtatatgctttgaccttttctgcctttgtcacatccatcgaattcagaacagatatgcacctcttgattgaaaaatcattactttccttttctcttgctaaatgagcctccttttctcttgctaactgagcctccttttctcttgctaaatgagcctccttttctcttgctaattgtgcagcctcatcttcagtttgtttggtcctcatatcaaggtacctttccataagtccttctacgccaacactcttcttttgcctcttgggttctttttcttctttgtttcttggtacagcaacaacccttctatgcggcatctctttaagcctttcagcatttgcattatcatcttcagttgcatctacatcatcttgtacttgataagccaaggtgtcctcataatctagaaatataatctcagtgttaccaagatcatcttgatcactctcaacttgagtaatgattggatgttgcaatggctcagttgaggtgaaattgtaggttccttctgcagtatatcctacacaagaaaattgagtacaagaaagggtaagcaagaaagcatgattataacttgtgatattgaaaacaaggattacagcttgtgatagaactaaccatcgtaaagttctcccaaggcctcaaatagagggaaagatttggtgcgaaacttcttggctttaggaaatgactacacaataaaaggaaaacactaaaaagatgcataatgtaattaactacaaaattaagtaatggtcagaaataatcttacgatgattatattgttccatatagcaggctcagcctcaatgatgcatctctggttattccatgaagctccactttgttttctagcctctttcagcatcctatattctctttttagctctttctccttttcttggatttgggactttgttaagcagacatatctgtccttctcatggaattccttcacgattttgttccgagcttctgaagtccatccattctgacccctatactcaggagtgttgtgctcatgcaataactcaacaagaatcttctctagggctgggttccaagaggttcttgttttttctacacaagataagaattgatgtataatctacatttaataatttcaaacatgaatttcacatgttctataattgcatacctattggagaacctccatgcttttttgtaggacgacctttcggagagttcttcttttgtgcagctttcgctaaaagcatggtcaaccttggagaacctcttccaagcatattaactgagaaaggatgcataacacaatattcataacaaaagcattgtagcaaatgtatgtcacatgcaaccaccatagttcatttataacataatatttgtaatatgtcgtagttattacagctcacaaaacatcaaaaaaaaatcaaatatactacttattacaacccactaattcctatgctgtcgatagtcattccacatttgatgtgctatcgtgtccctcaaaagattcccttgattagtgctttgatcattgccttcatcaccatctggcaggtcaacataattgcttggatggatattatgtggttggttatttaaccattgctcatccccattcagtgatcgaataatattatggaacactgcagcaaccactggtatcttcacttggttattgattttgtggaaagttgcaactttgaggatagggaagcgcttctttacaacccccaaagtcctttcaacatgattcctcaataccgcatggcgatggttaaataactctttgtagttttgaggtctacgccgacctaccccatactcctttagatgatacctgactttacgatatggtgcaaggaaagaattggtgttggcatatccaccatcaaccaaatagaactttccagggggtacttggaagcctttgtttactgcagaggtaagaaccctggcatctgtagccgacccctcccacccagtagacatgaaagtgatcttcagatcaaaatcacaagctatcatcacattttggctaagagtatttttcctatttctaaatggagctgctttgtcagatgatatagatatgggtatatgggtgccgtcaattgcaccaaggcaattctgcagcaaaaaaaaaaccacatatgattttctaaaaatgtaaaacagcatattaataaggatataagtgtttaggtaagaaccttgaaatagggataaaatctaggatctttttctattttccaatgaacttcattaggatttggaggcttcagaaaccgcttcgagagcgaagggacaactgagttgaagaaatgctttacgtgacgatgaaagctatccccactgtgcccaaatttctcttgcaaatcctcaaatgaagcattgtgactaagcatgtataagaagaacgccaacttctcttcaactttaatcctagtatcatcgaccaacttttcagttctaaggtaattggccaaagatataaatatttccggctccatcctgaatgctacccggcaattttttacatgcccttcaagcaactcccgaacacgctcctcgcatgttatctttgatgtatggcatcgcttcttttcccttgctccactagaactcaacaaatgtagtgcagggaaaataaacaacatcatatcatcgtcctcctcttccctcctctttctagcgcggtctcttgctctcatatccatagtagtactatagatagcacacaaattatttacaattttgcacttagcacagcaacaaaagatctagaaagataatcacaaaagaatcactaaactatgggaattaatcttaagaagatccaagttatgaagcatatttaaaaattgatgggaaaaatgaaaagaacaataagaatctttttttcttaaagagtgcacagtgcaacaataattgatggcagtagcacttacagaatgtatgaaaaagcagattacatggcagtagcacttaccaaatttagttgtcaaatttagttacagatgatcttttattagttagcgccgagcatgttcagaattcagaaatctgaaaaatctgagaacttgtatattctctatgcttttttatacaaatttaaccgtatgttgaaaggaaaagaaattttggtctacattacaccacttcttttattttttatatttacatcacaaaatatagataaacaacttaaagcaaagggaataaatagatctagtacctcttggagagggtacaaggtcccaggaaggagagggtacaaggtcccaggaaggaggaggttggtcttctccaactctaatgggtgcacgtgcaatctacaaaacaagcacaacttatacacatcactgacaactcaaattcagaactagaactagagttacataaaacccagaactagagctagctagcatcaaagtaggagctgctgtttttcaatcaaatagaaggatctcatcatcaaatacattataacatgggtacagaattaatcacccaatcagctcatttaacactagacatattagtgcttgaatagctatgataaacatgttttatacaagtatcatgttgaggaaaacaaatctgttagtctaatgagactaaaagctactgttgttagtttaaaataaatcagtttaagtatacattactgtatatactactgcaatttgttgctagtttgtttgtgaaacaatgacgatagaattagtttacaattcagaaatgttaaactaattacagagtacctccatagctctacaatcctcaagattaggacacccaacccttgtaatttccaaacagaaatataaccaacaaccacaagttgggactccgaaagcaccaagaactgagtacttcactgtaaaaacttgtatagtcaattttacaagacatgctcaggcaagcatcacagcatcagtcacactaagcaaaactaatcaaggcaagcatgtttccatagccaccgtacagctctcgctctcaccatctgctgcctcaaagccaccgtgaatcaagaactcaaatcaagaaccagagttgggcggtgcggtggcggcggcaaatcaagaactcatccccacccaaccaagaaaaaaagctccacgcccaaatcaagaactcaccagatcgagcaggatacgaggaggaggacgacgaatcgctaagcgctcactcaccaaaaagctgcacggcgagaagagagatggcggcgacgacaggaaagggagaagagaagaaaaccctaaccctagctttgcaagaggagggaagaaggggaaaggcagcgtgctcaccggagagaaggtggcggccggaggagagagccgtgttgtcgccatcgccgtcgccgtcgcctccgggtcgcgccgcgcgccgccccctccgtcgcgtcttcgttgcgccgccgcctcctctcgaggaaattttccacgccccaggagtagatgattttttcccaggcctagagaagagggaaaccccatggtgggccgggctaaaattcacggtagggcttaaccaaacgcacaatttcgcatgggccgggattttttcctcgccggggtgatccacggggattgggccccgatcccggccgggaacagcccaaccgaacaaggccttaggaggttcgatagtcttgagtgttcgtgcgtggttcacacggttgtttttggtgggcggaagtcatagaggacatgtgtttgcccttggtaagttctgaacaatcgatcggaggcatggagtactagtgcaaggctttcttcttttttttttgtggggtggggtgagaggttggtgtctgttagatggatctctctccccttgagcccaacggctcaagggggccttgaaccacgctctgatcgggggcgcccaacccaatggctggtgggccccgtcaccctgcgccatataaagaggggtggatgacgggacggcacaagacacgaggttcgtcgccgccgccactccaccccacaaaccctaaccgatcgagggggcacagccagtgacgggaacacgccaccgccgcgccacgcctcgtcgtcgacaccgccgctgcatcaccgccatcggcactgagttcactgtcaccgccgtccacgtcaagcccgcgacgacaaagacgatggccggccgcacatcctcctcctcaacattgaccggtcacatccctaaaccctctcactccctcttttttaattcatctattgttgttcatccatccaaagtgttctacctgactagatctaaacctaggtgatccaatagacaaccctaacaatggtatcagagcaaccctagggcttagatcggttcggggatagacatccacatataagaaagaaaatccaaagatcaaaagaaaagaacagcacacgatccgtacgggtcgaaaagaaaagagactcacctaccgccggcgccggctgccgacgcgcgcgggagagaaaagagggggcggcgccgcgccgccggctcgccgggcgccgctgcacagccgcttgacggtggcgcactcactcttgggtgagtgcgcatgtcggcgaaggggggtgcgacagcaccgccgcgccgtgccgccgctgcaccgtgccgccatgccgccgcgccgtgccgccgtcccgctgtgccgtgccgccgcgctgtgccgccgtgccaccgcggctagggtttcggccggtgaacggctagggttttcggccggcggactgggtggtgtgggtgtttttgtttccccgaaagtggcgctcggccgtccgatcgaaaccctagcgatcggacggtcggtgatggctgggctgattttggcccaagagggcgcgcgccgggggctcctttcccggcccaggcccaggttgtggcctgggggggggggagggggcacccacgcgcgtgaaagcatgccgtgggccgaccggctgcgccgcaataagtttattttaggtccctcggccgaagaaaaaagaagtttaacaaatgtccctatttcagaagctttttcaatatgtttaatgattgtgtttatttctaagcattttgaaccaatgtgaaaattgtttagagaatagataaatgtgagaaatgcttccgaacatgtattttgtatattttcatgcaaattacaatagaatttgaattgtttttgcatgttttacctctgtttaaatttgaaccaacgggagaatttttacagagtaaataatagagtttttttattgtttatatgaattgtatatagatcttccgctgcaaatagatgaaattgatgaaaattagtgtttctaaaattaaatttcgaatcaacgggagattttaattttaggaacattaactatatgctatgatgttgtaattttcggaccaacattgataattgcaatgttatagttatggctctatgtgttatgtctattttctgcccaatggtgatgtagacttaatacataatattttttattgttaattttgttctcacaatacatgattatctcaggtggctactccttgatgggttacataaaagatattccgaccctaacaggagataactacagagaatggaaaagagaactcgaccttgcttttatcttgggagaggtggactgggtgttgactaccccatgtcctatagaacctgctggtggctactccttgatgggttacataaaagatattccgaccctaacaggagataactacgagaatggaaaagagaactcgaccttgcttttatcttgggagaggtggactgggtgttgactaccccatgtcctatagaacctgctgaacttttcagaggtgaaaatgagtcaaatgcggaacggcaaaagagagagagggacaatgcttccctcatcatgtcgtatgaaattgaacatgcgaaatggtccttagccaacaagaactgtttggctgcggtaaagaacacgattgagccaagcatattgggctcattcctagagtatgacactgtctctatgtacctcaaaagtataaagagcaagtttactggttcttcaaagttttatgcgacacagctcataaagcagcttgtaacagagtggtaccatggaggtggtgtaaaagaccacattcttaggatgagcaacatggcttccaagttaaagtaaaaagatttgggcatctcagatgactttctggtccatctggttatgtcctcattgccagagaactttgacaactttgttgtcaactacaaagtaagtctagaaaaatggaatcttgaagagctcatctctaattgtgtgcaagaggaggaaagactcaaagagaccaatggtggctccattaaccttgttaaagataacaaggaaaagagccacgggtcaccctcctcaaaagcaaaacagcctcagcatctgcctcagcaacaacagttcacagttgagacaggatcagtgtctccactgcaagaagacaagacattccaagaaagatcgtcctgacttcctgacagtgatcatggcaaagaaaggtgagaacattattacatttataaatgaatctcattatgattggttattctagatctacatggtggatttattctagagcaactattcatatatgtaattgtttaaagggattctgttcgatgaggactacgcaaagaagcgaaagatccattagagttgcaaatggagttgaagcaaaagttgaagctattggagatcttctcctagagctcgcgaatggcttcacacttttacttcgagatgttttatgtccgttctttgcaaagaaacttaataagtgtatccaaattggattttgatagatatgattgccattttggaaatggcaaatgtgaactatggtataataatgcatgtattggtcttgttgtgttgcaagatcagctttatttgttatctctttctgagaatgtgaatgttgtgtccttgttgacaaaagaaaaagaaagcgaattcctgatgtctcatcaaaattatggcactgtcgtttaggccatatttcgagggggaggattgagagactggttaagaatgtaattcttcctccattggagttctcagttttggaaccatgcatacaatgcatagaatgcatcggtgcccaaaacactgtatgagctatggatcctccttgtgtgggggagtcctgcagaggctaaagtatttaacccaaatattgggaaattggatcccaaaaagtaagctgccattttattggctatcctgaaagatcaaagggttatcatttctactgtccaaacagttaaacaaagtttgtagaaacgagatggaaatgattaggggggagctcggtagtacgagaaattgatcttgaggagaggcgggtgtctgtacccgctcccttgactcaggaacctttcttctctctacctgctgatgttgtgcctgcaatgcatgatgttgcggtaccaacacctattgttatctctcctgtggcaacaatgaatgaaagtgaggaacctgttttacaggattcaacagaaattattgccacaccagaggaggagctgcaacagcctcaaacagataatgtgccaaatgaggaggcccctagaaggtctgaaagagtcagaagatcggcaatccgtgatgactatgaagttataatatagaagagtcgcatatggaggatgatcccacctcatatgaagaggccatgagaagcgctcgctcatctgaatggttggaagccatgaaagatgaaatgaaatcaatgaaattaaatggtgtctgggattttagaagaaattcctaaaggtgtcaaaatagttggctgtaaatgggtctacgaaaccaaatatgactgcagagggaatatagaaaagtttaaagcgcgacttgtggcaaaaggcttcacgcaaagagaagggattgattacaatgagacattttctccagtctcttgtaaagattccttcaggattataatggcactggtggcacattatgatttggaattacatcagaaggatgtaaaaagggaatttctaaatagagatttggaggaaaagtatacatggtgcaaccgaaaggttttgtcatgaaaagaaacgaaaatacgggatgccgtctaaagagatccatttatggattagaacatgcttcgagacaatggtacttgaagtttgatgggacaataaagaaattttgggttttcaagagaatgtcgaggacaactgtatttattcaaagtttaaaaatagtagatttattttcctaattctgtatgtagatgacgttctactaactagtagtgatgtcagtctattgcaggaaacaaagaaattcttgtcctcaaactttgacatgaaagacctctgtgaggcttcatatgttttgagcatagagattcaccgagatagaacaaagtatgcattgggactttctcaaaaggcatatatagaaaatgtgttgaagaaattcaatatgtacagatgcagtgctacacctgctcctatagtcaaaggcaaaaagtatggggcatcgcaatgtcccaaaaatcagtatgagctcaatgaaatgaaaataaagccatatgcgtcagctgtaggaatcctacagtacgcgcaagtgtgcacacgacctgacttggcatttgttaccgggatacttggcagatttcaaagtaatccaggcctagagcactggaattagtaaagaaagtcttgcgttatttgcaaggaacaaaaggcctcatgctgtcttacagaaaatcagaatcgctccagatagtggggtattcagattctaactttgcaaaagataatacaaagtcaacatcgggatatgtgttcaccctggcagtaggagctatttcatggaaaagctcaaaacagatcaccacttgtaacatcctcaaattttaaactaaaatttgactgcatcatgctggcttttgattaaattagtgtgttttaaaaaaaatctatttgatccttaattggttcaagtgttacttccttagaaccttgccaatttaccctaattatttcctttattccaaaccttagtgaatttgagcaaattctctcaaatttcaaactatagattatttctttagtttaccctaatattagtgaggattttctttactccaaaccctagtgaaacccttccaaattcatagtttaaattcaaatcttttctagggaaattttcaaaaattcctgaaaacactgttcattgcacacaaggtgcttgatgaaatgcccagcccacctagagcagcccaatctacccaatcttttacaaagtttagaattgatcctagggggccacaccccactcaaaaaccgtggatttctttgcttcttcctccccttcacgcgcgccccccggtcatccgacttagccgcgcgccgtgtcgccgcgcgtaagcctcggggccgcttgcgcgtgcccgatcgccttggcgtgccgctagccgtccgacgccctcagactgccattgccgcaccaatattgatgacgacaaagccgggatgacgaccgccgcaagaaatcgccgctcgacaccgtgcgctcccatccaaagccgccgccgagtccgattttgattctacccagggtgaatcgcaccaattcttggattaaagttagatggtggtttcccctctcacaattcaaatcattcacccccgagccggccgttttcaccctcgccgccgccgcgcgtcgcgcccggattggcgccaacacgtcgctagccgtttctacttgcggtcaagccaatctttcaccggtaagtattcaaacgtggcctcccgccactcaaatttatcttggccgccctctcacagcccttgccgccccagccatatctaaagttcgagctcatccatggcgatgacggtgcccgagctcatctactccttctagccctacaaataggacctcaatcccttccttgttcatcatcgatcatcaacaaccatagtcccacaaccccgaagctctgcttcaccaatccatctcatcaatcactttcgcccgtcggtcgaacaccttgtgcgcgatcgacaccacacccctccatccatcctccgccctaaatatcccttagaacaccttatatcaaccatgttctagtatagtagaccctaaccgaagccctgcgtcgagttttacctcgccgcaccaaaccgagcaccgcctctcccgcgttgctctgttcttcaccgccacgaagtttttccggccgcaatccgtcgtttcaaccgatctcggtgagttctttcgtttcaaccatctacatactacctagagtccatttttgcaatcggtttgcactagcatgccaccctctgggctgccgacgtgagcacggccgccgccaatggaggcgctcgtcggcaagtattctccgtgccttgccaaaggtcggcaagctgttggaatccatctaggcactccgtagatgctctagaacccctcccctagccatatctaactcacataatcccaatcgccttcacggcctaaccatgtcaccgccgccctagccgctaggccgctcgccgtcgccggagaaccctagctccctcccctcctcggccgcaacccctttccccctctagcaccgccgcaatcccaaaccctagcgccgccggctgcatttggggatcggccggaggttgaagaagagaagagagagagactgacaggtgggacccgcacatagtaacatttcacatttaattgattttcaaactttagaagcccatatcttttaaaatataaatccaattccagtgaaacttggaccaatattcttctaaaatcattctctatcttttgagcccctttttgttatttttctattttattttattttctctatttttcttatttttggattttatttgaattccttttgaatttgaattttatatgcttaaccctaggtcttgaggattcttctgacacattagataatatcaatcaatctcaggacatcgagcaaggcaagttaccatataccttttgatcatttaagcctattttttacaaattatttatttatagccttctattcaatattctattttatatgcataaatcaaccatagaaacccagataatttagtgttgcttactttgcttacaatctggtttaaataccttatacttagattggggtagtacgtaagatttggttgatttccgtgtggctagtactgtctcgatcaatatagtttttaccaggtacttatgtcgaacgaacgagtacgaccgcagtttctagaatggggacagacctagttattatgttaattagcaatatggcacctctgtatagtggttcttatttttaagtcctcgcgtaggaggcaactatagccgcgaagggcaactttaaccattaccatgtacaagtaaatggtttgtgatactcgagtataaactatatggtatatttctaaaccctgatcgagatgacgtggtgtcatacgatcagttccccttaaatacctcgggaacgccagaactcctcttgctgctgttaacaatacgttcagggcatatgaggatataagtttatggaataggtgccacaattgttaataacttaatactgagctatgactaaagccgatgattatcagcaagtcgtggactgtgggtaaagcgtacatctgctgcagtagaatatccttgaaactattcgaatagccgtactcatggagttgagtaccgggattcatatggtaccctggttagaaatctaaagtctatatgtttataaattcttgctataactcttccagattgtttatttctactttttgcaaagaaccctactatatgccaatgcataacatattttcatgataacttgctgagtattgtgaatactcgttcttgctctcataacccctttttcagatctgggttaagaggacccttatgactattactacgatgaccccgataatttagagaatccttaaaggttatacctccctagtcagaatgtataaaaacttccgctgtgtattaattctagttgatcaattagatgagtacctattattgtaaaacccttagtattgtaaaactttatcgtatgcaatgaagaaccggttatattgtatgtatcgatatctactgatccagggattgatacattaatttatgtcggatccaagttgttagttccgagacccgacaccactgcagggtctactatgtataccgagtttatagcatgctatgaggcaacggggcaggtgaactggctaaagaaattcacacccggtttaaaggtggttgacagtattgagaaacaactaaagttatactgcgatagcgaacccacagtaatgtactctcacaacaatcagtcaagtggtgctgccaaacacattgacataaagtactatgttgtgaaagacaaagtccgggatcaaacaatcagtctcgagcacattagaacagaaaggatgctcgcggatccgctcatgaaaggcctacctcccaacatgttcaaggaacatgtagcatgcatgggtttaagggaagcctaatgaatcctggactatagggcccaaaagttaaagtatctgtttctgaatagagatgtgtatagtgaatagagatgtgtatagtggctgtcgaatccatcagtaattaaccgtgacgatgaatcatgctctatatataaatctgtgatggaatagaaaaagctaaaagaaatagtgagatcaagggggagaatgttagatggatctccctccccttgagcccaacggctcaaaggggccttgacccgcgccctgatcgggggcgcccagcccaatggctggtgggccccatcaccctgcgccatataaagaggggtggatgacgggacaacacaagacacgaggttcgtcgccgccgccacttcaccccataaaccctaaccgatcgagggggcgcagctagtgataggaacatgccaccgccgcgccacgcctcgtcgtcgacaccgccgctgcaatcaccgccatcggcaccgagttcaccgtcaccgccgtccacgtcaagcctgcgacgacaacgacgatggccggccgcacttcctcctcctcaacatcgaccgatcacatccctaaaccctctcactccctctttgttaattcatctattgttgttcatccatccaaagtgttctacctgactagatctaaacctaggtgatccaatagacaaccctaacagcgtcatccaacgtcatcgattgtttgttatttccttgttaaagttcgcgaaaagaaattttttgggtgtcacatcggatgtttgaccggatgtcggaaggggtttccggacacgaatgaaaaagctaatttcataactcgcctggaaaccgtgagacgaatcttttaagcaattaatctgtcattagcatatgtgggttactgtagcacttatggctaattatggactaattaggctcataagatgggtctcgcgatttccccccctaactgtgcaattagtttttttaatctatatataatgcttcatgtatatgtccaaagatttgatgtgatgtttttgggaaaaaaatttgggaactaaaccaggcctttaggtgaaaatctcgatctatttttggatgataatgttggacaaacaccgtgtccttcttaaaaggtgttgttccagagcacgtgtctagctcttttgttgattgttcatgagttagttattagtctctctgttgtaaaatataattatttttgcacactgtatatctggacggagatatatccaggtatatttcaggaaatatgtaaaaaaattgcttatattttagaaaagagataatacaagacaacatgatgtgttcgtgtgtgtgtcttaggtttttttcattttatttatctttgtttttttttcttggctatgtattgtagatgtagagaccgtgtgtaattttagcgtacaataaaattcttccattatctaaaataaccaatcctgaaagtaccctcaccccctcatcataaaaaatgattatcaagaaaagttccaaaaaaaacccttcatcctctgttttcctcctgattttttccttcctcattttcaaaaacaagatcttgtctgtgatggctcaaccaagggaccgacagaatatgggaaatgaactggtaaacctgcagcatcaagctcgcacccattttcaccccacaccattgtcttgagtagggctgtaaaaaaaaaacctcgaggctcgtgagctgctcgagctcgacttgttctaggcttgattcgagctctagacgagccgaatctgagcctctccctaagctcgtaagctttgtcgagtcgagctcaagcttacaacgagtctaataatatatgatttttttgttgttatttaataaattagaagatcaaatatgttatttgtatgtcttgtattgatatcatatactccatccattccaaaatataaggcataaccacccttaatccaaagaccaagaaaataattattatcatcttgtagtttggatcatcctaataaatacaatgcatgcatccaatagaattagagaacatgagagtggaggattttaaaaagtaataatataatgaagaaggggtcatagttaattgcctacatgcgcatgtcttatattatgaaacatctagaaaagtggttgtgccttatattatggaatagagggagtatttattttattcttttttcctattctattaatacgataaaatataaattaattattatttttaaatattatccttgaaatatatatcgttttaattaaaaatcatgctcggtagtcgagctcgagcttttgatcgagctcgagccgagcctgctagacagctcgaacattttataggcttggcttgagcttatatcgagctcgctcaagcttgacttgttgacagccctagtcttgaggctaattttcaacaccattctcaccctagtcttcgtccttggtgtcactatcgtttctcatgttatcaccaaccttcctatttcaaatgacaaagggaatgatgactattaattagaggggcattgtttttttcttgtgcttatgccaactaacttttatagattctttttctgtctctaccattgccatgatgatatggcaatttgcctcaacagatcaaaactcctcttaatgtattcttttaggaagggcaacacaacaatattgtaatggacaacatatcgacccaccacaccttttcgataccaccataatacttggtcctttccattaacaaaatatactccctccatccacaacaattaggcatatttcatagtttaattttttaaaataagttgtttctatttgtaatctttatatattctaaacttgaatgtagagctaaattaaatatttgatcagaactcgaggaatcatcttaatactcattagttacatgtgtacatacactacttatctttgttacatataatataagttaattttttattagttttggtgataaaaataatatgtgtaacttttatgaaaggaggaagtaaattacaagactattaatagcaaagacatctccctttatttgtagcactttaatgaaagcatcatgtatcatgaatatattggttggttgaaaggagcttttcaccttaccctttccctaactcaagtttcatgctgatatggacatgcgaaaaaaagtaaattacatctgtggtacacacaactcgagattgcaaaaaaaaaaaactagaaatttaaggtagtgcatgcttgtgaggtagttgcacgattaaagccctgccttttgttttagaaaaatatatggcacaaataatggttatagcttataaatttataattcagaagagatctgaatcgtcggataatggacgcaaacaatatttattgtttccaagtttgttagtagtaaactacagttggcacgtaggagtagcaggtacgagccaactatgaagtagttgtttccaagttggcaggtatgagagccttgcttcgttgcatttcaaagcaatcctatttgtagtctagtcatcactcatcagtgcaatatatccatggatttgtttttctttttctctggaaatctggtgtttctagaattctagtttattgtctcaataatattaggggcatttgcaaatttgccaccgttttttcaataatattaatatgcctgctatgacgctatgatattcaaggtggaaagcaatgggccaaggccatttatttgggagtagggatggtgctttacactcttgagtggtgcttctgtgaatccctcatcaaatattatgatgcaatggagtggtcatgaaaaattcgtagaaatatattttggttttttgcaggggtaaaaaagcaagcatcctaagaaaaccagccgaaaccttgaccaatcctattgtttcgcctattcgtggaataaatcaaatggtatatttgcaaacgaaaagtaatttatgaataaaatttttatgtacgtgtttttggcgatttaaaagcaaaagctgaaaaataaaaactttgatgaaaaaaccctaaaatcagctccaaatttaaggttgaaaattcaaattttggttgataagcataagcataagcaaacagatgaggcccactaatttattttccgatttcatcatgtacttctccatgtgtgcatataatatatataaatgaatactttatactagtgtgaatgtatgattggttgattgactcgattctgcgtcaaagattgcaaatttatcaacagtttcttattagcgattgtatcatattttgatgaagtaaaacttaaagcatgcaccttcagagtgggacacacgaggtattctaatagtgatagatgggagctctccaactacttagggttagctcacattttggcgaaaaagatagaagatgacattgactttctcaagacaatggtttgtcatctgtaatttcgtcagcagaaggtactaggagcgatatgaaattcagacacatcttctgaatctttcttcgcatgcgctgccgtggcaaatttgctgatgctctccatgcctggatctttctcaagtgctgcatcaacaacgaacagacaatgtcagcaacaagatcccagtctgatactactgatccctttaattaacaaattggaggtgtcgaaattgtttttatcagagtaattttgcgtggcagattacctaactgaaaatgctctctcggaactcaactaaagtagtcggaactcaactctcacccagctttttctgtgttggctaatggttgccatgaactttcgcatcacacagagagattaagtgctcttgtattgatcgtcaacgatgccaacagcttggctaataaaaagaagacagcaatacatttttctcagagctgcttcaagaaactgtcgtgttgtccacaatcatgaggaggaccacattagagcattatctcttttattttcttttttaaaaaagaggccaaagctttgctattaacagagaattatcaacaggacagactttgattgtgctcagttgccgaaatgttgatacggactacggaggttttataaattgctgatctctaatttgatttctgagccaaatctgcatatttcggtgatttacatatacgtatttatatcggacgcggaattggggtctgatggtgcccgggcttcagaatttgaaatatccaaattcagctcgaattgaaaatgttcttttttggaaatttttttcatcttctgcgtataccacagcttgtaaaaaaaaacagctcaagttcaatgatatttcacaagctcatattacattgttcggtaactatgtttacatggcaacacgcctggaataaaaaaatagccaaaaaaggtatatgtcggttcaaatttagttcaaacatgtttaaactagtatagttagtaaacaaattattcttcataccttttttttcataaccgtttaaattaagcctaaagttttttttcataaattagctatagcattaagtttttctttacgatacaatgctattaattatgggccaaattttaattctttcgcgagtccataaatttctttgttcccgacgtcactatgaataagtccccattgactccctcaagtattggttcaatctgattcaaatccctcaaccgcaatacctaatatcttaatccctcaactgttgaaacctgtgtaatttaactcccagggcagtataaatagtggtatttgctgatgtgatgtccatgtggcatcccagtcatcaaataaattttaaaaagtgggacgacgacggggagcgacaacgagacgatggcggggctctcctctctctcccactccgaccccttcctccggctcccagcgctgctagcggagtggccgccaagtagggatgcggggtggtggtggagtacctcaggttctcaatagtggtgggctcggggaatgatgctagccgacgtcggcgacaagaccgagccaagtgaccgacttgagcttcccgtcaccccaaatggcgacaatcccgacaccctccttcccacggtgctgtagcttctgcagcccgaggttgcacagcgacattgcgtcggggtcccccatgacctcgaccagcccacactcctcgcacgggtggtcgtcgaagccgtcatcctcctcattgcctctcccatagaatggagtgacccggttgggcaacagtggcccgaccaacaacaaaaggcgagaaccactagagccgctaccgtgatgcagcagcaatagagggagagaagatggcttggaggaatacctaagctgttgttgcttttggtggtgctcgcgttcgatttggcggtggtggcgtggtggtggtggaggaggcgtgatgttgatgcgatacggccattagtgagtgaggaaaggagcggcacaagggattgggtcaagcggtggatgggttccctttcaagggtgaggtcaaggggcatgatttaaagagggttttgctggtcattgtgtgtccatcgtcccgccaccaccgccgtcgctccccgttgtcgtcctagtgatctgctgctatcaggccgagaagaagaaaaggggagagagatgtgataacatgtgggctccacttattatttttaatttatttgatgactgggctaccacattgttgccatgtcagtgaaaaccgctcttaaaaacaatcgagagagacattttagacagttttaatagttgggggagtcatcatatctagttttgcagtttagagatacgagtcagatccgaccactaggtaagggagtcagtgtggactctttccacatcactatgtgtcggatctgccaacttcccatagtgaacgagtaggctaataaaattgggaataagtctagttgccgtctacacgtcaagtgttcaaaatcatgcaaacgatgcatcctagtcagcaaggagggaataaaaaaaatatgtggggtccacatgtaattcacatgaaaaatataaaataaaaacttctcccccacctctcccccaagcacacggccgtgacgggcaccttcctctccatcctgagcttcagtcgcgaggagaagggaagcagaggttgaggatgctacagccagcgaggtcgagacggggtgcagggagaccgaggccgaggccgagtccaaggcctcccttcgaggccacgcacatgcattaaatcccttgatcaagatggcctctgttgatggttgttatcgatcagtttcgaccgtcaatattaccaaaatagaggagaactagtgatacttgcaatgcataaatatgttagaataataatattccactagtagtaggtatactaatcttttgtagagaacgacaataaagtggaggagaatcgacatcaatacaaacgataaatcaatcggacgatgtcgagaaccagacttatgtatgaatgggccaagaactcagaattgacacgacaaactaggccaaaattcaaaagtctggagaagaataacagaggaggccgccagccaaaccatgggctggttgggccggccccaggttcggcccaaccagggggttcgaccgaacctccctcatcgccgctggatgcagggtttcttctggacgatgtggattagctcccaatgatggttggagggtatttccgaccattccaaccatcacaatcgtcattgggaggctatataaaccccttaccttctcacttcactcacacacctcaagcaatagctctctcatttctctcaatttagtttggtagtatctagctggtggaataggaatagagtagaaatcaggagtccggaagccttcggaagagttcgggtatggctctagtagcttttctcttctcttttgtaagctttgtacttttattagaatactcttctatatacatttatggtattgaaatattttccgagtatatgagtacctattttacattatgttcatgttatagtgaatatacggctagcctatctgggagatgctttggtacgggtataatatttgcttatgcaattactctatgtcatgacgatgatattatagtagtatctagtagtttagacgtgatgtctagattatggaatatcattatttggggttatatattgcggatgagaggtgggccgctaatggtgacagctcagtacgggtattcctccacgctggtatataatcctaagttaattccctggggagggtattcctctgtatttagctccggttgtatgatcatgacaggctgtcgtaagaaactcggcagtcaggggtggcttctcgaagtaccaggagggcatcagatagagggtactccctccattccataatgatcagcatattttgttgtggcatcaagaccaaggagagacccactacccattttctatttaatccttgtaattaatctccatattaatcggcttggagaaacgaaacgacgttactgccgctgcatgattgcacatgcaagggatgttccgtgctgcatgcagctcaaaaatcgcatggccaactcgatctctgtgataactagttaatccatccgacatgcacatgctaccagtgttaatacgctgatcaaatcggaatatctctactttcgttatgcgctgatcattatggaatggagggagtattagctagtatatcggttaactagaatatatgtataatatgtatattagaagtatagaaatagattttctttctctttctttccacttagcttagataatatattatgagaatgagtagttaatgcttgtgtgtcactctacccttggattatcttaacccctgcttagaatatgattatcacaagtaatatataaattattagttgagttctctctacatgatcttttcacgggataaaataaatatgatacccttggaatactctcgggtgaaatgctacaatggtatatccgtgcgcttgcggatgaactctctaaccataatataccagaagtatttctgcggcattgctggaaattatatttctagtaatgtcgttaagaaataccaacagcctccactaccaccgccgctaccaccgcccgcaatgacagcatcctccccacccacaccatcatcgccatggtcccacccttcataacccacaaagacgtcgaactggaggcctccaggaggacgcgccagcaatgctgcctatgctgctgttgatggtcattagcgatcagtttcttccgtcaatattaccgaaatagaggagaactagttttgcttgtaatgcatatccatgttagaataataatattccactagtattaggttcactaaccttttgtagagaataatcattaaatggaggagaatcgacatcaattcagacgatcgatcaatcggacgatgtcgagaattagacttatcaatgaacgggctaagaactcagaaatgacacggctaattgggccaaagttcagaagtctgtggagtggagaagtccaggaggctactagccaaattatgggctggttgggccggcccttgtttcggccgaacccccctcatcgtcgttggatgcagagcttcttctagacgatgtagattggctcccaatgacggttggaggatatttccgaccattccaaccgtcacaaccatcattgggaggctatataaacccctcttactctctccatttcaatacacaccttaagcaaaagctctctcatattctctcaatttagtttagtgttttcaagctagtggaataggaatagagtagaaatcagagtccgtaagctttcggaagagttcgggtatggctctagtagctcttctcttctcttttgtaagctttgtactctatttagaatactcttctatatacatttatggtattgaaatactttccgagtatatgaatgccaactttacattatgttcaagttatactgattatactgctagcttatctgggagatgcatcggtacgggtataatgtttgcttatgcaattactctatgtcatgacgatgatattagagtagtatctggtagtttaggcatggtgtctagattacgtgatatcattatttggggttaaatgccgctgatggtgacaactcagtacgggtattcctccgtgcgtgtatatagccctaagttaatttgtcggttgtatggttatgacgggctgtcgttaggaactcggcagtcagaggtggcttctcgaagtatcaggagggcatcggatagagggtattagctagtatgtcagataactaggatgtatgtatactatgtatactagaagtataggaatagattctctttctcttttctttccacttagcttagatatttagtatgagaattagtagctccctgcttgtgtgtcactctagattatcttaacccctgcttagactatgattattacatgtaatatataaattattagtcaagttctctctattatgatctttccacgggattaaataaatacgatacccttggaatactctcgggtgaaatgctacaatggtatatccgtgcgtttgcggatgaactctataaccataatatagcaggagtatttatgcgccattgctgggaattatatttatagtaatgttgttaagaaatactaacaactcctacatgctcatcatccttgtggtgctcctcatcctggtcctctttctcactatgttccacatctacgaccccaccacccacctcgtctccacccgcctcgtcggactgtccccgcacactctccttcctagccatgttgctcgaacccaacatcacactactcatcaccatggcaatctacaaccccaacccgaccttcttcacctaagccataggggacacaccgatctcacctacatgggcacccacatcagcggcataaagatcgaccaggggaaaagctcgagctagaggagatggcaacatgacgacggtgctcaccatccataccggccgcttcgccggttacatcatgcagcttgtccgctatgtgatggccgtcggtggcgctcaacgcgagcaagaggatcaccggcatcaagtccccgaattcctcgcctccgcagccgttggtagatgcctcttgctgcttcgtcatcgtcaatcgaatttgttgctgccggagtgcagccaacagaggtcgatggaggaatggctgccatagtgcggcatcgacgaggcgcgatagctcccatctcccgggcgcgacatagactatagaggggattagcggcggttggccgcctcaactcttccctcccaagcgacgcgcgggaggtgggagagaggacacgaggcgaaggcggtgaccagtggtgcgaaccagtcgtcgtctgcctcaacctcgctaatcgtgccaccctcgtccttagcttccccgtgcccacccgctcccatgccccctcttctccttgcccttgtctttgatgtcatgggccacactgtcctcggcctcggcctccccatgccgaacctcgacctcgctggccacatcgtcctcagcctcagcctattgccaaagcttggacggatagaaaggtgtgcgtcgccgccatgcgcttgggggagaggtgcaagagaagttttgcttttatatttttttgtgtgacttacatgtgggcctcacatattttttttattctctcgttactgactaggatgacacgtcagtgaaaccactcatgcatactgccatgggaccttctttgcacggttttgaacacataaagggtagaaatttctgatatcggggattagggatgtcatacagattcgacgtaaaattgagggacagcaagtggacttattccgtaaactagtagaagcccttggccgaacgagaatatcacagtttgggccattaaagaagcccactactgctggaatacaaagccagccatcaatataactacttgggccaaacccagttaattatgtaagaaaatgtgaactccctatgggctcagatgggccatatttcctgcaccaaagctgattcataccccatgtttgactcctttggaaagtaagtccactttgacttcttcagtttcaggtgcaatctgattcataccccctaaccaaattaccaaatattttgacccatcaactattaaaccagatattttgacccatcatctattaaaaccagtgcaacataactcctttggtggttttaaaggcggttttcattgacgtgtcgaattgacttagtctctgagtctgacttgtcattacaataacaaaaataataaaaatagcatgtggacccatgggtcaggactgtttcctctctatatactccttgtttctcctctttctctatggtcgggacgacgacgatgccaacaagctagagtgggcaaggacggtcggcagtttcgacgagcacagagctaggtgccagcgtggcccgaggcggagtccgagcagctgtgatggctgatgagagggatccgcgacggggcttcacccaagacagagcgacggcctcgaggcacaacgatggtgcgccctcaagacggagcggcggcttacactgatctacagctcattgcccttgaggcgcaatggcagcacgacttgagatggagcggtggcggcacgacctcgagggaagggagctcgtcaatggcatgacctgcagggtggtgagaggttgaggagatggcgtgccggcatcactgacagcgcaatgaagtagctggagaagatgaagaaggaccccatcacccactggatcatagcattcccctccacgaagtccagcgccaccgatgccgctgcaaagcacaccaccaccgacccccttctctccctcgaccatctccgttcgtcgctacaatcccctaagtccgcccatcgctagtcattgccgcaatccactccgcctccatatcgcctcgattccctcagtccgcccatcggccatcgccgctcgctgcctgactggctgttgtgtcgcgtgtttgctagcggtccggcaccggagcgtgtccatggagtcgatggagaacttgtggaggcgagcaaacagtagagggtgtcgatggtgctgctgccccaggggcgtcgtgtggggaaaggagaaaaaggagagaataaagaggacatgacactgacacgtgggatccgcatgctgactcagccattttgactttaggtcaacatgccacgacggcaaaaaccgatctcaaaacagccgagggagtcgaattacactagtttcaatagttggagggttaggatatctggttttgcggttgggtgatacgaattagactggagctataattgagggagttaaagtggacttattcctttctaaacgaggctagaacagtattttcccgagtaaattgactttggttgaggcatgcttggattcggcctgttttggggtgtatcaggtattcgggccaaaccagcgtaaaaatttgtggtttacagcccatccaagcgtgattttgagcccatgtaagaaaagtaataggaataagtccactttgattcccttaaaaagtaacctgaatctaatccgtgaccctcaaccgcaaaaccggatagaacgactccccaaactattgaaactggtgcaatttgactcccttaacggttttggatagtggtttcgctgacgtggtgcttacgtggtagtgttgatctagcctggtcttgatgtggcgcttaggtggcatttaattaaaaacatatatgtgggacccatttgtcataaaaaaagtggggcccactgacatgtcatcctctctctttcttcttcctccccctctttctcccttctctctttctctccccttccaccgtccacggggagcacggctggagcggcggcggggcaggggccgaagtgctggcggccggcgggagctgaagcggcggtgggttggagctaacgcgggtggaggcggaggagaaggaggcggcgacggaggggcttgagtggcggcggcggtggaaaccgccccaagccacatacctctaacgaggcggctgcggctgcggctgcctctgactagcgcgctggattattcctagcctccgtcagctccagcccacttccaccaccgctccagctagctcccgtgtcagctcccaccggccgtcaccactccggctcccgacggcggggaggagcctcgacgacaggaacaggtcagcaacgccgaacctagtcgccttcttctgcgcctctcccagcgtctccaggaactcctcacgccaccggaagccgcactcccacatgatggcgcgcagtgtcaagtcggtcagcgtcccggtgatctgcctgctcacgtttagtgccgacagcggcggcgatggtgccaacgagcacacccgccaaagagtatccccaccgtggtgccgatggagtccctcactgtacgctcagccatagaggtcgaagcccctgggccaggcgccagaaggaggccgagctccatcctcgcctttggccatgatggtatgcatgtagcgatgcctgccttgggacgaaggcgaggcatatcatcaccttctcgacatgatttttgatgagcaggaagtaatcgagctatacagctatacacatcctcttgcttgctcgccttctcctatgctgctacattggtgtgtttgttgtactgctgctcgactctgccgaggctgacccgtggagcattgtgggggttggccggattgccgggctgggttcgtggactgcatcctcgaagaccgccgccatcacgcatgcggatacgccgaggtcgaggtcgatggcgatggggaagctggcgcccgcccgctgctgccgcgtcagccatcgccgccgccaccactccggctcccgcttgccgtcgccgcccttgcctgcaaattacactacgagagagaaggtgaagagaaaggggggagagaacggggagagagggaaggggaaggagagagtgaatgacatgtaggcccacatgtcagtggggcccacaatattttttatgtgtgaatcacatgtgggtccatagattttttttttaattctaatgccacgtaagcgccacgtgggacgaaaactaggtcaacattgccacgtcagcgcaacatcagcaaaaccacccatcgaaaccaccaagggagtcaaattgcactggtttcaatagtttagggagtcgttctatccggttttacggttgaggatcacatattagattcgagttacttttaatggagtcaaagtggacttattccaaagtaatattacattcatgtaatttgttctaagaaaaaaaatagggttttgaaccaggcccttattctcgacttttcactaatgtatatacccctcacgtgatggaacaagtggcaaggaagataacatcaatccaaactacaactttttctcgtttttcgttaacacgtttcctaaactattaagcagtacattttgtaataaatctattttctagttttgtaatagaataaactaaacgtactgctatatgttactccaatatagagtttcaacccctcttgggttgcaggcttgcagctgcatagcaccgctgttcggttgcaattgttttgaacaatgtttgcttgtaaaaaaaatgctgctgtagaaggcaagtgtttctgattttctggctacctgcagcctcagttgacgcttcagagtacagtacagttacagcactgctacagaacgtgcttccaaacaaacccatttctgctaatgcttttccaacaagcattgcctacatgcatatccacctactaggtacgtagcagctctcatgtcctccatttctttacttcccgaagtagcatatgtagcatccaatgcgacaaacaacactctccaattcaacgggcaagttagcgctgcatgttctagagcatatcatatgctttatactagctcgaactaaaaatgggaagaataaaatcgattttcgagaagccaccttaaaggcttaaacgatgtggtggtaaagttacagttacttcctccgtttcacaatgtaaattattctagcatttttcatattcatagattcattaacatcaatatgaatgtggaaaatgctagaataacttacattgtggaacgaagggagtacatgatttacgattatttagagtctgagtttagatcagctgtacgttggacagaaactttaggtggtacttaaaacgagataagttattagcgtatattcaatcaagtattaaaattagatttatttgatttctaggaaacttttatatataatttttttgtgctaaacatcccatttttcagctcagaaacgtgcccaaggagaatgagtaagtagtcgccgaattaccgactattccctccgcccaaaaaaaaaccaacctactattgaatgggatgtttccagtataacgaatcttgtcaatactagattggtttttttagacgaagggagtagaacttaaccgaaatgggtggtaaacaggatgcactcgttggtgtgtgcctatataagaagtacgcgcgaagtggtggcattatcctcataatcacaaaagaagaagaagaagaaaaaggttcgaagtggagctcgatcagctgctccatgcctttggtcaacccttgtcccatgcatatgctccgttttcgagcgaaatatcaccaactctaccaaaaacgatgaaatccaccagccaaacgtccaaaaaccaagcagtaccattttgcagtactgcacatcacatgctccgatctgcgtcctgaatcaccaaccaccactacaaccggctggcctttttgcctgcttgatgcagaactaaactgccttttttcatcgatctcaatcagccaaccgaactctgcaagccattcaagcgaccaggctaagtacaagaaccgtttccattatatagagagatgattaattaacaaccaagtaatgcttattttgctcggtcggtacgggaagtaacaaccgcttagccgtgttaacctcttttgcgcctgcttgcaaattaaaccaaactaatctctccatttcagattgattatcattcgatttaacattggcagtgtcttataccggttcgttggattttcttttgacaatgtttgctaccatacactcaaattttatgtaatttgctagtagaaatgacaaaaccgtgttacggctgaaaaacacctagtaatttgctgaaggatactttcaattcaattggagagggaaattcttcacaaaaacgagaatgccctagggccaaaagctttcaagctaaggcttagagtgaagatggaatatgatacatactaacgatgtatttaggatgatgataaatttagagttgtataattcccaaattttcactctaacgccatatttgaaggggaccctatttgaagtatgggttctaggggtgttcttatccttcttaagaatttatctctccaattgagttcaaagtgtcctccagcaaattactagttttataatatgtctttctgctgtgacacgtttttcgatgtctactagcaaattacacaaattttaggtatcctatagcaaaatttgtatttttttatgagttcataaaatttaacaacgtgcacattatgtatcatgaaagcatttctcaagatagatataaaaacataggggcaattgtgttcttgcccttgctttgtgatccaattgtgattttgccccctacttttagggttgtttttgcccctactttttataagtgaagcaaccattttgccactggttttgaccgtggttatgtgggactagaatttttgagataaacaaagggaaaggaaaattaaaaaatgattttgcaatttgtcaatgactgttatacccctggtgagtaaatcattaagcagtgtgtgaatcagattgaagccgtgtattcccggaaatgcttaccattggccgtccagccagaaataaaaaatcagatgtctcaatttaaaagaacaacagtgtaggtgcatggtgaaacagttggttaggtgtactgataagccaacggagcatgcatgcaaacatgtttcaaaatttaaatgattttttctcttaaactattagtccgaatttcaatctaattatatcattggattcgttacaattaaatctttataacaagatatcacatgactacattccgatgagttttaattttactttttaaatattgcacacattgttactgaaatgttccaaaaagcatttgttgatgtttcactaatgcattagcaatgtttcatgctgtctttttttatatgtttcagcaaatacattttttatgtttcaacaataattataattcgatgtttcaatctaaatataaaaaatgtttcactggtcgggacttaatgtttcatgtaataatgattattattgccatcaatactttttatatgttgtacctctttggaacaatttgtgaagagggttgaaacatctccacaagtgatgaaagaattatttttaaatagttcaacataagtttgttttttttctagaacacatatatatttttatcaaaatatattcatgtgagatcttgttataaattatagattgggtatatattttagaataaaatttcgtttaaagtttgattaagagagagagagaaagtaatactgcctcaggccaccttggcaaccagctctactcttgcatgcatgcatgcgacaacctcgctcctccaacgcgtccctgcatacatacagacgaggagcagcattcgatatttgaaaaaaaaaaatattgaatgttcgatttgtagcgtcctatttaaaaatatttcaacataattaagtatttgtgcaaaaatctaatggtataattgaaatttagatcagatatataattttggagaaaaatatttacaatttgaggaaaaaattaggcacgtgtaatgggagggagagggagagggagagagagtatgcaagcagcagcgcaagcaacgcatgtagggcaggcaagcaacgcagcacggaagcaacgcgggcatgcggcagtgtgggggcgagcgttgaccaacaagtaaaacattaagttatatatggtgaaacaaagaaaacaacaaccgaaacatttaaatatgtttatgaaacatggtgaatatacacgttgaaacatgttgttgtcacatatgaaataacaagtattgacggattgaaacatatgtttttcttttatcaaaatataatcatgcgatatcttgttgtaaagagttaattacaacgaatacaacggcgtgatcggatcatagattgaataagtaatttaaaagaaaaatcattttgaagcttgctaaaatacatgcatgtatgcatgcatgaggtggagagagagtagtagcagttaatttcaggaattttgtgaaacacaccgaagacacatattgaaacctatctctatcacgtatgaaacatgttattctaacggtttgaaacacatgtttttcttttgacataatataatcatgtgatattttattgtaaagatttaattgcaacgaatataacgatgtgatcggatcgtagatcggataagtaatttaggagaaaaaatatttaaagagaggagaaaagaatgaaaagaaacagctaggcacatacgttataggacagggttcattctcacatgcgcttgtttagacatccgatttttggtgtgatgccggatgtccgagccgtagcgctctccgtgtattccccatctccagtacggcctagcgagtggcggcagcggtgcaacagcagcagcaagaccaggcagccagcagggtgggcgcggcggcggcggcgacgactgcgggtcgacgcggctcaacagcgggccagcacgacggcggcgaccgttggccagcacgcaggaggcgcggcggcaaccgtgggtcggcgcggctctgctgcgggccagcgcggtggcgacaaccgttggccggtgcgcaaggaggtgcggtggcagcgtgaaggagaggcgtggccttggtcaggtggcctgttggcaaccgcgggctagcacggtccggcgcgatggggtgctcaggactgggtgagtacggttggggaagggaaggtgcaaaggggaaggttggcgcaggggctgctgggggccgacggtgcttgaggaggcacagatgcagcagggcgacggtgctagaggagatgcaagggtggctggctggcgctactggactttatggtgtttgctatagctgaaattgtgttgaaattcagtgaaatctccttgaaagtatgttgaaattttgtgaaatgaaatcttgtatatttattgctgaaatcatgttggaatcctgttgaaattttgtgatatttgtcaagctattgctgaaatctagtcattttttttataaatttcaagtatagcaaagttcacttcgaaacatttgtaaagttcagttcaaagctgaactcaaaaaagggcaaatacacaagtgggcacatatttgcataagggtatactcggcgttgtatctccgatctaacaccattagctagttttaacagaacagggggcactctgctccttcatttcaaaaaagcatgggcaaaattacaaaccctaaaaagtaatggcaaaatcacaattgaatcataaagtaagggcaagaacataattaccccaaaaacataagtcttgagatgttaaactacataaacttttaaaaattgatgataaaaaaataagtgcacaactgaaatgacaaatactgtctattccctcgatccccatcaccctaccaaacttcagttcagaaaccattcgagcgatatgatttccgtctcaaacagatcgtgcaactacgacgcatcggtaactaacaagttaaccatttccatcatcgaaaattaattaagtaacgatcaagcaatgctgatttaatttttctctgtactccatgatagaaaaggttgcatttcttttcaccgtgcaattaacatggtgagtgttgctcagtagtcagtattcagtatgaaaggacaagtaggcacgcggcataggctgggcgatgacaaaatgatcgttcatctgccacattgaatagtttgatcgatgattcgacgcaaaatgttgcagattttccgggctgattcagcatttgctaggtgattcgttgttgtcacatagacctcaagaaatttaaactttaatttgtgcatattgttgggggtaaattaattagccaagagtccacacctgcatgtgcacactgagctatattattggaccgagctaacgtgtttcggttcgtacaaattaactagctaggctgcaccactagcttacacagtaaccttctcttttccggaatcgacgggataagataacacggcaaacgccattgtttaagtacggttgttactacccttcagcactatttcactactctgaatatatatttaatttcatctcgtgattaattactgagctaatccgggctggtgattgatgagagggttggtgggaaattaaccaatcaagctagctcgaggggacgttttacctccatctttacttgtaaacatactgtatcgaggttgtagctgcggtttacggccaaaatggaagcatgtactccattttaatctctctctctctctctctaatttattgggtcacttaacccttaaacttgactcattttatcgctaaattattaaaaatgtttcattttggccgtaataacatttctttttttactcttcatataagttgcattttaagctaaaaattgttagagttatagatggtaaaatatgaattatgtagagagaaaaaaagggggaagaaatagtgtaaggggagtaaaagtgaaccattttcaatatttcaagctgtaaaatgagtaaaaatagtttaggggatcaagtgcttcgctgaaatatggattttttactttttaaaaccagaacaaataatccatgtcaacccagtagataagcttaaaaaaaatagggcaaatctagcttttgaatatgccatgccactctgaaaaagctgatccggccattcccacagaaattgcagttgtaacatcccattcccacagaaattgcagttgtaacatccataggaaccgtagtcgtaacatccttagttggatgctaaacagaaaaaataaaaagatactccctccgtactaataaagaaagttatttaggataatatttaagtgaaacattgggaatataaatcatgaataactcttaagttgttgagtttgaaaatgtaaaaattatatgaatagatttaccttgaaaaatactttcataaaaatatacatatatcattttttaataaatatttttatagaaacaagaagtcaaaattgtattaccgtgttactgtccaaaacgattttctttacgagtacggagggagtagtcagttagccatgtgttttaccaagaagtcaaagtgaatacaacacaacgatttgatgagcaattatggcatatccaagtttaaatatctccttcattcatgaatagtaaattttaagtgcaattggcctatcaaagtttaaatgctcctttatactcccttcatctaattttgatagtcatattttatcttagcacacagaccaatgataagtaattatacttatcatccatttaaatatgctactagtcattcctagtaaacaagcgattcattaacatttacatttctcaatacccatgtagccaatcatatgtggaaaaatggagagtcatgcattaaatccgagaaagtcattaagatgataggttgttggattgaaatatgcgtatcaaaaataaaattttcagatttagaaatatgactatcaaaagtagatggagagagtagtatttagaatttattggtttgtattctctccgttgacgttaaaattatttggcacagccaacgaggtccacgacatggtggcagccagccagttggagtagtatgcgattaatcaataaggttagtctgctctcatatgttttaaagaaacattattatctgtgcaatgaaattattcaagtcactgttgatagttctggaattatatatattggtgaaagagaatattagaatggcataaagagctaacccatttcatccttgatgtcccatcgatcaacaaattaaagcaaataaatttcaggccctgtttattcatatatatttttgttttatgtattgatttataccacgtttaatgcactacatatatgcatttttaatcgcagctcggatttgttatggtaatatatatttcttcgaggattaggaagacactattaatttataatgatgtatgtttccactattttccttcttcgaattgctttggtgaataggcatataaaacatctcacacatttataaatataagtttggtatacatgtcttgatatcttagcgcagatcaaaattagcgtacacacaccctctacaaatttatatcttagcgcagatcaaaattagcgtacacacaccctctacaaatttattctaacatgttaatttcaaagaagaagaacctgaccaaccacatcagtttatcaacatttcctttttaatttatggttatgtgcattcctagtaggtgcagagtttagatgtatttattaattattatactcctttatgatctttaaaaaataagtttgtcaataagaagcaaatgcgctctaaggaattcatgctccagacatgctagaaaggcatttgatattttttttagcgttgttttggtacttgctatttcttggatttgtagtttctcttaaaagaaaccttcacttggtaccatttctttcatattaattgactttgacgtctaaaaaatcttacgctttttgaaatacaagtttgagaaaattcaataatagaaaaaaataagatttaaatatgaataaaacccaaaaaatatattttaatagaccgtggaaaaaaattaaaaggagagataaaaactcaaatgaagttttatgaggttaaacctcatgctaaaattcctttaaaatcttcttgtcttaagccattcaataggaataatataagattgttatattagggtgctaatcctatgtttcaaaggatcaaagaggatatttttctacatgatttaaatcatataaatctcctatgtttttccaataaataaatgtgttttgtttgttcctttttttcggtgtgcacaacaccgcacaaggtatataatcttgttaaaaaaaacacctacatgcaaatataaattaaccaaacaacatttactatacatataaaaagtagctgaattatttaccgatcatctggtgatagatcaataatgccaccacgcctaatgaaagctacatgcacctagctgacttcgtacatatatatgctctatcgctagcgatgaacagatgatgtacgtaccaaaaaaggacaacaaagttagctactttttgatcgatgttgatgccctaaccaaaataactacaaatatatactatcaatatcagacacagtgaatagcagctttataataccaacctgcgcccctcttaggctgtgtttagttcaacacaaaatttgaattttggttgaaattgaagatgatgtgactgaaaaattatgtgtgtatgacatgttgatgtgatggaaaaggactgaagtttgtatctaaacagacccttacttgaacttaaattagctttgtctgaattagttacagtactgttcaagctacctagttcattcaatttgttggactacgctgtaacgttagctagctagctagctttgctttcttcacaagccgtcatggatcgaccgatcgagttcgttattaagagaattattggtagtcgtggtcctaatcatgcttatattgtcactcgattaattatatatgtaagatatatacgcattgttattagcgtgtcagctttgcatttctactaactttttgtttgtacgtactttgcttttgtataatttctttgtcctttctcgtaactgtgctttgcttttgctgtttctctcaaaaaaaaaaactgtgttttgctgcctgtacggcacctacctcttgctagtttaatccggctggttgcaaatctatgggtgtgtggttgatgagaccatgcatatgtatttgctgatcaattattctaggtgcagatgtaattaattaatattggaagcggttcctgattaattaatgaagtattataagccaccgaggaaaaaataagctagtgagggagagtattgcagttactatagcaggtgttgcatctgaaaacggatgagatcatacattattttatcagttttcagatgcaacgttctccggtgactaagacatttacctaggaacagtgacttaggcaatacaacaactctgttgtatttggtcaaatattgttaaaaattggtgttggttaatttctgctaactgcacttaattattagcacataaatccagatacatttagctatatctcgaatccgacgttttgtacagcactacaactccggagtcttaattttcactaagtcaaagagaatctattttcatattctttttctttttgttagaactatattactccctccattccaaatagatctatatatttcatatgtacaccaagaccaagaaaaactaataactctctcatactatatttactctagcaacaaactcgatgcatgcaccatccccaatattttctagccaatagcaaatcaagatattgcatgtgggttataaatacttatgtgcatggatgcatgcatcaatgtccatttactccaatgcacaaataacgaatagacttaataaatgaatacaaatatgcagatcatttaggaataatctcaaaataactactccctccatctacttttgatagtaatatttcatcttggcacacagaccaaggataagtaattctacatatcatctatttaaatatgctactagtcattcctcgtaaacaagcgattcattaatatttacatttctcaatgcccatgtagccaatcatgtgttgaagaatagagagtcatgcattaaatccaagaaagtcattaagatgataggttgttagattgaaatatgcctatcaaaaataaaattttcggatttagaaatatgactatcagaaatagatagatggagggagtatatttttcttcctcaacattggtcataaactagttacaccggtaatggtctgctatatgatttctctgcacacaaagtgacagagaagttgattatcatatatattttcatgtacaatttgtaggcagaatgcattacccgtacagctaaaatagacgttgcaacctatacatagattccagcggcgccgcagcagttggatgcaatcacaaacggggtgacagctagggtcaacaactcaagagaaaacaagggctagatagcctatagaatgcatggatccaaatccatccaattcgcatcccacaaattgaaatccatcaaattaatctcgatactacaaaatagtacaaacgaacccaaatattttttttataaacaaaagctacgtgaacacacagctaataaaggaattgttatttgttcctatcacaagtacttttacaataatctctacggtaatattctagctgctaccacaaagtaatattaattaattgttgatttacaaattatactcctccattccttcaaaagaataagcgtaactagtaaaacttattctactaccagtagttttgatgttctaatataaatgaatatgatttattgatgggaaagataaactgtctatatatatataaattgtcaagtaactgtagtttgtgtctctaagttttcgctcgatctcttttatgtcccacaagttttttttccttgaaaatgattatgttgccactctcatacatgcttgctagcttaataattaagaaaaacacaattatcaaatgaaaaaaagattcatttgtaaaaaaaggggcataggattatttaaccacaaatttaactgaaaactgatatttaaaatttaaactaatatcaaattaattttgattcagtttctacaacattttcaccaaaatttaaatccaaacaaaaataatcttggttctcaatttctcaatgaaactcttgtatggatttaataagaacttaaattttgtttaaaaatatatatttaatttttaacatttggcatcaaatgattcagtctcatttgaattttcataatttgatatgtttttcacattatgatttatgttattaaagtagttatcacataacacgtacgagaggtaggtaatatagcccttttagaaaaaaaaacattcaactcatgcatggtgttagttaacggaagggattagctattgagctgtcgacagtttttaagggtcaaaactttcaatttttttcaccttaagatctgtaatcaacggaccataggaaacgggtctgaaccaactgaaagcacgaaaccaatccgtttagagcgtgtgggcacattaagaaaccctgaataactaggcacactgtaactaaatgtaactgtaactgagctgtaactactctataactagattataactggactgtaactagtgtgtaactagggtgtaactggactataactagtgtgtaattaggttgtaactggactgtaactagtctataactaacttataagctctatttaactggaatataattaaacatttttatgtaactaaatggaaaaacatcaacgatggaatttatataactgaatagaaaaacattgacgcctccatcctcaagatgaacaacaatacatgcgtgcgaaaatcaacgaatcgtttcccctagaaatctaggagaagaacaccaaccaaacatacaaaggatttatagggcaaacatgatgcaggatctgaacacaaaatatcacatgaacgcaccaaaaagtgaaaaaatcacatgaaattttgagtagagagcgtgaggcagagaagatcgctgcgacagcgaggaacacgagcagctgaaggggaaaaatcggcgaggaagtgggcagcgagaaacccaccggccggcagcaaaaaaaatcgccgagagctgcatctggcggggtctccgcctccgcctaggccacctcgcctccaagaaatttctggaaaaaggcaacatgcagctatacacgccaacgggtagcacatctattggtcatcaggtttggatccaatagaaaaaaatctcacacgaatcatggcgccagatcgaacggccataaaatcgaatgtttctggctccaaaactgtcgacagctagctagcaaaaccgtaacggaatggacatagaacaaaaacttaaaaaacatgtagagaattgagacaaaatttagcggtacataaggatgaagaaaaactcaggagcaagtaattaaagaattttctcaaaaacacaaacgaacgagccttctattaactgtttgattgtatatcttggttcatatatatatactgtccttgatctgtggcctttcccaaactcgatcgttttcgagcttttaagtatatatatacctactaagccttgtaaatgtccggccacgtccgaggttaatttacgtacgtgtggttgatccatcccgtcaggacgtcacctaccactggacactatactcgtccaaattggttaatttgggtgggttcggcagcacacgtacggttggtgatggctatccaagtatgttaggtaggattcatctatatttgcatggtgtatcacgttcagaatgtcagaaatgtgaatcctgtacgtctttgtatacgcgtacgcgtagtagctagcaatatggcatgctaattattctcacaagtagtatacgatgtatatatataatcctaatgtcaggggaacgtacttaattatgcaaatttgtgagtttacctgagagattcctcactcataattttattatggaggccggatgagatagaagctgatgcccgtgagaaaggtcttgtagttggatacttaattatgcaaatttgtgagtttacctgagagattcctcactcataatccagctccgaaacgcggcggcgaacacacataaaaaaaattatcgaggatataatacatacttattatttaatatattaattaatatagttaataattgaatagcctatatgggtttaattttcgcgttcaccccaagaaattaaatgtaggaaggccactgtcaatactacaaaatatcaaataggtgtcagcactatatgcgctgtaagtgctaaaaagacacctgtaggcttttttccactttcgcatgttgaaatcctaaaaaattggcccctttaagcaattataggtgctagttctaaataataaccgatacctattttataggtgccattttttaaaaaaaaaaacataacctttaatgttaaaaaccgacacctataacatattataggtgttttttttaaaaaaaaatacacttctgacttaagccgagccagtgggccccaccacgaatgacgaaataaggcatcacgaggagataaggttcaatccatccacagacttccagagccatcttgcatctctctctccctcatctctcaactctctgcctcccttctctctcgttgtcctctctctctcgctgcccatggccggcgaaggcggcagcggcggcgcgtcctcccctccgccagatccggggaggggcggcctagcggcggcaacggcgggaggtggcatgcggcggtggaagggagggggatgcggcgggaggtggtggcggcccagcaacggcgccttccctctgttagatctagagggagggcaggcggcgggaggggaggcagtggagacctgctggcgagaggcagtggtggcccggcggcgggatgaaaggcagtggctgtccgacggtggcgccctccctccgtcggatttggatggagggcaagcggcgggaggggaggtggtggcggcctggcagcggaacgagtggcagtggcggcgcacttcctgttagtgaatgatttctgtgaatgttagtgaatgattttttgatgttcttcaatgttagtgaaagatttctgtgatgttcttcaatgtttcttgttctgtgatgttgtttgattggggattgggggttgtgattgatttgggagttctgtgatgtgggatgaatgagctcgatactcgagtctttttttggctcgcgagtaatctcaaaggtgccggttcttaaaacgggattagtgccggagcactcatcagtgctatcttcatggtgccggttggaaaaaccaacacctatggggtttcccaaccgccacttttcacgtgttctgtggtagtgtgtgatccatccagcaattttctagctctcatgtgcatgcaaccgttccatgcatgcatgtatattactcgctccgtactaaaatataaaagattttaagtgtatgtgacacatcataatactacgtatacgaatttatatgaaagtctgtctaaatttatagttttgttacattcacctaatattttttatattttggcataaagggcatatatgcatatcgcctcacacaagcgtatgcaccagcgaaccagcctgacacctgttcctctatgaatccatgccaatccgtgctggtcagagcagcatggccatgcacgttcacgtgtgcatcggtagatcgaccaccagcgtatatgcatatgcccatgcacacgtacaatctttcaagtaccagctgggtgatcgtacggcccgcacgtttccatgcctgtgtatactttggctggtcgatcgcctcgcgtgtatcgccagtgttcagtgcgtgtataacacgtcttttatatatacgtgcttgtatgactaattgaatgttaattatttaaaggaaaaggtatgttttactcccccaactattgcgacagtacaaattacccctcgaaccacagaaccggatatattacacctcaaactattgataccggatgaattaccccccccccacacacacacactcaatactaagcggttttgctcctacgtggtatacacgtggcgtcgacatggaaatccaatcaacaaaacaaacaaaagaaaatatagggcccacctgtcattacctctcttcagtcttccccctccccccttctctctctcaggcacgtgtcgaagggcagtgggcggcggcagcggcgcgtggacgggcggtgagcacggcggcagggagtggtggacctgggacaggcggcgggcgcggcgggtggcacggcggggagtggtgggcccgggacaggcggcgggcgtggcgggcgtggtggagaggcggccggtggccggcgggcatgacggcgcccgtgcccccctgtcactgcggagggcagcaaagcgcggcagcgaggcggttggcggggggacaacgtcgcggggattcgccgtgaacgcctacctcctcccgctgctgccaccgccgacgaccggcccgttgacccgcgtccgcgaatgggaggacgcgctcgcctccttcgccgcaccccgccgccgctcgcctcctccgcggcccctgcctcaccgccgccgcctagcgtccttcgcccctgcctctcgcctcgccaccacgctcgccactctgctgcctcgcctcctccgccacccccaccacgcccgccctgcctcgccttctccgccccagccacgctcgcctctccgccgcctcgcctccttcgcccccgccgcgctcgcctctccgccgtccccgtcgcgctcgcctctcctctgcccccgctgctctccaccgccgccgccgccttgcctcgcctcgccgctgctgactccaccgcgcttgctgcctcggccgtcgccgtccgaaggagaagagggagagagagtgagacagtgagagatgagataggagagagagatagaaactgacaggtggggcccacctatttttttaataaataaattgctgactctactgccacgtaaaccaaaaccaccgcggattaggtcgaggggggtaattcgtccggtttgcatagttgggggtgaagaaagtccggttttgtggttaggggggtaattcggacgaccgtgatagttagggggggtaattcatactttttccttatttaaatctaaataactttcctatagatattttttgtaaataacacaacacttagcagttatgaaagtgtacacgtggagaacgagatatttcttttcctaatcaggtgcaaacgaatgcagcctctcaagagtctatataccgagcatgtagttggtaatttcaaaatttcacaactactaaattctaaattaaaattatttgcctaagcagtctgcaaagggttgttgtgagggtgttccgggtttagcggttaggcgtttgtgaggcgatcgcggtggatccctccgtgacgctgacaacgggtgcaagcccgatcgtcggctcgacgcaagctgtaaccggcacacctactggcaaagcgcgaggcggcggcgtttgcggccgattctgggctatctctgacgttgcctccatcgacgacgatgagtctgaggatgagatgcttcatttacaaccatccgtccctaaccacaagatgagttttcctatgggtgcaggtcttgaagaagggtggacgacggtgaccagacgttcaagacaagggcggcagcaacatttggatgcgttgtcgtccggcgttcaccatcatgcatcaactagcccaagtaagacggaaaatggaaagactccgtggacgggtgcccttcctccgcgtcgacgttcgccgccggtgacaatcggcgacctgatttccaaggcgtcgcaccgtcctttgcgccggccgcggcggccgagcggatcagagcagccgagatcagcgcttcctcttcaaacgaggggtcaaacgaagtctccaagaccggcacaacattagcaaaagaatgggccatgcatcacaccaaacatgcgggcccagccgcctaatgggctccagtctaagggccctggcgatggcctctacaagcgacaaccaaaggcgctgcttgccctagctcgtaaacagcgtcgaccaatcaaccccaagcgatcttttgcggaagtggtgcgagcgggtgagatggctggtggtggaggacgatatggcggcggccgtggtaccggcagcggcggcgatggccaggatggtgacggccgtggcggcgtgttcaatccaggcaggggagaaggtggcgctgggcggccgcgggggagaggaccgtggcggcctcgcggcagaggttgacatcccgggaacacggctttgtctggagcggctaccgggaatggcagtggtggtgcttccggccgtggtcatcaaggccgtggcggagacagtaacagaggtccggatggtcagttcgctgtgaatctgaatgcagcaacagcatcaggtactgatgttccaagaggagagtctagggttgacatagtgactgcagaggctggcacttcttcaaaggcgtcaaaagggcgttgtttcagatgcaaggagaagagccatgctgtttcagagtgcacaaagattttgtgtgatatttgtgaagcacctgaacatactgcactttcatgcccgcttttactcgctcccaaacccacagcaagcatgtgtggatggggagttgatggtggaggctttttcatgatccccacgccaacaacaggggcagtgaaacccagggaacacaacaaaacagcaattatccgggtggagaatggccacatttctgtggacaacttgatcattgaattgcgaaggttggtgccggttaggttccaatgggatgttaaggagactgctccagacacttatatggttcaatttccctctgtgatcgaattagacaggttgcgtagggttggcagtgttcctagttttgactttaatgtgaacctagtcattgacaagtgggagcaagagattgaagcgaagtttgttctaaagaaaacttggtttaaagtttatggagtgtcatatgagattagagactttctcagtctacatgctgttggttctgtcattggtcaaacaacaactgtggacatgatttatctcaggaaaaatggtgtggttaggatgcaggtggcagttgatgagttagcagatttaccacctagtgtttacgttgttgtccgaaaccatggctatgaaatcttctttgaaccggaattgcctgaggtggatgggaaaggaaagaagaagattgatgatattgaccaggacggagaaagaaaaaatggtggtgatcatgatgttcacatggaagatagggacccaaaacgccaaaagaatggttctgatgggtcgctaaggatggaaataggaggcttagcgccagctaagctgccctcaacgcgcaccaataatatggttctagataatgaagcattttcaccgtctcctagctcagatacgcctgctacaacaacggagttggaagcgtttgcctcatactcctccgtggtgttggaaacgcccatgagtcaattgggagcccaagggacaggaaactccgagtcaaccaaggaggctgtcggtgaggtggtgtactccgacgaggtttcgacacagctagcgaagttggcaacgactaaggtactttctactgaggttgctgtgcagctagcaggaacagatgaggtggttacgaatggcaaagagcaacaacaagaacctgtcagcatggcacaagaattacagcatgtttcagctagcttcttgtctcccgtggagcatgtattggactgcaacgtgcagtctgaattgctccccaagaatagccagcttgcaggcgatggaagagtaacatcgactaagaacttgatggcagtactagcaaccaatgaagaccaacttagtgcctccagtgctgccacatctaaagcccaggatgcagcacaggcagttggagctcgatccccgacaagaaggcgacctcgtcgcccagtggaccctattccaactaggcaaagtgaaagacagaaggcgatggcaaatgcagatgcgccggtggcaaaccgggcagagctgcttaaaaaggttcataacctcgagacgctaacaggtaacaagtttaataccacaaattctgttgcttcaattccagataagactcttgctgcaaatttttctaaattaggggtttctctaggaaagaatgatttagaaataaaggagtccattaaccagattaaaatttcagaagtggatagatttgctactctttatagtagtgctgtagcgtctactagtaatgtagataaaagcaatgatgaattgttaaaattgtcttctctccagcacttatgtagtgactggctagaagaggctgagagtaatgacgatgagtctatggattctcaggccatacctcaaatgaggaagatttcgaccaaagtcaaacataaagtggtatgtcctcttttgactggtccaaaaaagaaagctaataagtttaagaaatgaaaggaatattttggaatagttgtggctttggtgatgcatctaaatttagatttatatctgaatatgttaaggagcaaaatttggattttattgccattcttgagactagaaaaccatcattcacccctttaaatcttaaaaacctttgtggtggaaaagattttctttggcatgagaaacctcctatcgggcgatcaggaggaatacttttaggagtaaatttaaatgtttttgatataggtgaaatttcagaaggggacttctatgtgaagtttcttcgaagaaataaagaggatggtttcaaatgggttttaatggcagtatatggtgctgctcaacccgagttaaaagaataatttttgacggaactagctcagacttgtggtaaggagtcataccctctattggtagggggggactttaatatcattagatcacccgaagaaaagaataataattcttttgaccctcgttggccttttctttttaatgcggtcatcaatagtctcaatttgagagagattatctttcggggagacaattcacctgggccaagaacctcgaaaatacaacttatgagaagttggatagagtgttaatgaacactgactgggagcaaaaatatcctttagttacgtgtcaagccttacctcgagccatttcagaccactctccaattatactgagatccggatcgcatgcacattttggcaatcagccgccatttcgttttgaattaggctggctagagcgggatggattctttgagatggtagccaaagagtggcaaagcataaacaagggaaggaatcctatggaacgttggaaacacaagattgtccaccttaggcaacatttaagagggtgggcgcgaagtttaagtggcacatataaaaaacaaaaaataaagcttttagttttaattaacacactagacaaaaaagccaaacacataactcttcgttgaagcaggtcaaaaatgatttggcaaaactgttaagggacgaagagttgtattggtaccagcgatctaagacaaatcatttactccaaggggatagtaatactaaatattatcacttgatagacaatggtaaacatcgtaagcagatgattttccagttggaacaagaggacactataataacgggtgaggggaatctcaaagaatacatcaccaattattataaaggattatttggtcctccagatcataatcatgtatccatgatagagggatggactgatgatattcctcaagtgtccgacttggaaaatgacatccttactgctgaattttcagaaaaggaagtcaaagaggcaatttttcaaatggatcataactcctccctaggtccagatggctttcctgcagagttttatcaggtcttttgggagattgttaagaatgatctcatggctctatttagagaatttcataaagggacattatccctttataacctaaactttgggatcatcgcgctattgccaaaaaaggctgatgcaaatcaaattcaacaatataggcctatttgcctactgaatgtcagctttaaaatttttacaaaagtggacaccaataggattacaacggttgctcacaaagtcattcgcccaacccaaacagcgtttttgccagatagaaatatcatggaaggggtggtgattttgcatgagactgtccatgagttacacacaaagaaaatggatggtatcatattcaaaattgactttgaaaaggcttatgacaaagttaaatggcagttccttcagcagacattacgaatgaaagggttttcacaatcgtggtgcaattggatttccaactgggtggaaggaggaactgtaagtgtcaaagtcaatgataatgtaggaaaaaatttccggacacgcaaaggcttgagacaaggggatccaatgtccccaattctttttaacatagtggctgatatgttagccattcttattgaaaaagtcaaagtcgatggccaaattagaggggtaattccacacttagtggatgatggtttgtccattctccaatatgccgacgatacaataatatttcttgaacatgattttgaacaagcaaaaaacatgaaggccattctttgtgtgtttgaacatctctcggggctgaaaataaactttcataaaagtgaaattttctgctttgggggagccaaggaaatggaggaccaatatagacaactgtttggttgtaattctggttcctttccattcaaatacttaggaatccccatacactatcgaaaactcagaaattttgattggaaatgtgtggaggataggtttcaaagaaaacttagcgcatggaagggcaaaaacagctcctatggtgggagattggttcttcttaacttggttctttcgagtcttcccatgttcatgttatccttttttgaaatacctcgaggtgtacttcaaagactagattactaccgatcgagctttttctggagcagtgatagccagaaaaagaaatataagttaacaaaatgggattatatatgccggccaaaagatcaaggtggactgggtgtcctaaatcttgatatcatgaatagatgtttgttgagcaaatggctattcaagcttcttaatggtgatggcctatggcaaaaccttttgcgcaacaagtacttaaagggtaaacccctctcccacatgtcacacaaaccaggaacatcccaattttgggctggcctaatgaaagtaaaagatcaattttttcagtatggatcttttaaacctggtaatgggatggaaataagattttgggaagatacatggttgggcttacaacctctcaaatatcaatatccttctctgtacaatgtggtccgaaaaagacattctactttggcagaggttatgagcacaacaccgttgaatgtttcattccgacgatcaattgtaggaccaaagttagttgagtggaacgatctgatctctcaactagctaacataaccctgtcaaatgaaaaggattgctttatttggtcgctacataaaaatggccatttttcggtcaaatccatgtataatgcgatcatcaattccaatgtaagaatccacaagaggatcttatgggaggtaaaggtaccactaaaaatcaaagtatttatgtggtttcttcacaaaaaagtaatcttgacaaaagataatctcataaagagaaattggaggggaaacaagcaatgttgtttttgtaatacacaagagaccatccaacatcttttctttgactgtcatgttgtacgttttgcttggcgatgtgtcttctttgccttcaacatcccccctccccacaatgcaaaagatatatttggtgactagctaaggggagtgcctagacccacaaaaaaaatgattttatttggagctagtgctttatgttggtcaatttggcgttgccgtaatgatatagtttttaaccataaaaaaatgcctaacatcatgcaggttatcttcatgtgttccaattggctccactcttggtgtatgatgctttcacaggaacaacaggatactatgcgcaatggtgctacacgcttggaaatagtagccaaggaacttttatttcattttggatggcgtagtacctacagaatttcgtgatagaatctacgtgattttgaaaaaaattattattttagtagatcatatcatcggcagaagttgagggtttgtcccatctcgccttttttaacttttctgttcacgtctgaatttttttggctgtgtgcttacgggcagaggccggagatgtaacacatttccattatttaaaaaaaaattattaaattaagaacagtacactgaaagtactccaagaagtataacaatagtccatgcaaaatatgatttggtggggtgactagcagagctaatatagcatcatgcatgatttaagcaagattatatggagatatatcacttctacacgactacaccggcaaaatgtacaagttagtgcgttctcggtctaaccgcacgacgacgcccatgtaaaccgaatttaacagtgtgaaccgggctgcaaaattaaattaaactgtcgcaagttttgtagcaattccgattaataaatgacgttatgacgcaacgatagaattaaaacaaatcaaatgacgttattacgcaacgatagaattaaaacaaatcaaattaagtcagcctggtcagtgatcagtgcaccatagcgcagctaaacaaagcaggttaaacgtgcttaattaagtcaacacaaccacactacctccctgccttatttttcttttcaaacctctgaagaaaaagttcagaaaagacatggagaacaaaaaaaaaagtgtactcctagctaagtagcgaagctaatctgcttctataaatacccagcaaggcatgccgtgtcacccaccacacgcacacagttagctctagctttgcttgatttgcagcagcagcagcagcagcagcagctagcttgcatccatgggcgtcttcgccgtcaccaaggtgtccgagggccccgtccggccgtccgcagcgacgccgtcggagacgctgccgctcgcctgggtcgaccgctacccgacgcaccgcggcctcgtcgagtccgtgcacatctacctccgccgcgacgacgccgccgtcgaggcgccgtgcgccgacggcggcgtcatcgtcgagggaaagaagaagaataataagccggcggcggcggtggtgcgcggcgcgctggcggacgcgctggtgcactactacccgttcgcggggcggatcgtggaggacgagcggtcgccggggcggcctgccgtgctgtgctccggcgagggcgtctacttcgtggaggccgccgccaactgcaccctcgccgacgtcaaccacctggagcggccgctgctgctgtccaaggaggacctcgtgccgtgcccgacgccggagcagtggcccgtcgagccgcacaacagcctcgccatgatccaggtacatacgtgaattaatactgcattattcctgcttgctttttttttcttttttctttttggctttctagattttgctttgcactgttggatctcgttatgtttttcatgtgtccttgaaattgatatggcaacaagcatgcggcagtttgaatctatcaatcaaacatgcacgtcaaacttaatttcgtgaaaagaaaattaaattaatactactgctagctcctgttgtgcattgtgagtgtactgcacttgattagtacaggagttaactgcatctacgactctagtaccaacgtgattgcaacacctagctagattaaaaatacctttttcgtctcctttgccacgaatttgaattgatgttttattctcatacctatactatgtactggagtactcctgaaaaccagtgtagcttgcagaaaaaatgtcgaggtcaaaacctgggtacagaaccaaaaacaaagcaaaaaaatgacgcggactcatcagtcagttgattaattagttggaggtcacgtgatttgcaggtgacgacgttcacctgcggcggcttcgtgatcgggctgcgcaccaaccacgcggtggcggacggcaccggcgccgcccagttcatgaacgccgtcggcgacctcgcccgcggcctcccggagccgcgggtgaagccgatctgggcgcgcgaccgcttcccggacccggacatcaagcccggcccgctgccggagctccccgtgctgccgctccagtacatcgccttcgacttccccgccgcctacctcggcaagctcaaggcgcagtacgccgccaccgccggcgccagcaagatctgctccgccttcgacatcgtcatcgccaagctctggcagtgccggacgcgcgccatcgccgccgaccccgccgcggccgtcaagctctgcttcttcgccagcgcccgccaggtgctcggcctggagaccggctactggggcaacgccatcttcccggtgaaggtgtccgcggcggcgggggaggtggcggcgtcgtcggtgatcgagctcgtcggcgtggtccgggaggcgaagcggcggatggccggcgagtgcctgcgctgggcggaggggcgcaccggcggcgccgacccgttccagatgacgttcgactacgagtccgtgtacgtgtcggactggagcaagctcgggttcaacgacgtcgactacgggtacggcgcgccgtcggcggcggggccgctggtgaactgcgacctcatctcgtcggtgatcgtcatgcgggcgccggcgccgctcgccggcacgcggctgctggcgagctgcgtcaccaaggagcacgccgacgacttcgccgccaggatgagggaggatctcgtctaatataccatggccgcccccaataacattattagtcacgtacaatattgtcactgaatattaatttgttcgtgtatatctattgtggtatgtattttttttttcataggaaaaaagtagtagtacgacaataggtagctgggagctacctaatatcgacctctggtttgagagtaagtgagcgagcgagagatgtaaaccacctcagtttttaccgtgctttgtgacatgcgtggtacagtactggtactattaatcattggccgtgaaaaattatctacccatatgccactgtatttatggttgtttgtggaggattacgtatactaatttatctatgtcttacatttttcttttcatggacgcactcttaaggccccctttgaattggaggataaatggaggaaaaacaaaggaatggaaattctatactattcatgcctttgattcgtagaaatgagaaaaggaaaaacgtaggaaactttcctattcctatgattttagaggaaaaaagtagaaaatttaacatccactctaacctcttggaaaaattcccttgagtgtatctctctcatctggttcctacgtttttcatgcggtccaatcaaacggtcattcctatgtttttcctgtgcttttgcaatcctttattttacacttgtattcttatcagtcctacgatttaaatgggtcctaaatatgtgtctgtgtgagatgcccgttaggtttcttcaattcacgccactatttcaagtggctagctacatccactacatgagttttcccttggagacaaacctcctatcataagaccaaccgtcgacaccagacaccagtgacgtcctctattactgtggctcacctcccacgccacctttcttctaataaaaagggggcaattggagttcctcgttaccgctctggctctcactcactacgcctcctcacctccactccaactctcccgtcatgatgcatggactcaccgcgaccgccttagaatatcaccaccagtgaggaggaggaaaacaacgatggtaagcgacaaaatgcatcttgttcgaggccaaggacaagatacaataaaacgaaaagaattgtgaatgcctagcccaatatgcgatttaagtaataaaaactgatccaaagtacaattcacttcgaaataaattttgtgctcgaccaattcgatcatcttcctttttgtgatgattcggttaaagtgtgaaaggtgacaatcaacctgcaagtacacgtacgagagagtgacactcctcatatctgatatctgtgttgaaatactcccttcgtcctaaaataagtgtagttttacactatttacgttcaacgtttgatcgttcgtcttatttgaaaaaaattttatgattagtatttttattgctattagatgataaaacatgaatagtactttatgtgtgactaaatatttttaattttttcacaatttttttaaataggacggacggtcaaacgttgggtatggatatccacagctacatattttgggatggaggtagtatattactactgtcaagtcatatacttaagataatttctaactctgccactgacactgggtctagtcacatacacagccatgcatgatgcacgtacgtagatacttggattgtgtacggctcgatccatgatgcggacccagcatatagtaccaaaatagtggcagtagtttggcattgcacaggcagtacgcatacactaactcatcgttgaataggagtaataattatactaatccatatagataacccttacaccgttttatattataaatcattaattttaacctttttctggttaatttttttaaatgtttgactaggtttatagaaaactttagcagcatctaaaaaactaaatttgtttcattaaatctcacattaaatatattttaatagtttacttattttgtgttaaaaatactactatgtttttctataaatttggttaaagaaaaaagttaaaatgatttataatatgaaatgaatggagtagtgtactacacggatacacctgcttttgcaattttcatgcagctttcgttcatttatttatacatacttcacttacttctctctacgtaccatatatataaatatatggaaggtcttcctacaacaactattatttggaagttagtagttcacatcagcttcataattgtatgagtgtctggagtaaaatctctctcggcaatcagcttatcagcataaacatactatatatctatcactggacttttattacaacgttctgctcactttcttgcaacaaacgccaagccgtccgtacaatcttctataattgcagggaggcaggtgaccggcaaaactgaagatctcaaacaccaaccgacactggtgtactcatgcaatattaagaaaaaaataataattcaagctccagttaagctagctatagcctacaggctatatattgctaacgcacattatttttcgttgacctccttccttttgctgatcgcgagaaattaagctagagcaagtataagagaggctgatgaaacatcgcatcctactgcttatttccaagcgtcttaaggaccttgtttttgttttttttttcctcctcgccgacctaatattcacctagctagcataagatatttacgtacggcaactgcagaatcatcctctcgaattagcctgacgcaacatgtttgccaatcgcgctgagtacttttgttacttgcaaattgcacctaattcatcaacgacttcagatttaagaatgcaacatatgcatgcatgtagtattgatcaaggctcaccactcccatggcaatgcgaaatggcaagctttttagttactactattttcttcggtcgtaaatatttgacgcatttaatttaagaaaaaattggttatatagcattaaaatatcactttttggttttatagcaccgaaatataccggttcactttaatagcacctaaagtttaccccgttcccatttttaacaattccgttaattctcaatcgttttccgtccgccttgatcgctattgacccagccacgcatccgatatgggctgcaggaat

SEQ ID NO: 82516 - DNA, 7003 bp, Oryza sativa
  unsure (1)..(7003): unsure at all n locations
cggcgcgatagagtgcacggggaagggaggcgaaaaggggaaatgtgagaggaggacgcgaggttgctttttgaaagcatggggagggtggacaagaccgggaggcggccggatttctcgccgacgtggaggatggagagagagagtggggggattcgaattgaatcccgctcttgcgggcgcgcgcgcgtgagcggggaaaggcggggcgtgggggtggcgacgtgggggcgtggagcgcggagtgggcgcgagagaagcgggggaagcggcggcgatgggtggcggtttcggcggcggcggttgagggaggccgcctctccggctggaggttaggggcgaacccgacaggtgggccccacctgtcggcgcccgggtggagagggggaggccggatggacttcggcgggtgggggagggaagaaatgggcccgcggcgcaaagggagaaaaaaaggaggaaaaagaaaaagaaaaaggatttttcctgggatttaaaattgcacatgctcatttttaaatgggttaaaattatttccaaggttctgaaaattccactaaaaatcctgttaatatattggagcatggggaactcaagaaaaattctacaagctatttccgattattaattgcatttattaattatggaattagctctaggttaatgaaacaatttcttcgcgcaatttatttaaccatttttttaaagcaaggaaaaaagggggaaacttcagggcgtgacatataggtgcacacctttttttctgtcttggtgattaagtcggcgaccacgtgcactttctcatcggcagcgttgtctatggagtcggcaaccacgaccacttcctcaccggcctcatcgtgcatggagtccgagactacgagctatttcttgctcgcctcgttcatggtgtctctggccatcgactcctcatcgtgagcctcgtacatgatgtcaggaactatggcttcttgtttttttttttgtgctcaaagcccacataagtaatcctgttcaagttctctcgtttgcttgcatgcacgtatgccgccattaagtacatgagatgggaacgaagcattcaaggagtaacgagtagtcatcatcaatgcacaagggcaatctcgtcccgtacgtgagaaaaatgctccaacgacagattttctcatccacagctaactgagctcaaacgactagtaaaaccagcccggagggagtacttaagaccgtagtatagatcttatttttccatgttgtcgcttacatggtatatgtccggacgcatttgttagcttgttgagttaccgtgccaccgttaaacggagttaaaagacatgcgtgtacaatttctcaccacgttcttgttccgtgggcgatggaccgactccatcgtcacccttcccgatgacgggggacgacaacgcctgattcgccgccaagcccaccattggcactcccaggatggagggtggcggatgtgcctcacccgagaacagggatgccagatctgccaccatcattgatgagattggtaggaagagtgaggagggggaagcgggagagaggaggaggatgaggggagaggagaggggaggagatgggggggggggggagagggagtggatgtgttgaggagaagagatgggagtggattagaggatgatggatttgactttcaaagagaatattatttttgtatgcgagcctcttaagggatcacatgtgaaaatgcattatcgcatgcggtcccttaagaggcccgcctgcggtatacaatacgtctattatcgcagacaggcctcataaggggccacaagccataatgcattttcatatgcgactccttaaactgtcctatcgggtgcaatttttgcaggtgagggtagttacctgcaacttagaaggggtcttatccggaaaaatcgattatatagtagtaccagctcgtcaatttcaccggcgcgcagctcccaacggctattaacattgtcgatttgcagcaacaacaattggtcccaacagccatcgaaacaacaactcgggtgaccgccctatccacatgcacttctccggtgccaactctcccataagcaacagtggtgtgggtggaaggagggcaacagcggcgtggcaaactacccgaagatgacgagccagtcttttctaagcaataacggggagagagagtttacacgtgcacgtcattaactccgtttaacaatggcattgatgactcagcatgctgataggtgggtttggacatctgccatccgtttagggggtgaagatttataatatttagtattagtatatatagggatgtcaatcaaactcaatgtaaagttgatggacaatacttatttctctaatctactatcatcgctagtggcctcaaggctggacaaggaattttataggccaaatttgttttttatttttttaagtatgtgttcaaatgaatttaaattttaaattcaaagtaaaccttcaaatgaaactttaaaaatatcaagtcaaaatttgaaagtttcaacacaaattttgaagcttttgacacaaaattttaaaagtttcacgtcaaatttagaagtcttaattcaagttttgaaactttcaactcacttctggaatttatataatttcaattcttatttcaaaactttcaactcacatttttatattctattataaaactttaaaactttcaactcaaattgtgaaaaatttcagctcaaatttataactttcaatttaactatcaagttgcattttaaaacttccaattcactatttaattattattttattcaagaaaatacatttgccactgaactcctaagatattagcgctaagtgctatgatgagcggcgtggaagcacgtgctttacttcgcttctcggtgcagctgcgcgcaatagaacccccaaacatgtaatgccattattcaatcgggcgaattcatcctgagctcatgaattagttataatcaaacagtcaactgcacaatagtagcacatgtcacattcaattttattagctctaactcacataaaaatgcaatttatttgaacacgaataatgtccaaaattagctcttgaaacgaagatcactaccatcactttgcaacttcgcattcatcttccatcatcgataatttctctgttaatctctagggaaggtgtgagaggggatgtctccctctgcccactgagctcatcggcagtagacccggagtagccggtggtgacatggctgctattccttcccctgagctgcaactcaatgatgtagttcggcttcgccaccacatcactcaccggaatgtctccggtgagcattgccaccacccttgacataggtggtctttggtgtggtgagccttgggtgcaaaggaacgacatacgaatgactctcaagacctcctcttcattgatttcctcgagccttgggtccacgattccgagcgcttgctctcgttcatagagcccccaagcctataaggtttaacatacgaagggaacatgtttcagtaacctataaaaggataaactgataaactgatgtattctctaggattcaaagatttcttatcagctaacccattcaaagagatatttcttgtcttccacaagggagtagtcggtgtttgatcgaccagcgacagtctctagagcgaccacaccaaatgagaaaacatcaaccttttcagttaaatggcctctcattgcatactcaggtgccaggtagccactagacaaagttcaagcaagtgcaatcagtacaggttatttaacatatacacgaacatgatagccatgatgaatgcgcttacaacgtgccggcaacttttgtgttaacatgagtcttcttctcatcatagagcttggcaagcccaaaatcagatatcttgggtgttaaatcagggtcgagtaggatgttactagccttgatgtcccgatgcacgatgcgcacattggcctcctcatgaagataacttagccctcttgcaatgcctaaaatgatttcaaaacgtgttgaccagccaaggttgaacctaccatcccctgcatttccaaaaacgaccaagataaatgacatgatgataaagagaagaaaaatataaagagttaagaaccaggtatctcgataacggagtgcagcataagcaatttgataggtgatggtgatacgatgtgaactcaccgaagagtgcttgatccagacttccattttcgaggtactcataaaccaacaatggtgtattactgtcaatgcagcagccatataatttcacaaggttccgatgttgcacagaagagattgttgcaacctctgtcacaaactggcttttcccctgctgggatgattgagaaagttgtttcacagctaccacccttccatcagttaatataccctatcaaaagatgaactttccttattgctagatcagataaatattcacttacaattaacattgagtaaattaggggaaataaccaaccttatagactggtccatatcctccttctccaagaatgttttgagaaccaaaattctccgtagctaacttaagctccgcattgctgaagacattacgccttccaaccatgttgtagagttctgccaaaaaaaaaccatcacatattggaaataattaggaattaaaatcatctatttaaaaagtgaattgctagaagaatatctaccttctttccgttgtgacgttctccttctcttctttagcaacataaataatccaactaggactgctaatccaaagaatgaagcgccgatcactactccagaaattgtccctgctttacttttcttttttggaacaccattttgcacagtaggaataaaatctgaaacatgagttttacattaattaaaaatcaatggaattcccttttcttggttgtacatatatattgactaattggtcagtacttggggtcacgcttaatgctgagatcgtaggtccataatgtccttgagtaggaatgcaacaagtacccttcccagcccagaacagatggatctcaaggaagtttttggacacagttgcagtatatctcttattgacagcaataagagactttccaccagccatcttccttatattgaagttcttttccttcagctcaccctatgcaaaacgtctagttagaaaacattccatgcagacatgcacaaaatattatgtgacacactcagtatgaacctgaacatatatgtcaaaaactctccgcccgatgctatttgaagttagtgagtttggataaacaaactctgcgaactcaagtgagacagtgtaattcccattctcaagtccaataccatagtatctaagtgatgatggtgacattcttgcagtttggaataattctgagttaagtgcactctgaaactgctgggggctatatattgcataacttccattggaagcctcattgaatttacctacactgcttacaccccatctcgcattgtcactaacataataagatgcggctccaatgttttgagcatcagtttcatacaaagtattatctgatccccttgtagatttattactgccacagtcgaccgcaaaggaataatctgcaattgagatggttataatagtactgaggtcatatcaactaccaatgtgagtgaagagttggaaacttggaattatacattctggagaaccacggaaacaaggagtatcttgctggagacagtttagccctgaaggtaaaatgctgcacaaataattgaatcaccaatctcagatcgcgcacaaatgttttcatctgtacaatttaatgtgacacatacctattgttggtgctatcaagaatgaagtcattagccaccaaattcctatagaacgcaaaatggttaacttgctaggaaacatgtaagcacaacctagagtatgtatattttcccctctgcctgcattcaaaagtttataagaaatttcagaacataaaacttacagttgcaaattgttcccagtaacccatggaggaaagcttccagagagatggttatatgaaaaatctctgcaaaggttccatcagaagttcaaaaaaaccaagtacaaaatattcaaaaatataggagtaacatgtggccatgtgctacacttaaatgttaatttgctacacatacaaattgttcagtgaagggcttttgtcatatggcaagcttccagaaaggctgttgttcccaagaaacctggtttatgtacaggtcagtatggcccccaaaagattaccttccgaagccattgtatgacaggaacaggaatattcagaaagaattttttaatttcttacaagaagctaagcttgtccagattcagtatggattgaggaacatgacctgtgatattgttaaagctcaagtccctgtgccaatagggaagcagcaacatcgtcgatacagatgccttatatcaaactgaccaaaagtaaagagcaggaaaagaaatacttacagtaaggttaaccctgcaagcttagaaaagttaactgttccaagattatcagatatcttgcagttcctcagtattctgtaataaaagtatctaacttagtaacttgccactttgtgaagactaagcaattatgaactctatagcaaaagcttttcaccgtacaagacattcaaagatgtcagattagagataaacgacagcggggagctcccatttagaatatcaccgatccgcctgaagcacggacacttagagaataaagtacttatattgatctccatggaggaaacaggcagtgtaatgtaaaaatacttacaaacttgttaatctggttagatttgatagacttgctggaattggaccttgaaaagaatttccttggaaccttctacaggttaatgttttgattagatcataaatatatgatgtcaaaagggaaaattatacaaatttatcactcangccatgtgttgcactctctgtaggactagggctgagaatatgatat

SEQ ID NO: 82517 - DNA, 563 bp, Oryza sativa
ttttagtcccggttaaaaactttttgatctgtagtcccggttggtaacaccaaccaggactaaagatcatttttagtcccggttcaaaaaattgtccggacgagtcagggccccaattatctttagtcccggttggtataaacaaccgggactaaaaatagatttttagtcccggttgtttataccaaccgggactaaactttaccccaagccgcgcgcctgtcagtccacagtcgtcgtcatcaatcttatccccctgccccttcctctccccctctttgcattaaattaacagccagcctagatatctccatcgtctcagaagtctcccctctcctatccccttcttcctcccccttcacctctcctccccctccccgcctcatcctctctaggtgaccaagtccgagcggcggcggctggcgtggccggccgcgcggagggcgggcgggcgggcggcggccgagtccgagcggcggcggcggttggcgcgccgggccgcgcggagggcgggcgggcggcggccaagtccgagcggcggcggcggctggcgcgccgggccg

SEQ ID NO: 82518 - DNA, 13443 bp, Oryza sativa
caccggctcttctaatatcagaaataatccctttttcacattataaccagatgcttgttgtgccaagtcatttgccctagaattatcacgcctagcaatatgtctaatagcaaaattatcaaaattggcaataatatctaaacatgaatcgaggtacctatttagtgatccgtccaagcatttgtagactccggcgacttgttgcaccaccaattccgaatcaccaaaggcctccacatatttagctccaaccatctccataacttgtaagccgaacaataaagcattgtattcggcttgattatttgtgcaataatattctaaacgaaccgatgcttcataacacatgccattaggtgaaaacaaaactacccctatgccttgaccttctttgcaagaagaaccatcaaaataaatcttccaaggtataacttcaactaatcaaacctctccctcataagcaacatctatatgatggtctactataaaatcacatacaattggccttttatagttttcaatggtccataagccaaatcatattctatcaaagcatatgcccacttgccaatttctcccacttagaattggcctttgcaacatgtgtttaataacatcggcttgacaagtaactatgcatgtactagataacaaataatgcctcaatttgatacaagcgtagtataagcatagacaatagtctctctataaaaacatacctcgtttcggcatccaaaagacggcggctcaaatatgtaatgatatattccttgccatcttcctcttgcatcaaaaaggcaccaatgactttgtcctctgaggcaatatataagcgaaaaggctttccggctttaggcgctcgcacaacgttggagtagataaatacctcttcaactcttcaaacgcttcttgttgttttgccccccaagtaaaatcggcttctttcttcaagcgaagtataggaacaaaagcatcgattttaccctctaggttagaaataaacctcctcaaataattcaccttacctagcaacttttgaacttctttcttacatgtcggtgctttgaaatcacgaattttttctatcttcttatgatcaatctcaactcctctctcatgcaccatgaatcctaagaacttcgccgccgacacaccaaaagcacatttaagtggattcatcttcaaactataccggcgcatcctctcaaaagctaatctcaaatcggctatatgtccttccataccatctgatttgacaacaatatcatcaatatagatctctaagataatacctagcaaatcatggaagatcaaattcattgccctttgatacgttgcaccggtattcttcaacccaaaagtcataacaacccactcaaataagcctacaaatcccggacacctaaaagccgtcttgtacatatcctcctccgccataaagatttgattgtagccggcattaccatctaaaaagctaatcaccttatgacccgaggcatcattaatcatcatgtcggctataggcataggatactcatctttaggagtggctttatttaaatctctaaaatttatgcaaactctaatcttaccactccccttcttctccaccaggactatgctagaaacccactccgcataacgacatggcctaataaaccccgcctttaataaccgatcaatctcctctttgactcggtcatataataaaggattaaaacgacgaggtggttgcttataaggcataaaacccggtttaattggaatccgatgctcaacaagctcacggctaagacccggcatctcatggtactcccatgcaaagctattaacatactccttaagtagctcgattatcttaaccttataatcggctttcatttttttgtttacaaaagttggccttggtttagttccatcacctatgtctacttcctccaatggatcggccgatgcaaacccttgtccaagcttctccacttcatcaaaatcttcaacagtttcaccaatatcgttcttcgtagactgatattcttgcaccctcttttgtaaccactcaaaactagcctctttactcattatacaaatttatatggcttagccgtgctacactagccggctttacagagataggtacaaatctgccatcggagatactaataaaatcatagctagaaagatccctccccgataaacattggatattcccatgacgccactcaaaagtagcatcggccattgcaacctcagccgatgtatccgcttgcacaatttcaacatcatcgccgtcccattggattaaacattgatgcaaggtagaaggcacacaacaattggcatgaatccaacaacgacccaaaataacattgtagttaccttgcacatcgacgatgaagaaagcggttggtagcgtcttgtttcccactgtgagctccgccgaaaagataccccttgcttccgttggttcaccgttgaagccattgagaatcatgttagtcttcttcaactcatcatcctcgcgccccaacttcttgaacaacgagtacggcacctccatccactagcatcctagagaccggcttcccatcaacatggcctttgaggtagagaggcttcatgtgacggtttgattcatcgggcttctcaaaaaccgcgtctttaggacctaatgagaattgagcaacctcggcttcatccatagcacaaaactccataggcaacatacataccatgttgatatccatgtcttcttttggagatgattcacttttatcaaccgattgttctattttcttctctacaatcggttttgccttctctatggatttaggcctccataccggtggtggtcgcaactcattgaaccttttatctctttgctcttcggtccttttctcccttagttcttgggctcgaagacgttgcaaccttctcttttgagtagccgtcaaatccttaggcatctacctaggattcggctctgttctaggaggtaaataatgtcctctattaaccttgcttggagacgatgaagccctcacatcgccctttgcagccctctcatcaaaccggcgctggagctcggtcagaccggctgtagaccaccggtcagaccggccagacgcgtcggtcagaccgacgtgtggcacacggttagaccggcctgaggcgtcggtcagactgtcgtcaggtcggcggtcagaccggcctgatggcccggtcagaccggcaatatggtcgcggtcagaccggccagagggcctggtcagaccggccgactgcgaggagctggtaccggcttcggattttttgcttggggactttccaactccatctccagaaggtataggcacatcatgggaccctattttgatagtaatcacctccgaagtcctttcttccaccttggtgcgctttccttccctcttctcttcattaacccgatttttaccataaaatcggcttttgtttggcgaagacaaacgctcatgaattggcctccgtggtcctccccatccttggttgaattgcattggaggcatatgattgtacattggcggcgttgccccccacggcctgaagtaaggataaggataacccggcggcggcattggataagaaccccatgacatatcttgtggatgaaaatatggaggtgaacgcgatcgtcttggtgaatgaccaaatcgctccctaggaggtgatcttggtcttttccctttgttgtgatccctctcaccaccttgcttctcacacttctccaaaaccatatcaaaggttactttggtcttcctaagagccttagacgttgaagctccacccttattctccttccaaacgccaacctccggcttctttggcaccatcatcttaggccttggctcaccaatgaccacttcctttcccttagtagattcggcttgctccggccgaatcaacacctttttatcattgaaattaattgtattcaccggaaaaggatcatgatcaagcttcatcttggagccatcggtgaatttcaatcgtccttcatctatggccgattgaacctgtcgtcgaaacaaattgcaatcattagtagagtgagaatgagaatcatgccacttacaatatgctcgacgtttcaactcttcttgtgatggtatgacatggcctttaggtaatctaatttgtttctcttgcaaaagataatcaaaaatcttatacttggccacctcaaaactatatttaacttcactttgccgatctttgcgaggagtcggcatcaggttagaacaaacaaaaggcttatttttgttagtccatgaccattcggcaacataaatatcatgatcaccctccttctcactatcactagcctcagggtaatcaattacattaacattaggcttttatcgaatggtctagcaaattttttattatccttaacccggctttcttgagccagagccctttgcatgagttaactaacatcaagaaattgttggccatctagtttttctctaagaggagcaactaaaccattaaaagcaagaccggctaaatctctatcagttatattcaaagtataacatcggtttctaacatctctaaatctcttaatataatcaacaacagattcattatacttttgcttaaccgatgttaaatcacataacctaagctcagtttccccagtatagaaataatcatgaaattgttcttctaattgagcccaagtatgaatagaatttgccggtaaagaagtaaaccatgtaaaagcattaccagataaagataaagaaaacaagcgcaatttaaaagtatcactattagcctcaccacattgcgctaaaaattgacctacatgctcccatgtggtcttaccatcctcaccactaaatttggcaaattcgggaactctataatttctaggaaacggcacattatcataataatcgagatatggctttttgtaagctctagcacgatttctagtttcgatcccgaatccattcctcataatatcgctaatcatatcttccatgttattaggcccttgtggatttggtggtaggtttggtggtctaataggttgggtttgtggcgcaatatgattatattggccttgcctagtatcgggaagatatcccctagaaacatcattataaatgttaggaatatgtgggggaacttgaggattagtggtagcagtagatacaggaggatcaaatgttctaaagtggtacaaataactagcattagtcattggatgtataccctgtattgggacaattgcgccggtctgaccggcccaaggcccggtctgacgggcgtcatgttgcgcggtcggaccggcctgagagccggtctgaccggtgggataatacccggtctgaccggccatctggccagtcggaccgacggctgtatcacggtctgaccggccatcaggcccggtcggaccggtcgtgaacaccattccgctggttttagaccccattggatctataggagattgatcaacagtggtataggctttatcttttaatgtataatcatccataaaagcacctagcctactccttaaaaaccaatcaaccttttccttaaacattacatctaatgtatctttaaaattagccatagataaatctattgtagatgcaatttgttggttgatagattgcgatacctcgtcattacttaccacgtcgcgagcgagcttgggacgtggcccgggcttgatgatcacgccttgacgagtcctagtagttaatctcatcaacgcctcccgtgtgagctcgttgatgtactcctccacagctttacgatcctctccttcgaagtcatccaatatgaccggcatcacattagatggctctacctccgtcttggatgatggcttcgtcatggcgaagtcgaagtcgagttgacgataaacggatctcttccccagcggagtcgccaaaaatcgtgttggcaacttttttaacaagttgacaagcacgatcgtagcaccttaagctttgcggtgatcctagagtcgccaaccacctcgatctagcaaagagctaaacctagatgggttttgataactaaaccggctagcggagccgatttctagatagctacccgtctcgtgggcaaatggaaggttttcaggacaaacctacaaagagatgtcgcactctcgcagcggcggcggacggtttacagcgcaaaccgacaaagatggacaaactaagagaaaactaaaagcaatatgaaaagaacgattcgattgattgattgtaggatggtttttacaatgaaccggccttgtccccttatataggggttggtcttgccctctacaggccctcctccacgtccaactcggggtagaaaccaaaggaaacccgaaacatgccttccggaacaaggaaacctcgaaacccgacgaaacagggtcggactcggacctgctggtcagaccggccacataccgccggtctgaccggccctcaaccggcggtctgaccgcccaacacatggcggtcagaccggcccactcggaggaaaccggtagatttctaaattttggcaatcttttttattttaatcctagatactaaatttgggtgtaaacagtatggttcatttgttgagtcctgtatttacacggacatatacgtgcttgatcgaactaatcacgaatttgtgatgtggcagcacgataaatttcctcgatcaaaactcattaggggggtcaggactcaggaggcaggccccgaccacgcagacgtgcgcgcgtcggaaatcccatcgtcttcctttccgattcctctcttcctcccacgtggacgcacacgttttagagccaaaccgagcgaaacaatggtttcggctaaaaattagcgcgtgcaagcgaacgcgaagcggggcgctacgctaaagcggaataggataatactagaaaataaccgctgctttgccgcgcgttagtatatataggccagctcaattggatgaacccagtacactgttaattatgaagctaggtaaatacgaattgatcataactaaatctgtatatccaaaacaaagggctacataatcacaaaattttacattcaacttacccaataatgcatagtggcttaggaatggtttcgattataagtagtccaacatttttcattgaacaccctaaaaattagaatcagaaatagatataaatggtttgtacactttgaaaaattgaccatatcaaattttagtaatgtcgaattttgacatattttggtattatcgaattttggtaacattggctttgtttggtttgatgcctttactacattttgatgcctttaagagagaacttctggaactgccaaaattgagtaacattgtaatagttgaagtgtgtttactaccaaaatttggcaatgctaaaattcggtaagattgaaagtggcaacaaacttaaacattccccaaatcatccttccatagtcttttccaattccctactttcctattcaagaaaatcagcgtgcctgttggaaaaccaacttatagctagtacatatttacttatttaaaatagttattgttgttgctgttaagagtttcgaatgcaatatttttttttgaaaaaatatatacacttgttcatttagaagaaactatttaatgacttttgaaaaggttgaggaacaattaacctgtagtaaccatattcatgtaaagattttaagctttgttaaagcattactacggaaaacaaaattaaaaaaactttattttcttttatttgtaatacttgtctatttactttcaaaccttttcttgtgctaattaatctattagtgccacatacttacctctatggtcagtatatgatattccctccatctatatttatctcacaatatagagattgtcaggctgattagctaatcataggtaaaatagaatacaattagagcaatattggccctgtctggatcataggtatgttaatctatggttaacggatgattactgtagcatcactataacaaatcatcatagattaatatacctcgttagattcgtctcgcaaaatagtctacaggttatggaatgggttttgtcagtaatgtacgtttaatacttctaaatagcaagattccggaggactatttaatagcccttcggatccaaacagggccattgtcaacaattagagtaaatatggttagtttatgcatggctaattcttatgtgtcgtatttagttaactgtatttgtctggtgaataattatatttcaactttttaaaaaagatttgtaacggatagttaactactttaagtgtatctgtatgcctttaacaaatactactttggaagatatttcttttaaattagtaggatttacaaaatttatcaaattacgtgaaaattacaaaatttagattgcatattttttaaataaataactcctatcatccactcaatatagagtcataataatatgttactctttgtacatcagaccaaacaagtcttgaaaagtcaaaacttctaaggtcctaaacataaatactccctccgtccttaaaaaaaccttaggtttccgtatccaacgtttgactatccatcttatatgaaatttttttataattagtatttttattattgttagatgataaaacatgattaatactttatgcgtgacttatcttttcaattttttcattattttttaaataagacggacggtccaacattggacacagaaatccaaggtttatctttttttaagtacatgagtactaacctaggggtattttttttaaatattttgtactccctccatctacttttgatagacatatttccaaatcttaaaatctatttttgataggcatatttcaatccacaacctatcatcttaatgactttctcaaatttaatgtgtgactctccattcttctacataagattggctacataggcatcgagaaatgtaaatattaatgaatcgtttgtttacgaggaataactagtagtatgtttaaatggatgataagtataattatttatccttggtctgtgtgccaagatgaaatatgactatcaaaagtagatgatggagggagtatttagtaaagtataggataaaaaatactattaggggtgaaatggaaatttttttaggagttgatggcacgggtaagttagcaggtggccattgggaattgggagcagtgacgtgctccatcctccatgcatgcaaatgccccgtcgttccacctatgcttttttttttgagagcccacctctgctttcaatcccagttcactcttattctctcgtactgcacctactgcgctactattgttgtggcttgtgctttccagcatggatttgggctgagaaagaactgatggatgaggccgcttgcaaatgcaagaggtaactggcttctttggtcactgggttcaaggcttcttcaagctggccagctctgcatgcatcacggaggcagcggaggtggcgtacgtggtcgaacggcagcgggttaagaggagccatcgggctgaccgccggccgtcctgccaccaccagctccgttgtctccgcctccgatctccggcgacgagcggagaggtcgcggtggtggcggaaggggctagggggcggtgcgaccggccgtggtggcggaagcggcaaaggaggctatcgaggagacgacgcgagcggttgatcgcagaggcggtacgtaaaggaggccggcgacaagcagagcggcgttgagccgaccgagctgatccccgcggatgtagcgacggcgtggacctccgccgccgtccctactcgtctatatcaaggccccgcgcgggcgggccgtcgagctccaggaccagcgcggaggtatcccctatggcgctctctatctcagccggctccctccagtgtcgtctacaactccgtcgtcggatcaaggcagggcggggccaaggagctccaggtcaatcgagctcgagctcatcgtccccgtttttgccatcaacgcgacggcatggtgactaggaaaggggaatatattgttcttgccggatttttttttctgattacgttttttttttttcatatactccggactgttctagataagattgtgcattttgttaaaaacccttcttaaacttgcaatttatatttaggtccgctaggccttttctcaccgttcgtatgtaatcggacggctatgggacggttcgaatgcgtggcatgttctccagccgagaatctggtcggtgagctatgcgtgatgccacgtgggccaatcaatagcaagggttctaaccctgcaatcggtattaaagatgacgtacgatagtttgtttaaaaacatcattaatttttataatagtagagataaaaagggataattgctcatttgatcctgttctaaagcataactactaatttgactctactttttaaagtttgctcatttttcaaaattagagttgccatctgaccctggtttcatcacactgttagtgatggcggtggctcgacgaggcggaggagcggcagcagctcgacaaggcggaggagcggcggcggtggctcaacgaggaggaggagtagtggcggctcgatgatgcgggggagtgggaggaatggcggtggctcgacgaggaagaggagcggcggtggcggctcgacgacgaggaggaggggggcgacgacggcagggtggatctggcgaaggctcggcgacgaggcgatggatctggtgttgccgaggcacgcacgcggcgcatctggcggcgtcgaaaagtgtgtgcgatggatttggctccggcgggtcggcgaaggcggtgcggcggtggtgaggttctgcggggagggaggagcaccagcgacggcggtgcacggtgagacgacgattgctcgcgaagggtcggagcaacggagccggtgagtagagggaggagtggtggcggcggctgctttgcacagatgggtttgggagttcgccgtcggcggcacgggtgttctgctgcttgacatgtttttttcttttttctttttgtttttggtagccataaatttgtgccatatatttgtgtttgtggcaatttaatatatgctaataagtgcacacaactgcattgaataaaaaactttgagataccgggttaaattcaaaagggtatagatggaacttccgtcttgagttaataccgtcatattgccttcacggaatagggtcaagtctcatattcgtttataaaaaagagggtcaaatgagaaaactcgaaaaagtatggccaaattagtagttagtcttaaaaaaaagataaaaacgcaattgccccatataaaaattaggagtaaagtatacgggcggtccttaaacttgtaggggtgtgtcatctaggtccctaaactcttaaaatgtatatccaagtcccagaacttgtcatagtgtgtcatttaggtcccaaatcgccacaaccccatcaggatcctacgtggcattgatgtggcttgccacgcgaacatgacgtggtattattttgactgacaaataggacccatttaaattttttcttttttcttttcccccctttattctcctttctctatgacctgagcagaagaaaggaaagaagaatgagaagaaaacagaaaagaaaaataaaaataaaagaagaaaatgacacgtcatgtccacgtggcatgctatatcagcgccacataggatcctagaggggatgtgtcgattcgggacctagatgatacactttgataagttctaggacctgaatatgcattttgagagtttagggaactatatgacacaaccctataagattagagaaccaccagtgcactttactcaaaaagtagtaaatgtattttctatacatcacatcccgggattactttctacgtatttcgtttagtctgtcctttcctaatgtatctgatcgatagagtaattagctaagctaagctcacttgatggcgctagcaagcaaggcaacagcaaaagaagaggagctcgaagggctagcggcggttgactttgaggccgcctcgcaccgatccgcggatcgctcctcccccaaatcccaatcgcgctccctcgcccgtcgcccgtcgccgcgccttcctctaccccgtaccaccgccgaaaccctagaccctcgtcgcatccgtcctcggcggctagatcggcgcacgcattcatctccggcccggctgacgcttcttccctggctcgattcgcgacccagttgggccgatttggatcagcagcggcccggccctcttcttagcccaattccaacaaacccccactcgccgccagcctcgtcggccgccagcggcggagctctcccccctccggatactctttcgagctttcttggtaagccccccttcgtcggagcggtgattcctctgcatttcccccgtcttcttttttttccccgggatgcgattgggatccgaataatctctcccgcgggatctatctcggccgattggtgaggcgtttgtagctgctagggctccgtggttcggccgcccgcctctgtcggtggcgacatgtggggggttctttgtccaaaaccctcgttcgggcgctgtccagatgcttcgtttctttttcttttgtcattttcggtctcggtgctcgctcctcgctgatggttaatgtggctgttgattgtttcgcccgctgcttaatttgctgaagcaagtagcaacacataaggatagttcaatgtagaccgttcaatcctttttgcgcgaatcgtcagcttgtatccgttcttgcagtgcaggagcacgttttgtttcgtctgacggctgttcttgaaaatcagcgttagcgtttagcaatgtgctggatatcatgcatgatccctttcttttctttttgggttataatttttttccttttgatgtatatatatattgagtattgcatctttgtataagctaatgtccttctttttttttactaacgtggcaattccatctggtcaggtgaatacaatcttgtttctagtcatggcgaagcaggcctacgcgacgagcagcctcgtgataggatatgcactctgctcgagcttgctcgcgatcatcaacaagtatgccatcaccaagttcagctaccctggcctcctcactgccctgcagtacttgacatcagtggctggtgtctggaccctcggaaagctcggactcctctaccatgatcccttcaacctccagaccgcaaagaagtttgcgccggctgcacttgtgttcccccttgccatcttcaccaacacccatctcctgaagcatgccaatgtggataccttcatagtgttcagatcgttgaccccgcttttggtcgccatcgctgataccggcttcaggaagcagccatgtccttccaagctcacatttgtgtcccttg

SEQ ID NO: 82519 - DNA, 6324 bp, Oryza sativa
agcatcaagggcgcccgcgccgtcctcaacttccccggcctcgcccctgccctcccgcgcccggcctccctcgccccccgcaacgtccacggcgccaccgccctcgccgccgtcatgcaccaccacaaacacccctcctcctccacctccacctcctcgccgccggctgctcctccgccggacgaacaccaccctcgccacgagccgcagcagcctgagtcgagcagggaggatgaccagcagcagcagccggcggcggcggcggcggcgcagatggcggtggccgagctggtgttcgacgagctggcgccgctgtgggtggaggacgtggtggagttcgggacgtcggatcattgctggacggcgtacgatgcgcttgaccccatcggcttccagcctctcctctgggagtactaggctgctgcttgtaaaacagcttcctcttcttttcttttcttttctttttttggttttgttttttgtgtggattttttcccctagtgctgcttaaaatgtggcttgttttttttcttctctctttcaatcttgatttgagttggatttggagtttgtgtgatatatgcgatggaattagttcgagatgcgtgcacattttgtcccaggaaaaatgcaatgcttaactcgaagcagaagctcaatattgtggttgagactgaaccaaaatcaatctaaaatttgagggttgaaaatttagacttctgcgaaagttcgagggatgtaaaagaagaaaaatgtcaccgtattatctatttttgaacgagaggtttaagctatatatataagcactttgtttactctgagcaatgggatgtaattttcatgaaagcaagcagtgcatatatcgactaaacgagtccagaacttcagataaaaacatatgctagattttctagaaactgacggctcatggcttttgcttgcgtaacagcacctatggtaaaatagtctttctgaattaatcgcaaaaattaaaaaaaaaatctttctgaattctgacaagtcagaagaaataaatatttttgctggctcgatcgcacaaatacctgcacatcttgccattgtgatcactttcactatgcgtaacataagtcatcgatttttttttcgaacacgcaaaagaattacacatcaatatattaaaagaaatcagagttttggttacactacgcaaacgaccagaaggctattgccaggggacatgaaaaaaatggaaggaaaaagaatgtaaaagaaaatttcattaccatgaattccttgaaagcaatttcaaggaccttactactgtaatacttatcagaactgactactactaccactacttaaactttgaccactaatagcttttaaactgccagattatggcgatttaaacaatgcatagttgcaatgatgtttatcaaaatttacctgcaatttaaactgtatcaatcgctcagcaatcgaaccttacctaaatactaataattgactctgcagctgggacctgcagaaacctagcttgggaattaactaagcatggtgtcccatggcaacgccgatcaattcattaatctgtacaactcagagatcctattgagattcgatgaatgcaatgtgaatcgtcagagaagttaattagctgtgaataaaatctaaagaaactgatcctcttacagggtgttagctccacgtacgaaaaaatagagtaaattgggtgcagtgcatgtatgtgtgtgtttgtctgtcttagccggccgctggtcgctgaacctgaacctgaactagctgtctgaatatttctgtcgcctgaatctgtctgaatgatcatctgatgatctgatccgacggtccagagctcgagccaggccaaatgtgtgcaacagattcaatggctggagcccccatcaagattcaagaggtagggacggctgcattcactggcgttgtcatgtcactcagaaaaatatccatcttgacccgggtaatttctcttcggttttcagggttacaaatctcttttggttttgttgaaatataagcacttctaaaatttttcagagagattatttgagaagataagtgaaactaaatgagaaatgatcagtgacggagccagcacagttgtaaaactcaaacgactagtggtgtttttgggtgactggccgatttttatagatgactaatgataatagagacggcagcggcggagcctgggtggcagcccgacctatccgggagttgccttcactgctggaaatgattgcaattggttaaaacaagagagtagtcggaggaattactatatatagtttgaaataaaatttgaacactaaaatttgctatagtttgggatgaagtatttttcatttctccctttaatttcctataggaattgtgtcttcaggttgaaattaagcacatgcagtgcattttagtgagattagagatttgcggctgaaccctgactcttttgagcgttcgtgtgcaatcacgttttctgtgtaatcgtaaaaaaagtataatgcaaaaattttacagcaactttgtaggattttccaacgaacttatcaaattacttctgcaatagccaagaaaaaaccctgcgttcttgaagctgtatatggtacatgatcatcatagccaactttcttgatctggataatttgtatccaaggttaagcagagtgtgacaactaccaggggcatatcttagataccacaattttgcaaagatttctggaagaatatatacaaatacagtgataggccaacaacatgatggtcctgatgaggaaacagtctgattagctacatacaaatcgccatgtgtgttctcctcctgtcctgagacagtgagacaccagagattcagaaggagacggctaatgacagttttgatggattattacatgcaagccacacacctgtgctgaatgtatgcatcattatatcctgcttagacaattctaatacccctgcaggagttactcctatatatatcactcagagacagtgtatgtgattgacattagagatgacacctgtgcacacgtgtcagctcgtgatagactggctggagattaccctgagattctggacatgaatgccactaactgtaatgcctcctggcgtgttgatgtgtgtgcttgttaattagtgcaacagttgcaatgtgggttgccataagcatcgatttggggaattaataatccatgaggttgatataaactatatggattaacgatggatgttggctgtgtgcaattgtgcagagtgtttgattacgagtcaactttgttcagttcagatcatatttcactggtggagaaaccatctttagtcggtccaccagatttcacaatagtcccgattgtattaaaaaccgggactaaaaacatatttagtcccggtttgaaagctctgaggaattttttaccaaccgggactaaagatctatttatagtcccggttagtaacaccaaccgggaaaaaagatcggttgatgttatcaaccgggactaaagatctatttttagtcccggttggtaacaccaaccggaaaaaaagtcgacataagcggggtggttgcacacggatcggatcaatacaatctcatcatctccttttttaactcatctcctcatagagtcacccttatctcttcctctccctcctcccttcctctcctcctctccacctccctcctccccacctccctctgcaacggcggggcacggagggccggcccgcgcagcggcgcggcgagcggagggccgggcgaggcggcgcggcggcgtgcaggcgcactggcggctggaggcggcgggcggcgcggcggcggccggcgaggcggcgggccgttcgtcttctttctttctttttttttgagaatctgtgattcggatctgagatgatttgtgtgtgatgtatttgatgtgtgtgtgatgtgaatatgtgatgtatttgcaatgaattttgtagaagttgtgatgtaatttttttaagattttgtgatgtattcacagatattgatttgagaatttggagactattcgggcatgattgatttaggattttgggatcggatagagtgaatcaatatattaaaacccatgaagaaaagcatagaataaagtagcagccggatctagcctctttagtcccggttggtgtcaccaaccgggactaaagatagagtatctttagtcccggttggtaacaccaaccgggattaaaaatggatttttactcccgattttttcaccagggactaaagatagcgatcttgagtcccggatttgtagtcccggttggaaaaccgagactataggggggttacgaaccgggagtaaaaactccttctccacaagtgtttggaatatatgtgtgcattttactattttgggtaggataattaagaattagttcaaagttataatttagcacatacttgtggtaacgatatatttgttcaaaattatcactgatatgtgcaaatttttcacaaaatgctgctagttaacttgtaatattgtagggattgtgcttgtttagaaacaataatcaatttgacctattttacttaattaacataaataatgaatttctagttcaacgttatgtgcgttttaaaacaagctgaccaaaataaaactaattaaaacgctataataatgttgattattgaaatgcactgttttcttaaataaatggccctactctaatcaacatgtacatgctgatgtacttctattaaaaaaatagtacacaataacttttaaacgctaaccacatgataatattatatgtagctaattaactactccattcgtattttaatatataacgctgttgatattttgagatatgtttgaccatttatcttattcaaaaaatttatgtaattattatttattttattgtgacttgatttatcatcaaatgttctttaagcatcacataaatatttttatatttacacaaaaattttgaataaaacaaatggtcaaaatgtcaacggtgttatacattaaaatacgaatggagtagttaattaagataagttaaataatgttggtacaatgctacagtatgtccaccctcgtgcaagtatgtatacagagctagctacgtactaccaattaatattagtgttcatcagtatattaattagtcctttaagcacgtagcttgtcttcaagatacgagacaaaagatctcttagcttacagccattaattgtcacactcaacccaaatatatatacttatactactacacataatacttcctccgtttcacaatgtaaatcattctagtatttcccacattaatattgatattaataaatctaaatagatatatatgtctagattaattaacatcaatattaatatgagaaatgttagaatgacttacattgtgaaacagagagagtattatttacaatcttacatagattaattaagctaattaataagctgttgatgttcttaaactcgttgaaacttaattattattttcccttaatttgcccccagttgtaggataattcatgcatcattgttcatgatgaattgatgcgtgacctcgtcaaatgataattagttggcgccctggatgccggacatgtggtgtaattagccgcagtttcgctgcagggccatcaagaacaatgtcaacgttaaattaatcaccttgatttaatactgatagagcacacggccattttgctttgatcaatataggtgttattatgtgtgtagctgcatgtggttcgtctttaatttcctctctaaatcgaatgggcagaactactgccacatccggtttcgaagaaaaaatcgccctgatgaatcaattcaagttttttttctttgaataaggggacttttctttgttttttagcagcggctcaaatagatgttttctttgtttttttacctaacttcacagtcacttaagagggtgtaggtttgatccaaaggcagaaattgattcaactagaatgttatcaaattcatagtgcagaaattattcaaccactagaacatttttttcggacgggatttcgttttgtcctgacgggtttttttttccgttagagcgaacccggttttcagtgctgaattgtttacttttccccatctccctggtattatttgtgtttttactcaatattttctaaactctctatatatgtgtaatttttatagaatttgtacaattgtcaaggtgttacacgattattttcgtgagtcttataccctgtttagatgtgactaaaacttttaagtccctatcacatcggatgtttagacacta

SEQ ID NO: 82520 - DNA, 9044 bp, Oryza sativa
cagcaacatcgtcgatacagatgccttatatcaaactgaccaaaagtaaagagcaggaaaagaaatacttacagtaaggttaaccctgcaagcttagaaaagttaactgttccaagattatcagatatcttgcagttcctcagtattctgtaataaaagtatctaacttagtaacttgccactttgtgaagactaagcaattatgaactctatagcaaaagcttttcaccgtacaagacattcaaagatgtcagattagagataaacgacagcgaggagctcccatttagaatatcaccgatccgcctgaagcacggacacttagagaataaagtacttatattgatctccatggaggaaacaggcagtgtaatgtaaaaatacttacaaacttgttaatctggttagatttgatagacttgctggaattggaccttgaaaagaatttccttggaaccttctacaggttaatgttttgattagatcataaatatatgatgtcaaaaggtaaaattatacaaatttatcactcaggcaatgtgttgcactcctgttaggactagggctgagaatatgatatgttcttgtcctaatgtaagggcaagaaatgaaggagaagcattttgtgctacagttccattgattttctgttataataaatcaggataaatatttaaatggagcaagaggttgataattaatcttacaaatcttgtaaatttggaaagctcccaaaataatcaggtatttttcctgttaaatcattatctgatgcccacctgcaggcaaaatagaatctgttacttcgagcatatggaaccaaaatgaaaataacatttgtgacactccaatagcttacagaatcttcaaattcttaagctttgagaatgttgaagggaagggaccactgaagccagaactaataatatacctataaaaggaagactgcagtaattaaaaacaactttagatgggcctcatcaaaattttagttaacaggagtctaaatttggaagctcaaaatggacaatgggattacatttgctcgagtttttccaaattgcccagttctgcagggagttcaccagtaaaattgtttgaactaatgcccctgaaatcccaaagaaacatgttgactacgattttgtttatgtacagacagaaaatagcataaattcgcctctgtaagaattaagcatgttacaaaacactgcttaagaatctacaattttgttattttggatagcagataagaactatttattactgtttggatctgatgcaagcataagaaactcatgtagaaatgataaatttttataaaattcttaataagttacagttacacatttgtgtctcctgtgtaactaatttacttcagatagtccgtagtataaacttcaactccgagtagaaaaaatagtctgtaatgtaaacttcaactctgaagaaatttaactaagatatctcttacaatgatagaagatttctaagattcccgatctccttcggaagaggtccagataacggattgagggacaccgccctagtaatttttttttcaacattatgcgattactgattagagaaacagaaagtaacaactgatgaatgctaagagaaaataaaactaaagcagtgatcgaaatcagattcttacaagtactgcatggcagaaaagtttccaataaaggatggcaggggacccgtcaagtaatttcgccgaagatcccttcagtaatatcaaaaccatcaagctaaacataaacacttcataatcaggctcctgtaccctgattattcttgctagtttttctagatgaggaagatgatagttcttcgctagttattaggatttttttactgaacgcttgagtaacacaatggagaacagggtatggtgataggtattctgcaagctttattttcaaacttctcaaaatatttatgtgtattgtcctcgtaaaacatatatatggtatttgttccatacttatttaatactatcaagattgtggtataggattatagcttctgctatataatgtatttcccaatatctgctatattgaagccaaatcacagtcaacagacagaacaattatatataatctacccccacaaagatcacaccttaagaatttttccaagaatgtgtgaatgacatgtgcacccatcttgtcggcgcatacaactgattctttcttccagatttagcactttgaagtgatatatccttttagcataattttaccatgagaagttggactcaaaagattattcataaattggataaaaggaccctcaagagctgaagagcatctcaattgccattcctcagtcgatgttctctacatcctactagctagctctcagaaaaagtagtgctttactgctttatcttcaaaacagagaagagaaagtttagaggccatacaagttattcagataagagagattctgcagctcctcaggtatttgaccaacaacgttcaacgagaacactctcctgaatagacacacaaaaacctgttagctagagctccttggatcctaaagatcgtgatttcagggaaaaaaacaaaccaaacataggagtttgcagagacggattggaaggaactaatatcaaacaatttcattttcatgtgtgcaagcctaatcctcagcaacaccatggtcactcatggcctcttgtaggcattatatcgaacacctggtgtgcagctggatcagcgcaggttgagaggatacgtacagtctgatgatgtggcagacggtgccggcgttgaaggagcagtcgcacttgatggccgggttgatgttggggttgttgtcgacgccggtctcgtcgatggcgacgccgctgcagggctcgccgctgatgttccacgccggcgacgcccgcaggccccatctccccaggatcgtgttcagtgcagccactggagagacacatacgcaattcagtttaagcaaatgtagctcgaaaaccttttctttgttttccgctaaacaagataccaaggcagatgctcgtatacatatgcacgctcaagccatataaccacacgctctacttctgtaaacacctactccctccgttttccgttttagattataattcgttttgactttggtcaaaatcaaactattttaagtttaatcaagtttgattttggtcaaaaccaaactactttaagtttaatcaagtttacttacaacactaaaatagtttcattaaatctacaattaaatatattttcataatatacttatcttatgttgaaaatgttactacgtttttctacaaacttgatcaaacttgagcagtttaactttgatcaaagtcaaaacgacatataatctaaaacggagggagtacttaacattaccggctcgctatcttaccgttctagttaaatttctacttatttttatattgaaatatatgagtcgagtccatttccttaattaagtgggacaaacacaactcattgtggtacttcatgtgtcatttgaaggaggagagaattgtggattgaattaggtgtctaattagttagactcaaaaggcacatatatggtagaagatatgagaaaattatctaatacttattttatattaaaatagtcccactcaagtccatttcaattgtctaaataaaacatttatttaattaagtgggacaaatacatctcaccttttcctaccctatgggccctaggttgccaattgaaaaaaaaataagtcggaaatcaaggaaggaattggtgtccatggttttaagaagaaagaagcaaatatttcaggtgagcatgctcgagcaaaatcgaactcaggcggatggggtgcatgccagcaacccatctctaagctgccaattgggtttgacttcaagctgctcaccattaattcttccaatagccttcctttaatatcaaagtccgtcctttaatattcagcgtctagatagactttaaccttctgatgcgtcataattgatccctgtttactgaaaatgttgccagttaaatttctgacttgtatttcacttacgttgtctacaggcctaactttttattttgaaagcataggagctaagttattatctgaattttaggatttgcttctgtcattaacctgttgttcagtgaactaaacaacctgggtactaaccggatgctgttttatttcggatttgagtattatagattgaatttgaagctagctcttcaaaattagtgaatgaaaccggagaacaaattaagcgacaagacacagtttgcacgcaattaactaagctctgctaattactagtaatcctgccagtttctgaattaacaccctctagctaccacttgcagagttgcaggtagaacaagatcaatagagatatgtaatttgcaaaactgaattcacataccttctgctggatcagttctcgctgcttgctgagcttgaacagctgcacaggacgcataaacgagcatcagccacaagaagccatggacgctgctgctgctgcaactcatctctctcttaatttctctctcagctaattaaccaaagcaaaagcagcaggtttggtttggtttgttttgaaatatagtgatgaattgtccgaggtgttgtgtatatatgtaccagcagcaacgggagcttcaaggcgaaaagttaattaatcctaattatgacaatatgaaaaggccaagagaaacctcagttgctaattagtaagatattatttctgtttccaagatagcgagaggagtggagcattaaggtttcaataatgtttacgacattgactaattcatggcatcaacgtactattgatggtacacaactggaagagatcggacatgtcaactgcgacttgtacgtatgaaagccccctttttttggaataatcatccactattacctgctacctccacgctgatctcaatgtctcaaaaactaactatagtcaaaagatcatagtgaggacatgagaattaaagttggaggacttttttttatgcttactattcgtaagttgaaattagcgaaatgcaatcttttgtgggcttgtctggacatccaaaatcgcctacgaatagcagatttaaatacaacattacttaatacatacggttgaaaacggtcggaaacggcttggaaaaaagtcccaaccatttccgtaaccatatttttctaagaagagcaatttcaccgtccaacatttggtatctcaaggtactacaaatttttttgtacctctaagtactttctagtgcaaaatttagtactttgaggtaccaaatgttggatatagtaaaattgctcttctaagaaaaaaaatggaaaatggtaaagccgtaaatgaaaacgatgttagaaatatcagaaaaccggaaacataactatatagatggaaacatattggtatcgttcgaaaaaattgaactgtagaatcacacacacttaactttgcataactttctaaatataatgaaataaattttaagtttgtaataaattacaaatggtcgtccatttaagcttatacttgagttaaaaatttggttgagtagtcgatgagcttctaaactacgggtcaaataaagaaatgaatcagtcaatgagcttataaactatgggtcaaataaagaaatgaatcataaatattgatgtataaaaagtagctacttttaagaacattgatgcatttagaaatatagtaattaccataatataaaaaatagtaattcgtaagaattcggcaaaattcagaaatagttggtattttaataatttttaccattttcatttttgtttttgttggtaaccattaatccatattgctcagttggtaaaagtagagacgagggtcgattagtcaagaattttcgtggacgttttcacccctatatgtacataacctatgggaaaaaaaaggaccctatcaagttcactgaactattattgagtttcctttcggaggcttaaaagagtttaaggatcaaatctccatacagcctttaattatttcacctcatcccttcttgtggcaagcatatgtgcctatgaacccatgaagttgtcctccagccaacaaatttcatggacagtttttactattttgctgcagaatgtgctcataaacatgcgaatacgttgattaatttctaagatatatactaggatactactctatttgacctgttacaaattacaaggagtaaatacttttatcatcatacatacttcagaataattaagttccactattagctccgtcttacatttacatacaatcatttcaaaccaagatcacctgcaggttgcagcattcaccttccatcatgactagatccggtgattgttggcgacatggtgagagggtcgatctccttctgcctgctgaactctgaggtggtagattctgagttggtgctgtttccatctctatattgccactcagtgatgtagctcggtttcgtcaccatctcaactacctcagcatctccagtgagcactgccatgaccctcgacattggcggtcgctgatttggtgagccctgtgtgcagaggagcgcaacatgaatgactctgagaacttcatctttattgaaatcctcaagtcttggatcaacgattctttgtgcttgctccttttcgtacaggtcccaggcctgtaaattaacataggtatagcttcaataatcaaaacatcatatacatgaatagattagtgtgttgtttgaggatggagcattgatcaacttacccactctaaaagatagatcttgctttcctcgatggagttattagtgttcgatcgaccagcgacagtctctaatgcgaccaccccgaatgcataaacatcaaccttttcagtcaaatgacgtctcattgcatactcaggagccagataaccacttgacaaaaggttagacaagttttagttagctttcattttagaggacaaccacaagagaaatggtgaaatgtgcttacaatgtgcccgcaatccccgtgctgacatgagtcttcttctcatcatagagcctagcgagtccaaagtctgatatctttggggtgaggtcggtgtcaagtaggacattgctggccttgatgtccctatgcacaatgcgcacacttgactcctcatgaagataagttagtcctcttgcgattcctaaaatgatctcgaagcgagttgcccagtccagttttaagctattcttccctgtacaagcagaaatgactttaaggtcttgagaattcaaatgatgaaaaaatgaagagaagaaatttcccaaaatataaaatacaattttgcactgttggttatgagcagacttgaactcactgaagagtgcttgatctaggcttccattttcaaggtactcataaactaacaaaggtgtattactgtcaatgcaacaaccatgcaatttgacaagattccggtgttgcacagaagaaattgttgcaacctctgtcacaaactggtttttcccctgatgggatgattgagaaagttgttttacagctataactcttccatcaggtagcataccctgccaaaggaagaactttacttacgttacatttatattttgagggtagaccaacaagtttgcaagaaatctatatttaatacagatcagataattattcaattgcaatttcacagtattaaattagggaaaatagacaaccttatagactggtccatatccaccttccccaagaatgttttgggaactgtaattatttgtagctaacttgagttcagcattactgaagacatcaggccgtccaactaggttgtacagttctgtagacaccagcgcacaccagaaagaataaatcatttgaaaattttgttgtctgaattcctgtataataaaaatatttacctccttgctgttgtgcaagtcttcttctcttctttatgaacataaatattccaaatagggctgctaatcctacaactgaggcaccaatcgatattccagcaattgcacctactttacttttccttttgggtacaccgtttcgcacagtaggagtaaaatctgaaacagagatttcatttactagaaggcaatataatccttcttgaggttaccttaatgattaggcttacttggagtgatgcttaatgctgagatcaatggcccgtagtaaccttgaataggaatgcaacaagtgccctttccagcccagaacagatggatttcgaggaagtttttcgacacagttgccgtgtaactcttgtaaacagcagtgaaagattttccaccagccatcttccttatatcgaagtccttttcttttaggtcaccctataaaaatgtcaataatacaatcagataaagaagaaaaggatccagtaaatatttttttctgtttttgcttttagtaaacactagcatattgcccgtgcattgtaacggtatttttaattaaagaaaattatcattaacccgttattatcatctcttaattgctgtacaaatctgttactgacatgtggaccctttggccccacgttgtccttttttcattcccgcaaaaattagagagttgttaggagtattttattcttttttctcttcaagaaaagttaggaattggttgtggggtggtagcagaaccaccaccaccactagtcccttttataaggagaatagaaattaccatacaatgcactcaatttgtacctggatatatatgtcaaaaactctccttcctaagcttttccaagttggtgagtctggataacctaactctgcaaattgaagcagaacagtgtaatttccattctcaagtccaaggccaaagtatctcagagacgatggtgacatccttgcagtttggagtagttctgaaaccactgcattctgaatcttctcattgctatatatgatcttactgtcatttggagactggaaatattttcctacattgctaacaccccatcttgtttcactggtaacgtaatatgatgagctgccaaggtctgtgaaatccaattcatacatag

SEQ ID NO: 82521 - DNA, 36905 bp, Oryza sativa
ttcttttataagaaggcctgaacctgtataaatcctttgtctccaaacccatacacttttctagcttgatagccacccccttttattattgccgaaatctagtttcgacagttggcgcgccaggtaggggttgcgtcaagcttttcgccgatcagtgcaatgggttccgtctccggcatcgacgacctcgtcttcccacccgggcagacgtttcggttcggcagcctcgacttcatcaccaacaacttcggcaagatttctctcctcgactcggaatcaaaccagtcgggagagaaccggatttcggtcccgtttggattcccgaacgcggctgaaagctacttcaagaccatcttaaccgagtcggcttcaaaccactcggccgagattgcatctcctccgacggagccagatcaagatgatggggcttacccaccagtcctgatgaagctccccgacgatttagcggccgtcttcaccacgacaacgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcgcgccccaccgacatcgtggagtacgatgagtttagctctcgctaccacgacccggatctcgacgacttcgacggaagcctagatgacaactacacccctctctactttggcgttttcatggccaataacgagacggaggagcaacgccaagcccgggagaccgaagagcgtcgccgactggaggaggagcaccaagcacaagaacaagaacggctacggcgcgagcagcaggaccgtgaacggatcgcgaaggaggctgaagatcgacgtcagcgagctttggaagcagggcgccgagcgcgtgatctcatcggccagcaagatgtcgaagggacaccggttttccgcacccctcaacagaatgcggttgccgcgatcacccttctcgacaccctcctcaaccaaaacgagctcaatcgatccgaccacgtcgtcaacatcctgaaccagacaaagaccatgattgcggcgacggtcccagttaactccgaaagcgtccacacgccgactggcagccgggtcccccacttccgatctcatgactaccgtcatccaagcctcagcatcaccggagcaggatccaatcgcaggagcaggggccacgacgagcggtctgttcactcgcctcccgaacttcatagggagcgccgagtggaacggcctcgctcaccacctcgtcgccggcccatcgatcttcgcgacacaatcacacagcgccgagcagctcgaggctaccatcactcgccggatcgccgcgacgacgaccttgacgagttgcagccttcaccgacgacctgcgtcgagtggattggccagccggcttcaaaccgactggaatagagaagtacgacggtaccactaatccagaatcgtggcttaccgtctacggtctcgcaatccgcgcagcaggaggagataacaaggccatggcgaactatttaccggtggctttagcagattccgcccgatcttggctccatggattgccccgtggtacaattggatcttgggccgaactacgcgaccacttcatcgccaacttccaaggcaccttcgagcgtcccggcacacaatatgatctttacaacgtcattcagaagtccggagaatctcttcgagattacatccggcgattttctgaacaacgtaacaagatctccgacatcaccgacgacgtcatcatcgccgcattcaccaaagggattcgccacgaagaattggtcggcaaattcgggcgcaaacctcccagaacagtcaagctcatgtttgaaaaagccaacgagtacgccaaagccgaagacgccgtcaccgcatcgaagcagtcgggtcccagttggaagccgaaaaatacgccggctacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaaccacgtggccaaagagtgcttcatctacaaacagttcgcggagcagtacaccaagtctactcggaagaactccgacgaagaacaaagcacgtcaaggaagaaggatgacggcgacaccccggctggatttcaagaccaccccaaggagcttaaccatatcttcggcggccccctggcttacgaatctaaacggaagcagaagttgactgaacgggagatcaatgctgttcaacctgacacgccccagtatcttcgatggtcagaaatcgcaatcaagtttgaccgctcggatcatcctgaccgagtggtccacccggggcggtaccccctggtactagacccagtggtccgtaatgtcaagcttcgcagaaccctcattgatggcggcagtgcactcaatatcctcttcgccaagactttggatgatatgcagatccctcgctccgagttaaaaccaagcaatgcgccttttcatggagtaattccaggattatccgcaactccactcggccagattactcttccggtcacttttggcactcgggaaaacttccgcacagagaatatcagctttgaagttgccgatttcgagacagcataccacgccatactcggacgcccggcgttagccaagttcatggctgtcccgcactacacttacatgatgatgaagatgcctggtccccgaggagtcctatccctacggagcgacatcaagcaagccgtcacatgcgacaaggagagttgcgacatggcccaaactcgcgagatggcgctagcccgagaggaaatccgactggctgcaaccacggtgagcgaaggaggagtgcccgctgccaagatttcaaaaagtggggaaaccgaagcccagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagctgttagcagcaggcttcatcaaagaagttcttcatcccgactggctggcaaacccggttctggttcggaagaaaacagggcaatggcgcatgtgcgttgattacactgacctcaacaagtcttgccctaaagatcccttcgggttgcctcgcattgaccaggtagttgactcaaccgccggctgcgagcttctcagttttctggattgctactcggggtatcatcagatccgactgaaggaatccgactgcttgaagacttcattcatcacgccctttggggcatactgctacgtcaccatgccgttcggactaaaaaacgcaggggcaacttatcaacgcatgattcagagatgcttctcaacacagatcggccgcaacgttgaagcctacgtggatgatgtagtcgtcaagaccaagcaaaaggatgatctgatctcggatctacaagaaacctttgcgagcatccgtgctttcaggatgaaattaaaccctgaaaagtgcaccttcggagtaccgtcagggaagctgcttggcttcatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaagacagataatttccaatggggacctgaagcacagaaggccttcgaagatttcaaacaactcctcaccaagccaccggtcttagcctcaccacatccgcaggagccgttgttgctgtatgtatcagccacctcccaggtcgtgagcacagtcttggttgtcgagcgtgaggaagaaggccatgtccagaaagttcagcgaccaatctacttcgtcagcgaggtcctggccgactccaaaacgaggtaccctcaggttcagaagctgttatatggtattttaattactaccaggaagctgtctcattactttcaaggtcactcggtaacggtggtcacatcattcccactcggcgatgtactacacaaccgcgaagcaaatgggcggattgctaagtgggctttggagttgatgtctttggacatatcattcaagccccgcacttcaatcaagtctcaagcgttagccgattttgtcgccgagtggaccgagtgccaagaggatacccccgtggagaaaatagagcactggaccatgcattttgacgggtcaaaaagactttcaggcactggagctggagtggttttaatttccccgactggagaaagattaagttatgtgctttggatacatttttcggcgtcccacaacgtcgccgagtatgaggcgctccttcatgggctacggattgcaatttccctagggataaagcgtctaatcgttcgaggtgattcacagctggttgtcaaccaagttatgaaagagtggtcttgcattgacgacaacatgatggcatatcgacaagaggtacgcaaactggaggataagttcgatggacttgagctcagccatgttcttcgacacaacaatgaagctgccgatagacttgcgaactttggatccaagcgcgaggcggcgccctctgatgtttttgtcgaacacctttatacgccgacggtacctcacaaagatgccactcaaattacgggcacccatgatgtcgctatggttgaagccgactggcgagagcccttcatacgatttttaacttctcaagagctccctcaagataaagatgaagccgagcggatttcaaggcggagcaaactttatgttatgcatgaatctgagttatacaagaaaagcccttcaggaattctgcaacgctgcgtatctttagaggaagggagacaattgctgaaagacatacattctgggatatgcggaaaccatgctgctgcgcgcaccattgtcggcaaagcttaccggcagggttttttctggcctactgcagtgtccgacgccgacaaaattgtgcgcacatgtgaaggttgccaatttttcgccagacaaattcacttaccagctcaagagttgcaaactatcccgctgtcttggccgtttgcggtttgggggctcgacatggttggcccgtttaaaaaggcagtcggcggttacacgcacctcttcgtggccatcgacaaattttccaagtggatcgaagctaagcctgttgtcacgattacagcagataatgctcgagacttcttcatcaacattgtgcatagatttggagtgcccaatcggataatcactgataatggcacacaattcaccggcggagttttcaaagacttttgtgaagatttcggaataaagatttgttatgcctcagtagcgcacccaatgagcaatggacaggtggagagggccaacggcatgatacttcaagggattaaagctcgagtttttgaccggcttaaaccctatgccggcaaatgggtgtcacagttaccatcagtactttggtctttgcgtactacgcccagtcgggccacaggccagtcaccttttttccttgtctacggggcagaagcaatgttgccgagtgaagtcgagttcgaatctttgcgcttccgtaatttccgtgaagaacgctatgaagaagaccgagtggacgacttgcaccgactggaagaagtccgcgaagcagctttgattcagtcagctcggtacttgcaagggttgcgacgttatcataatcgcaatgttcgatctcgtgcctgtctagtcggcgacctggttttacggaaaattcaaaccacacgagatcggcacaagttatctcctctatgggaagggccatttattatctctgaagttacccggccaggttcatatcgactcaagcgcgaagacggcactctcgtcgacaactcttggaacattgaacatcttcgtcgtttctacgcttaactttatcattgtatttccctattttgactgtcaacatcaagttttcttcttgccgttgtcagtcgggggctattatcataataatggagtgtgattttttttatcaattcagtttgcttacttggtttatcattgccttgtttggtttttctacttagtttgagaggactgaaagtttttaatagcttctttgggttttaggctcaacaaagcttagcaaaaacttttaagaaatcaaaaactttgcaagaatcatcaagcacagcataaatacaccagtattgtacaaattgagcctccatgtattacatccaaactcagtcagagtcagtcctttcatcatcagagtcatcattactcggctggaggtcgttgttgcgaaattgctccacaacatcactcgctattttgtcagccgcagtttgcgcactactgataagatcaagggcagcttcttcacttgtcccgtctgcaaatccatcaatggtgtcgacttcaattctcgggtacaaagattttgtcatcgccaaggccatgccagctcccatacttccagctttcttgatatttttgaaatatacttccggagcaacactcagcttgtcaaatatttcggttgcgtcgagtgcactcggaccaccgttattgaggaacatggcttggataattggtgcagcggcattggcgacatcatcccttgctccttcaagcctcttgatcttaccaaccaggacgtcaaactgagcttgagatttgatcttgcgatctacaaaacacatttatgatgagcatctgttgcattataaggagagaagctcagattgttggctggcgttaccttcgacttccttcaaggctgagtccctttgcgcagccagttctgtcttatctctctccagggcttcaatttgctttgccatctgttccatcctggcggcttgcgctgttttgaaattcagatggttgaggatatagttatgccagtttaaactgatgaaactgatctagagattaccttttgatgaaccactcagctcataatttgactcttggagctgagcaattcggtcccttaattctttctccgtcttcttggcaagctccttggtctcatgcagctggtccctaactgcttctagagttcccaaatgaggaaccagcttttccaaagttgtggtcttggcctcattgcgaagatggattctctgcatgatggatcatggttcagttctgctaaaaagaaaacaaagttactgaaggctgtcgctcggaagacttacatttacaatacgagtggcctctccaagcgctttcttcagctggcacacttcttcatcttctttctgacggtttatgactataccggcggcttgtgagttctcgtcccaccatttgatcaaaataggaggacgagagtcgtcggttgcctttatgcgagggatttcttctccgtcatcacctgacggtcctgatgtgtttccaagacattagacggatacactgaggttatttaaatcgccattatttgagaagacaactaacctgaagatgtacctagctgagcgtgaggtgatctttgttctttacctgaagacccagctatcgagtcgttaccagcctctggtccttgtgaagccgtcgtctgcgctcctacttcggggatctcctgatcagggcctgcgtccgactggtttccagtcgggggctcttgagttgttgccgtttcagttgttgccgactggtttccagtcggcggcaggtcactcggattggccctatctcccgaagcatgggcgccagtcggctggctttcagcagtcggctggttttcagtagtcagctcggggtccttggatatattctgctctgtcatggcaggatcggggtcttttccagatggatctatatcagatggtttcctgcaaagtattctttcagaatttagcatcattttcatgagagagcttaccaaagtgaaatcataccgagaggtcttatacctggaagatgttctaatttttggcattgcgcggccggccaattttttcctgggcatggtgcgctttgggggtttgttaggcgagcccttatccccagatttatcatcgtcgccttcatcatcatcaagcaccagtttcctcttgcgaggacccgtctgaccagttgatttggaggtctgaggttgcggatccggtctgatcgttggccctccacctccctgagcagtgtgttggcgaggagaccggcgctgagtgactggtggatctgacttcatcagtgcatattcctgaaccagatgcttccatagttagtcaactcagcatgaagacaaaattatgttctgatcatggtttgaggattttcgatacatacctgtggaggcggattgaacgcattatatggcacgactggcagctggtgtgagtagctgacgacgattgcatttgagaagattttatacatcctctccttcatgattctgaaatccagagagtctgattcttcacggttaggatcatacctgccgtcgaactcgaatgccgtgcgagatctctccttgattggcgctagtcggcatttgatgaagtgccgagtaatctgctctccttgcaagccttgctctttgagctttaacatgcgatccaacaattccaaggcttggactgcttcgtctccgattggaagggagttccaggtatcttggtatactggaggaagacaagagtacccgggaagagcaggctcaggattttggacatagaaccagtttgcgtgccagcctttgttcgaagtcttgaagggcatggagaaatatttttggctcagagttcccctcagttggaatcctgcccccccgactacacacggtttgttcttgtttggttggggcttgaggaaaaagatccggcggaatagggcaaagtgaggcttgatccccaaaaaggcttcacaagcatggacgaaattggcaatatgtacgatggaattcgggtttaggtgatgtaagctgattccatagaagttcaagatcccacggaaaaatcttgaggtcggaagagcaaaaccaccgtagaagaaatgcgagaagactacaatttcatgcgtatctggagatggaaatgcctcaccgtacgctggccgccacccgatgatctctttggctgggagaacaccatgcgccaccatctccttcagattctcctctgtcgcatcggacgccgcccattggccttcaaagctttctctctcttccgccatcgatttttctcaaatgtgctgatttgattcgagggatggcttgagagaggtgaggaattgaggtggtggatcacgggaaggattttgatgcacttttcggaggtggatttggccggagttgtgaaccctagttcgctggcgcagctttgcactgtagcagggagtggggaaaatggcgagagttccggcggggaagacgaagcgtcgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtgttatatgcctgttttcatggtaaatagtcattgcctaggctattcgacttatttattaccataatctttataatgcttgatgggtaatctttagagtttttatattcggatgcctgtcaagtgtgttcattcgtgaaccttttagagtgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttgggggctacacctaattaggtgcatctattcgatgcaccatgttttttatcttttcgccctttacagtccactcggcaggccttggcatgaaaagcttgaagcacttggattactatctttgagaaggctatgatggtcgactgcaaaggactcgggggctactgtggagattatgggtatcccatatctacacggcgacggtatttggattgggtaccggatacttaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttcccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacactccgttttaaaatgtttgacaccgttgactttttagcacatgtcggacagtccgtcttattcaaaaacttttgggaaatatgttaaattatatgcctacataaaaatatatttaactatgaatcaaatgatagaaaaagaattaataattacttaaatttgttgaataagacgaacggtcaaacatgtgctaaaaagtcaacggcgtcaaatatttcgaaacggatggagtaatattttgtcggatcaaatacgttgtacgatatactccctccatcatataaaaatgtaaggtacagtcaccgcaaatgtaaagattaaaaaaaattatcacttttttaattgcctcaatagaaacacgcatatacccaatataattagagattttaaaagtggaggatttttaaaaatgaatttagaggagaggaatgtgctagttaattgtatgcatatatgtgcgctgaaaacattaaaaaggagggtgagattgtaccttatatttatgttgggatatcgatggagggaatatatactagtttgcccaattctttcgaaatgatgcaattccttccaagagtagttagtcactagtttggtactatttgataaacaattaaacaaactatggatgcctttgtacatttttttcggtaagtatacagtagatgctttatttttcacattgtcatcattcttttcttttcaattacactacttgcaagttggcgatcacgcatgcatgcatatgtagttactaggatataggttactttactaaaagctatatgtgatgggttcagtaatttagttttcatgctgattggtggaaggctatagtggtatttagattcatgacgttcttgactgatcggagtgttctattaccacaggcaaatgcacgtgcatgtgccacctggtcttgaagatgtcaaattgtgacttgattggcctctgacttgttcgtatgcacacgtgcatgcagacttctaattaggtaatcggcgcaaataagctactactcgggcacctccaatgtttatgaccataagtagcattaaggtgggtcccactattcttagggttattaccacaatgtttgaagcaagagtaaactttaagatgggtcccacaatgtactattctagtaatttttttatcagccgtaccaatttttcatcctcatatctattttaccccattattttattgcttgtggtcaagccataagcttaaagctttcttttgcatttaatgacttatgactttgtttcacaatgtatatggtcactataaaaccttatggcctcttcttatggccacattgtggctgcctagggacatttatatttatactagaaaaatgcccgtgcgttgcaacgggtgaagtctattttaatcttattattgttatatggttaagttaagatgaaatttaatgtggaatttcgcttggatatatatttttagaaaatcaagagctccaattagtagttcgatcttctcaagttagcatgcgagttttttaaaacatattttttatatgattccttatgtattaaaaaccgatcttaaaaaccgactcaaatacggatatgtattttcaaaagcaaacaaacttaaaaactgactcatacacgaatgacataccaaaatatcggcaaaaacatctttaatttttataatagtagagatagagatatcctttttagaaacatagtacaaacatcagcactcactatgtatgcacacttacccttacgaatacatacacatcctatcattacgagcacatccgaaaaattagaccgtccggtatattttgagaccgatgaagtcactatgggtaccctgccatggacgggtacatcgccgatcactactactataaacacacatatacaaactatattcttatgagcacctctaaaaaattaaattaggctggtacatctttgagtgcctcctgttgacaagtatgtcatccaccactaaaaaaataaggaaaaaaatctaaattatccctgaactatcatggcagaacaaattaccacctcaattcaaaaactagacattctttaccctcaattttttatactagacgaattatctcctgactgactccggaacggttttggtcttatgtggcgcacatgtggaagtctagtcagcataaaaaataaaaaatgatgtgacccacttgtcaattttgcctcttctctcggtcactagatgtgagccctaccttttttatattttttattactgactggactaccacataagtttcacgtaggaccaaaactgctctgaagtatatcagggggtaattcgtccggtataaaaatttgagggtgaagaatgtcttacactaaactatctggtttagtatctggtttttgaattgagggggccagataattcgtaccttcacaataatttagggattaattcggcctttttcaaaaaaaaaaatgtaaatgcgagcacctacgtcaagttattgaaccaggtgcaggtacattttattgtattttgaggtgcgcacatacattttattttacttcgcttgaatttattttgaggtgcacatacattttattttaacctttttaatacaaattttatttgacaatgaacgatcaacagatagcttattttgaacataacctttagtaagccacaccgcatgataagatgacgcatcaactcacactggtgaaagaagaatgccatttttggcttttcagagtgtttgcgttgtactatgtaattctcaaaaaagaaaaagtgaaataagttgtaattctgaacatgaaatcctttacaacaaacctaggtaagctagcaatattggtgtaacaacggtaacatttgttatgaaaaaaaactggatatatctatctgatattgtcaaaacttatactttaaatgaaaactatataccctgtccgttttctaagttgatgacaccgttgactttttatatgatgtttgactattctcatatttaaaaaatttatataaatatcagttattttgttgtgatatatatgttttaacattaaaggaaatttaggtgtgatactttaagcatatttacacaatttttctaataagatgaatggctaaatattattttaaaagtataatagcatcatctattaaaaacaaaggtattagattgccgtgttttaactgtatacattgtatatgttgtcatacatttcttttctgaccatagaaaagtattgcttcctccatcccaaaatataataacttatagcgtttaaaagttgtaataaaatataaaaacttatatatacctttctcaaccaatcacaactttctacctttcgaattaattttccaccaatttccttttcccaactattcacaacattctcttatttaattctacatactttcttataggcatatttaaacctaaaactcttcgcatttaggaaagaggtggtattaagcagctaatgatatatatatgtgtaaacaagtgtgagaagagccaccagtttcagaagacaccagccgactacagcagccacagtgaatcgaaccagaagaaattaactagcgcttctgatgcatgcacagtggtgtcgtcgatcgatcgatctgcccagcctcctctataaataacagtacgtagcaacaacacatctacacccctccagctgctacctcgatcatcatttgtgcactatagctagagaaacatattgtaaccagctaggccagcccaatcaatggcgtccgccgcggctaagattgccgtcgtctgtctggtggttttgtccgtggggcagtccatgatgatgacggcggcggcaactactgccgccaccggcgccacgacgtgcaactgcgacacaagcggttgctacaattgcatgctggatgtcgtcaccaactggtgcaaaggcagagatttcaactggatggtgttcaccgcctgcttgatcaaatactccaaggaaaaccagtgcttcagcaagtaatagacttatcggagctagccgacatacgccgatctatcgtttgacgcgtacgacatatatctatttctattatctattatctatttctattatctattatctattatctatctattctattatctatctatctatctatctatctatctatctattctattatttatatctattatctatttctattatctattatctattatctattatctatcgattttgctatatatttatcgacaaatttttccccaaaaatttgacggatgtaattacagtacaatcgtagtgtaattacactgtaacttgcatgtaattacactgtaactatagtgtaacttgtatgtaactttcaaaaatctttccgcaacatgttatttcggtaaaatggaggtcgtgggaacaaattctttcatatatgtgtgtgctatgatttgttttcttcctcaccaaaacaaatcttgtgatagatctaacgattcaaaattatgtgaaacttacaagtcacagtgtagttacatgcaagttacagtgtaattggatataagttacagtgtaattacgttacgattgtactataattacatctgtcaaatttttggggaaaaatttgtcgataaatgtataggcagtcccattatctattacttcctccgtattttaatgtatgacgccgttgactttttgacaaacgtttgacctttcgtcttattaaaaaaattatgtaattataatttattttattgtgacttgatttatcatcaaaggttctttaaggatgacataagtatttttatatttgcataaaatttttgaataagtcgagtggtcaatcattggttaaaaagtcaacggcgtcatacattaaaatatggagggagtatatatatactacttaaaaagtataagatgcttccttcgtccatataataaaaaaatccgcttctgattaaaaaaacaccgttcataagaaaacagcgtgaaaaaaaaggccttctagaaaacggcatcggtaaaaaaaccccgcaaaaaaagtaacccccacacgcggcaaaacgccgttaggaagaaagacggaaaaaagaaaagaaattttgattccgatttaaaaaaaaccgtccccaagaaaacggcgaaaaaaacatctagaaacggcgtcagtaaaatatccggcaaaaaaggaaaaaaaaaaaaggccagaacactatcagcaagaaaaacggcggaataaaagaagagagaaaagcaaaaaaaaaatagacaaagagaatcttaactaattaaaaatttggtagctttcgatcatcacatcgatttttagtccgtactaccattttccgtccgttcgcaacatcgcgcgcaccttttctccaaatcccacataatcaaaatccaagtccaaccaaaaacataatctcaatccaaatccaaatccaaatctaaatcggaatcatcacaaaatcatccaaaatattaagagatgttgagaggagatggaggggcgagcgggaggccaccgttcctcctccgccgtcccgtcattgcatcggggatcagccgagccgccactgtgtcgctagggagccggggagtagccgcggttgcgttgggaagtcgctggctcgcctctgcgccaggaagatgctgggagggagagggaggagccaatcctgagccaccatgccgccggggagccaccgacttgctggatctggcgaggagtgggatggcagcagcaccccgacgaggaggaattaaaggagccaatggttagggggggagggagggggagcggcaccgcgggagaaaggagggcatggagaggcaccaccggtgggggaggggcgtggagaggcgccaccggtggggaaggggcagctcgcggtgggaggagtagcgtcgttggtggggagagaggaggggcgccgctggtaggggacagaggcggcctgcggtgaggggagggaggggaaaatgaattagggttagggattttttaaccgcgacgattttgatggattcaaaatcgatctgagccgtccatcaaaacgaacggctcagatcgatcccgtgttgggccagcctccatctttaggccgcatcactgctacgcagcacgctggccggctggtccaacaaagcacttaggttggactttcggttgggggccacacggcaatgagaggaggagtagggggagccaaattacacttcctgttgggccgaatgctttcctacaggttgagacggaggggaggagaagggataaaagcgggctgaaaatggcctagagaccaaggttgatttttttatttaaataaatgctgaaataatgcttgtactatcaaaattagctattaaactctagaaatttcaataaaattccaaatattgtaattaatcatggagacttcaataaaattaaatccaactatataattttatttcgcacactaaactaatttaattatatatctacctacttaaaaaataccaaatattttcggaaatttatatttcaattaattacataatacatatctttctcaaatttttctcaattttctagtctttacaattcctgttgcaacgcacggacacttttactagtaaatatatatatatatacatgcgtgtgtgcttgtatagttctgcaaaagaataaactcgatcaccagcgtgcggtgtgcgcttatatacacacacatatatatatatatatatatatatatatatatatatatataactacaatagggcaccttaaggtgccaccgattaaatggcacctgatacaacctcacaaccactctgccccacataccgccaccgaccacgcagcccgcatcacaccagattaatagtacatagttaaaagttaactcagtgttgtacaacatccatcacatattttacagtgtcgctattctcaattaagcaaaattttaactttattttttttcttcaggcatcattcaaaccacacactagcgggcgtcgtagcacagatcattagatggggttatttttaaactcaacaatctgtttttgatttatttatttttaattttccgacatttattctaaatgtttaattaaatgttttccatttttttattatttggattcaaacacttttttttatcatgcacgacaagacagttattatttaagtggaagggatttaggcattgtgtgtttcttttttttcggttacaatggtgtgcacacattgagttattatttaactcatcgaagcaactagatcacataatgagttttcagttatattttaactgttagcgacttaggcatgggttgtttatttaataatcgatgcggatgcacggcgagttatttcttaactcgacacgcaatgtattgttatttacgattcctttttttcccttgcagctacagtgcgaatagcagcgaatcttcagggtctagtcttttcaaaccatcggagttatcgtcttccccacattttacggccagttctttcttctccgtcgaccaagaagaactctccctcctctctcgccgcctctgccccggagatcgccggcgccgccgggattgattcccactgattttcttccacaagtcggccacaggtaaatgtgatatcccccgatttttatccgttgtgttatggatgctggtttcgtttccccatcccaaatcgaccgcaatctagggattcttcctaatgtatcgtcgctccctttaggaagggtgaagaggattcggttcgccgattcgcaaaccgcgtgtgaagttgtgttccacaggccatggtcagcggcgcaacttcttcatcaatggctggagatgaagcaacacataggaagccaaaaaggaagcggcgggctaagtcggccgatgaagacgcatcaggcgatgaggttagtacaaaactcagtcaatcttttgctacctttttttccagtgactattttgggcatatgttaattgatacaaatttactcatgttggggatccataccgcaacaggggagagcagggtgtgcgtagtttgcgtgcacaaatccatcatacgcgattataagttatttctttttactcttctttgtgtcacaatttcggataccctaggtgtatctatctacagcgctctgcaattgacttacctttaatttgatcagtcaagcgcatgggtatgtgttgttatttttcagtcaaattagcgatatcctttatgcatcaatagcttctttttttttttactataatgtgttatgcagtatatttcggttttcgtttgattcccacgacccacccacgggctcgtgccgactagaatgaggattggtccatctttttggttgcaaatatacgattcttttgttttcagttctgtctcgcatgtatgcgagtaatatactatattcacaatttttccttttcagtatacataacaataggcaaattgatttatgtgtttgtcatatgccgtttaatttttattttcatacatgtcagtgttatgcacaccatcttgtgtgtattcttttttttcttttttttgcaaacacttcataacactgccatttatagcctcgtctttccagtgaacatatcagataaaaaatcacatccttttatttttatttctagtgtcggcattgatatactagcaccattttttttggatttttattattcatgcttaatttcaataggtctatatttttgtttgcagccacccgaatcaaaggggcccaacctgacatgttgcagcgccacgttagcgtcggaggcttgtcgtgtgctgtccaatacacaccacgagaaattgggggaaatcgggctagacgccgtggcttgcatgacacttgaaagtctcaagaagaccaaccccgacacaatgtgtccttccattgatggtgaacggaagattcagatcacccctcgcaccgtgaagcttgtgatggggaccccattaggcggacatgatattgtaatcccacctaacaaggttgtgcgaagcgtgcacgacaggatcacacaagaattgggaattgcacggaatggtcggatctcagctaaaatgctgattgaagtgatcaagaaccagaaagacaacccctcggcagttcgtttcttagtcatggttcttatgtccaagctcctactcccaacaaccgacttttacatacccaagagtgatgtatgggttgccgctgacctcgatcgggtcgctgccatcgattggtcgaaggcagtgttccaagcactgagcgataccatcagatgttggcgacaaaagcccacatcgtcaatcacatcttgtgttgtatttttggtggtaagctattccgttaatttcatctattttacttctgtttctaacaattttattcattttatgcatacaaacctaggtttatacttccgtcatgaattttttttattctccatcatgatacttctttttgtacaggttcggttctgtatcttgacaacatcctcgacgtccgaatcaggtgggttgaggtcatcaatgtccgatggtggagatgggcgtggagttgacatgtacccaaaatcttcagcgaacatcgtgtcatctgcttccatcgagggcgacagcaggaatgggtctggggaaggcggtggtggctccgacacacgaaactcttcgggggagttcacatacctcctcacggtgctccgacgtggtattaacggacggagctggaacatgttcttcggaattagtcgctttggcggtagatgtttgggcaatctcatccatgggatgagttgggtctgtgttgggcacttgtgcagaagccgtgatagtcaagtttataaaagggaatgcaaaccttgcaaacagaaatcacgggatctgatccgtgctaatccagggagtaatcgaagatattttctagcggattagttagcttgtacgtacgtacaatcccgagattcgtggctacgcattatcacacaaattagcgaacccctaattatattatagttaaaaaaacatccatcgaatcatgcagggtacaaatcaacaaagttattttttaactcaataacctatacaccaaatccacgtcacaaccgtgtataagtcaaatattaactccatcaccataccatccttttaaaagtaaaactcttatctaacattaactaaaaataagtaaaaatttaactcttcgcgaacggaatcataacccacctccaaatgtacataagttaattattaacttcacactgggttgtttgctcgatggtgggattttcccaccgtgagtcgcgtcacgtttcttcctggcgcgcagcggctgtgagtagcgctaggtagcgctaccgtgtgtgtgtctatatatatatatatatatatacacacacacacacatgtgtaatatatgtatatatgtaatatatgtatatatgtatatatatatatacatacatatatgtatatatgtatatatgtatatatgtatatatgtatatatatatacatatatgtatatatgtatatatgtatatatatatgtatatatgtatatatgtatatatatatgtatatatgtatatatatatatatatatatgtatatatatatgtatatatgtatatatatactctgttcgtgtgtccatgtaccactagtcttgtgtttagtttctttttttttaacaaatcgtacgggacagtgaaaggttttatattgatagtaatcatgcacgtaataaccactgtgaattaaaccatccatattgcacttgcaatgcaagtttcccatgtaataatgaacacgtattcacatttaaaattcaaaaaccattataaaaaacataaatcattaactgatactatattgaaatgtagtctcgatatacaaataaataaatcatacgccgtctcccccccccccccttccccggtggccttctcctcctccccctgccccaggccccagctgttgccgcctcgtggcgaacgcgcgggtaggcgtgctcgctgccccatcctccttccccgcatcgtcgcctcgtcctccctccgccctgtagtccccgccggccgccgccaccgcctcccagcgcggcctctggcgccgcctggccagccctcccctgcgctcccctctccctctctctccaggtgttaaatatgttattcgaattttaggcatacaatatatttggataagttttctagtacgagtctttccccgggttctctgttgttctgtcagtagcaaaatttccggtattttttgcagcgtgcacatatccaaatatcaggagtcaagctttgcattgtagctattctgttcaagtgaattcaatttcacgttcaaaagtgctacattcacccgaggttgtgtgccatgagattttcagatgttgctacgcacacacaattttgtgtatatgaggtttgtacggagttcaagatactttgttttatgcacccaggcgtttcaagtggttcccaactccccctttcgttttccacgtgcacgcttttcaaactgctaaacggtgcatttttacaaaaagtttctatacgaaagttgcttaaataaaccatattgattcatttttttaaaaaaaatagctaatacttaattaatcacacgctaatggaccgctccattttccttgcgggagggattagtttccatcctcctaaaacgaacacagccctggagttctgataaatttactctttactaccttagagcatccccaggagatccttcatccggtcctccatccgatatatggtgtacgcgagatgaaaatggacctccagcagatacggcatccagtccgccaaatatggacgatgcgccaaagcgagcagatttcggccaaatatagcgattctctctcctcacgccatatctcaatgcccacatctcctgcccacattcggacttccgtcgcgacctcgcctccgtcgtcgccgttgctggccgcaagttgctgatgccaagtcgtcgcaagccgcaagctgccgccgcctcttaccagcctgtcgaccgcctgcgctgctcgccgtggagtgtggagaggagggtgtaggcatggagagggagagtaccaaatctagaaggagccgtgcggccgccgcctgccgccgttgcctcgcgcgttgtcgtcgcctcctgccgtcgccgttggtgggggcgaggacggagcgaagaggaagggcggcgcgagatgcaagacggcgggggcgaggtcgcgaggagccaaggaagcgaggacgacaggccagcggtggttggtggcgcactctagatgcgccgctccgccgccggcgcctctggatggcgatgcgccgctcccggcctccctcccgatctgtctgacttctctctctgcactctcttctctagggttagcagcttgggttgggcctgctggggacttggggagggattatggactattgattggatgggcctttttaacttcagaaattccgagaaattttccggaatgtttccgaccgattccgagttctgacggaaactgcgattatcatattcgattccgtttccgagaaattccaaaaaatttccgaccggctgattccgtttccgaaaataggtccggaatccggaaaaattccgtaccgttttcacccctagtaaagaagaggaaataggaaataggaaataggaatagagtgaaaggaaaagagtagtagtagtagtagagaagaggaaataggaaataggaatagggtaaaaggaaataggaaataggaatattttttgctgtgtttttatgttcatttcattttatggatgatggtacgaatatataaaaaaatgtttccctcaattcaaatatatcaattaaaaaactatccattaaaaatatatccgttaaaatttactcgtttcaaaatattttcgcgataaataacaccgttaaaattaagttagttggaaatatacccttaaaatacaaatgtaaagttagttggaaagatattcctaaaatataggatgatgagatatggatgatgtaatatgaatgatctgttggagttggaagggatatcttttttggatgatactccatatggacatttggaggaccaaatatagatgagcggctgaggatgctcttatgttctgaaggcggtggtctctgaatccggcagaagtatgcgcatgacgtcattagcagtctacttgtacaacccaagaacattgtcttgtcacttgtgcaacatcagatccttgagaagcaaagaagctcaccctcaacaaaataacctcaaatttcaagcaaatgccgcaaatttcacttcataatcaactcagtaatttccaatctgaagagtaattgacattgacagtgcaatcaatgacgggcctgttagcaacccatattgaatacagctctttgtttggtggagaacataagaagaagaaaagagagataagttctataagggttctagaactacagggggtggaggtagaagttgagtttgagaaggaattgacaagcaacccattgtagtactacaatcacgattttcacgtgcgttggttccgcccgtctagaacccagcgtctgcgaaagtcacgattttttcgtgcgggagaggcacccgcacgtgtgggcgcttaagccacccacacgggaaaataaaaaatcaaaacaaaaaaaaccgtcgccgccgccgccactgccatcgtcatcgcccgcttcccacgccagatccgccgcccgctcccgtcgccgaccgaatacacccttcccctccgctggatctgcaaggggagggaggggaggggagggagtggccgcacgccgtcatcgtcacccgccgctgacgctgtcgcctccgcctgcgcccaccaccggatccgccgccctcatccctcccctccgccggatctgctaggggagggagggaaggggaggggagccaaagggagagggagggaggggccactcgccaccatcgtcgaccgccgccggatccaccgcccccatgcctcccctccgccggatctgcaaggggagggaggggccgcgcgccgccgtcgtcgcccgctatcgcccgattacgcccaccaccggatccgccgcccccatccctcccctccgccggatctgcaagtggaggggaacagaagggagagggacggaggggccgctcgccaccgtcgtccactgccgtccccatgcctcttctccgccagatgtgcgaggggaaggaggggccgcgcgccttcgtcgtcgcccgtcgccatgctgtcgcctccgcctgcgcccgccggatccgccgcccccatgcctcccatccgccggatctgcaaggggagggaggggagctgaagggagagggagggaggggccgccgcgcgctatcgcccggcaccgccgctgtcgctgctgtgaggagaggagaggccgggaggagagaaggagtgggagagttaaggagtggggatgaggattatttttgcgtgcggggcgagtaaagaggcccgcacggcattttcgtgagcagttgagtaaagtggcccgcacgggataatgtgttttcccgtgcgggcgacagcctgttgccagtcccccgattatcccatgtggtgacaattatggccagcctagaaacaaacaggtctagcgtccaggaaaatatttcatgtagtagtgttggcctctaggtcgccgccgccgccaccgccgccgccgtcgtcggttcttctgttgatcaatgcccctcgatggttgctgcagctttcgttttgtattctcttgatccaagcctccacggggcatgggggaatttatacaagactcggtgctgttgttgcacttctcccatcacatacacccaatgaagccatgctactctactcattcaatttcaatcttaaaaaaatagtaattaagaatgtattagtacatgaggatattgtaggctgcgataaacacatatagtacacggattggataagttaaaacactattcgaaggtatgagcggtgctcggggttaactacttagctatgggagggacggaccgggtattgcttggggtatgaagcgtgatgtagttccaattgaaaactaatacccttcttctagcatagtacatcattcaatagaatacttaacaatgagcctagatggtatcaagcattgtgaaagactagatgatgccccagcgctttgctgtgggatatatgttagatattggagaaatgatggaatgatttggattgaaatattataaaatgatttgagaatgatgatttaacatgtgtatgattagttttagaatgaaataaattgtaggcataattattatattcttgcatgttaagctttgtgtgcttaataggttgatgtggcacgcttgcatgtaggttttaggagtgataataaatactatgcttgcatgttgagcttttggtgtttagtgggcattagctttattgaaagaagtgatttgaataaacaatagcaaaataaatgaatcacaccttataatcttcatggactatgtacattgttgataccattacatatcgtgttttgttaatttgcttccagagtatatatactatatctaaaagatagtggtggaggtgaccaatgacatgtgggtcatgatgtctgattacatatcgtgttttgttaatttgcttctagagtatatatactatatctaaaagatagtggtggaggtgaccaatgacatgtgggtcatgatatcagagtacttagctatttttttccttacttgtgtagagtagttatgtagtctgtaactcgattgattaatcttgtttcaaccaagtacttcctccgtttcatattataagattttctagtattgtccacattcatatatgttaatgaatctagacatatatacatgtttagattcattaacatctatataaatattggcaatgttagaaagtcttataatatgaaacggatgaagtagaaactaatatttttttaacaaggacattactgctgtcacacacaggtatttagctagcgttgcatataaaacatagtttacaatgatagtcccaaaaattttgcaggtttgccttatggagggcagtcgggtgtcgttactcattctagttgcagcacagtgtgagatcgttttgtattcgaactagcatgtttttttcctattcgatctaatctatgtttggaacacatgaatttctcgtagaatttatggaaactttcattttaaataatcctactggacataactaataagaaattttcaacgatctgatgatgccatcgtagtactaggcagagtagttatcattgataggtcacaggagtgctcaatatttcgactctaatatgttagactaccgttgacaagatgtagagatcaaccgaatgaagcagccattaaaaaaagggaatatgtaaagcgatttaaaagcctaggcttacactacaatggaaaaaaaaacatctctaaattcaactttcaagattcaaatttggtcgcggttaataaaccaacaaccagataatgagatccacagcaaaaccaagacaagttcgtcaaaggagtataagtttggattcactcaacatagagccttgcccttgctatggtatattgttgatgtgcaagtgagctgcacattctctcaacatctggcatagaaaccacctttgcgcaactacaaattgccactgcctttgtatccttcacctagctgaaaaggatatgaaaataataggttaatccccttccataagatgtttctagtccactccaactcggtttgcactaagaattacctggttttgacaccatacttcccttaactctgttcttcgcaagggatgcagaccatcttggcggatggggatatagactagttccaatagcttcatcttggattgtgcgaaagaaaagaagccaatccacatcttgactatcgaacgaacaaactggagtaccatttacagaagcaattccaagtggaaccaggcttttgtaagatgtttcttgagcaagatatttcaaaacctacacagttcaaacgatttttcagtcagtgatgaagaagggtataaaacaccttatgttttagtttagtagtggataaactgtcagtatatcacacatattaccaagctgtctagtcaatatcattcaaacttttcagaaaaaaattaacctgtgctgcccacttaggtaaggtcatcaagacttcaaaagtggaagctccagaagccacggacattgaagtcaacggctcagctgaagatggcccatcctcgctaaccgagacaacacgaactaactggcggctctcaataagttcttttttaatatgcttctccaaaagctacataatgccatgaaacaacatatgacattgcaaatatcaaactgaagactaaaaaatgctccataattacaaaaacaataccttatcatcaaaacaggtctgtggactgccagaaagaagcagtgacacatgggaagaactagatgttgtgatatcacaacatattgtaaccatcccgtccaacagagttgaatcaacatgaagaggaggagcagcgctgcaaagagaaatgttgtgagcagaaacaagctaaaaattttatagtaatcgtgcaagcaaccatgcataactgcaaataagaataagaagcataactttataaaagttaaaatatgattacaaaaggatacaggttaaatactctacggcactttagtttacattttacaagacacaccaataaaagcatttataatttatgttaccattaagttttgtctttagtctataggaaatgttacctcagttaacctttaaattatactagcagcaaaatacaagttagctcactgagacaacatcagtttgagctttaaatatttctgtggcatagaaaattatgatatgattactgaagcaaggacacaggcacaaacataacacacacatgagcaatagtatttaagatacaacaggttgtgagatattgaatatgtattatatagcagcggaagatacctgactctatcctggagtttgcaccatcgaaactgaaaaaaggagagaagaaaatcaaacattaacaaggccctaccaacaattttactacttgcataatttttcttgtccaatttaatagaaaaaaatggacagagaatatgaaaagtatgtgccatattatcttgttcctaaattcatggtacataaaatttacatacaatggtactagcaaaataccattgtattgcaaaaatcaacaaatatacaagttccaattttaaaatttgtatatatttcatgaaaaaacaaatacatttgcaatcctacatcaatcaaaaaataaatccacaaatcagaagatcctaccaaacaaaataggaggtggtgggaaggcacacccaccagtcaccaccaccactactaagtttttcgatgtgggtatgctgcatagtctaaaatgaatatttacaactcagaaagtgagactccaactaaactacatcgagcttcattccatcaccatacaagtatggactttagaacctagccccggcccaccagcttgtataaggtgcttagcaatactggccggtggccactagcatgttacttatgatgcagcagtatttctgatttgtaagttagcatcatgtacttcattactccaataacctagcacttctacaaaataggtctttggggtaatactctatttagaactcagcactaattaattagacatagaaaataaaaggcagcaacacatggtaactagaagaggatttgacacatacttcaatattgagaagagcattcaaaccatcctctagtgagttcaatagagatgaatcctgtaaaagagatggaagtacaatcattgatttggaataagaaaaatgccatattttagaagaaaaatataggcatgatcgcttaaacttacaagggtgcaatgtgctccacaaataagaagcttcaagttcacatcttcatcatatatctttatgtctggaaaatattccgaggtatcttcttcctcggctatttcgtttccaggaggggtgatatatatccttggagcatccccaagtagatgaggcccaagcataagacgttgcacctcattatttcttacacaatacagttgaaaagtagcatatgcaacctgaaatgcatcccatgcatggctacaggagctacaaacaggaatacacaattattggataaagaaacaaaacttaatggcttacaatatattcaacaaatgcaagacggatatgatacctctgaacaactgacatcaaggaatggcgaaaatgagatgctgcatacgatgataatgaatatctccaatacattatatatgaaataccctagcaatgaaagagtgtgaaaattgcaaatctgaaattagaaataagattccgaagtataatagcacattaggaattgtattttgggtggggggggggaaagcttagtaaaactacccaaaaaaaatgtaaattagtaatcagaatgtggaaaaatggacagtgattgcagacattaaaagcatgtaattatataaaatttccatcaatagaaccacactatgccaatcaaaacaagttataacacatgcagtttagtagtaattgttttatggaaactaatctctataatactccacaagaaaatgattttttaaccaataaatagggacatttggatatcgcatcgcaacaagcagatacccacctgtggcaaaaggagatttgcagcaataagcaatctacaagctcaaacgtaaataagaaacagctaattgaaaatatcataaaacagactaccttcgattgaagagattgagcaatcttttctccacttggaacttccaaataaacctgtattatagcttaaaaggtaatatgagtagctacaaggaagaagactaaggaaaaattggaaaaaaaaaactttcactaaactaaacaggaaaataggcagagaggaaggttaaaaagaaatttaattgttagtagctacaagtcagacaaatatatctggaatatataaacaaggttacaagagttaaaaaaaacaaaaaccaaaatatgtaattttaaagggccaattagttaatctctaaattggcccttaaaacacaatcaacctcaataacaaagggagcctggatgcatgcatttatgaactattccctctgcataactatatcggccgtgtatttttctcgcattaaaccaagaaacccaatgagatagcctaaatgcccatatttatggctccataagagtattgatgcaattgttgcctggctctaatcccagctgcatgcatgcatgaattaatcgtattatcgatcactcaattaaaagatcaataccgtatgctaagagcagtgataactacattagcaagcactctagcacccaaattatacaaattggcaaacttcatcagcaaacactaataactaaaatggatcagtaaaccaaacatgtaaagaagcatattggctatatagactgcagcgctaaaagaagcatagtccaggtgctattgggagctgaagcaccaagcagccaaacatcagtgctctaaaaatcggtgctaggcgcctattagccgcctgggattaggcattacattgtgtactagacggctagccatccttaggtgctcttgtgcgatctaatttagtgttgtactgtctaatttttatgtaatatgcttgctaatttcctaggcgccagccctgcagacactctagggctattgtattgtctaacatttgctagtttaagttagacatgataaaatgtatagtacatagaaaatcagcagagtttagtgcatacaatggtaggaaaaggcggacgaatgagtgaactaagtatctgtggatcagatacatcagcatcgcgccagacaagtgtaccaatttcttcttcgttgtcaagctgctgaccccggaggtacatgaagcggggttgcaaagcacgttgtgcctccagaaattcatcaactgtagggttaatcagcgtgtgcacctgcatgcccagctttccaagttcagaactgacaaacaaaatatatgtacttaagagcaagtttaatagtagatctaactactagatataagctaatcaaaaagtagcattagggctcacatgtgtaacagattagttataaggttgtctctaattttcttctctctctttttctcatttatataattaatgcatttatcgtagacaggggtggagctatcaaaaatatcattgaggtcactcttcacataccatggtgcaaatgccaattctaagagtaatttattagttccaagcatatttaataatataattagcaaaaataattggtgtcatcagtaaccatacactggatccgcccctgatcttagagcatgtgtatagctaactttttatacacaagagcttaacactttttattctccaggttatctctcctccacataggtttatactagatggattatagcctacaattaaacttgctccttaacaaaaataaacagcaaaaggatacttacctccaacctcccggacgagatcaactccgggaatgggtacgatggccgctgctgctgggacccaggcaccggacaaggtggcgcccgctgcttgcctaccttcccacacagcactgcaagcaccgtgcacttcacccttgagccgctagggaaatgaggcatggttgaaaacctgcaagggtttgcacccatagcaacagcagatcgatcagacctccacaatagttctccacccgaaaccaacaaggaacacaaaaggaaccgagcaaatcaaacgaataccccagatcggatcgagcagcgaaaatgggatcgagcagagaaaatcggatcgagcggatctaagctaacaggagaccaaaaccgactgccacaactcggaatcgggactcctgagccgctaggacgccggtggaagcgctcgatccatttggtggtggcggcggcggaggaggaggaaagggtggagctgggatatgggggcgagaatgcaacggaaccctaggtttcctctcggtctcggatcatttaatagagccaaaaatgaaggggaaaacgccgattaatccccagaagcgaagcaaaaaaggcaaaatcgtaacggcaaaaaaaaaaaaaatcgattggccgggagggacgaaccgctcgaggcactggagatcgaacgatgcacggaaacgtgattttccccaattcctcacatttgctacggctgctgctggcctgctgatgctgatgctgatgacgacgacgatgattcatagcttgcggagagaaaaacaaaaaacatgtcggattaaattagctttctcgcagcaggatttggaaggagaattggagagaaaaattaaaaccgaatttgttctgtgcttttctgggcgcatacctcgatcagctttgattatctgctgctgcggctgctactgcttttgggttttttcggccgcatccatttcgatcggatcggatgcgtcgcaggcccgggtgttgttgtgtttggctcatggcattggctccggaggagggattttgggaggaatcgggatcgcacggcaggtctccgggcgggagacgtgcgagcggaggcgccatgttggattgcttcgaggggtgatggtgcgtccagtactccagttcctgcatgttcgtccggctcttgatatttcgatgacaagagtgcgaatgaacaaatgcgagcggaagggagatggggatggttgatgcgcgggcggtcgcgcaccagctcgatcagtttccccctctagtcttttccctctctctctataagtatattgatacgtatatacacgtacacatacaaactttatacttcctccgtttcacaatgtaagtcattctagcatttcccacttcatattaatatgtttagattcattaacatcaatatgaatatgtgaaatgctagaatgacttgtattatgaaacaaaggaagtattttactagaaaagatactagtgcgttgcaacaggtgaagattattttaatcttgttattgtcatacagtttaattgctgtgaaatttattgtagaaattcgcctggatatatatatatatatatatatatatatatatatatatatatatatatatatatatatatatatatattaaaaaaagcgaacttatttccaaaagcgaacttaaaaacggactcatacacggatgatgtactaaagtaccggtaaaaacatcttcaatttttataatagtagagatgtgtgtatagataaaataaaccgaaagatacttatatatttaaaaactgaaataactgaaacaaaaccgaaagaaaactgaaaaaagaaaaggaaaaatcgactcttcccacgcgctccatgagagagaatctgacttagaccctgtttctttccgcttaagattattataatctagattattgagttagattactataagctagattgttataatctgtagtagaataaccggttagttgtttctttcctagattatttgggtttgcaagtctaaagagggagtggggtgacatggtgggtaatttttcacccaataatctagaaaaagctcacctaaatgagtttatcatattataataagctgggctccagattataataagctacttcaataagttgtctgtttctttcagcttactcccaataatctggattataataatcccaagctgaaagaaacagggccttatatgcgagggccgactaaatagcttttttctttaacttattttgaaactagtatggtgactcatcgttataatttttctcacataatagcatttttttcatattttatttttaaaatatattaaaatggtaataggattttaaattactagcaacatgtatgtgcgttgcaacggatgaaactaatattaatataaacaacaaataaatactaaaattaaaatttaagtgtcacaacataacgttacggaagaatttaattttttggctaaatttcttattggccacatttggacaaaaaaaaatcaaagtgcaaaaatattcctaaatggtaactccgttgggccaagaaaataaaggaaataattcctgcgagcctgacctgaaggcctacgaacattttaattggtcgatcacggttgacagggggagcaggttggtttttctttggagttcatgtctagggttttccctgcgaaattttttatatttttttagatatttttatgttttaattttattaatagaccattctaaaaaatatttttaaatctggaccttttggcccgcacgtggccaaataactctgtcacgccgcgtgcagcgggcatgacaattttatcctaccacgccagcgagagcggcatggccagataacactgtcaagccaacgacgccggcgtggccaaataacgctatcactccagcgggagcggcatgtcacgcccagaaattcactagtaatttccaaacttatttgtgcattaaatcctcatccagaaatcagccgaggtacacaaactgacaatttaatatacagattcatcaagttaactaaaacgataaatacttacataagaggcacttagtcctcaccacgaagaaaactgcagcggaaaataaaatctagcgaagctccggctccactcccacaggcagctcaactagggtataagccaaacatcttctccttcgtaacttttcttcaactgaggtttgattgattattacaaggtgagtacatggaatactccgcaagccacacagcaaatatgcaagtgcacaaggataccaaaggatgacataatatagggctcatttgcaaaagcagcatttagcaaacatttaagaattgtaaaacagtagagtaattaatcatcaatattaatcaacactgaacagcacacccatgctgcacaggcccaaccatcctgaacaaccatacccggctgtacagatctatctccaaaccaggaataaaccattcaaaaccaggagctaatcaaattattaccagttatagcatcatttattatgatgaaaagtgtgagactaatcacgaaagacattgttagacctgcctataaccgcgggcacggctattcgaatagttttactctggccagaggtgtaccactgtacccacaagacacgattccacacatgttaccatgccctgaagtaccaccacgccactgcaaagggggaaatcgtgacagtacccttcgcacaacacaactcaaagcagtgcaccgttcctggatcataatcacccccttataaacacaaggcatggactccccagcgacccccgtgggcttatctccgccacttctcagtctggtgccccgcaatgaaccatgctatacaaaagataaagttgttgcccatactggcttgtggtttgcacggttaatgtttcacaaccgaaactcgtgaaccagtccttaattgtcatgagcacgaccagcaaaaccatgtgctcacaacccacatttatcaagttttagttggcaaattaattaattaaccaatcatgattagccatcgtgagctaccattatcatgtccatcattaagtagtagtgaaacattagttatcccaatagtgtgctaatgtttctaagcatggctaagcaattatatctaatatatctagctgaaccaatatataaagctcaactagtcaaattgtaacccaaggtatcaaaggacagagtaatcaatacaaagtggccataacaaaggtatagtttcacaccaaccggtgacattcgaaaatagacctttccaaaaaatattttcaaaactgaacctggc

SEQ ID NO: 82522 - DNA, 6548 bp, Oryza sativa
aaaccgggagtataggggggttaccaactgggaggaaaaacactttctccactagtggttaaacgataatttagaaataaataagtggttccatttcaaagcatgattttatctaatttcttttctatgtgatgattcaattctctgatgctgctggagacagacaggatcagaaatggaagtttgggcaagaaaaccccggcagctaagccagcctaagtttacgtacgtggaacagtatccatgcatcgtgtttgatgattgattcttttaattatcattgcggatttggctcactccgaacgaaatccatccaaattataaactcgtggagaggtagacatgcaggcctgcagttgcaggacacatcgatcgatcggcctgattaaaatccgagacaatgtcaagcgattagtactactccatgtcccatcaattttgatcctgacgaactaatcaacttctcttattacggttaacaaaatcatcaacttatacctttgtccttttcactgtgcgttatttgcaaaacaaatccgagacaagctcaagcaatcgatccatgtaggagtttctggcgccaattaagagaaaaatactgaagtagccgacttgagatagcggaaaaattcaaagattatggataatccgatttctttttctaatagctatttgaggctatggacgactgaattaactactgcaaaggtaattaaaattgttgctttagaaagaaacttgctgggtggcccgcgcaattgcgcggctagcacccatataaaattatatattttttaatatgattttacttaaaaattattaaatagttatctcgttgtcttaagattttgaaagaccaaaccttatcatcctcgtcttatcattctcgtgtttctaattttatagtttttaaaagtcacaccagtggctaccccttacttctgtcatattattctttgttagcttgctcgatctatcaccgtttctattcattcttagaaacctttaaaaattggaagtctttttaaaaattggatgttaagacttatagtttttagagtttattgtcctgttgggcttcttttgtataatttccagaaagcctgtcaaacgttgtcattatactcctctacgaccgtccactgcatcttctctttattgtcattgctattttaaaaatcgaacataattatcgtttaggttcatttttctaccttatagaagtttcgccaaaacgttagcgactttgtcactgtactcctctatgactccctgttgccgctcttctttattgtcattgagattttaaaatcaaatatgattatcattagggtttatttttttactttttagaagcccgaaccattaaaaatttgaccttatagtttttagagtttattgtcgcattgggttcatgttttttataatttttagaaatcccgtcaaacgctgccgtcctttacgacccgtccgccgcgtactctttagtgtcattgggattgtaaaaatcgaacataacttttattgaaatttatttttcaatttctagaagacccaccaacaattggcggctctgttattgtactcctatacgacccgcttgctgcctctcatttttattgtaattgagatttcaaaaatcaaatatgattatcattagggtttattttttttactttctagaagttcctgccaaccgccttgaccgattggttcacgatctatttgtcatccttccttttaatcgtcattaggattctatttggtgttttattaatagtttttagaagtctcatcaaccgccaccactctgctcctctatcggcatgttacttaattaatctcgtcatgtgttttagattgtcttttttttcaatagttttattttctttatcaccaatattagttatttataaattgtatttcttgttgaaatcttatttttctttttctaatttcagaatttattttatttttcgtattgtgttcttctgatattttttattttttattttcaatttcagttgtttcaaaattgtattcctactttaactctctttttaatttgcctaatttcggatttttattttattctttattctaaattttaattaatctactattgggttcttataaatactcttatttcgatattgcttatatttaattccgaatttcagttaattttaaattgtattcctactttgaactcttctattcttttttataatttgatttttttattttttattctgaattttaattaatctcgtagtggattcttgtatggatttttcttttaatattccttatttgtaattccaaattttagttatttttaaattatattcctacttgggctcttcattttttctaattttggtttttattttatttttatttcgattttgattaatctcgtgttgggttcttatatggactcatctttcaatattgcttactccgtttgaatcttaagaacatgtcaatatatttttgccaatcactttgcattgcttaatatatttatcatattttattcagtcatagatggacggggaattctgtaattagttttgtattctaattatctattcggctccaacacataatatatgcatgcaacgtgcatgtccgattcctcatcaatgaaaatattgtaattacttctcagtttcctattaggactgaataagttaagcttagagcagtagtttctattcatattcatattcttcaaattaatctacaccgttaaaatctagtcagtttgtgatctaacggtttaatattttttgttttttctctgattaatgtgagaatttctagcccccatagcgaacgtggtgtctcctttcaaagttgttttaataatataatagattccaaaaaaaattaaaatagagcaaatgaaaatccgaatccattcatgtagagtcttttgttgctttagaaaagaacatgtccttttttcactccattcatgtagagtcttttgttttttcactgcagtaaaaagacaagagggagaagaactgaagaaaaagaaagaaagaaagaaagaacagctaggtgaacaggtgacaggtgaatcactttactctgaatcctggaacacgaagaggtgctaggctgcatcgatcagagacgcaaacccaggcagcaacgtaaattagcctgcgaggcgtacgtggctgccttgcccgcatgcgtgcaaactgtatgtgcctctaaaattaactgaccgggttgaagagcatgcaggcatgtgcagcccgggcaggcaaagtacagagcctctcgagtctcgatctccaggcagaaacagggagagagagagagagatgcaatgcaaccatgcaagtgaagtgactgaaatctgcatcctcttgatcgattgattactctgcaattatattatagtccattgtttgggtgtgtttaattagtttcacgctaaaattgaaagtttgaagaaaaaagttgaaagtttatgtgtgtagaaaagttttgatgtgatgaaaaagttgaaagtttgaagaaaaagttgggaactaaacaacggctttgttccaagcaaggagcattgcaagctcatctcgtctgactgtctgacgaagagagaaaaaatagatttgatttttaagctgaagatgcatgttagtagtatgaaattggaacaggaggtgtttgtgtgtgtatatgtgcaaatccaatttggctggatttatattacatttggatatatgatcttgtattttggggtggtttggttggtagctctgcaatgattgcagtcgaggttgatctgggagctgaacttgaatgggatgcaggtgttgtctcatttgggaagccatgcatgcatgagcaaagctgatgatgagatgataccactcaccatcatttagaagattatcattattattactattaaataatctgatctgattggatagtatgcaaggcatatataggttttcaactaaaattgcagtaaaataatgtattcttttcgtctccattgacacctgtaatttggagtgatgtgctcctgtctcctgtatctatatactcctatctgtaacctgttcagaaatatagttaattaggtgctccacttgttaatacatccgaataaggcaagtatgcagatgatgtttttggactactgtattgtaccagtctcaagtacaggtatagatgattccagagaaaaggtatgtcatgtctgtactctgtaccctgttcaaattacgtcatggaaattcagaaagattagtgttttccatttgaatattgttgtcacttgcctaaggccaagccaaatggctgtatgcctgtatttgtacatacagttggataatgttcatggtgtgttagtttgggactagtgaaaaatgaatccccattccccatataatttcaagcaataattaagaattactctattttataaaaaaaataagttcgtgttcgatcatgacatcatttatgtctaccgtacacccaattttctgatggaggtagcaactggcaatataaatggatgcgatatgaatgtggtcgggatggcaggagcagggtgctagcatgcttgtgccgggccaactacaaataaatactcctcggatcacaaatacttgcttgttagttctcacctaaaaatttactattactatacatccgtcataaatataatagattttgataatgtaattttgggatttttgaagtaaaaatttttcgattttgttaccatattgggttgcatcacatgactagtttacccaaaaagataagtaaggatggacaatttatttctatttgttgctctaatttttttcctctccttaattatcccacctttattttatctctaatcgatcgaaaatggttcactttactccgtaataatatttctcttttccctctctttattgaagttgtcttttaagactcaaatatttggagctatggattacataccactatcaaaattatttttcatgatcatttgcttgaaatatttctcttttttccttctttatacaagttgtattttaagcagaaaatttttagatatggattacaccataatcaaaattatttttcatgatcatttgcttgaaatatttctgtttttcccttctttatacgagttgtattttaagcaacaaatttttagatatggattacaccataatcaaaattatttttcatgaccatttgcttgatatttaaaattagtcttagactcttaggtgcttcgaactcatggaaacagtgacaaaaattataaaaaatgttaagacgtaataagttgtaatgcatctatcagcctaacataattccagtgcaaaatatggcttttatatatagagaaagaaaataccgttggagagttaatgcaaccgttttaaatagtttacggtataaaataaactgaaaaatggtttaggtggttaaccgttccggtgaaatagtaaaatagacatttcacttattttttattaaatatggaaaaataatactatattagtaaagaatggagatggatatttttcactcatctcacatatacaaacacaaaagtaaaaaggctagaatattcctattttatcaaatcccaatgtaacaattctcactctatctactcgcaatattattattctctactttcacaaactctgttgcaactattacggtaaaactgaatttatttttgggacagatgaaatgagttaaaaatgaacttaatatagagcctgtttggcacagctccagctccagctccagctccacccctcctggagctggagctcagccaaacagttttagctccaccaaaactggaagtggagctgggtggagctctctcacaaaataaactagagttgtgaagctccacaactctacttcagacttaactcttggagttaaatttaggagttagagctatcccatcgaacggaggaaggaagtaagtgttggaactgattaatggcgtttgtaattattctagatggagaggggtgtgtgtgtgtgtggcatggcagggcatggatccctcctcctcgccccagagacgcgccatccatgaccaatgatccccacacgcccaataatggccatgcactcatgccacccccgagcgcgcgccatcgcgtcgcgcgccatcgccatggtcgcgtcgcgtctctcctctccccgcttgcactgcagctcacgcgtcgcttttgaccatccccgccacgctgccccctcttcccgcgcgccctctctctacttatacctcccctcctcatctcgctagctacctacccacctccgcgtcgtcgtcgtcgtcgtcgagcgctcgatcgatcgccatggcagccagcgagcagagctccgagtcgtcgtcgacggcgtccacgtcgtcgtgcggcaagaaacagcaggtggccgggaagaggaagcgcgaggacgtcggcggcggcggggagcaggcggcggctgttgcttacaggggggtgaggatgagggcgtgggggaagtgggtgccg

SEQ ID NO: 82523 - DNA, 2207 bp, Oryza sativa
atcaaattaaaattactttcatacctcaaccataatttttcatccatccatccatccaaaccatccaaaaatcaacattaccacatatatggttaaaaaaatcgtgacaccaatgagtacattgcaaacatgtagcactacaacaaaccaatcctaagaacaaatgctaaaaatcacaaattcgggtaaaaaaggggttctagggttacccaccgatctacaaattcaaccaataaaaacaaaaaaaaagaggggtgaatgaaggagtctacctttctcttcgatttccacaaaaaaatcccgcgaaaaacgagttcaaatggagtggatttgaggtggggaggtgagagggagagagagggggagagctgctgctgctcagctcgggttggtgcttgggcgaaaatgggagtggggaggagataggtggtagggcccacggggtttaaggggtcggcccacagaggaggggcgcgccagccatgctggcgccgtggtatgaggggcggcgccagtgtggctggcgcccccattctgcccagtcagcacctccacgacagccctagtgccacggtggcacgggcacggcgccagtgtggctggcgccgccatgttggggtacggcgccagccactctggcgtcccaaaaaggaccatttccggtttaagttttttcaggggtctatttgtaaaataagttttcaaaaaggaccaaaatataaaaatttcagtgattttgctctgctacacaaaagatgcacacgtggttgactgatgctcattaatctgttcatctgccagaacattaaaagttcgaaagaattaatagtcgcataaataaagattacgatattaacccacacagtcgatcagcaatctcatgcttggaccaatcacataggcaatgatcgaggatttttgagccttcgagggaagagatttttcgtcgtgtttgataaggattttaccaaatgttcgtacttgtagccctgcagggagtacaagctaatgagctatagtagcaagtacaagtgcgtgttcgtcgtcgcggatgccctccggctttggaccggagttttgctgggtcgtcagccgacatgacgatgatgagttcaagtttaatatggagtactaagcctaaatcaattataaagttattcggagaatagaacttgaaaaattaaaatgattagctttcatataaaagctaactctctacgtatatatactcatttaaaagtctctagtggtggtgatagtaaatctggcactccaccacggtttatagtttttacaaatttaccaatgatattttctaatattatgaaacaatctaaatatttagttaaaacacgtgaataccatatattcaaaaatgcaaacaggtgatactccctcttttctatcgaatcggtcataaccactgcctacattccacaaaatagtgcaccacaagtaagcactaatgaataggcctgcgattccgtagaaagacatcacgaccccctgtagaaaaaaaagaatttgttgagatggaagtacagatataatattcttaccaagataactgaaagccccaaccactaagaatcctattgaacctagaaaaagaatacaggcccagaaaaaattacctcttacacaataattcttttgtctattacatattataatatattttattttgtccaaagcaaaggttgagtattttgctactatatttcaagataaatgcattaaatatgtatagctcatctactgtacatattaactctaatgtggatctatataattagctctactattacacttgctctaatgccccccccccccccaccaccaatcgtattaaactgttaactacgacagttgactatattaagagaagactttccaacactattacagaagctgttgcggtctctttacagggagaaagaagaggagagacctacggatcggacgtccgatcaggagaaaaaaatcggacgctcgtcccagccatcggatcgagggattaaatctcgaccattgatagcgcgtcgtcactgttcgatgcaaacttctcccgggcagctgcatgcatgcaacttttcccgcgcacagaattgcatatgtgacagggatagttaatgtcccgcgcacaaaagggcttcgattgtgggaagagggcagcgccagccaccgtggcgccagtgcctgggggg

SEQ ID NO: 82524 - DNA, 66130 bp, Oryza sativa
tcttattattggagcaagctgaacttccttctgtgtggtgaattcaaaaaaacgaagaaaacggtccttcacatagaaaacagtatctccactcacagagaaagctggacgttccctctccaatttaaacacaatcataccactgtcatgaccagcggcaagaagattcatctcagggtgagcagaaagaatccagaaacgatcatgttcccgcctgaacgtttgaataccggttcgctttgtggcatcccagatgcgaatgcttttgtcctctgagttggacacaatgatgtcttgcttagcatggaacatcacgcatgacacattattcatgtgtccccgcaaagtatcaacttcccaagccttcgtgtctgtccaaaaaaatagcacatttagattacattaattcaaatacctcaatagcggtttgctgcatatgcatatagttttgtgtttggccagtctagcaatatgcagaagaatgaagtgctatgcaacaagaatgaccacctttcattccaaccaaagtgacaaactagaggtcaggagctagttactaattgagtaattgtgaagcatgtttcttgcattcagcttgttcggtaattactacttctgtgaaagtatgataaattgaagaaaacaaaaggaattcataataaaatcaaatccatagtttgtagtaataatatatggaaggacaaatgaataaaaacacaaatatgcaagcgtttatccatggaaaatggtaatagaaaagtttaaggccttgtagcagtattaccattcattctccatagcttcacttgtcggtcatctgccccggaaacaatgagtggcaatgtggggtgaaatgatgcccagttcaccccacggtcatgcccttccaacacatattttacaactgcatcaacacctccaaacagatctgtgttcatctgggtgagacgcaggatgtcatctgcaggtgacaccgtcttcttcctcaaagcaccaatatcccaaacacggacagtctgatccagtgatgctgacacaaccaggtcctccttgggatggaatgatgcgcacatgacatagtggttatgtccagtcagcacagctacacatgtgcgtgactgccagttccagatccggattgtctggtcatcactagcacttactatccatgggtattcgtggtggaattgcacggtgcgaatatagtcaaggtgcccgtgaagtgtgaagaggcagcggtgtgtcttgtaattccacaccttaatcttgtaatcatcacctgcaatgcatcacagaaatcttagaatagttcagaagttcaaccattccgcatcccaatcatattagtccaccgagcaatacgaccggacaccagtatgacttcgtttcaagtttcaacagatcccaaagtccaggtttcaacaaattccaaaggtccatgatggcaccttgccatcgctaacttgctacttgtatcagattcacactacaaaagctgattctctctggttgagggctacacatcgactcattctacttcctatcatatctcttctacggaaggattgcaaaatcgatggagatcccggtcataaatagaaacaaaatgtcacatgaaggtttcaaactaacaattcaccaaacagttcatcttaagctaagagaatagaaccagcaccagatccaaccaacgaggatcacttgcacaaccaccactgtacacgaaacgcgatctaatcgcaaaccacgtacgcgtggtatctacctcgagtgtcctcattgcaccatgaaatggatcacgcggaaatctaacggccacgcgagacgtcctccaaatccgaggaggaggatccgaccaaacacgcgtcgacgccacacccgaccccgcgagcggcgaaccaccacagcgaaaaaaaaaatgctcgaggcgggcgagatctaggcagggaggaatcgatgtttacctccggagacgaagagcggctgcgtggcgtggaagtggacgccgcggacggggccgtcgtgctcgtcgaagcggtcgaggagggtgcccatgcggtagtcccacatctggatcaccccgctgtggaggctggccaggatccatggccgccgcgggtggaagctcagccccttcacccggttgctcttcgtctcgaacttggtcagcatcttctctagccgtccccccggcgcgacggcggcggcggcggcgaaacccctcgccgctgaggcgcgcggaggagagagaggggggagggggggtggtatggcgttgggtggagaggacgaaggtgtttttgagatctcggggtgggaggaggaagaagtggggggagagatctgggtttcggacgcggtggtgaggtggtgggaggcttggccaccgttggattctggagacggggagatctgggccgttggttccggtgtggccgtgttgtcagattggggtagacttgtttaggggtgagtcagcttggtccgtaaggtacctgatgaatactgtagcttcagtacgaaggcagcgtttttgacttgtcagtagcagtagagaaaaaaaaaagtttagggccatttgaatcgcatggttgaaagaaatgtaggaatataaaaaagacaggattctgataagaattgaagtgtaaaacagaggattgcaatatacatgaatggtcgtttgattagagcgcagaaaaaaaacgcatgaatcgaatgagagagatagactcaaaggacattttctaagaggttggagctcttgctaaaattttcctctaaaatccacatgcaatgtgtcattccataggaatttcataggttttggaaagcttcaatcatttgaatcaaagtaccaaatagaaaaatttcctataggatttgaatcctatgaaatttctacataaatcctttgtttcaagaggccttaccttttgtagttatgtcatttatatttaaaaaacaggatatatcatataaaaaattataaccatgctagtagaaaaaaggaatttataaggctggttataaccatggtttatacttatgctagtagaacaaagagtttccatgtcttaaaatgtcacaacagatgcaagcaaacaagcacaaccataatacttgccgattttggcaggtacagtagtataggaatgagcgttggttactgcaattgtttctccgatgaatcaataagtgcattatcgattggaataagataacttaatggacgatccttcccgagtcttcatcaacaaccaagagaaaacgatagacatcagaaaaggttaaaggtggtaaacaacataattccataaatggaaggggacaaaagacctagacagtatatcactatattagatctaatcttgtaaatactttatttgaaaaacaaatctaaaatattcctaaaataaaatagaagggcctcctcaccatcgacaagggtgctaaagacagtagggaagggaagggggactagatgggttgtgaggacgaaagccttcatgaattaaattggtgattcatggtacgctctcgctatgacatattccagtttaccatccaaatctatataatactttatctatagatatatccacctagtttatttgctataaaaaatctagcacatgaagtttaaagtgcatctaggctctaattcaatttcagtaatcaatgactagcgattagagatgactaacacctttgcatataactctttgggcctacatgtcatgtcagtggctagatattatggaacttggtccctaagctttctaaaaatcttgaataggtccttatcttcaaccacaaataagaggagtgtaataagtggcgcgctcagccaagagccaaggcatgcccaggggacctccgtggtcccttcgggtgcagtaggcacatcatagagtggctagaggacgacgggcgacgagctcctgaaaagccgtggccatgatgcttatggtggtgggtaggcagtgctcgggtggtagaacggcaatagctctagcaactacatgcatagggaatagggaaaccgtaagcaggctagggattttctcacttagaagggcttttcccgcacttagtgatggcgggaggtagcagtggtgcttcggcaagatatgaacaatgttggtaggcgcggctattcgggaaggggaaaacgagatcagtgcaacatggggaaaaaggtgatgcacatggttgaaaggtgatctcaccgaggacgttgcgataggctcttgtgcttaccagcaccaatgatggctcctttattcctgacaagagagagagccatgagctccctcaagttggaatagaatggggcgagttgaggaaaaggagtgcaacaggaaggtttatgcgagggttgcaagctcatttcatggcattactctaatatggcgacctcaagccgtgtggtgatggaacgggattgtcgggggtaccgtggtatcagggaggagccaggaggattgatagcttgaaatctttggtcagcattgaaagatttggtcggtttgacttagtcggcacaagagggaccgtatacgttcaacgattagcgagaaagaaatagagtaaattccctgtgtacccctgaaaactcactcaatccctttcatactcctaaaatttacccgatcccttctgtacccctgaaatttcaatttgatcccttccatgcccctaccgttacattttccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaaaataaaatttttatttgaaattttaataggacaatggatttttttatcaggagcattcataaaaaaaaatgttgtgaacattggtatacctatctttatatgaatgctcctcatttttatgacctttttttaaaaaaattaatacgtatttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacggtcaactgacgggaggggtatgcaagggatcaaaatcaaattttgggggtatataaggaagtaagcaaaattcaggggtatagaagggattaggaaaaatttcaggggtatataagggattttctcaaagaaatatggtgagagatgagtgttcaaaggcgagtaaaaaaaattctacaaccacattgcataataaaaaaaatcaaataataatttcatataactagactagaacaaagcttaagaggtgaaaggagttttatgctatgatttagtagtcgttgagacctatgttactcaaaattttagactcaatctacggggttttttttttgcccacgggttggtgggtacgggcgtgtaaagaacggaccatacccatgtacctaacggctaagagttttcgcccgtcaatagactcatgggtataagagttagaacatgattagctcctaatagagtaaaaatccgtcgggtgtcgggtcacgggtccccattgacatctttacttccaagtcatcatgcatggaaaaaaaaaaccaaaaataatttagcgcatatgaatttatgtacatcattttgaagttttcactacttcattttcttcttggatgttgcgtcgatgatgaacaaattgaatgaagttaaatttctatttcaatggtagaatttaataagtttctaatccatgttaagctaatcttattgaagtataatattttctataaggtcatcgggctatgtgatgtattttgccaaaagtcttcacagtttatttatgggtgatttaactacaataagtgggaaaagattatttgtttagatcttggtttaaaattctaatttgactgagttgctggggcatcacaataatggtaaagattataaaatgtttttgtgaagtctgtttgttttacttcggatcgagttgtcttagccccaggccccagcatgctttgtacctttcctccatgtatgaaaaatagtcatgagtgttaacatttttatgtattgttcgtatattataataacatctaaaatttactaaaatgtacttagtatttatttgtgattaggaaaatcaattttgctttgataaaagtatttttccttgcatttcatttgcataaaatgttgttacgtgggtgcatggtttgggattaaagacgtttgatttattatatttgcgtatgctatgttttgattttcatttatatgtaaaataaactattaaaatgagttttaacattttaaggcagctaaatgcgtcccctccccggtccagtccccggcattctcagcggtgacgagggaaagggtacccatcttaggatttattccaattacatcctcctattatcaatctaggatatttctcccatggtgtttcttgaatcaggtttggttaaattcttttgctctttttacatctcttgttggaggttatttcgtttgcaagattcccagttcgccaatgaagcaatcaatggcaccacctttaaggttagggtcaccgatttgctgatttatcaaaggagtgaagatagtggcctgtgttccttgatttctttgtgtgcatgttggagttggttagagttgtctcactatccattgttaataagagattaagcagcaaacaagagactaaaatgtggtaaatttccagtagcatggaaggaatttatccgttcactaatgaatgattaccgcgtctaagagcataggggtttgacgccgaacaaagctaggcctatatttttcagttaggacaatctatatatatttttaacttttctggcatgaacttaatgtgtctaattgtactttgcccccaaaaggcctatgcccaataccttggatgtaaagtgttttttttagtcatttactccctccatctcagaatatagagagttttaacccttgacatggctattaaggagaagggtagaaagacttatttgccatcttaggatagatgatgtgcatgtactgactataattaaaacaaggaatagttaggtaatatgggtagcttagtagaaaaaatacaacctattactaatactattttgctatatttgagacaaatcttgaattctataagttgttatatgctacatttgagataacttttgaattttatatttgagataacttttgaattctatatgaggttatattttagtacgaagggagtatgggaaaatatgtaatgtagtagaaacctaaaaactacagttggattcaaaaaatagcacccgagtgtaaattttttactcttaatgacgtgaaaaaatctcatacatttattttttttatttttagatcaatgataattataagtttctattacatatgtgcatttttaggtgcaacggtagtttgctgggggagaattgctgttttttttttccagtacccaagtttacactgcgccaacaatacaagggaaatcttttcccagcatttgggtaaagttctctctcctacttgggagcaccggatttttttttctcacctatataactttttctcagaagttaacacatgacatgctatggaattgcatagtttactgcccaaaacactgtccaggctacgacattgttctgttgtgccgcagcagaagcaacgaaaaatagaactgaagcagtacgttctaaggactaaggacttgtttagatgggactaaaacttttaaatccatattatatcggatgtttggacactaattataaatattaaacgtagactattaataaaacccatccataatcttggactaattcgcgagacgaatctattgagcctaattaatccatgattaacctatgtgatgctacagtaaacattctctaattatagattaattaggcttaaaaattttgtctcgcaaattagctttcatttatataattagttttgtaagtagtctatatttaatactctaaattagtgtctaaatacatggactaaagttaagtccctatattcaaacaccacctaacaaactataatcctgcaggtcctagtttaggccaaagttggcaatgaacaaccaatttggaactgaacagcccgcttgaagatttacaacacacagatcatttgctactcctaaaaggagcataaacaagtatcacaattctttgttaaccaaacaatcttaaggtgatcaacattgtgaacatacagtgtaacaaaagcaagcgtggacggtgacaatcacaagcaacagaatgaacaaaataatgcgagaaagtagctcaataggatgacaatgaaagtaacaccacgacaaaaaatttccaagagtgaaagtaatattggtacatcaattgtccaggggtaggcgcataggccaccatgagatgatcaaaagtccatatatgacaagtgtaacagctgcctcaaggcaaacaaaaatcgagggaaatgagggggagaagatacaaaaacacgaccatgtatacactcctcaatcagtaaacatgcagctaaaatgtgagatagagaatccctagaattttaagagactaaaagaaaatgggggagctctaccttagcaccacttatctcaactgtgtgggcgagcagacgaggcctgaagcatctgcaccaaccacggcaagctcacatatggtacaaagctgcccttcgatcgaaggaacaaaccgggatccacagtacgggcaggaaacatccttctggccacggtagattggaacatatgtggcgccacagacaacaaatggatttctgtagtcatagttcagctcagagctatccttcttgccactgcactgctgctgcacctgtcgagccctccttgcctgggcctcattagggttgttctccagaagcatccttgcaaagtgctctgcagtagcgaagttcttttgcttgtagcacagacccatagcgcttccaagcacaagcctcatatgaactctctgaagcttgcagttagtgaaataagcagccaattcttgttggcggttgacatcatctctcaactccttcctcttaagttccatcctcaggccaagaacatactccctcacaatctcgatcaactctttcacttcatccacttccctcctcgagtctaccacgataagagggatggtatgcaagatgctaaggaactgcctcagggcttctgggaacttaccatctgtggtggccttataggcagccttgagtctgtcttccatttgtgggaaggtgaaaacaagtgcaggagggcctctcacgttaggacttgcagactcgctccaacctttctcaacagcgattggtattatgggggcagttgcaagtgcacgaagatatgagtggctgcccatgtgcagatcaagaaacaggggcttgaggggagcaaagttttttatgcccaactggcgactaagcaacctcattgcagtgtcaaagttccctgctgctgcatgctccccagcaagagaagatttctgagtccaaatcaggctgacaggcatgcctggtggaggagcaacgaagaccgctgagcgtgcattgccagcattttttggggtctctgcttcaggcggaagttccagatcttctaggtcccaaccaccttcctcgccatcctcctcatttgcttcaccctcctcagcatcaaaaccgtcaccaccattcgccatcgcttcgcttgcatcaacaatatccaggccctcatcaccccagtcagcaccagcagcttcatcgtcttcctcaagttcagccttcccagtagcatccagtccaccctcaaagataccatgcatcacccgaagcaatggccaatcaccactggctgtaagaggagcaggggggatcaaaagagagcgagcttttccttcaggaagagaaggaatattttcacccagctcagcggcaagcctatcagcaatttctgtgagcccatgggtggtagcagtaatataagcaagaggtagctgtccagcattctctaggatctcaactctcttcaacgcatcaccaagatacagagcattgtggaattgacccatcaggttattgttctgtccagcaattttgcacatgaaacccaccttgtccatgtaaccagtaataagatataggaaagcaagcctctcaaaattcttcgtacgttggtatgcatattccacaataccaacatttccctgcctcagggcctcaattcccaacctgtaccagtgatccttgtcatcaatctcttttgcagaagcaactgcgatttggatgttaccactctcaagagcaaggttaaatcttgtcttctcatctttcacaaagtggagggcaacttctggaaagcctttctgttgtaaataagaaatcacagcttgcccacacagctgggaattcttgatcatactcatcacatgatcataccgtttgcgtagaagggccagcttgaaaatgtactcagatgcatcaactgtgaccagcttgttcttaccatcacgatctagacagaatatattgttcccaataacccttgttatgtatataggaacatcgagggttttaataatcccactatctccattgggaaggcaatacttgatatgattcagggtagtgtaaataaacacaccattctcatcccaggcaccacttttcacacgaatggtttcgtgcagtgtacagcgatggacgagcttcttgtttgctataaccactgcatgcttgctcagcagtgcgacagattccatatcactagaccaaacaacatatttaacagaaggtgcctggagctcaccaagaattaacctttgctgcagatcaaagatggtcactcggtcttcggctttgcacagcaagttaccagtcccagcataataaattgcatccgtggcaataggaagagggcttttctttacgatttcattcttaagattcttcaccaaaacttgattgctactcttctcaaggactgcaaacctgttgcgtgccacgaaaacagctgacccaccagcccccttctttgcatcctgcaaatagtcagccctgccagcagaatccttgggaacaatgtagagttcgtatgagcctccatccacatcagagcaaatcaggacagcattttcagttggactgtaagatagtgtcttgggtgactggttcaagctcactgatccaggtcttcttattggagcaagctgaacttccttctgtgtggtgaattcaaaaaaacgaagaaaacggtccttcacatagaaaacagtatctccactcacagagaaagctggacgttccctctccaatttaaacacaatcataccactgtcatgaccagcggcaagaagattcatctcagggtgagcagaaagaatccagaaacgatcatgctcccgcctgaacgtttgaataccggttcgctttgtggcatcccagatgcgaatgcttttgtcctctgagttggacactatgatgtcttgctttgcatggaacatcacacaggacacgttattcatgtgcccccgcaaagtatcaacttcccaagccttggtgtctgtcaaaaaacagcacatttagattgcatcacctattatccctttaaataatgcaatggtgatagtggaagtgaatgttccacaccccacaaagtttgcagcacatcttttttacttccttgaagttctttagtttgttaatatcttattctcatctctaaatcaagtttatcacagaaaggtctacggtggtaaaactgacacatatatatgtagagtaatgtaaaaatcattagtgctacttgtacctagaataacaaagatgaagggtgtgttgaatgaaaaagtcataattcatttgtttcaaacaatattagcacatgtacaattcatcttgcctgttgcaagtagcaatgcatggttatttagctagttcaaatattttgattgctggcatgcatatactttttattttttttaagtttgaacaatatacagaaaagtaaagtgctatacagcaacaataaccacctttagtcctactggcactagtttactaactggaaacatctcttgcattctgcttgtttgctgacaagttagttcagattaatgtagacatgggggaaacgctaattagttcttctgtcaaagaaagacaaatcaaggaacacaaaataattcataataaaagcagatgcataattctgtagctctgttctatgaaaaatgatggatgcaaacaaaaataatgaagttgtttatctaaggaaaaaaaaggatgtagtagcagtattaccattcattctccatatcttcacttgccgatcatctgccccagaaacaattagtggcaacgtgggatgaaatgaagcccagttgaccccacgatcatgcccttccaacacatattttacaaccgcgtcaacacctccaaacagatctgtgttcatctgggtgagacgcaggatgtcatccgcaggtgacactgacttcttcctcaaagcactaatatcccagacacggacagtctgatcaagagatgctgaaacaaccagatcctccttagggtggaaagatgcacacatgacataatggttatgcccagtgagcacagccacacatgtgcgtgactgccagttccagatccggattgtctggtcatcactggcacttacgatccacgggcactcgtggtggaattgcaccgtgcgaatgtagtcaaggtggccatgaagcgtgaagaggcaacggtgtgtcttgtaattccataccttaatcttgtaatcatcacctgcaatgcatcacggaaaacttagaagagttcaggagttgttcgatcttattttatgacagttccaaatcatatgggccactgttatgccaacaatacagatgaaactggtgtgtgacttagtttcaagttccaacaatccaaatgttccatgattgccaaccccaccattgctatggtatcagaaatacaaccatggaagctgctactcttcagttaaagctatagatcgactctcatgtttgaaaagattgtaaaatcgatggagatcctgccatcctgctggtcataaacatgaaccaaatggcccctgaaggttacaaaccaacaatccaccgaacagttcagcgtaagcagatatgataaagctcgcaagcactagatccgactaacccaacccaccaaccaggatccttgacaaccaaccaccactccaaatcaaacgcgatctaatcggatcacagagacaactagaggcctcgagacgtcctccgatccagggcaggatccgagcgaaacaagcaacacgccacgaagcccatgcccgccgccccgcgagggagagagatctagcgggtctactcacctccggagacgaagagcggctgcgtggcgtggaagtggacgccgcggacggggccgtcgtgctcgtcgaagcggtcgaggagggtgcccatgcggtagtcccacatctggatcaccccgctgtggaggctggccaggatccatggccgccgcgggtggaagctcagccccttcacccggttgctcttcgtctcgaacttggtcagcatcttcgcttggccctcccgcccctgatcgtcgtctccggcgacggcgggcgcggcggcggaggcgaacccctagccccggaggcggagacgagcggaggagaggggaggcgctggatctggggcggggtggagggaggagagagagagagaggatggcatggttgtgagattgccacttaagcagtcacttccgatcttagccgttcaaggtgcaatcaacggcggatgcatttccctgttttcctaaacaccagaaccgagagaacggacaatatgccactctatacgtggggattcgataaaatgccactcaatatgatgcaccggataaaatgtcactcagtatgttggtatcaggtgaaataccactttgaacctatgttgatttatttttggatgaaaagaatgcttgttgtatcaatcaaattggccagacgcccattttgatttgatatcagcgtagttggcccattttgatttgatattagtgtagttggcccattttgatttgatattattgtagttcaaccggctaaatttcttgtggtaaaaccaaccccctaagtttaagtcctagtcttgacgttagtgcttataattatggctagttattattttccagtgatagataatgaacccgccaacaatgaaatgctcgtggtgacttcgtcaatcttaccgacccaatctttcggaggtgctcatagaggtaaggtgagtgccgtgtgcacgttataaatgcttgtgtttgtactgtgtttcaaaaaaatatatgccttaccaaattattgataccttaaaagtactttagttcctattaaaaagcactttggttagtgtttggtttgctattaaagtgttccaataacacatgtctatattgcttttttaaaaaagttagtgctcgtagtgaacttgccacatcacctactctcattataaattttacaaaataccctttattaaatgtattaatattaagaaacaatcaaatctaaatgaatatctgtcaggattacggataagacatatctcgtatcctacaattaaccaagtatattagatcggtatacctcatatcccaagatatgtttctatatgcgataaggacatatataaaatattataggaaatatccttatgagctggagactactagagtcctactcgggaaggactaggactattctatatcgtgcagggttcattgtttccgagttcaacttggagactaaggcaatccacggtataaaaggcatacccctggaggggttctggattatcgaatcatagcgccaacacgccgaccatagttttcgaagccgaaggacccaagctgaagccgccgggagatctcatcgaacaatctcgactagggtctcgtcggtctcaacgagttcgtatgttctctctgtattctgtggtcttccatatcaatcccatataaactgaattagggttattattttacgaggggccttaaccaatataatcattgtattttgtctattttaatgtcgtatcgtatagatcatcgtaccaacataccctaataccctatttatctggtctacgggtatcccccgttgacaatatccatatataaaatcaaaataaggggaatatttcctatagaaaaggaatgagtaacacatttcatgaaaaatttattttagaaaatattgtaatgtattttcttttatccgtagcaaaacatatatattcaattagtagataaaaacaaattggcagtactgaaatttgcatgtgttgacattgctaatattttgtcatggtagcaaactaaataagcccaccatcttgccaaaattttgtttaaagagtggccacgtcttaggcaagatagtaaatattaaaccatggcatgattgaatagctgcttttaaaaagttaggaaagtatagtagaaattaagcaaacaccctatgcttctgttgtgtcaatgatttcttaagacagatttttgatggtacaccaaagcttcagtgtagaggattaggattagtgactttaattagacatgttgttttgcgtcgtgacggaggttcaaacgtcccaacgtcaagaaaactaacttcccaactttagcaattgattgcatgctgctctctttgaagtttggaccatacatacatacatacatacatacatacatacatacatatatatatatatatatatatatatatatatatatatatatatataataagctaaaattggaacgatgtgatgaaaaagttgaaagtttatgtgtagaaagttttgatgtgatgtaaaagttggaagtttgaagaaaaaagttgggaactaaactaggccttaggtttaaaaaaattgcaagtcaagatttaaaacttttaacttagttttaaaaactttcaagtgaagattttaaaccttaactcaaatttaaaaacttttaactaaaattttgaaagctttttggatttgaaacaaaatcagatcaatatttgaaaaatatcaactcaggtatgaaaacttttaaatcaaaattaaaaactttcatcttaaaattcagaacgttcaaataaaatttgaaaactttcataccaaaattcaaaatattcaactcaaatttaaaaaaactatcaactgaaattggagatgagaatatttaatttctaaactaaaaaaatagtgaaaaaagtcaaaaaccgcgtctggtcaattagctttggaaagagtacgaattaccccctcacccaccccgtactatcgtggttgaccgaattaccccctaaactcaaaaaccagatatctctcaccatgaacttttaataccggataagttacccccctcgatccaatccattgtaagcaaagaagtcatctaaactcgaatattggatttcaaatcccgtctggttttcgcgcctcgatcaatgaaatctcactctaatactgaaactttcaggctctcgaaacactcacttcatagcacataatatgctatggtccttcaacccttcacaaccaagactatcgacgactcaacaagaaaagaaattgacaacattaaatattttttacataataacaaattttattgaagttaatcaattacataaaaacgataaccatcaatacccttttacagtatcatatgtcatacactacccgaattcccgaaaccatgttcaacgttcctttccattcagacagatccagcaggctcagcctcctctcggttgcacagcacaacactaggcataaaatctcatcatcttcttctcgttttccacacgcatgcttttcaaactgctaaacggtgttttttttaaaaaaagcttcaatacgaaagttgcttaaaaaatcatattgattcgttttttaaaaaattaacaaatacttaattaaccacacgctaatggacggttcgatgaacgcatcaggttgggaagccaggcttccgaacgcagcctaatccagcggcggagtactgcccaggagaagcgttctgaacacatgccccctcctgaaacggcaggaacatggacgtgggcacgtaacagcctgtgaatgcagccaaacaccgctgaaaattcccaacaaacttcgcccgtttccaaaggctgctacgacttcaccataaacaaaagtcacctacccacagcaagaagcactcactgatgactaatccctgagagaacttatcagctaaacacaatcaagtagtgtaatcaacagctggaacagattttgcccagcactccatccatccgttccgaaataaactacactaaaataaataatgtgttatttatatgacagtaccttgtcgcaaaataaagatatttctccacatatctcctcctatcaaccagtcacaaccattttctttcacccatttttatcttcttaaccaattacacccttcctctaatcattcttacatattttcttaatatctatattaaccctataaatacttattttttgaaatagagaaagtataacaaatattgatatatccttagtttaatttattttaaaacggagatatatcttagtttttttttttgcgtgacagcctgacaggcaagcgtgagacagaccccgtgaatgtgtgatgccccccgagtgcccagggaccctacctacctccacctgcgacagctgctgctgctgcgtgaaggcacgcccatgacgaacctaggacctcgtcttcagtgtcgccatcacccggcagcacatgagcacacaacaactttgatcatcatcatcaccattgttatgcatcttatccggtggagattggagaaactgattgagatcctcctcgttgtcgtcgtggatggaaggaggccttctttctttctccgcgtcagcaggctgatcgctcagtttcggtccaaaagcaaaagagagagagacatcgcattctcagattctccgcatcgtctgtggtacaggaaatttgcgtggaaaaattggtcgccgagcaggtgagcgagcgagtgaccgcgatttcggtcgtgttcttgtccgtaagtctgtccgaatttatcagattgatgctgcagattgcgttcaggtctttcgacagtccaactgtaacatccgcggttcatcacactgtaacttcacacgccaacagctcagacatttctaccaggagacgaaacgaatagattgacagctcaagacacgctaagcaacgatattggaacacttcatcaacaaaactcgggtcacctttggaagctagtaactgtacaggattttcaccggaactagttcaattcccgtgagaaaatcctccgaaaatccttattccataggagggatcaagctgaagacgatgggcattgatcatccttatggatcaagctgaagacaatgagcattgaccatcatcaattttgcagcaggaacaacagcaaacaacagggaagcagtgagtcctttgcagttcttgcttgaaatcaaccactacaatgtcaaaagatctaggcagaagctaaaatgatcaatgatcaatacagtcatacactgaaacaagaagcacaaacccggacagtatctcccccgaatcaaaacgatcaactaaaaattgcattgcaatttctgggcgtgcgtgacaacagatacaggatacaccaccgggaagcaaaggctgctccggcgacaaaagggtagcagcaacaccacgaactgaaaacacaccacctccggcggcaaccggcaatcgccgtcgtcgtcgccgtcatcgtcatcgtccagcacctacacacgctcctccctgaattagaacaacacgaacggagaaagaactccacatgaaacaacagcagcagcagcaggaaacttgagtgaaatgttagcgattcctctttcggccttgggcttgggcgtcgtcgtctcacacgaagccgacctcggcgaactgcgggcgcggcttggccgtcgcgccggggcgcgtcggcggcggcggcaccatcccttccgggagagggttcttgcgcgggcgccctcgcgggcgtgggatcttgggcggcgcgtgcgggtcccgcggcttgggcgggcggccacgccggcgcggcacggcgggggcggcggcggcgacggagccgtcgaccggcgcaccgacggggacggggacgggtgcggcggcggcgggtacggccgggtagcccggggggcgcaccttcgggggacggccgcggcctcgcttgggcggaggaggcggcggtaagtcgtcggccgagtcatcatcggcgaggaactcctcctcctcctcctcctcctccgccaccgccgccgccgccgccggatccgccggcggcggcggcggaggagtcgggcggagcgcgtacttcccacccgcgacggcgacgagctccccggcggctgacatccgggagaggtgcgccgcgacgagcgcggggtgcgacggcgggaggaggccgccgccgccgcgggccgcctcgatgcggcgcgcgatggcggcctggctagacccgttctcctccgccagcgacgcgatcgcctccacgatcatctgcagcaaagagaaggagaagacaacccaagaaacccggtcaattccgccacagatctgggcatctggccaggaacagctagggtttagaaagagagcgtgcctcggggtaggaggggaggacgaggtcggcggcgcggtggccagtggaagtggaggtggccatgcctggctggctggctggctggctccctccctctcgtagggttggggtggcgggggcgaggggcgctgtctccttccggcgttggtgctgcgctgtgcgcgtgtgggatttggggccgccgcgacgcggatctgagaggagaaggggggttgtggttgtggtcttgtggatgtgggggggaatggaatgcaagtacagtttagacaaggaatctgtcgggtggtaccgggccggacgaccggtcgcggctgcacgctctactcctcctgtgactccggtccggtttagggggtgtttgggataggaacttcttttttttttagagagagagagagagagtttagcccctctctcccaaacagccccttagtctattcgcaagcttaaattctactccctatgtactaaaaaaaactcaatttaaaagagagaaaaaaacagctaatgagaagctcctttgtcgtgcagtcttgtacctagctttgatcgcttgtcttatttattttttaaaaaaattaaaaacataagtcatgcataaagtactattcatattttattatcttataataataaaaatactaattataaaaagttaggtacggaaacttatggttgcatttaaaatatgacggatgtagtagttggtaataatttggataagctaggaaactcagcttcttctagtttctaattcattttatgaattctacaactataatttcttaaaatctaaataagaacctaaattgtttaagagagcctctagcagctgaggattttagaagaaactgcagctacgaaaacttctgcaaacataccctctcagtccggtcttagtctccggtcttactccggtctgatcgggctggttcggccggctcggttcagtgagctggtgattagtatactagtaggattaatatatacagtgataagcattgtttgagtggtaaagtggtttggctaattggctcgtatggtcgcatctggtttgtggtttgtgaaagtgtcaactgggcaaaggatagtctcatcagatgctggcgagtttggcggtcgttttcacgtgacttgtgacggtggtggtgttgcgtggtagcaacagctggttgatcctttttttgttactagtttggctaatagtggattttatttaatctctggtttctttattaaaaaaacttttaagctctgaaggggtcaatatcgtttgagtgcctatttactttgatcagcggaggctcataatttgcggtaactggtgctctctttgtacagctttaaattcaaaaaaattttgagttagattttcctaagagcaagtactagaagcctctaaacacaagcccaatatatcatgtaaacttagataataacgtggaggagagaaaaagaatagagagatgactagagtatccacttcttatgcaaggaacaacctccatagaaactctaaaaataatagagaaagagataaattgattggtgaaaaatatattgggactagtgtcctacaggcaatatactgtatatgttagtttttaaatttaagagtatataatatcgataaataagagctgatcactgcctctactataaaacttgatctaacttaataaatccatagatctagaactatgattacgttgataacatttgaataaaacattctgctttcatttcaaatgaaatttaaaattttaaatatctataacatgcaaacttatttttttctgtggatctgagatatgaatctataccaaacatgatataggtagccgaatgtccatgatatttactataactaaaaccttgaatgttcatgccaagtgtaagaacatctttagaccttttcaactctgttcataccgttttatatatagatactcgcacacaatttgcgtttttaatagtattttactcacattagggattagggatttatggttagtctttgtctattatgcaaagaatgtgttagagaacgcatatccatgttacatgtgcgtattattataaaaaaaactttagtcatttcattttttttaaatccccgtttgctctttccaaataaatgcttctactcatttattggaaacaaatgctaattctgtcacaaattagaataactcattttcccgatgcagtataaaaatgatgcgcttatttactggggttattttcttcatttttttaaacaactatgcgcatgtaaaaagataaaaagagatttatttaacgtgcagtccattacttcagtgggccgcgttctgcgcgagaaaaggattggaaaaagtacaccgaaggtccctcaacttggcaatgggatacaaaacatccttgaaccgtaaaaccaaatatgctgggtccgttaactatacaaaactagtcatcagaggcccttccgcggtttttatccgtgttttagtctacttgacggctgagtcagcgtgggacctacgtggaccccacatatcagctgggcacgtcatcaccctctccctttctcctctctctctctctctcactcttctcttatcttctggcgactgggcaagccggccggaggcgacggcgcagggcggcccaaggggcacctcttcaaccgggcgccgtcgccgcaccagaatggcggccagagcaggcgaagcggcgacggtggcgggcgagcacggttgcggagaggcggcgtcggcgggcgagagcggtgcggcatcggcgggctggaacgatgcgacgtcggcaggcgagagcggtggcggcggagggagcgtgcctgctcattggcgacgtcacgggcgcgcagctcccggatctcgtcctcccacctctccaccctctcctctccttgtggatcctgcacacgccaaattcacaaacaaaccagattgcatcgattgattatgctgctcgtcatcaagcaaccaaccaaaccaattattttattagcgggtgtgtgtgtccatggccatggctatggatggtggtcttacgagcagaggcgatcctcgaagtcggcggcgaggttcttgaacagctcatgccccgcctccagcatctccgacacctgcattggcattgcaatctcatcgatcgatgaaaaattcagaatgacaaatagcgaaatcaatgaatggagagaggtggacctggcgagtgaaggcgtcaatggcgaggaggatgcgctgcacgtgctcctccgtctccgccgacgccgccaccacctcctcctcctcggcgacggccatgtcgtcctccgtctccgtcatgggcccggtggtgatgttgacggcgaccccggaggaggccgccactccccctcccgcgctcccctggctcaaccatctcctcctctccctgtcctccgttgccctgcacgcatccatccatccatccatcccaaaactcagatcagattgagccatcaaattttcgacccaaatcaaaaatcaaatgcgcctcaacaactgaactgattgagacagtagatgaaatggaacaagtcgatcggaacggaatcgcgtggccttggttcgatcaaagcaacgaacgcagctgacgaccgaatccaatcccccagaacgaacgcagctgcatggactcgcggaccacgaccgccgccgcctctgctccatcgattcccgggtgcactcgccgccaacacctcacccgccgccaaccacgaccgcgcggccagcccagccccgcgtgagcgccgcatccacgaccgcctgccgctggtctcccgcgcggtccgccgcctgcgccatcctttccccatgccggagagtgtgatcggggaggacgagcccgccaccgcgttcacccgccgccgccgcctcgcccttccgccaccctccccttctcccgtgctgcatcgtcggccgtcggagagaagagtgtgtgagagagagaaacagcagaaaagggagaggagggaaaagatatactgacatgtgggacccacgtgggtcccacgctaactcagccaccacgtaggccaaatccgggatcaaaaccgccgaagcacctctggttctgtacagttaagagaccctgtatatctggttttgcggttaagatgtttttttatcccgttgacaagttgagggaccttcggtgtacttttcccaaaaggattcggcgagaaaaacaagagttcgtaggcccatcagcccatcccatgagcccacctagaaaaaaaaaaccctaaaacacgcctgccgttttgatcggcccaagccaccatcgccagccaaccacagactagaggagaaggaacacttcgccggcgacggcggcggcggcggcatggccttctggcaggcgcgggacttcctcttctgcggcgtgtgcggcaccctcctcaaattcgactccgtccgctccgcctcctgccccctctgcggcttcaagcgcaaggccaaaggtcgtcgtcttccccatctctctccctgcaaagccctgggctgtgttcttcttgcggctgatgccttcgttctctttttttacggcgcagatatcgaagggaaggagacgcggtacacggtcacggctgaggtgcggccgattgctctaccctctagctcgcgcgaaaccctgggctcgtctgtttcagtcgcgaccgattttgtttcccctcaagtatctaaaatccataatgcgattcattcagtgtagtaatcctaggagatatagtttagtttgatttacgcgaggagtatatatggttgtgcggtggagcaatccagtcttgtggtttaggtaaaaggacggtttcactgtgtcgtgcttcagtatcgtatttcatatagaggaatggcttggtgattattgaatctacatggcagtgcactttagtagatttttagttttacaaatatccatgctgccttccttgggataatgcaatgcatctcttgggagctactccctctgttccaaaatataaggatttctaggttgtttagcaagtactctactaagattaggtcaaaagattttttttttctttattcattgcagttgtcaatttttgaactttgattttcttagattcccttctgaagcatctgattggctctgcgatcattgaagtgatgggaatcagtgcagaaatgcttatattgtggtacaacatttgaatcctagaaatccttatattttgaaacggagggagtattggtctgagattttattttatgtgctgagatgactcaaatggcaatatcctcatgctttcacatgcatgaatcaactgtggtaatggaatagtatgagttgtaggcaaacatcttatggagcagcaaggtaagatgtatagtgattttctggcttggcatttgtaggctactctgagtctctgattaagtcctatgctccatacttgtacacttctagtacttaacaaagacatagcacctaaaaggtgccaaatgaacattttaattttatggaccacaggtcctgcctttttaatgaactgtgcggtttcttgaatcttgtcccaaccatttatatcagatatgaaagaagatttccatggctatttatatgtagttgacattttgcatgctgttgacaggatattagaagagagctaaaacttgatccatatgtgattcttgaaacaacactgaaggaggaagacgtaattgtcgaaagagctacagtaagttaagctttttcatcaatatatagtctgatagtattttgtagttctgcacatattcataaatccttttctgcattaggtaaataaagagtgtgaaaaatgcaaaaatcctgaacttcagtattacaccaagcaggtcagctatcgatccttgaacatttgatgttcaataagcttaattttcctttttctagctttgatgcttaactactttatgaaaaatgtgtaattgcagttacggtcagcagatgaggggcaaactgttttctataagtgcgcaaactgcaggcatgagttcaatgagaaccagtagtcaccttagaatgagctttttgatcacttctacgattgtggtctaaaaaatggccatgctttgacatgacaagtgattttgaaatattttttttatgcctttgcttgaattatgacaagtaatggtgtgttcgggagaagggtttaggaacctcttccccgtgcatggaaaacggggtggcttattagtgcattattaattaagtactttaacgcatggtttagcagtttgccaaaaacattgtatgtgcttggaaaacgagggagaagaagttggtaaagtgtagtatagaacataccctaaagaatcacattactttgggccacatgtccaatcctcaatcatgctgtttttcgcgggtgctaattgcacataaccgaagtgtttctgttttctaaagattattaacctgaaactgcattttggaccttacggtgctcatatgagctctcttacttccctcaaatcctttatgccctcaacctatgccatttcaacctgttccataaatcatacatgttcagcttctaggagatatggcattgtttgctaactgcaaaaatgaaaaggtgtataagaaaggctcgtatggtttgaggggtgtactcttgtcagcaccaggattccaaattttgcgataaatgggtgcgtatcagtagcgctgtgactcccggtaagagctcatcttgagaggttttctgttgtcgtttcaaatcattttctgttgggactttcaggttatgaccaagttatcaaatccagtgattagtttttttaaggagaattttttcttaactagttcgagatgaagctgggacaaattcgcagtcccaattcctggtctaatggtctatatgaatttctggctatcttgttcttgagctcgagactgcagcttgtttggttcacgttctggttgctcatgccgtgccgagcactcgtgctacctccgtcccaaaataagtgcagccattgatattcgtgcccaatatttgaccgtccgtcttatttgaaaattttaaaaatatttagtcacaaagtactattcatgttttatcatctaatagcaataaaaatactaattataaaaaaaatttaaataaggcaaacggttaaacattaaacgtgaatagtataaaattgcacttattttggaacggagggagtagtattagctaaagctgattgtggtaaagagccaaagaggtcagatgagcagtcatgctcatgcgtgatcagaattcagaaggatttgaaatcctttgctcagtttgttccccttttcccaactcctatttctcgttttccgcgcgcacgcttttcaaactgctattttggtgcgttttttttaaaagtttctatatgaaagttgtttaaaaaaaatcatattattctatttttttaaaaaaactaataactaaataatcacgtgctaattgattgctatgtttttcgcgcggaggagtttggttcccaaccatccgaaacgaacacaaggtccgcaaaatgaacacttgtacactaaaattttggcgaggcatactcatttcagattgccgtagggatgcgaaatgcatcgcgagacccagcatttgtgtacgtgtatgagaatctcctacgtggatggtcactgtgaaaggccttagaggcaaggggttgtatgtcagttttttacttgcaacgtttaaccacttgttttatttaaattctttttgcaaatataaaaaacgaaaaattgtgcttaaagtactttagataatcaagtaagtcacaaataaaataattaataatttcaaaaaaatttaaataagacaagttgtcaaacgttgcaagcaaaaactcaaaatcccttatattattatatgacagagggagtagtagcaaacctacattatacatattacctcataatttattggttgttaacaggaatgaaattagacgtaatagccacctccactgcaaaacttaggcattcaccattctctacgagaaaagaactcaagaccgcgcagtctcccgagttccctcgattggtaaagatacagtgaatccattgactaaccaagcgaaccaaacagagcagtatacttgccccgagaaaatttgagcactgctatttaaccagatttatacccagtgaatggtattttgaagtgttgatagttccgagtacagggatacctccgagatgacaggaacttcattcggtcattcccaatcacatgccacaatgaaaaattgctcagaccatctacatcttcaagggttctatttgcatacagtaaccttgaccaaatcttggtggcacccaaggccgatgaagtgcggtaagagaagggaaaaaaacagcgctcctaggtgacgcattccaacttatggtcaaggatgtttcatcgatgatgacacgggaattgttcgaaaacaagcaacatcaaaactgtactcggctccgcgaaatgtaggaacaacctcaataggaacaagcccatgcctcacactttcatctgcaacatttgtagttactactggattaaaccatgaaacagcatcacaatatgacatttgactgctcatagaagaactggaaatacttacatgtacaagatctacaccacgcgagcaccttgtaaattgtttggttacttcaaatgaataaattccgatataacacgaactgctacgtctcagatttcgttggtggatcatccttcaatcctttggtgagcaaatcgtaattgatagagacaagttgtgatagattctgcagcaaaagaagttagaacggtgtgcagaatataggcacaaatgggctaacaataagttttctacccctacttttaaggattgatactgtcaatgaaacgtgacaatcacaaatttaatgagaataaaaaagaatatgtatttgttttgttggactgctagacactaagaactttggtttgtctttgtcgacactttgcccaattccttttttccactcattgtctcgctggcccacatgtcagtgagccatcagtgataaaatattcagtggatttttagattatgtatcacaaggatctaggtgctattttataatgaacattgtactatcgtttactgtgtggaacaattttgccacattcaagggaatcatcaaactacattttacaaagcacgtgcttgtgaagttgtgagcatataagttgactgacggattactagtatgattcataccaatagcattaaatatctagcgaagttattccaatggtttgagctatattacagtactgtgtctagcgaagtagagatgtgactactatgatttgaagcatattgtaactgaaaaaggtgttattactgcttggtaatgcaaatactgaggacctgttcgtgagtaaatacaagggaaatgtaaggagctgtgggtaaacttttctgcccgtaagtgaaggacatgcattacacattacacgttcattttaaaaaaggatccatcatggttactcatgcttcaatcaatcacattatgaacatgaaacaaaataggtggactgtgaagccgtaggcttactttgactgagaaattgtaaagaaaaaaaggaataggttatccaccgtgataacaccatcatgcttcaattattttaaggatataaatatgtgaaactgtaggattaccttgaatgagaaattgctgaaagaatagttgacatttgagctagattcaaactcagtgaagccactagactcatccccctatttgcacaatttgcacaattgtttagtaaaatgactgaagaataaaaaggcagacaaacaaattgtagttttcttttcctctacttatataaatgctgatgattcataccatatcatcttggtgattgctcacacagctactgctgccactaaggcttccattatcactggaatcctcaaattcgtatgcttcatagatgttttcgtccgatggattccaagaataacggctggtgaagtagctcgtgtcaaatgcactatctgaggaggggacaaaggcagcctgcatatgattccgtgttatcctcggtacacctttacaatggagatgcaactatgtttaaagaataaatagttaaccatatcccaccttttgcctagcaagggtatcccagctaatgtctttaaaaaattgatgctgcttaacctgaagggaataggattataagcatcaatcatttatgtatcataagaagttttgaataatccatacaacggatgaaggtttctaaaaccctcaaaagtcaaaatacctcagaggcgccatttgcacctagccgttggtgagggtcttctgtcaataatctgggtaaagcagtcataatatcacattagttacataaaaaacataaccacaataaacttcacaaaggattttgaaattgagcatgaagtagatagggagtattgtaataatatgcttaaattgcatgcgtaaagattccaaaaatacaaatcatattgaatagttctacctttgagcaaacagatgctataaaccatagaacacaactgaacacatataatatagcagtgtgctactgttaccctataagctgaaactggaaaaaagatagggactgacctatggcaatataaaatatagcgagtaccaagttatcaagcaagaaaatgtaatattttagagcagatgtgtccctgcctagtttgacccaaaatcctaattaaccccaacattcatttgtgttatttggaacctgaataatacagctaacaatctgacgtacattaattcacaatgctgatacgagcaacttttgggtggtgattttacagtacaaatgagggagctcacttcaattgttattgatggtgatgatcatggcaaaaaccctattgactttagtatagaaatttcatgcttgtcattgggataacacaaaggaaaatgcagtataaagacaacaatttattatataattggtccattgaccctaaaagtgacgtaaaagctgtgcaatctagcataatcatctatcacattaaaacttggaagcaagaaatagtaacatgcaatcctgtaagactgaaacatgagttactgtgtattcagaatactcgaaacatttcttacttgtcaattagatcctgagcttcagaactcatctcttctgggacatgtggccaaggtattttgcggttcagaatgttgtcgaaaattgtctacaccaaatacaacaagaatgtcaagttgccacagtttcaatacagcaaaaaacaacattgacttatatagcgacattttgcattaaatagatgaaaacccatgtgttttctagcagaccaaaacccatgtattttctagaagacctctttctctcatattctcaagagatctgaacgggagctttgcatgcttaatgaaagaactttactcaacgtcacataaatggcagagaaatattcagtacatgaaagtctgatacctgggggtgttctgcgttgaatggaggtattccaacaattaattcaaaaagtataacacccacagaccaccaatcagcactagtacctgcaaggacaatcagtactcaagagagtcaaaacgagaagacaatgcagaggttgaaagaaaactatgtcgggcattttaccatgtcctgtccccaaaaggatttccggtgctaaataatcaggagttccgacagcagagcgcttttgtctccgtgctcggtgatccatttcctcaaattcgctcatctgaggttcatcatctccatacaacgaagacccgctaacagcaggaccagatagatcatccgtgctgttgatcagaccaaccttggacaacccaaaatctgtcaactggagaattaagattgataagcaggacatatagaaggcattaaaaaggaacatattcgaaaaagaacgaaaacaatatttattgctgaattacaggttaaatgaaatgaaaactcagaaggaaatatgtgtagcattatcatcaattcattaagatatggattcacttaattagaaaagagctagctgaaatcagcatatatttgatttatgtggaaaccaacatgtcatgacatgaaagtttttatgcattgcctgattgtcatgtggggacgtcactactcactaagtccggcgccggcgacgacagcaagatacggaacagtagtttgttagcatcctttttcttagctaaattggtttgttagtttagccctatgatttgttatgatcttatctcttagatgggtatattaagctgtaaggaagttgattaatgcaagcagaatttgagatcaatctcatttcattgttcctgcctcaagggcgcgtcgcggatcacggcaccgccgcgccgtcgaggtccagggccacgtccgatcacctctttcaaatacaatcttcgccgagttcctccttccaatttgctaactcgtgacattgatacaacacagtttgaaacctcaaaaagtttcaaaactccaaaaactgattctcctcagaactctcataggatatgtgtttattttatctctcactagatgatgccattgtggcaattgctatgaactgctacatcactatctcatttggttgctggaaccaaaaataggaatatatcttctagtcatcagagaacagaaaagcgcttacctttgagaggcatgtgaatgattttttagtttatcatgtactccctccttccaaaagtctaagtcctatttcattctttggtttttccaaaagtctaagtcctatttgtagtcattatatgctatattaatttttttatcggaacccaagaagtcattttagtactttataggttgcatgttcattggttttgtcacatgatgaatgagttaactacatattggtcttggtgcaaaaagaaataggacttagacttttggaaggagggagtatctaacattgaacataaaacaagaaaaatggagagaaaacttaacgatcatgcgcacacataaatacctttatatgcccgtcatgagctatcaataagttgtcaggtttaagatctctatgaactatgtgcatagagtgcaaatattccaaagctagcacctgcagaataaaatgattatcagacaaaggaaaagtgaaaatggaagaaataaattgttagtaaaagaaacttacaacttctgcaaggtatatacgagcaacatcttcatccaagcaccctaaatttctcagtagagaatacaggtcccctccattcaggtactccatgactagatacaaattttcccgggaggtaaaagaatagaagaaacgaaccttaaaagaacataaccaattcagaaccacagtatagctttcaatgatgaagggtcgcatttgcaagttcactcaccacaaaaggattcctcactgtaatcaagatatcacgttcagccaatatactctcaacagcatttttccgaatcatatctgccttccttaatacctgtttcaaaagtaagcaactattgttagaccacatggatgccccatccatcccaaaccgaaaaacaaaagctaataataaagggagtttagcagtcaagcccccaaactattgctttacatcttagagctatcatgctgagcagaggcaaggtgttgtgtgctcagcaaaaccaaaattactataccaatttatcattacttccttttttgtgaggagtcaattcatcattcatgtgaactaaagtcacttcaatctaaaacctatgatggtcaagttgtcacaagtaaagcatgaacatgatgggccgctccactgtcattctgatcccatttttataagtaagctatgactatcaaggagactaatgcaggtaaaaataactacttagagtccaatatcatgtccagtctacaccatagtctagaaaacaaaaactaccaaaccaaacaggcaaacacaccatcaaaattttgccactaccaaaactttggcattgcccatatatttgtctcttgttggcacaaattggcaccaaaccaaacctaccaactctaccctaccaaaatgtgatagtgccaaaagttgccaaagatacggcattaccaaacttttggtagggtatcgaaccaaaatgtgatagtgccaaaacagcataatgatttaacgggagcaactaaatggatcccattggaaccgactccatattagttaactttttaaaagcaaacagtcatataattttaacatatcctgtaatcacataagttacttatctaacaagacgcagatttgattaaaaaacaagggatgcctaactaatgaaatcgagtgcagtttctttctcgaatgaattttagaacaagtgatataattcgtaacattgaccacatgtaccaaatgaaccagcggaacaagtggtacagccaggtttttgtagtatggatagtgtactacagtactataaatatgaagaggtgtactacaaatatgaagatgtgtactataaacatcaaggtgttaatcttttttgtggtcaactagtcaaactgggagcaaattaaaaaagcaaacgcgagaaataccatctctctaatcttccttctctgaacattgaaggtccacaggtatttcctttcttttgcaaaagttttcaatccaataatttgaccatgtcatgttgatcacaaggggtccttgataataaataatgaatgacttccagctggtggttctcatagaaatgtgttgtttagaaaggtatgcataaatgtacgaaaaacctcaaggccctttctaaagtatcattgcaataatatcacaatggcaggggttatcaactgaacaaaactaccgccgagtatcgacaagaacaaatattcttgagtgtgttttattgagttttggggaagaagactggcaagtcaacatatttacatcaaaagcaatttcctttccccttttttgcatgctaaaattctggtttgcgtctgaaagatagtcatatagcaatatttttggtttttggtcaagaatgcctacaacattacaggtacaaccaaggaaagcaagtctgggtacataagggaacaaatatatggcaacaaatacctttatagcaaagaggtctcctgtagttcttttcttggccaagaaaacacgtccaaatgctccacggctgataggtttaatgatttcgaagtcatcaatcgaagtacgatccttgactgggtgaacaggactagctcgtaagctacggacaacatcatcttcttcatccattacagtactcgctgaatcaactttgtccatatcaaccgaatcacaaagcagtaggtacttctccctaagaaattatataaatgtgaagggaaattacaaatggaaactaatataagtgctaaaagtgacctgcaagaattattttcatgtgcttatttagtataatgtcaactaagataagccacttgtgtagtgaactcagcagagactcaccggtggagtttttctatacgtgtgccaaatgtctgcaccgtgagagcctcatgcttcctacgattgacaatttcttgcagatcttctatgcaggtaaccaatagggagagtgccctttcttcatctagaggagtagttgcaatgcaccgcgcaatatcagcaagttcaacaatctgcacagattgaaggacactgttaatcagcacttcttgcattatattacattacaaaatcatttactactggtagatgatgcatagtgatcctaacctagattattatatggtaaataccacactgaggaccagtgtgaaggggggagtccgcttggaaagggaggtaaacatgacaggagtgaactttttaatctttcttcttgcttaattcttaaaagaaaacaaatccccttgagctcccaaaggtgcagctaagacattggagatagtagatgccatctaatcagcaccatctctaggtatacttggtaacaaagcaaactaaccaactaacagcatctctaatgaagggcttgattggtatagcttgctgcagctgcagctgtaactacagtaccaataacaggttttgtgatgaagctgctatagtgctgcggctgtgcagcagcagcaaagctgaaccaatccggcccgacatctaacgtgtggcagtggcagctaagcccacaatcatacatggcacattcgttccagccacccaaccatcatatatacgcatgacacagtggttgattggaaaaatagtggcattattaccattccttttcaacaaacgtattctgcacaagagaaactaaattttcataaacaaacaaaatattttaccatggccatagctttgctcactttgcacattgtaccttgtacaaaaataaacaccgactattttctatagtttagcctagcaaaataatcaactatctaatatatgtatgtgtgattgagagagcttacctgaggaagatcatcgctctcattaattgcacttcggccagctaaaagcatgtctatgtgattagatcttggagttgttagtggagatctaggggtcatacttcctgctgaagatgtagccattccatgatcagattttggcccaaaacgagtcttacatgtcatggaaggaaggttttttatgtcatccagtgaaatagtgctatcagcctcctggaggtagtcaagcatatcagctgagcctcttctagaccaatcagagagttttggagaggggccatcagattcttcattgatgcttgaatttgatacttttgcaacatctggactgccaacagcatttggaaggtctttttgtgtataagattctaccaacttttcaagtgcttcagcaactctaattagacgttcatcaacgcttacacctttttgatcacatctgtcagcacttgcacatattgctgagtgattttctacataatgagtagggacatattcttcacatatgcgacacattattgaaccttcttcagaaatatttggctggtcagaccagtgaccccatgaagttttgtgttgatgcttgggaggaagagattgatgtgatgtagattccactggactgttcaattcagcctggctactaactgcagggggtgtatctgttttcttattaggtgattcctctttaataggggtagggtctttagggggttttgggacaggtgatggaaaaggtttccaggaagatatacgctccctggttggagactcaacctcctttttaacatctgttgtatcaagcggtgaaagaaacttaacaggctttatctcctggcttctcttccattttaaattatgttgctcttgactgtacgattttcgtacatcacttttgctgcctctggttgtagtgtcatcacctggttgagccaatatctgcctatcagcagattgtatgatcttatcacgttgatccataacaacttcatcctccgcaaagccactctctttgtgaaattgaagcaatcttgtacatctcgtaaggataaaaagcatccgagtgtacagtttcttcagcacacccattgggagctcctgacgatgatcatctaaatcttgcactatgccttcacattgaagccaaaactcccccggtgtcattacacagcagctacgtgcaagtatgagcaaatcttccaaagtttccttccactcaggatgagaatctgcgtacttttccattacaccaaccaagtctcctgcaaatactgccaaatctgaatttacctcctcctttgctttctcaaatctcacctgaataacttttaacacctcctgtgttgatgacagaaaacaagattaattttgctccataaatagcaatatgaaggtcattaatcactatccacgaagaccatgaattgagaataccttcaagttgtaaatgccccgaggcttccaaaaagggaatggtcggacccccttggagttcaactcatgcgaaaaactttttatatctgcagggactctcttccttggagcactggtagcctgcatgatggccttaaagcgtggagattccgattcctttggtgtttcacagggatcatatgcacactgtggattaagatgacagtacagataggaggagtaagaaaagagcaaaagatggttttgtcattgcttgtttaatttaaaaatgtgaaatgggcttgtagaagcatcagtaccacattatctggtatgtgagttggagtcctcaaatctccagaatggttccgcaatgcattcggtttaactgtgtatgagatagattgggcacacacatatcagattttcaagttacaaaaagacacacagattatacattgttagctattgttatatgggataaagtagaatgtgctatggacaaggctacaaaaagaaatgcattttcatatgagaggagcagaaactattaaacaccggaagcacatattatagaataaattcagccagttgtagcaacaatatgaatctttatagtaaaacatttctcagcaaactactacagagtttgctgcggactccaagaagttcgttttttttaagaactagcaaattaaactgaaggatatagctccgatagacataaacaggtatttaagtaagtaatctgccacaagtcaaatgaacacctcactccagtcatatatccaatgagctgtgtatatagaattagaagctgtgcgcacaattacattaacttcaatcatgaaatcgcaggaatagcttatgatcaactgctaaaaatagcaaccaattactagctttgaatttaaattgtctacaccttttaataactaggcgggcattccttacttaaatggtaagaatcattcttacgttagcaccggtggttccaagtttagcatctagacaccatgcggcaaaatgaaaatcatgggcgccaatctccttataactcaacacatctaagttgaaattattatgtttttactgtttttaacaactaccgtcgacacggtaagctctgaagggagcttgaattgaattgcttaatgctgttctccccttactatcaatgcaagagcttggcaatgataagctaatccccctatcttccaaaaacctgtagccggcttgcaggatcatgatgcaaaaacctggaaaacaagtttaaaggatgttcagcttgcaggatcaacaaccttttgcagagctctttccttccaggctcgttgctgtggcgccccgcgctggatgttcggccgctttccctttcccccggctgccactggtcgaatctgcccatgagcttccagccttcctcccgccgccgccgccgccgccagccgatgcagccgacgggtccgcctgcgcctgcccacgcgatagattactgctcccgagcgcggcagcgatgcggtgcccctcctgcggcaggggcccggatctcgtcttaatccggttgaggcccagcgaggacgccaggatgggcgacagcgccgccgccgacgccccgcccgcgcccccatcccgaagctgcgccgcggcggccttcctcccgtccgccgacgggctcgacgaggccgacgcaggcgccgcccccgcgccgcccttggaggcggcggacccggacgcggagccgccgaagagcttgtcgcgcttcctgggggtctccgatttgggcttcttcttgtcggatctggacgacgacgacgacgacgccgccgccggcgaccccgccgcgggcggcgcggaggtgggcgtccgcgggctgttgctcccgtccgtggggctcgacgactccgacgacttgtgccgggacgagaagaacctccccttgaacaccatctcctcgccgcccgccggggaggcgttcggtcgaacaggtggtgggggcggccgagcgagcgagactgcgagtccacaaggagagagagagagagagagggagagcgtggtagtggggacaaggccgcagatgtagagagaggagagaggagaggagccgaggaggaggaggactcggccggtcggtcggggcgcgcggcgcgtgctctccctcctcatccccttcccttgcggctcacggctcgggcctctgggtgggacggtacgagagagagaccgcggcttgactggggcagtagtgggtcagctacagtgctactggctatgctaatgctacagcagctccactggggtcagcgagggagtgtggtggctttggtgggccggaggagagggggttcgttgcagcggggaaataagtccactttgactcccttcggccttgtttggtttggagggagttgaaggggactggagaggtttgaggagaattattccacatcacaataggtgtagaataaatgtttttggcttggttatcaggttgggtaatgaaagttgtctgttgtaaaaaaaaagccgtggaataaatcacttccaatctctcactcttatgcattaaccgaacatggacttaactagtgaccaaatctgattcgtatccttgaaacataatacaggatatctcgacccccaactattaaaacaggtgcagtttaactctctcggcagttttggagggcgttttcactaacgtggtagtattgacctagtctgtggcgtcgacatggcgctttggttctattataattaaaaaaatatatatgtgggatccatttgtcattcaaaaaaaataggacccacatatcatcctctctctcctctttcctccttcctctctctcctcttcgaccgtctgcaaggggcaggagttggagcagccggtggactttcgtccgcagcacacgtatgctgcatccggcctacttgacctcgccatcacgctcctccgcctcacgctggacccaaccaccatgttctacagctccgccatccacgtccacacctcccacagtctccagctcgccacactcgcgctgctctctgagatgctgggtagggggctcctcccaacctcgcacacctgcgccgccgccgctgctccagccctgctcctcgcatacggccaaaggtggaaaaggggagacaaagggagagataatggagagagagggaggaggaagaagggggaggagagagatgatggcatgtggcccgatagggttaatggactcttctgtcagatatggatcatgtttgaggagacgaagattctaaaagctagctggtttggtaggtagctatagcctctaaaaacatgaaaaaaaatggttcctcagcttgtaattttcagttattttctaaatagattgtatagttatacatcacataaaatatgtacgctttaaattggatcatgctttaaattgtaagtgagtttctagtaatggtaacttctcttacaatttctagctcttaaattggatcatgttttttttaaatattttcagcttctctatataattcaaattgtcaatcatactctattacaatgtcaaaaatctaaaacgacagagtagtagtaatattgaataaaatatgatacatttgaaagggtatagttcgaaatgtacatttgaatccaactcgggacaattcgtcggtatgctgtgtggacgggattgagagagacctgacgagtgggtttgctgttccggcgtgggggccgggggagtttctggtttccagcatcgaggattcgagatgctgccattgtgccatgctgctggtagcctgtgctagtcagcctgttcactggtgcagtggtgctgctgatgctcagctcagggcccggtctgggagagtcaaagattcccggtccatggtttgaatttggaaagagagaatttctcttttacttttctagtagatctgaaaattattttaattttgctaaggtgaaccggtgtgagctgagatctactccctccgtcccaggaagaagggattctggaagcccaaggtagttttagaataaagagtaaaagactaaactaaccttagtactagtacatccaattattagttacaaataaagtattactactgccacacattaataaaatataattagtactccatactcaaacacacatggagatacagggcgccaaggtgccaaataatttgaatgaagagttaagcgccactttattggcgggatgtaatacaaatttagcacaccccaccacaacaaaccctacaagtttcaaatctgaagtttccctcccactttatcacttcataactctgcaaaaacacaagtttccctcccactttatcccttcataactctgcaaaaacacatccatggctttagatctaaatatagcattagatgatggagatgaacatgctatacctaacctcaatgaagcagtggctgaagaaacagcagcggctgatcaggaggatgaccaggttggaggtgatctccatggaggtgccaaccgtgagcttcctggaggtgatttccaaggaggtgccaaccatgtgcttccttttgatctcaacttgcatgcatctgaccaaaggagaaatacatctaggtaaccttgtaaacatgaatagaaaataaatgatctttgtagatatggcttgcataaatcactctaaaatctttgccatttctctgtaaaaatgatctataacatgtgcattgatgcaattgctatcttcttggaacaaaattggtctttgataagcttgagaaaacaattaggacttgattttttttctttgatatttaccaactcaattctgtcaagagttgagcataatgaaatttattcccttccataatatcagaggttatactagattctagatatgctagattctgcatggatagtttggttaggccatgtttatttcaaggtgaaaagtttttaagtgtcatatcatatatacgaacacatatttaaagtattaaacatagtataataacaaaacaaattacagattccgtctgtaaactgcaagacgaatttattaagcctaattaatccgccactagtaaatgtttactgtagcaccacattgctaaattatggcgcagttaggcttaaaaaattcgtctcgcaatttacacgcaatctgtgtaattattattttttctatatttaatactccatatatgtgtccaaaattcgatatgatagggtgaaaagtttttctttgtaaactaaacagggccttagccaagctctgtggatttggttgcccgatggccaataatgaagcccataagtaaggccatgtttagatcatttagtccctggatattaaacttgtcccttactgttttgatctaggaacttcagtaaaaaggactaaaagcacgtagaccgagggagaaaaaagagagtggttatcattttagtccttataaatacctctaagagggtctaatagattttagttccaatatacacctttaatcccttttagtcatccctatttagattcttaaggattaaaagtgactaaaatggagggattaatagattactccatgaccaaacatgacctaagaaaacatgaatgcagtttacatttaactatccttcgagatagtcacgtctacaaactaaacctatttttgaacggaggatgtataatgaataaaaactgaactactttctatgaaactgaactagtgatctaagggcgaggtcagcgaaggtgaatagactcatctgcctaaggcttttttaagtatacagacacacatttaaagtattaaacgtagattaataacaaaacaaattacagattctgtctgtaaaccgcgagatgaatttattaagcttaattaaaccgtcattagtaaatttttactgtagcatcacattgtcaaatcatgtcgtaattaggctcagaagatttgtctcgtgatttacatgtaaattatgtaattggttttttttccacatttaatgctccatgcatgtatccaaacatttggttttgatgtgatggaaaagttgaaagtttgaagaaaaaattgtgaatctaaaggcctaattttaatagaaacgttcgcccaacatatgtttgcatctcgagcctcataactgtagtgggagtatttgatacacacgtatacgactgttccatcttgttttaattttcgacaaaaatattgataaattttttgatctttaagcctgaggaacaaaaccgtatagtcgtgcgattttactttcaaaatgacgataaaaattcaacgaatgtcaaatgtcaaaccttgatttctcccttccagaagtcgagagtttttgaattcctcaacttgccgtcggcttgtccctcttcccgcgtgttgaaatcatcttcccttccagaaagccaacgccttcatctgatcatctccttggccaccaagaaatgccttcgtcgaacaccttgccacgccacgccgcgcgcgcgcccatggccctctcctgcgccgccgagtgcgcgctctccctcgcctgcgcgcgctgggcgctccgccgcctctccctgtccggcgccgacgacagcgcgtcctggcccgcggcctcgccctcctccttcgcgcccgtcccgcgcgcgtgccgctccgcgctcgcggcctggcagcaggggcacgacgaggcggagcaggcgccgacgccggcgccgtcgcggctgtgcccgccgtaccgtctctcccacgaccgcgcgcgcggggaggtcgtgctcgccgtgcgcgggctgggactcgcgcggctcgaggactaccgcgtgctcctcgacgccggcgggcccgagccgttcgcgggcgggcacgcgcaccgcgggctcctccgcgccgccgtgtggctgctcgaccgggagggccccgcgatccggcggatggtggcgaaggccgggccggcggggtgcaggctcgtgttcgtcggccactcgctcggcgccggggtcgccgcgctcgcggccgtcgtggcggtgaggtgctggctggagcggctcggcctccgccgcggcgacgtgaggtgctacgcgatggcgccgccgcggtgcatgtcgctcggtctcgccgtcgagtacgccgacgtcgtccactccgtcgtgctacaggcaagcctagcctcccaacaacattgttgcctctttccccttagctgatatcgcgtccatttctagcattgtttatcgaacattctgcaataagaacggaatccgacctcgattcatttcgttgcaatgattttggaattcgaatcgcacactcaattcttgaatttggatgcaggacgatttcttgccaagaactccagcgcctctgcaacacatcttcggatcaattttctggtaattaaaacagctaaaaatactcttgttatccatgtgttccaacggcgttgattactggttgttccagctgttgattcaccaatttttttagaacaagtgattcaccattttttctgtttcttgcattgcagtttgccgtgcctgctgtgtttcatttgcatgagagacacgtttgtgtcagaagagaagcttaaggatgcatctaaactctacgctccaggaagagtctttcatatcgtggagagggagaactgcaggttaagggccaaaattccaaaaattaaaacttttttaaaattaaaaaaacaaaatccttgtgtgctagtatggcattagacattagttagaagcttccgaagattagctgttatatttacacttgattttaattggcattgtatccacattggctgctatgcagatgtgggagacttccgccgcaggtcagaacggcagtgccagcagagggcagatttgagcatgtggtgttgtcatgcaacgccacttctgaccacgggattatttggatcgaaaaggaggctcaaaaggctttggatgtgagtaatttcgtctttgcacatgcctgcctgtcaatagtaaaaaaaaattatccctctttgtaaccgatcaattattctttcttccctttttacgaatcggcacaagacaatacccgtttcattgtatagagtaggagaaaaagtggtataaccaacatgttgcatggctttctttaccaagttgttgttcatccttagcaacatgatttcattaatcattttacctgatgtttaatttcttcgcatgttcctttttttcttttctttcgtttgctgtcctgcatgttctggttgccaatcagttaatggagcaagaagaattgacactacccccatcccagcaaaagatgctcagagtgaaagaaacggaatcactcgcagaccaccaaaagctcagtgcagggaatccacaagaagacgacaccctctcctcctcgtcaccgttcagtagccctagaacttcgacgacatcatcattgcgcagcgaatcgtcgtcgacgaggagcgagtgggatgagctcgtggagatatttctgagtgaccatgaagaagacggtgatggtaggacaaacatgtgtaaccgggcaggttgtttgccttgctgtaaataaaagattgttgcatagaaattttagagtgtaaatgaactatattgaaattagagtgtaaatgaactagaagatggttaaattttattccaattcgacctcacgatcaactcgattgaatgttaatatacagaggctccaataatccatccgtaccagtgtactattgtcccagatactagtaaggctaagttatactcctatttctcaacttgaaactttaacttcctcgttgtttttcaaactgttaaatgatatgtttttttaaaaaaattctatatagaagttatttaaaagattcaaatagttattaatcttaattaatcacgtgctaatgggatttttcgttttacgtgtgtcaaaaatctctctcaaaaacaaagagatcgaacgcagcctaagtagtactccatagtattgatccaccatatgggtactagtagtaatttttctcttcacaaaaattattcagttaccttatcactatatatatttctaatttctatcaagcttgtatggggtaaaatgggtaaaagaaaaacatcatattgaaaaaaaagaataaagacaacattattcatcgtttcgcccacaaataattgtaatattgtgacacttatttctaactaaaatttaattatatgaattcatattttatatatgtgttcttaatgacttgaaatccaatattgaaaaataaattatgatgaaaacaaatattaaaaacaactttcaagttagaatttaaaatttgattgtgtttactctccctgtttcagattataagtcattttgactttggttaaaatcaaacagttccaagtttgattagttttgtagaaaaaaatgtaatatttttaactcaagacaaatatattataaaaatatattcaattattgatttaaagaaactaatttgatgtcgtaaatattacaatatttatctacaaacttaattaaatttaaagtagtttaactttgatgaaagttaaaacgaattataacgagggattaataaactgaagagcagctgaaaaatttgtcatcacttatcaccatgacacggccggtgaccacatttcgccggtgaacacacagacacaaaaactagccgttactctatatcgtagtagcattcaaactaaccagccacgcgaagccaccacgacaaccgcagcaaaatctccggaagccgccccgccaccgaaccgaagagcgccgccaccgccatggggagtctcggcggcaagtccgactacgagagcgtccgcgacgcccgcatctccgagaacctggtaagcatccttctcctcgatcatcaactttcgggtttcctctctggatgaggaatctctcgcgcgcggacgcgatggcaatggctcgcccgccgcgctgattcttgggcgagtccccgcaggcacggatggagatgctcggcctgcgccgctgcgccggggagttcagtgccatcgcctccgcctccgcgtccgcctcggcagcagccagccgccgcgccgggatcggcggcacaaccccgaggaggaaccccaagccgccgcgtgtcctcaccccgctccgccgctccggccgattggtcgccatcgccgccgcggcgccggccggatccgcgtcgggtccccgccgttccgcccggcttaacgggcagacgacggagcacaaggcgctgcctctgaaaggttggtccctctcgctgccgcgttcgctgaaatgctgaatctccatggcatctggctgcctgagatgggaacaaattcttgtgctctctctctcttaggatctttgagtaagtttgccgcggaggaagcagaggaggaggaggaggaggaggagcaagaagagaagaaggcgatggtggtgatcgacaaggagagggtgcggatcctgcaggagcggaggtgtgacagcaaggggaggggcgccgtgtacgaccctgttcttgggatttgctgccatttctgcaggtagattctccccactgtcaacatttacgaccgattagtgctcctcatcttgttcttaatcaagaatgctaggtaccatagttttcatactgtgacttgttgagaaaatttcttcatagttttcgtatgatttgttgagaaagtctcttctcgtgtgatcttaggcagaagaaattgtgcggcgaggagggctgcaagcgctgcggggaaggagacctgaaccagccttgcataggtaaaaaagaagcagtaaaaaggtcaattttttggtgtcaattattatgtgcagcttgattgcaatagtcaactccttttctgtgtcaatctttgacagggaagacggattgctcctcttgccattcttcttatggaatactgtgccgtgcttgcctgaaagtgaggtatggggaaggtaagcttcatgctgtcaagaaatgccattgttgttggtcagcttattgtgttggtaaagcttctgattttgagatgtggtatcagacatggatgaggtcaggaagaacaagaactggatgtgccctcactgtattgaggagaagggtaccaagaaattctggatatgtaacaggtatatgattcttacaaagctttgatatttcatcccaatatcaaactgaaggaatgtatgactatgctcacttgctcgatttttcataaaaactatgcagctccatctgcttgaagaagaggaagttatcaccaactggaattgccatatacgacggtaattctgcgtccacaacttgatatatgaggcttatccatactgtcaatgctaattctaccatgatacatgttgttcttgatggtcctaaatcctatctatttttggatcccttaacaacagcgcgggagcaaggttacgagtctgttgcgcaccttctcatggacaagctgaagtgccgagcattctgaggtcttctatgtcgttcagagacgacgatgatgtttgcctagcgcactggaaggtggaagggccccttttgttttgttgacagtaggtatgacgcactttaggagaaaaactagtgtagaaatgagtaccactattgtgctcaagattgtgaatctagtactagaaccttttgtagccgatgtttccatatgctgcttgtgtttgggggcagctgggctattgactgttcttctgaagatccaagcaagggaacatgtattgccttttcaatcagtggttgatgagtcatgaccataactgtgtctgctacttgctaatttcatggcttaatgtcatttgtaccaaacgataattttgttaaacattggtgccttggtggcatgccatttggataagtagggttttttctgagagaccatttgaatctctaattgtgaattgtgacaaacaagctacaataacttcgcaaatgctacttacgttatggcagtttcaaaaccgtttcagtgcacggattttttgctgttctcacaaatattaggtggcctaccttgcacttgcataacaagaaaaaaaaatctgcctttatccaaatgaaaacttaggccttgttttagcacgtctgatgtctccaacttcttgatatttctacacagggaaagtcgtgtgcaataaaaaatacaagcacaagtcgtccttatagaaaatagggtttataaactaaactaaagtggcttaaactacaaaattctcttatttcagtccgaaataaatacacaatgtgttactaacaatcttaacctgcacccatctccaacttcaacaatgtctgtaactagaaattcccagctcaagaaaaacctggagttgaagttgtgccaaaagggatcacctatacatttgtcaacaaattttctcctaaaaatttgacagatgtaattatagtacaatcatagtgtaattacactataacttgtatataacacagtaacttgtatataagttccatgtaattttgaatcattagatctattataagatttgttctgatgaagaagaaaaaaaatcacagcacacatatgtgagaggatttgttcccacgaccttcattttacccaaaaaacatgttacggggagattcttgaaagtgtgtaattatatgcaagttatagttgtcgacgtttgatgtcgcgattccggtatttgcatagtatggggatcgttggtactaggatatacgcgagactgaggtaaaagatagagacagggatttttatacaggttcgggcccttgaatggtcaggtaataaccctacattctgttggccgaagccgatattgctcttattcaccataatcacaccggtacaatatttggggtagcttatataagtgtttgtcgacatggcggtctgaagctctgactcgtagtcgacaacagggtagtcttcctcctcgagttcgtgctcggcgagatcagagataacgctatgtctctcctaacagtatccggagacaccgtaggggactagccgtgcttatctctaaagtcgatatccagcgtcttgtcttggcgtatgttagtttgtatgttgtggcctctgttgtcccgtagattgtggtgggtgtgtcgtcgatgtccccctctcctcctaaggggccttgtatttatgtccccttatccaagtagaactagggaaaccagtatggatacaatccgagtagtctttgtcgtttccatatagaactctggttgtctttccttatccggaactcctcctatattcgcaggttgtttccgtatatgacatggtaagtggtgggtcctgctgagatttagtcaactactattaggtatgtggtatccataaccctgataacagtgtaattacactatgattgtactgtaattacatctgtcaaatttttaagagaaaatttgttgggaacctctacggctcaggtgcccgatcatttggagaaaaatcgggcgatgatgtcatgcaaacttctttaaactgatttatctcttaaattacttatccaaatcattatctgattgcaccattaaatttgttgcaattaaatcttaaaaacaagaccacacatggatatattccgacgaaattttttttagcttattattgaattatttttaaatgttgcacgatgttacacctggtatatcggaattgtttcactaagtagatcgaaaatatttcactcgtttaaattgagtgttgtttcaccttatatgaaaacaatgtttcagcaaatagcgaaagattgtttcagttcactgcaacatttaatccatacatagtaaaacattataactacactaggtgaaacatttttcggtggaacaaaaaataaaacgaattcccttaatagggggtttccaaaatatgtgggttttttttgttgcaatgaaagatttcagttcactacaacattagatctatacatagtaaaacattgtgagtacactcggtgaaacattttttgtggaacaaaaaaaaaatcaaattcccttaatagaggatttccaaaatatgtggttgatttgttgcaggtgggggcaggtattgtggtggggcccaacgacatcactgcctgcgggggcgggggtggggggagcgcccgatttttgctccccccgcccgatcgcccgaggacaagtattctcgaaatttgtcgcaaaatatatagcaaaattggtgccaaaaagcccaatgataaaatctattgtcggcccaaactatttgtactgaactgggcccggttgggccagttttctcaaccgggccgggtcctggaaccggttggaattttccatttccagcaagtccacggctttacggctgcttgcttttgcgcaagtttcaagcgatgcgccaccgcgtcggccccgccgccgccgccgcggcggcgctccggcggttctcccacctccgcccgccggccccgccggacccgaggctcgccttccttcgctcagagtttgatggccgtgagcccggccgacagccaccgtcaccggaaacaagagaggagccaaaaggtggcgagcgcgcgcgctcgccggtggccgtggatatcgcgcacccgtggccggagtgggtggcgctgatggagctcctccttcagaggggccacctcgacgcctccgtgttcgccggcggcgcggctggctcgccgtccaaggattccaacgttatccgcaccgcctgcctccggtttgggcgagagcggccggagcttatcaggtgagatgcttcagctcgtaggagtcgccaatgtgtgtgcttctttgctctggatgttgcggtgcgccggtgtcacttgagtatgcgattgtcattgatagggctatggtttagctgcacgcacgcgaggtgtttgtggaaatgccccgtcaatatagttgcattttcttggtcaggtagcctgatgcactcgaggtggtctaaatggcgtatgatattcatgtgccttgcatatagagctgaaacccttttgttgcaggcatctatcaagatgggatatccaggttgctctccggtatgggtgccccagcattgacaggaaggttgttaattctgggaagcgattacgtgctcatgtaggccttgatgaaggagaggtaactaataaatacacaattatttattttcatgtactgtatttttctctattacttttattttgaaattgtcagttaccaatgtttgtgaatagaaaattgcctagtagcagtatttctgaataaaatcttcaaaccattgggttatgaaaaaaattgcaacattataattaggatcacaaatggagagaagaaacttctgcatgcttacaatagtttgatgacaaaattagtattttaatgctgcttataaatctatatgttatatagcatttctccagcatcagcttatgctgacaggtctgcagccaatgcaatttaaggggtggatgcgagagggcatatgtaaaggctcggaaggaggaaattggaagaactgtggatgttatgcgcatccttttgacttatgggcttgacacagttactggcaatgtggagaacagagcatgtctaaacaaaaccgttaaagaatccattaagagcctacttaatgagattgttgggttcgattccatgggtcctggttccagcactgaaaagcccacacaccgtatgccaaaaggacaatcttctattcctatgaagcagggtgattggaattgtcccaagtatgttggagccttttaatcacatatacattttgtgataatgccacgctttataatgtcatatgttattgtcagatgcaacttcttgaactttgcaaagaatataaaatgtttacgctgcaatggagaatttgaagagaggtatcagctgctccatgagaaccaagagcatcttcctctcaaaaagggtgattggatatgcaaaaggtgaggtttcacaaatctctagtttataagattgactcggagttggaatagtcttctttttgcacctgtactgatcttatattttcaggtgcaactttttgaattttgcaaagaatacaagatgccttcagtgccatgagaaaccaacaaaccgtcaactcaatccaggggaatgggagtgtgtctcgtgagtggcatttttgttacatatcactgcatatttgcattctcttaatagttagtatcaatatgagaacttggcaacaaaatgatgttagtggctttgtctggtctttcagtgtcatgattatcttctgcttactataaaaaattttccaagataactatacgattgattcatgacaggtgtaattatttgaacttcaagaggaatgcattctgtttgaaatgtggttggaaaagaccaaaatcattgaacaaccaagacagtattgaatcacaacgtgacttagatgataataagcattctgctatttcatttatccaagatggcatccaatcgaggaggcaaattctgcaaaataaggctccattgtctgacgaagattcagacttctggagctccgaggaggaaggggcctaccacagtgacaaaaacattcccccaataaagaaggattacaagttccttgaaagttttcccatcattgggggtaggactgctatgtctcaagatcctcttgagagggagaaatggaaggacgaaatgtccaggagaaacaaagggctcctaacagaagtatcagaagaaagtaatcggccttcgtgccccgttcgtattccgagaagcattgagcagattgaatctggtgacgacgacgacgacgacatttcatcatggttttctggtggtactagtaatattaacatgaaaaaggcatagccagatttctgtaaacgctagtatctgcacaatttcatctgtaatatttacagtgtaggcattcagtaagaaaaaatcatgtctcgcaaagaacttcagtattgtacttctgctatgatctgtcttggcaaataatatactatgattttacaagtttttgtattcgtgtagtggctggttccatccactttagtactaaacaacgtcgagttcttatatgtacatgattaacctgtaacgagtttcgagttttaacagttcttgtactgtcgaagagcatgagaccaacctcttatcacacagctagacgcttgttttgtagtttcttgttgcatttctctcttgtgccagtactccacctgcacgattttgttgtgattgaatttcaacaaacatatccacccaattatgaccaatcaccaaacctgcaaataactggagacccgacacaaccaacacataacctgcaatttctacgctcataaaatcattgaatcgccccctccccctctcccctccccccaaaagaagatgaagaagaagaagaagaagaagaagaagaaaagatcagtgtattataaggatcgaattgtcttctttttctgtccttgcatgtttggtatgagattcgagcccaaaaaaaaggagatgatgcttaacgtttcaggaggttcttgtgcattgattttctagttatcatgatcatggtccccaaccttcttccttccctctgaaattcccattattcaattcttgcaaaaatatcgcaaaattcctttattccaaaggaggccgcaaaacgccttttgaaaagtaaatataaggaggaagaaatggagatgtttaacccatttttgacatcaaaatggacctaggaattttaacccatttttgccggaatatgcatttaggcgcttggttgcattgtcaacctgacagcgacgcacaacggcaatgtatggttggtaataatggaaaaagacatcacatattttcgtagcagtagcaattagcaccaacaactgtcaactcagatcccatgggtccgttgcatgtctcgagtggttaactccgatttggtggtagctagccagctatgtgtgtgtgagctaccaaccattgagctgcagaatcaagcttttgcactgtagattatctggattcaccttgcatattttagcttttttttttttaagaaaagcctaggactcttattacaaggtgtgtgatggtcgatctggcttcaagccttacccctgtcttaataaatttaaatacaagagcccttcctcttaccacggccatgtagatattttgttttatgggcagtgattatggcatattaaaatgaccatgggcatgatttgattttggtgcaatcccttcttcctatatagttggtacccactacaatattaactcctataaagaaagcaccaggttaagccacatcatcaggattttagagccgtctgatcaatcaattgtcagatgcaaggcaccgttagatcttcttccttgctggacacagaaataaggaccaagttggtgagccggccctgttaagtctgtccgaattcctgcaaacctctgctggacacacaccacgaacgatgccatgcactgatggggatttcaatcggctaattcagttaacagaaattgtttacagattatattcaagatgaaattgcactattgcaggttatacatatttccatttgcaacagttcatgctctatctcaatgatattcaaataattcatttttcattttttttatatctacagtatgttgtttgccgtggtagttcttttccaggactatcatgaaatccaattcacactaatatgtcattttgaatttagtacttagcataaaccaaaaggctttaatacataaatgtacgagtctcttttgacaccattgatagtgataaaaagcagttggttcatactaacttttcaggtttgaaataactcaataagcccacagcaacgcgcagggaatcaactagtatatattacgaatggtgtctaactgtccatattctactgtataagattgcttggaaacataagtattgttaaaagtcatttatgtcttttccccttttcccctttgactatattctggagtactggataactagaaattacctaggagtaactagaaggcattatccctaaattatagcttttataacaatgtgaccttggcaaattggcctaaaaaatttccatagctcaaattgaaccacttggtaagttcagaacccccccccccaaaaaaaaaaagatctagacattgctaaaaaaaaattcgaccacatagctagatatttcttagtgccatcatgatttttcggtagtaatgctcatctcacagaccgagacctcgttatgcatgtattccatagaaattcgtttacataactttatctccggaagaaatagaaaaaaaaattcccacattacaaatattttacaataccgagcaggttcaaacctacagtctgaaatctgattgtttcagttacgattgataagccttaaaaaaataaacaaaacaaccaagtaaaatttttatatctatgttatcaatgatttataaactaatacttaaaaataagctatgttaaaaaaataaaaaaactttaaaatttacttttaaagtttaaatttaatggctggtagctaactagcggactatactagctgtgttctttcctctatcttaccaacttctactacctcgttttttacacacatattatcgaattgttaaacggtacatatattttttaaaaaagtttatgagaaaaattgtattaattcatttttaatttctaactaatatttaattaatcctacactaatctatcgttttgttttgtgtattccggagggagaagttgcaaaacctgtgagggccgaactcacctgagagggtgatactatactgttgcccaattggcaagggattagctatacatttatcattaaattttaattaaaaagtttgacatatgtaaatatagtacaatcataatgtaattacagtgtaacttatatgtaactatagtataacttgcatgtaactttttgacctaagtgaaatgctaatactgtgaaaatgaaggtaatggtactgaatcccccttacatgtgcgtgggttgtaattttttcctatcacccttgcacaaattttaaagcaaatcgaacgattcaaaattacattgtagttacatggtagttatactacgattgtaccatatttacattgtcgataaatatatagctaaatcgattgggaattgtcaagtcaaccaactcatcatccaactggagaaaaataaaggggctcaaatccggtgatccgccgcgtcgtccttcagtcctcctcctgattgctgcggtttgcgccaaaatttctctctctctatcccctcgcccttcttccccatgacgtgctcccctcctcctctccttgggccccgctctccagttaccgttaccggcaaaatcttatctgctttctactaaaagctgggccttcatgctttttatctaaaaaacgtggcacataaccccaggtgtcatggttataaagttccacaaaattacactattattcattttgattttgatctaacatacttttgagttctacgatcatatttaattttataatttctttctccatcttgtaagtatagccttttaaaattttgatacaagattgttgtcgaattagttaacggtgtggttttatgaaactttaggatcataatacctaagttatatgtcacataccaaaatatgcaattttgtacaacttggatcataataatatggggttttacgaaatgtactcttaaatttacgctgtggctgatactccctctgtcccgaaatataagggattttggttggatgtgacacattctagtactatgaatttggacaaagagtatgtccaaattcacagtcgcaggatatgttatatccacgcaaaatctattatatttcgggacgaggagagtaataaactaactagcggatttataaagtgactatgggtgtgtttagttcacaccaaatttccccctaactcccacttttccatcacatcacattacatccaaaactttcctacacacgtaaactcttaactttttttttccaaactaccaaccttttcaaacttctccccaatttcagaaactaagacagcctatactgttgcctaattggcaattgtcaagtcaaccagctcatcatccaattgttggaggaaaaaaaaaaaaagctcaaatccggtggtccgccgcgtcgtcctccagtcccagtccctcctgattgctgcggtttgcgccaaaatctcctcgcccttcttccccacgacgtgctcccctcccctcctcctcgggccccgctctccagttgctgcaatcctcccaaggagaggagaggactccactccacgctggggattgggatattccttgtcccgcggggtcagtttttagcagcagcagtacagtagttggctggttgctaccactacacgagctcgggaggaaggaaggaaggaaggaaggaatcgcaaggcgaagagtcggagctggcggaggaggaggtgctcgcgatggggtccgagggatccgccggggtcgtcgtcggtgagtagccagggaacccttgccgaattttggttttgtggtggtggatttgggtggggtggggggatcttcgcggccggtcaagaacgcgagagttggttgagttcttgatgggatttttaggggctgattctcgtgtggtagggcgtaatttctctggacgtgcgcgtaggcaagattcaagaaactctgagagcaaatgtagattcgtgaggaattaggatttgttagattcgtgaggagttaggattgcttcgggattagattgttctgtaaaggggaatgctgagggggtagtctcagctctcggttcccaattcgccgaactcttagcactgtgaattcttgttcaattgtttgttcttttgtggctaagctaagaattggagcaattttatatggatggaaacgatggatttaggggtactagctggatttgttggttgctcacgtttatcttcaatcgcgaattattgcatatcaataagtttgtcttatcattagttcctgagtttgatcctaatatcagtatttttggcatttctaccatttcttggtttgggtattttttgcataacaagatgaacaatactgctacttcatagggggggggagagagagagagagagagagagagagagagagagagagagagagagagaggggatccctatatttggtcattgcaaaataaaaaatccgcaattaagtcactcaagtctgatcatgtgtttgaatttggtttactaatactttacagccacagctgtggcttgtcagctaccccacttgttcatagacatgttttttttttaacccaaattgtagattggcacatttttttttccaatatgcaactaaggccgagtttagttctaaattttttcttcaaacttccaactttttcatcacatcaaaactttcctacacacacaaacttccaactttccgtcacatcattccaatttcaaccaaacttccaattttggcgtgaactaaacacaccctaatgataatttttccttgaatacgcaagatgcgctcattgcattagtagaagaagtaaggcatccaaacacgccaaagaacagcaaaaagtacaggaacttgcaccaccacaaaacaacccactgcaagggcggtgacaaaaccaaaaagtactaaaatagaagtccctagccggggtccatgagggccccttagcccccgccaaactccataggcgggcttactcacttgctaacatcaagacctaggcgggcttactcacttgctaacatcaagaccctatactaatgatattaaaatacaaccagggtgatgcattttacttttgtgatccactgtgttgtgactagcatgccacaaaataaccaaaaataaaggaagtcattcatactcttaagaaaagagacttctaagcgaatacaaagtgaatattacttccaactaataagaattgttccagcgtattctttccactaaaagatgattcgtcctcctaagacatccaactcaatttattggcattcttttctcttcttacaaatggttccaattctgaaaaaaaaaacgtaaatcttttgctttatccgaggccttgtaattattttatcttaccatttatcgtgttcttttctaaattttgcttgaaagtactccctctagtcattaatatatgacgttttttaacactaaaatatgtattaaaaacgtcatatattaatagccggagggagtactttacagaaatggaataaggttagagtggaacataataatctcaataaatggatattgaatctaccctatccatgcactgtagttttttggatgactataaactgatacattcctttatcctaaaatgatactggaactactttaggatttaatgaggaccaaaaagactgtcctagtagcatatgcattttgttaagggagactcaacttttatgattcttattaggtctatgcaccaggttaatatattgttatatctagagcggaaaccagagtttactttcggagtcaataatttgctctttcgttaattcataatggcaggaaagacccttcatttattcacacaagatggccttcttatttcccaatagtgcagctttgcttcccaattggtacttctcgagttaaaaaagaaatattaagcatggaattctcaacaatgcaatgactggctaaggcccactgtgcttatctttttaattgttgcagaaatgtaaacttagaaccattgcattttctttacaaatcaaattaaggttagacaaaacatggtatccaactgttatgtatttcacaatcgttctatcttttctgaatgcaataatattgccgtttgcatcttaaattaaaagaaaaacatttagccaaacacccgaacatctaaaagcagttgaaccaaatgagaatatgataatccacctcaatcgaacaggagtctaagtcagctttgcatgccctaaacatgcatttttatcgtagccatcctatagatggaccatggcaaaacagaactacagaacacattcccttgttcttgaccccatacataattgatagtaactgaaatcaattcactatatacagatcctgtgagttctgaccttagaaactttctttcttgtcactccatgcataactctctatctcatcaatgaacaatgtaagacatgaaactggtgctgaacaggtttctgcataataggcccctctgttcatctcttggctacaagttatttaatttggatgctttagtcctgccaataagtcctatcatatctctatctgaacttggaagccttttttctgaaaaaataaacattgaaggcattttttctacttggtccatcccattttagtgggcaaaatggcatcaagggcggagctaccattgaaacaaggtggtgcactaccatcgaaaacctagaaaatttcgatggaactgtgcattctagcgtttataagtgagaaatcttggatttaggggggtgggggggggggtgggtgggtgcttgggttcctgtgcaccacccaagcttaatgtggctccgccactgaatgccatgtgggtttgaacagcatgaaccatgtgctacatattaataagctgacacaaacattttaaatattactaaatatgctattggaattatctttaataaggaatgctttgcaactccattttttttctttgtgcttatgcagttgctacattatgttagttagccttctagtaataataggtaaatcttgtgatttgtggcataacattttctctattgttttctgtacattagttatgacttgcctttgttcccctcaaacaacacggttcttctgttatttattacatggatagatgagcatgccaatggcctggtgctacagctcatgaggaaactttcgaaatataatttaaatacgtgaatggagtgtgctcattctggaaagctgttttgacttgtgttgatgcaaaacattgtcggatcggttactacactccaattttatgttctctaaacagattaaatattattcttttttgggatttcaagcctcatgagtagctgcatacagaacaaatctagtaattcatttattgaattctttactgtgctgagtacatctctgcagttcccagaaactttagactgcttgaagagcttgagcgaggtgagaagggcattggtgatgggacagtgagctatggaatggatgatgctgatgacatatatatgcgttcctggacaggaactatcattggccctcctaatgtatgttgtataacacccattagtagatattaactgcatttgcttctgtatgctcaaactgaatgatcttttacattcaatttgtcttgcagactgttcatgagggacgaatctatcagttgaagttgttctgtgatacagactatccagacagaccacctactgttcgattccagactcgaatcaatatgtcatgtgtgaatcaagaaactggaatggtacatgtccacttgctttcctttaagctaaagtagttggtgaatcattttattggcgtagtacttacaaggagctactttctaggttgaaccaagtctattccccatgcttggtaactggcaaagagaacatacaatgcaagacatcctgatcggcttaaaaaaggagatgtctgctcctcagaatcgtaggctccatcaaccccatgatggtaatttccatatctctgcttcagtgaatttgatctacagcctcgtcgttttcccttaagcttataaaccgcaaccaaaatttgagttttaaaacttaatttcggagttaattttagtgcttttttttatcgtagtttatttctagcatttgtttttaaatcgctgaggacacgtatataaaagtttcgctcacaaattattttttgggcactgataagcagttacagtttataatcagcataagcgaaacaatgaggttgctacttgctagactgaagttgcatgttgggttctgaacctagttgctgtttctttctgcaggcaatgaagatcaaagagtagaacagaaagggctatcgcttaggtgtgtcatcatgtaagagatgcgaattgcaatgtacagtattattaaattgagtagcatcaggcgcaaaaaagagaacccatgatctcctgtaatttggcagtaactacattggatccaaaccgtgctgtcgcctcaataaaatgtcggcaacttcgttaatttgcacattgtgtaaaccgttcatcccctcgttcagtaagattgcaacttgcaagttgcaacccatgtctccattgtttcaggaaagcatccgtaccatctttctgcttgtctgttccagtctgaattattagtttgtctggagacctgtaattttcttcagacacctggtatgcatgctagttggagagcagtatcttcagaatgctaacctggttgttgatgtcaagatacccctctctttttattttttatcactgcacccaaaatataggtgctccaaaactgggaatttggtttttttctatgaaattcagtgaattacactcaaaacttttttgccgacaaacttatcccggtaacctagacacctagtatacgtgcaagctggaggtccataaacttccgaatgctgtggccggacggctgctgtttgaggcgattttaaacttcttgcacaacaccaaatccagacgaaattcagctaaactcattagagaaacctcctcatgaagtcacccaaatgctgaacctcacctcttgcaaacaagcaggagaccgtgccctcctcctgttgagagatccttgacgtttcaggatgagaaaagcatccgtccaagaaaggggaaaaaaaaaagagagacgaacaccaaaaggcaaaggcaaagcatttacagggaacatgctcctgcgtgcccacaagcctacagcgcaagccaaggaaagcgaggctgtgcctaccctgccatggccatggccatgccttctctgcttgcaactcgcacttcgcaaagctgatgacaacgcctcctgtcctatccaatgtgattggaatcatcgtcgactcgatctttttcctcatcgaccaccggccaaaccccaggctgccgacacggcagcatcaaaatgatatggcttgtcctactcttcttcttcttctttttcttttttttttcctactatttgtttggagattgacagattgtggaagtaaaacttctggcctctctgcatcgtgtgatgcaaataaccaatttcagaagaccaaaaatgctgagccgagatcggtgtgattctgcatacgagttacttgaaatgcagggaattattatgaactttatgtttttttttagataatggaaataggttacatctctggtctctgcccgtaagcacacagccaaaaagtccagaagattatgaactttatgtaactctcagtagtgtggagttctacacttcaactcattgctctttgaaaccaatgaaacttgcagtgcaaactgtggcctgtgggtgcagactactacagaattacaccctcatcaatatcgcagccatgaaagaagattctaccattgactcgtaaagcagactgaaaatttgtttttccaaagtaaagagaagatggaaacgaaattcaatgttcagagtttcagttctcaaaaaatgttcagagtttcagacttatgtaccacaagaaaagaataaataaacagctgactattcagactaacatgctgtacaagagacaaacacccagcgtcagagatactccgtaatgttcgtttcactcttgcagaattctgatcccgaattctgaagtaacacaagctggctgatgtggcatcagagatatccagagcagtgcaataaacatctcccaggccagtttaattgaccgtacagaaactacagtgcttagcagatcatgtccaagaaaagggaccatttgctgaaaagtaaacactgacaggtcctggatgtaagtactgaaaatgagtactagctacaacaaattcagagtgacattaccaaaaacataattgatcagtctccattatcatatactccctccgtttcgaaatgtttgacgccgttgactttttagcacatgtttgatcgttcgtcttattcaaaaaatttaagtaattattaattctttttctatcatttgattcattgtggggatcctctagagtcgacctgcaggc

SEQ ID NO: 82525 - DNA, 57797 bp, Oryza sativa
gtagaatactgtggacataattgacttgaaaaaagttgtgagaaaaaattgttaatattaaacacttatggaagtatagccaaatgtcataagtacccgttgttggtgctgccaagatcaaagttgtttgccaccaaattcctggtaataattgaagcgttgaacataacaaatttttttccccttgccaacacaaatttgagatctttctacttacaattgcaagttgttctgggtagcccaagagggaaagcttccagtgagctggttgtatgaaaaatctctgcaaatatgaaataaatgcatcattctaattttagctgtactgcaatgttgaattgtttacacacaagttttttagtgaagggcttatcccatctggcagtcctccggttaggctattgttcccaagaaacctgaattgggtagaatacaagatgatgaaacatggtcatcaatataacatatgtttctgtagatgtaataacctccagaaagaattccttacaggtctgtaagcatttgtagattcagaattgattgaggaactttgcccgagatattgttaaaactcaagtccctgtgccacaagacagcatacttgaacagacacttcacatgaaatttcagaaaaaacaccaagagtttcatggattgtgctatgacccataatgaaaaacgtacaggaaggctaattttgtgaactttgaaaagtctactgctccaaggtctccagatatcctgcagttcctcaatacactgtaaaaagtattcggtattagcaagttattactttgtcaatatataaaattgcaagatgtatagttagaatttaagtgtcacatacaggatattcaaagacgtcagactactgacaaaggcaaatgaagagctcccacttacaatatctccaatccgtctgctcatttgtatttagcacatcagtcatcatgacaagaggggatggcaatgttgccatagaacagagtacttacaaggttgtcaatttggttagattagacaaactttccggaatcggtccttcaaaagaatttccttggaaagccctgtgagttcataatttaagaaaaaagtatgaaaatgccaagtttatttgaatattagaaaaagtaacctctacatattaagacactgttgggaccagagtaatggcatacaggtatgcacatttctgttcatagtgatgacttaaaagaaaaaaaacacgctacagttcgaattcaattggaaacaacatatgcagaaaatttctgttgcagttccacttgtcttgtgaataggataaaatcattgatgtgataaaaagttaaaaattactcttacagatcttccaaattagtcaagctcccaatataatcaggtatttttcctgtaaaatcgttatctgatgcccgcctacaagcacaaaaacatgtttgatgttgagcatatgaaaacaaaatgaacatgacaactgtggctctgttcttgaacgtacaggagcttcaggttcttaagctttgagaacgttgaagggaatggaccactcaagccagcactatcagtgtacctgttattaatgaaatgcaacaatcatgcatgttcaacaataggtatcttgctggtccaaattaaactttgttcttctagaagtagcatctgtcaagttagaaagagggggcttacaaacttacaattgttcgagtttggtcaagttgcccagttcttcaggaagttcaccagtaaaattgtttgagccaatgcctctgaaacaaaaggaaatagtttagaattgatataacttgtttatctgcactaaaaatagcagaaaagtggattaacttttcctgatgatccataatattcacctttttaggatttcatttggattaaggttatgaacaccatttggaaaaggtaaattgcaccgacaagacttgcatatgagtaatgtttttttagaacttctccttgagaatatatgcaattaatttacttcagacactaatcaattgttgagaatgagaagacatgcaagaagatctcttacaatgatcgaagatccgtgagattcccaatttcctttggaaggggcccagatagcgaattgattgataaggtccttttttcataaacgaaaaaataacaaggagagaagatgtctaagagaaagctccaacagactgatgtagaagaatatataacttgaaatcaaactcttacaggtattgcatgaaagtaagcttcccaatgaatgatggcacagggccagtcaagtaattttgctgcaggttcctgaaacaacacaagaatcatcaaacaaattagccaaacacacgaggtatgattactattaatccagttttttcctgctaactgaaaattgattagtcaaaacatgggattggatcaatatttactgcaaaaatactgttcaactatttgacagtgcaacagaaagtgctccatcaatcatcataaaaaaaaattctaaggcataagaatttgaaaccatacaagttagccagatatctgagactctccagctccgcaggtatcgtaccgacaacattcaacgcgtacaccctcctgcataaacatcacgtcagaaaactcccttgcatgacgacagtaactaaaaacacaatgcactaaaaagattgtgtgttcgcaagtatccaaatcctattcatcgtgatttgtgaattgatcccaagagcaattatatgcttcttgcaactaccagaccaaaaataaaaataaaaatcggaggaccccatggcctctctctagaatttcctctgtcctctgaggcattccgtcgaacacctggcctgcggtcgaagcaagaggttcagtcaaaggcgtgcacgtacagcttggtgatgtggcagacggtgcggttgttgaaggagcagtcgcacttgatgccggggttgacgacggggctgtcgtcgatgttggtgtcgtcgacggcggtgccggtgcaggggtcgccgccggtgatgttccaagtcttgggcggattcgttccccatctccccaggatcgcgttcagcgccgccactgcattggcgttccacacaaacaccaatccatttctttatatgcaaggtctaaaccaatatagaaaaagaaaagaaaagaaaaaacagagaggaagaagcagcggcgaatagtgcaaaaaaaaaagtttttaaaatgtacgacgcagttcacttctcgaccaacattcgaccattcgttttattcaatttttttacaaatataaaaaatatttatatcatacttaaagaatatttgatgatgaattaagtcacattaaaataaataataattatataattttttttaataaaacaaatggtcaaactttgaaaaaaaattaacggtgtcatacattaaaatatagaggtagtattacacaagttgttcatcatcttaatgattgatttctcttcctctatttttttttcgagaactgcgtgtaatgtattattccctccattatttttatttgattgtgattattttcatcacgatcaaagacaacttaaccttttattttcatttaatgtgattatgtggtagaaattaatcaagaaacgtgcgctttaactaccccaaatactgtgctatacaataatgctatatgttaaatgaaggtacagtgtaatgtgatcttaatttgaaatttctaatttttaattatgtgatgatcgatagagtattactccctccgtttcaaaatatttgacacactttttagtacgtgtttgaccattcatcttattcaaaaaatttaagtaattatttattcttttcatatcatttgatttattgttaaatatattttcatgtacacatatagttgtacatatttcacaaaattttttttaataagatgaacggtcaaacatgtacttaaaaagtcaacagtgtcaaatattttaaaacggagggagtacattatagagttgaagaaaatcgtggaacaaacgatccggctaactctgctttgaacagaagcagggataactgacctttcgtcgaagataaaacaggtctctttatttttatttttagatgaaaaaagaggtcgcttctgactattggtctaaaaaataattgaaggaaagggacaagaaacagccaagaagaaaataattcttcttccaaaaaaagagagaagaaatgaattaataagccaccaggatcaactctgcagtgctattttctcttcaagatcggcaacatttttgctgatgcacatgtaataaaccctttctaaatcttaatgaaccgatcgaagacgttccatctctcatccggcgaaaagagaaaaagaaatcaaaacaacatcaaacatatctctaatctgtcttcctatctctgaagactcaatgaaaaaaaatggagagaaagctagcatatttgcaaatcggagaccaatgaacatgtatatatccaatccaaaagcacgtttcaactgatacacataccttcaactggatcagttcttggagcttgctgagcctgagcagctgcaacccaagaacacgcgatcaccagccaatacaggagcagcagctgcctgccatggctgccgctgcagcgcctcctcatcatcctgaaaaatctctctgctgcgtcgtcgtcttctctcctctccttaaaaatctatgtagctatgtctgtcaacgcatgtacatatataagctgataaaatcatcgatctgtcgtcggcacaaatggatgcgcaacttggagcagcaagttgcttgtcgacagatatgtaggagcagcagcggcggctccaggtgaagaggacctcgagaaaatcaatcgaacggcaccatgtgtttgtaatgccattagttggaagattaatcaacgccagaaagtcgtgtagacgtgtacagtgatgacgatcgaactggtgtcgagttgaccttgttttgttaattactagtataagagtaatttcgacgatttccatagtactgtacttaattagtactacacagttgtcagctttcaagacgttttaactttgatcaaaactgtttcatatttaactaaatttatagaaaaaataataatatttttaactcaagacaaatttattataaaaatatattcaattattaatttaataaaactaatttggtattataaatattactatatttgcttatacacttagttaaatttaaaatagtttgactttgactaaagtcaacacatcttacaatacacgaattagttccaagagtgtacaggtcatcaacagatatgcatagtttttctcactgcacagtaattggagttgctagcaggttaattagttttgagtttcacataacatctagcctgagtttagttggatccaaagtttggattttgattaaaattgaagatgatgtgactgaaaagttatatgtgtatgacaggttgatgggataaaaaaggactgaagtttagatgcacacagccctactactcctatatcccatcgactgacgactcgtcgacagtgacaattgttttggaagtatcaggaatatcctaggatcgatacatcggtcagggatcgatgccaaatatgacttgtgcccaaatctgaataatccatcgccgaattatagaggaagaaagcgcgaagcagtaaacgccatccatgagttgaatgcatgcgtctacattacagaatgcgacataaagttttggatcgaccagttccactactacctagctgctagtactaattgtgcatgcatgcgtctctggtcaattaagtaagagaagttcttcgagaaaacaaaataagattagtcccacacgcatgcatggctagctgggcaacaacctgcttgacttgtttactacgctctccgtttcctactataaatcattagaaaaatatccgtacgttgtaacggatgaagagactattttaatcttattattattatatggtttagttaaggtgaaattcattatattaaattcatttgaatatatatatttttgttagaaaatcatgtgctacaattagaagtctgatcatcttaagttagaatgcgagttttttaaagagatttttttatatgattccttctatatttccaaaaacgaactaacttaaaaaccgactaaaatatgaatttgtgtttctaaaagtgaatgaacttaataaccgacttatatacggatgacataccaaaaataccggcaaaaatatcttcaatttttataatattagagatttagttattttctaagtttaaccaaatttatagaaaaatataatactctctccatctacttttgataggcatatttccaaatctaaaaattttatttttgatagacatatttcaatctaacaatctatactcttaatgactttcttggatttaaggcgtgactctacattctttcatacaagattggctacatggatatcgagaaatataaatattaaagaatcgcttgttacaaggaataactagtagcatgtttaaatggatgataagtagaattacttatccttattctatctgccaagatgaaatatgactataaaaaatagatggagggagtaacatttttaacacaacataaacacagtatcaaaacatatttcaagttatatttaatgaaactaaatgttataaatgttgcttttttttaataaaacttaatcaaacgtaaaaaaagtttaacgcgaaaaaaaaatcaaaataactcataataatataaatgagagggagttaattctgtagttgacaagactcagattgacaagatgacaactgtagatgtagtactctgtatgcatgcgtatctcgtactctcgtatactcaaatacattaacgtacgaagagagcgatgtctaagctacctagttgttggatcgatgtataaattacgcacgttgggatatagcgcgcataactaatgctaacgacgcgcggtttgaaagcccacagtatcgaattgggatcacatgcagtttgtacatggactacaagttaagatactgcaggcaataggagccatctattttgttgatgaacggaccagatcatcagctagctacagtatctctccggccggttgcttgtttcgttgtagctagcgtacgactgtacgagcaaattaaaaaaggcaccgtatccggtgcaaatcagggttgttgtgcaaccttacaaactttcaatcaagaccacaggatgcccatccgatggctagggacagatagagctgggacttgggccgtgctttatcaggccggcccaaggcacgaaggtccggcacgatagaaagcacggtccgacacggaccgtaaatgggctgggccggcacggcccgtacgtgggccgtgcctgggcctggacaacgggcacaacgggcggcacggcacgaccactgggccgtgcttgggccggcacggcacgcgaatggctgctgcagcacgaggtcatcagccatcacccatccacggtcaaatttcctatgcagccagcaggtagcagcaagtagcagctcgttttcttcatcggctcatcggtagcacgtagcagcaaccagcaaggccatcagcccagcaggccagcactagcatttggcaagattgttggctgactcacgccgccacgccggtgggctgcgtccccgcgacgagctgacgaggaggagcaggatgggcgtggctgtcactgccgcgtcaccgcgacgggacgacgaagccgcaagccaccgctgccgcgtcgccgccagagtttcttcttagcgcagccggcctgctcccgtcttttgggtcgtgcttgtgccggcctggcacgaataggcccgtcgggccattgggccgtgcttgggccgcgtcctgaagaggccgtgctgacacggcacggcacgacaagtgggccgtgctgggccggaacggcccaatttggcacgaagcacgctgggccgtgccgtgctagcccggcacggcccaagtcccagctctagggacagaggtgggttacttttgcacttaaccgccctcactcatctctactaatttgttttttatgcaaatcccccctaatcacagctccgtccgtccgccctccccgcgtcgtttcatttctatagcacacacgattcgccgccgccgcctgcctgagtccccgccgccttccagcgactcgccggcgccccttcgccgcgccaccgccgccatgtcgcaaaccctcccgttgtgaggtcacggtgtagaacgtgccgctgccgccttggagtccggcacgcgcgacgtttcgaattccaacgcgacagaccctgtgcaggaccagcgggcgagcgccgttgatcctgtcgtcgccattgatcccatctccgttgaggccgccgccatggatcatgccgtcatcatcgtggacgagggccaaacaagctgtgaactatgaaccgtggaagtgtacttgctggaagtccctatacttgatgtattcctgaatgagacatgcttattttcgtattgtgaacattttaatcttaacctgtatgctcttgttatgggtagatgctgccaaaatttagtaaaaaagggtacatgctgccaaaatctgaactgcaacaagagcttcttatctgagacatatttgccatcaatatattgcaatacatgaaactgaacctgtatcaaacctatcaagctgttgtgctctagcacatgtgcagaaaatgcacaacaagtagtttgacagtttgacagattacaaaattcgtgttggtttcagttcatcttttatccgaatgcgtgaagctgggcatatattcagtttgacagattgacacagaaaacaactggtagttcattcaggctattattcataagagcatctccaacagactacccaaatccgactctccaaacacctatatagccaactctccaattgatttggagagtcaaacttatagattactccaacaacatctctatccacgctctctactctgagtctatgacaacgacccacaagtcagtctctactctttctccccctctctctcgcttttctccccatatgcgatggcggagacggcggaggctacgaggcagaggggcggtggacggtgtcggcgtggtcggagcagaggcgcggtggacggcgacggcgcggttgagaggcgcggtggacagcgacggcggatgtagaatgcgattgcggagacggcagaggccacgaggcggaggggcggtggacggtgtcggcgtggtcagagcggaggcacggtggatggcgacggcgcggtggacggaggaggcgcagtggatagcgacggcgccgttcttcttcccctctcctccccgagttcgcgccgttggatggccgggggcaaaggcggcgacaaatgtggctgtggacgaaggcggcgatgctggcgatggtaggggatccggtggtgggcgggacgacgatggcggagatcgagacgacgatggtggagatcgggacggcgacgaagagggaggggatgacggagatggggacgacgatggaggtgcggccgaaaggagcaccgtggcggtgaggaggagctagggcgcccatctgggagcgggagatccggggcggcgcgcggccatggccggagatcgaaggcagagaggggaggtcgcggctagctccggcgcgaacgacgacggtggtcgcggcgggcttcggcgcggacgacggcgtcggtcgcggctggctccggcgcctctctcctatgtgccgtcggccgtcgctgtcgtgcagtgcggttcatgccgtcgccgttcacgagcgtgctcaagccgggggagatagatgggtgggagagggagtggtgggtcccacaaatagccaggcagggagactctccaagtttgaccagtgaagtatgcgatttagccatccggctgttggagggtatttttctcccatacttgctaaaatttaacttggccagtcatttagccactctattggagttgctcttacacacccataggttccactgtcaccacaagcaagaaaaaaaattttatggttccacttgactcaatctcattatcaaatgacattacacaattccattgcatatttgcagtcacaatctttcagagttttagattacaaaatcagtacatcagtgtcaatctcagaacacgattccattgcatatcagctcggcgggccagcgaccgcgttgagccggctgacgcggccacggcggcgagcggcgacggaaggaggcacatctcggcaggccagcgacagcatcgagtcggctgggcggggacgcggccgcggcggcgagcggcgacggcgggagggcagagggagaggcgaggcagagggcagaggacggcggccacacgaagcaggggggatttgcataaaaaaaacagattagcagatatgagtgcgggcggttaagtgcaaaagtaacccacctctgtccctagccatcggatgagcatcatgtggtcttgattgaaagtttgcaaggctgcacagcaactctggtttgcaccagatacggtgccaattaaaaatgccaccttctcacacggttaatctaaatatttaacaacatgcagcttttgatttgatcaaattaaccttaccaatctctctctcttttttttttgaagaatctccactactcataagttcagaacatgcagccttcgtttcatattatttttgtcctaaaattaattaccttcttagaaaaatatatcaacatgatctattagattaatttcataaaagtcctcttaagagacccacatgcaaaaaaaatatatattttcacataggagcctcttaacacacccgcatgcaaaacacaagcattttttagcatgtggatttcttaagcgggcgcatgcaaaaatgtctcttcccgctcagcatctttaaaattttaagtccccatcgttatctcctcaacttctctctcacctctcatttttccacaccctctcaatctccttactcaatcccccactcatttttctctcctcctctcccacttcctcctccatcgctgggtaggagcgcgggcgggcgacaatggcaggagcggcgggatgctccccggctcctcctccacagcccggtgggagcacggcgggcgggagttgcagcggcggtgacaagcttggcctcagatggagccggggtggcagtgctagggttttttttttccttttggggaattttatttttttcgcgattttttgttttcgcatgtagttgcgttggtcgcatgcaaaaatccgattttcgctgacctttgggtgcaagcgggccgccccatccgcatgcaaaaatcgattttggcttcatggaaaaactgaatccgtagtagtgcacgaaacatatcttgatgatgtatttatttattattgtatatatttctgcatttttctataatcctgatcagagttgaagaagtttaacttaatcagtacaaaagctaaaacaacttataatacagaaccagtggaatatctcataagttcaccgcacattgaagaggtagtatgttatatatttttatactacctaacaagctacctcataatttatatatttttatgctatctaacatactacctcttaaccgcacattaaagagtatgtactttaagtctttaaccataacttacccaaaaattttgaataagataaatggtcaaatgtatgtctaaaaattaatgttatcatatattaaaaactgaagggagtctcttttcctatttcatggagtcatactacctataataaaaatatattattattattattattattattattattattattattattattattattattattattattatctttattagcacagttaaaactcgaccaattgtgacgatgtaaagtggactttttcccacctccgttacatgtgtgcaccctcggcccaaatcggtgtaccccaaattagtgtacctttcggcccaatccggcctgacatagagagccaacgtcaggtgtgtctacaggcagcggacgcgctaaccgacgggagtatatcaaaccgatttttaatcttttgattaaaatccaatagacacagtaaaaagcaaaaagcaactcaaaacaccataatgaacactaaattaccatatcttcaagaaaaagacaaaatccaatataaatttcaaaacttacatgcaaagattaaaaaattacattgtagcttacaaaagttacaatgtaagtttcataaattacactgtgacttaaaaaaaatatactgtaattttgagtgaaaaaattgagtgagagataagaaaaaatctttcgagtgagatatagcaaaatcgataacggattcctctcccgaaattcctaccgcgcgatcgcttgcgaggcacgatcaacctctcctctccacgtggtttttttttttcaccgtattactttcatattttagtaaatttatgcacctaaagtttgtacacctcaagtttacacatctaaagtttatacacctaaagtttagagacccaaagtttataagtcaaaagtttatatatccgatttaaatttgaatttgaatttaaatattttttatatatagtatttctatacatctaaagtttatacacatatagtttatagacacaaagtttataagtcaaaagtttatataccctattcaaatttgaatttgaattcaaatatttatatatatatagtatttccgtacataaatttttctaactttgttttcttatttttttttcaaatttatggtgtagtaggaagagaagaggggatgagaagggggatggagggggggtgatcacccacccattagcgttgcccattcctgattcaattgtgttaagattggggcaattgtgttcctgcccttgctttctgattcaattgtgattttacctcttctttttagggtttgtgattttgcccttgttttttcaaattgaagcttctgtttgcccttactctgttaggatgaattaacggtgttaatttagtagcagaaagactggtgtgccctttgcatttctttgtgtggatgtactgtttttgccccgatatatgatgtggacattaactttgagattgtatggcaactccacacaaatcaatttattgccagttattttcaggaacatgtcagttgcatatattcatcatcacgaagggaaaaagaaaggagaacgcaaccaattgtccaaacaaatctattacctagctttttcatgaacaaagagattgcacacatcaaaaaggagaaagaacagagagcccaagcaaaaaataatccccagatccatctaacagagcctcaatgattcatcgcagttgcttgccggttgattcaatcaacaaagcaaaccattaaaccctcccagttcctcggtggcaacggtaactttgagcaaagctgggatccaacaaggaggaggcgcaggattcacatgagacgatgcacccagcggcaaaatgtcatggctgacgcagtcgctgtcgaagtgtcgataccgcgcgggaaatcagaagcctgccgcctttgcgcctgcttgcctccagcaggctccggtccgcagtcccgacgacggtcggccgcgcgtgcgcctcccctgcgttggcctgttatccccgccgcgcctccccttcatgtcgacccgtagtcccggcgacattccgcggcgcacgcacctccccttcgcgccgccgcctgctactcccctgcgtcgcgtcgccgtgcctccccgtcgcctgttcgtgtcgccgccgcttgctcgtgccaccggcacggccaaatcctctagccctaggttttgggatgggggaggggaatccgtagctttccaacccaattcgcacagctacttgagtgatttatttactcaccaggggtataacagtcattgacaaattacgaaattatttttttattttcttccccctttgtttaactcggaaattctagccccactaacagccgtcaaaatcgagggcaaacagctacttcattttgaaaaagcaagggtaaaaacacaaacctaaaaaacaggggtaaaatcacaattgaattagaaagtaaggacaggaacacaattgccccttaagaagggcttaaacgctaccaataactcaataagagcatcatcaatagtgcctctaatccacttccaatttatatttttaatgattttagtctaaaaatccggcccaacggcctccctaccttgtccctaaatctttgggaattttcttccctttgattttcgctctaggcatatgagggcgaggcctcgctcccaatcttgcggtcacgtcgttgtgaaacatactaggtctcttgtgatgcctacgcatatatcgaagcgggttgttcgatcggtttaggttcgccttgcctacacatggacttatgttttaggcaccatagaatttactaatggtgcatattaatagcagaagtcccaaaagcagcaaactagtagcgaaggtagtttgatgaaggctcccatttttcaggaattcctagacgagaagcggtgctttattactcccaatgcaacaagcatgcaacttgacaaccatgcgggtgccaccactgaaaacaagaaaaggaggagggggacgcaaaatagacttattccttaacccccaaatcatctcattctcctctattcggaactccggcgtcgggcatggccatcggccgtcgccaagaacggcgcgccactcctcggccccggcggcggaccttcctccagctcgtctccgcgggctcatctaccgctgccacgcgcgcgcgcgcgcgcggggtgtcacaccgcgacgtcaagccacagcggagcaggaggccggccgcctccacgccagcttcgaggagaacgtacggcggccgcccccaagtccatcccattcgccgcgcgcggccttctccgacctcgacctcattgtcgtgtaccccgcgccggcggccgggtagaacgcggtggtgcgcgctgccttgccctcgtttctcgcccccctccttcgccttgccgtgtcgtgctgcatctgtttggcaggcaacgcgtcggccgcggccgttgaacttggtagtgtggccatcagcaagcaggcaacagcatccaattttgattttggtttgacgacggtttcagaatgggtttaaatccatttcttagcttgtttggataattggattagctttaattttgcacttggggctgttgagattataggcatataataatttaatatattccataaataaatcatggcattgcagatgtatactagcattaacgcatcattagatctacacatgtaaactaagcagtaaaacatgaacagatcaaatatgcgcaacatattgaacacgtaccgaggtggtagaaagaccggctgctcggcaagaacatttcgcaattgcaggcgtctacgaaggcgcgcagcacgcgagcgaagaggaagacgagccgtcgcggacgaacagggagcagtcgcgctaagcgcttcccaaaaaccttattgtcgccttctctcggtgcaggacatcgaaggcagaggttcaagagacctgctctcccgatcgccagtgcacgccgacgagcgcgatggagtaatctacgagcgacggtgcagcatagagtaggaggcaaaccctagattgattttgcgtgcgttgcgtgaagacggcaggtcggtttatatagagaagggtcgcttgatcagggcgcccgcacgatctccactgcgcataaccgaaccggataagtcacgcgtaacttatccggactccacgccgttttcacgcaccggatttttcggaatgtttccaaaacaaaaatgaatccgaatttgcagcaaaacaaaactgcaaaaggaggctgcatctacgccttgcccaggccaggcgaggcgagcgagcgcgtgtgttccccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccatccattaattccaacgggggcaggccggttcgggtgttgcctttgattaatggatttggattggtttggtttgtgaagtatagtgtatatacagatgaatggagcgggtcctactaatgcgcgggtgatcgctgggcgcactcccctcctcctatgccgattcctctctccccctttctccttcccatcttctcttcctactacagtacaccacaaatattttttaaaaaaacaaaaagttagaaaaaattatggatagaaatactatatataaaaaatttgaattcaaattcaaatttgaatttgaatacaaatttaaatttgaattcaaatttgaatcaaattcgaaatcgaattcaaattcgaattcaaattcaaattcgaatttgaatcgggtatgtaaatttttgacttataaactttgtatctataaactttagatgtatagaactactatatatagaaaatatttgaattcaaattcaaatttgaatcagatataattcaaattcaaatttaaaacgggtatataaactttaggtctataaactttaggtctataaactttagatctataaactttaggtgtataaactttagatgtatataaatattatatatataaaaaatatttgaattcaaattcaaatttgaatcggatatataaacttttgacttataaacttttggtctctaaactttagatgtgtaaacttgaggtgtataaactttagatacataaatttactaaaataggaaagtaatacggtgctaaaaaaggaaaccaggtggagggagggaggggggaatagggtgatcgctagccaacagccagggcgattgatcgctgattagagtttctggaatggagcggaccaatccctagccagctggccagagaatcctcttaagatcagctttcatggaagaatcacccacatgatctgtcctcagagatttgatattttgacaccacaaattgggctttgattattcgacatcgtgacccactgtaaccaactcagatggacccgcatgttattgtcaagagtgttaacatgatcgaagcggcaacaaatatggagtgtcaaatcatcaaatttaaccgtttcagtgtagatcaaggaaaaaaagacaggcaggactggtcaaagatcataaagcttacagaaattcagaaaacttgtggttgtgatgctcaccaacccccagcttgggtctacatcatgtgtactctccactgaagacttattcagccaagtcagggactgtttcaagggaagtgaagagcacagaggatggtgattttgttcatccttcacggcgaattctcccaatttcttccatttaagttcttcttggttgtctgattattaggtttctgcttcgaaaatgctggtttgctctgctgctggctgcttgggttcaacctgatctggtgcttcctagtcgaattcaaggagagccggtgagctaagctccaaaccagttgcaatttgttaaagaaccagtcgattgtcatatgcttgctaacctgcttccgtatttgcagaggaaaatatttgggaggggcaatggcagaaaccgcggtgagtgcatctaagggtgtgataggtgccctttttgagaagctcactaagctggtggaggacaagtgcaccaatctcgtaggcatgtcaaaaaatattgtgttccttaaagatgagctcccaaccatgagcgcgctactcgagaagctagaggatgcagatgaacttgatccagtggtgaaggcttggaggaaccaggtcagggagatggcatatgatattgaagattgcatcgatgactttgtgcaccacgtgggaggtggtgatgtggaagctggcttcatcgataaggtttctcactttctcagaactttgagggcccgtcttgagactgccgagcatatcaaggatctcaagattcagctaatagagataaatgaacggcacaagaggtacaaatttgatctagatgacactcctagttctagctttgtggccattgatcctcggttgccagcactgtacagtgaagccgctaatcttgtgggtattgaaggcccaagggaacaggttataaagtggttgacagatgcggatcaacaaataatggtcctaccaattgttggctttggaggtctgggtaaaactacgctcgccaaggaggtttatcaaaaaattggacagcaattcaacaccacggaatttgtttcagtttcccaaaggcctgatgtaacaagatttctcaaaggaatacaatcaaaacttccgataaggctgtcttctgaatattgtgaagttaaagacatcattgacaacatcagagcatatctacaacatagaaggtcagtatccatttacttataatagtggtaggcattaattctttttccgttctatgttttcaagggttcatatggtttcaagaagttttctatctaaagtgcctgttttgctctacataattacttgtttggagctgacaggcatcctttgccagctttttggcttctagaaaagtaaagctcttctcttaaatgggtcatgtgccagagttgaggggcaaaaatatctaggtctatattagcatagcgcacagatgttggtgcgatttaggtttgagttctaaatgaatatcctaatttagcaatataattcatggttagtacaaggaaaaaaaaactcatgaatttccttgaaccaaatgtgcttattaattgttgaatttgttgatatatttcaattattcatcgcacataccaaagaattgtatggcacttgataatttaatttaacaggtacctttttgttgttgatgacttgtgggatgcacctacatggaatattattcggtctgtttttccagaaaatggcatgggctgtagaataattgtgaccacacgatcggaagatgttgctagatgggtatgctgcaatcatcgacgattcatttacagaatggagcccctcagtgatgaaaactcaagatggctattctttaacaggatatttggctcggaagatggttgcccttcccaatttagagaaatttccgctcagattctgaaaaaatgtagcggtttaccacttgcaatcattaccattgctagcctattggctaatcagcctgcaccacacaagaaagaatattgggagagtattcgtaattctattggcacctgggggtctggcacaaatcccacgttggaagggatgaggcaaattttacaccttagctacaaggatcttcctcgtcatcttaggacatgcttcctataccttggtatttatcctgaggacttcaccatcaagaaggatgatttgattagacaatggctggctgaaggctttgtccatcatttccatggggggagttcagaggaagttgctaagagttatttcaatgaactgatcaatagaagcttaattcaaccagaagaaaccaaatatggggaggtagtttcttgtagagtacatgatatgatgcttgatttgatcttaagtaggtgtgcagaggataattttatctgcgtggcatacaatctagaagaattgtctggaaaacatgaattcaaagtccgtcgattattggtcgactctagagttggtgattcaggagataccaaaatatcaggaacacctgctcctagattgttgcaactcagatcacttcagctgtttggagtatctgtatccctgtctttgttgccactgtctaagtatatccgagtgttgatattacacttgggaaaaaccgggacaggaggcaatgaaagagttgatgtgaccgcaattgggcaattattccagttgaggtatttgaagattgtaagcctccatcatgcgctcgtactagagcttcctactgaaattcgaggacttcaatatttgtcaacattggaaatagattgcacaaatgagaacagtttgccatcagatattgttcatttgtcccgcttgtcccacctgattgttccaagtggtatagggttacctgatgggaagataggcagcatgaagtccctatgcactctccaaaaaattgagatattagatatcaagagcgccattggccttggtgagctgaccaatctaaaggaccttgagctgtacagtaaacaggctctgtcagagagagagattgatgcgctggtaacttcccttggaaaacttcataagctcatatctctgcgcatgtctaagtttgcagaatgtatctggtatgatgaggataaccggctcggttcattgtccaatcctcctctcaatattgagagactccacctgggaggatggaggttgcgtcgagttcctagatggatcaatggtcacctccaaaacctctgcttcctcgttcttgatgttacagagatgtcaactgatgaggttcggctccttggagagctaccttcactcagtgaactctgcctgagcgtgaagcgtttggctccatgcagcgcatccctcgtattcggtgcagggttcccagcattggagtgtcttgaattcttttgcggtggagatatatcacacctgtgctttgaggcaggggttatgcccaatctcagaaagatcattctgttttacatagatattgaatggagcggcaccgcaccagttggcattgagcacctactgaacaaacaactccgatacatccaattacatccggttactgacacagcagtggatgccgagcgtatcagcctcgcattcacagaagctataagagcacatacaagccgtggtggtgctgaaccttacctgcgcttcgcccggatccgaagtggtagcctcataggtgcaaactctttaatccggcacagttttacttgtcatagagtttctgctttgtttctcctgaatcacattcttgccattcttttttctaaatttatattgtgcatttctgttctaagtttacttttttggttgtacgcgtaccttgctgagtattggaaactcttccactttcagaatgactgatcggctaccttctatcttgaaatggcgcggggacgcattcatgtttttagttcaagctgcagcaatgtttccttgaagaacattctgttaaatggtaggtgcccttcacatctctttgggcttgttcactttgatgccaaaaaaaaaccttaccaaattttatcattgtccaaaattttggcaatggcaggattttttatataattactaaaatttgacagcaaactaaatatagccactttttgataactttactaaaatttgataaggttgaaaatggcatcaaagtgaacagggcccttcatcagctccaggagacagcttcgggcttcggccagagtcactagaacagatcaatgtgcagagcacttatgtcatgccagttatgacccggcactaataaggttttctctgttagtagtgagctactccttccaatttcacaactcttgacattttggataatattgtttaaaatgtcaagaattatagaactggagggagtcactgctcgtaattgttcgtgcatctctggtaacaaattaagtaaagtcctggatgcacaattagttatagaaattcactgcaataagaagctggccattgcatacatgggcaacatgctggacatagattgtttactagtattaacaacaaaagaacatactggacaacgatccgtggtgacctcgagttgatttttttttcttcaaaaaacggacagattggattgaggctggcgccgcacctgcttatgcatagtcatatatatatgaatcaggggcaaaaaagaaccgaagccgaatcaaatgcaaatcaatcgcgggacgggacacaattgagagttgagaggctattcgagtaagcatggaaacaaattaaatgatgggctggaaatcttgccggggatcggcctgtcttggtgaaatgggcagcccatgtagaaagaaaaggcccaaattcgggggaagaagtttagaggcccaaaatagcattgcagcctggactgaccattggatcggaccgaccgctttcatctgtaagggccgatctgcggcgatcacgaccgatcactttacacctccatcatctcgctttccacgggaatgaaagggagatatttaacaatggggcaattatattcttacctctactttcgtatgtaattgtgattttatctctcttttttagtttgtaattttactttttttaaacaccggtttacccctactctgtgaagatgacttagctgtgttcttttcccctctttcccaactcgctttcctcgttatttacgcacacgcttttcaaactgttaaacagtgtatttttgaaaagatttctatatgaaagttggtttaaaaaattatattaatctattttcaagtttttaggctaatagttaattaatctcactataatttttaggctaataattaattaatctcactataaccacgtactttgttggaatattgcccttccgaacacagccttgacggtgtcaactcggttataaaaacacatatacaagctttaacacttgcccatacttttctaacaagatttgtatattttattaaatttaacgaaacactgatagatttttgacaggattttcacaaacttgcaacgggtgcaaaaaaaaaaatcttccaaaagtattaatcacattcaccataaaaaagatcaccaaataaattccttgtagtcaggggcggagccaggtgtggagcaacttgggcccgggccccacacctggcagaaaaaataccaaggaatttactaatttttctattaaaatttgttcaacaagttcatactctaatgattaagccctactcttaacataatcctggcttcgcccctgcttgtagtgattgggaaaacaaaaaaaaagaagagaaagaacaaacgttgcaagctgcccgtggacgagccgctcgacatgcctcgtcgacgagatgctcgctcgccgcccaaatcgtcgcgtgctggcgtgcagctgccaaggccgccgccgccgcgagctcgcgcactgccgctggagctgctcatacacgcgtgctgctgccgaggtcaccgcatggtccgcatccgcgcccctcacctgctcgcgcgctgccgccgccggagcgcctccttcaccgcctggcacctgctcactcctggccgcgttgggatgcttcgcgcagccgcggccgtcgcctgatgctcggtgcgtcggcccgcctagagcaacccaggctctaggcatctgctgctcctcgcctcgccccacccagccgccgcgccgctgccgcagccgccatgtcgttggtttcagaatgggggagcgggtgaatggtgccacggaatgggtataatggtccatttctactttctttacagtttcatatattcttttcacactcttattccaggtccaccaaacgatctgagcgtaaataatagcttcatttaaaaaaagtaagagcaaaatcacaaactctagaaacaaggggtaaaattacaattgcttctgaaagtaggggcaaaaatacaattatcccatcaattatttactactgttagatgtagcaattaatcatttattacctagatccacacatgtcatgcacatataagatctacatgtgacacatagatagtaaatgattaaacgctaaatctaagagtgggattaagttaaatgtcctgagaaaaacaagggaagaaagataaaataggacatcgtgactttacggttttagctatatgctaccacacgaagtaacttttataagaagacgtacactttgtaaatatggaaattagctcatggacaccatgtatattaaaatattcatttctaattgaatagaagagagaaaccacgtgaatgctatgaaatatctcttggcggctagatccacatgtcaagtccccctatctttgcccctctctctctggaagtcatggcaaagaggagcaagaggtgagagaatgcgctggagcatggcagtgccaggcaggccacagtggatgacgtcgagtaggagcggagtgcatggagatcgacaaggtggtgcggacgaagtgcaagtggatgcacgcaggttagagttgcgtggaagcagtagcgctaggtgcgagtgcacaagacatcatcggtggcgacgggaggaggaggttgagctagagcccactcggcgccatgcaaccgagctagaggagtagtaccagcaagcgacaacccaagaaccaagcgtgtggtgggtttgcatggagcaacgaggttgttgcgacggggctctacgccatcctcaaccacattatcctccatgccacacccgtccaagccgttgagtgcgtcagtgactccgactcccacaccaccaccggtgccatggccgttacggcaaatgacacctattcctgttgcttcgtgacaaaggtgtgtgctatggcgcccatcgacatggaaacccacctcagcggcctcctccaagtgggtgtgcaagtcttgcagcgagcgtggcttcaccgtgttactcctcccccatttaactattcatgtgcgagcgagatagagagatgatagacctgacaatatgggctcgagggtattcgatcaaaataaatattataatgggtgcagtgtccatgagctaatttccacgtttagagattatcttccatcaaaaatcactttgtgcggtatccaacattaaaaccatgaagccataatatcatgtagaaaaatttgaggaaaaaaaaacaccgcctcactcattgtcctattttttcatacctgaggtgcaattgttgcaaacaatgtagaactgttgtgacctgaatttgttcactgactatacagaacctccgctatacaaatcaaggatgctgttgtgggagaaaatatttatgttgtagttgcaaatgtcgtgcgatggataaagctgtttgaacgtgctagaggaattttgaaggaattaagatgtttcttaactagagagaataagagaataaggtttgctatagacttctcaagtgaatgttaataaaaggtttaaattttttctaaaaaaataaaaggtttaaattaagctcatgcttgaaatccttcaaaaagtggaggaagggaatatttccctcttttcagccactccattccaagatcatcataagagaaaaaaaaactcatagggccaataaaaattccacctatgttttgttaattccaaactcaaaaaagcacgcacacaaaattggtgacaaatacatttgcaaactcctacaaaatttgctgtacccatagattgtttatgtttcaaatgtaattggtcaggaattacagaccagatattacaacaccatgtgcatccagtgtttgatctactatacatggaagaaaagaaatacacaaattgttctgaagtaagaaaaattaggcaaacatgattatatgaattataaccctaagatatgaaacccaacatgtctagttctcatggaaagttaatgaagggcacaatgtttgaaggagaaaaagggaccaagattcactcaaacttaaaaacagcacccttgggtacttatctatcaccttccctcagcaaactcactgatagaattagccgacaaaacaagtgggaaggtttccccttgggattttgtgttgtttcctgagcttgatggcacactagattcggtgcctgaagattgctgcatcgatgacgtgaagaaactatcacttccactcttcctctgccactgaggcacatagctaggccacatactcatatccacctcactcatctcggtatcttcagtaagcatggagacgacttttgacatcggtgggcgttgctcaggcaggcccacggtgcaaaggagaatgatgttgatgacacgcacaacctcttcctcgtcaaatcttgcaagtttagggtccaacatttcaagagtctgacttcgctcatgtagccgccaagcctattaaaatcagtttagtttgatgatttgatgtttaaccatggaaaagtacttctcttaatcaactcacccatccaagcagatacttcttatcatcctcgaggctctcatcaaagtttggccttcctgcaataatctccattgccacaacaccataagcgaagacatcagccttctctgtcaagtggcccatcatggcatactcgggtgctagataaccactaaaggtaagaaaccaaatatatgatcaatgatcattttttttgttataggtcaattaaaataatatcatcaggagagtttcttacagcgtgccagctactcctgtgctaaggtgagtcatgttgtcctcataatgcctagctagcccaaagtcagagatttttggattgagatcaccatcaagcaagacattgctggttttgatgtccctgtgaactatccttgtgctggactcctcatggagatatgctaggcctcttgcgatgcctacgcatatgtcgaagcgggttctccaatctaggttcatatttgtcttgcctacaagtgaacttaaattttagggaccttggaatttgctggtggtgcatattttattattacagaagtttaggaagtcgagagaagcaaaccagtagcaaagatagtttgatcaaggctcccattttctaggaattcatagaccagaagtggtgctttgctctcaatgcaacaaccatacaacttcacgaggtttcggtgttgaacggtggatatagttgaaatttctgtcatgaactcccgtttcccttgatgagatgttggagataattgcttcacagctaccattcttccatcatatagcttaccctattcatggaagatatagataacaattcaaaatgatgaatgaaattatgcaaattttgctacatgacactaaaaaatgctggtagacaacgtaaagacgcgtcggctgaaagacaccctaaaaaaccagtaatttgctggaggacgctttcggctcaatatgatgagagaaattctttaaattataaagacaagactaccttagggccaaaagcattcgagttgaggctagagtgaatatggaatatgatatatgctagcgatgtatttgggtgatggcaaatttagagttgtatagtttcaatttttcactccaatgccacatttgaagcatgtggccctaggggcattctcgtcattttgaagaatgtctctcttccagtgttcacctagtcgctaaacgctagtcggacggccacctactgactagcgactaggctgattaggcggcgactagacggattaggcaaattagacgttttttctatttctttcacacaaaaatacttattctagacattcggtacttggtaaatataggcatttaggcaaatagcataaatcatagttaagttcagaaatcatcaagtccatacaacgcactgacactgcacacgaagcattgggtttagtacaaatctatagggatagcgaacacatcagtatagccactgtacatgcacatcataattcataaatcataactttatagatctgaggggctagagctaggagagaggaagaaaaatttatctggaactggaagaacagaggaggtgaggtggtggaggggagcctgatcccctgatggcctgatttagggttggcgtaggctgcttgagtggtttcgtgcttgactgcttcaatcggtgtgtttgccaccttccattgatggcaaggatgaaggatgggagggagagcaggagcagcagaggagggggaagaacgtggagcagcagaggaggagagggaagaacgtagcggcacggtggaagatcgatgggcgcggcaacggagtcgtcgctcgtggcggtgtgaaaaaggggtaggcagggattgcgctctctctccaggctctcaaataaggcaacctaaatccccttctataccgagtcagtcccacgtggtgcttctaaattttatcatgcccaaattttgatttctatcacctagtcgccacctagacgcactgtcccgttgtctaattgcgcccaggcaccgtcctgtccaggccgtccaggctgcctaggaccgactaggaccatctaggcggtaaatcgactaattcactgcctaaggtgtaaactggacaaattgtcgctgaccagcgattaatcaccgtctagacgggctaggtggctgtttaggcgaacattgctctcttcaatcgagccgaatgttccatctagcaaattacctatttcttaaggtgtctttaagccgtgacacattttcgcaatgtctacctgcaaattacataaattttaagtttctagtagcaaaatttgccaaattatggtgtaactgatcatgtagagtaacatacgagctactttacaccaataattagattgaggaatattataagatagaatcaaattgtactactccctccgtttttaaatatttgacgccgttgacttttttaaatatgtttgaccattcgtcttattaaaaaaatttaagtaatcattaattattttcctatcatttgattcattgttaaatatacttatatgtgtatatatagttttacatatttcacaaaagtttttgaataagacgaacggtcaaatatgtgctaaaaagtcaacggtgtcaaatatttagaaacagagggagtatgttgtaacgattggaaagctctaccatgcatgggttacttacactgtgtaagttcccaatatataaaacatggaaggaaggactattggactaataataactgcatgtaaaaagggaatcatgttcttgtgaaactatatttgtttggtcttttgtaactcattttctagtttagtcagtaagtaaactaaaaagggatttttttaatataaaatagagctgaccttgtaaacaaggccatagcccccccttcctaggatgttatcctggctaaagttgttggtagctgattttatttcaccataactgaagacatctggccttccaactacactgagaagctctgcaaaatccttcacattgtcagacaaaacaagggaatcatataaggctatgtttagttcacgctaaaattggaagtttggttgaaattagaacgatgtaatggaaaagttagaagtttgtgtgtttagaaaaagttttgatgtgatggaaaatttaaaagttcgaagaaaactttggaactaaacacggccataaataagtcccactttttccaaagagtaaacagttatgtaattttaactacctcccatctccgcctccatttttttccttttctgtctccaaagaaatgtccctgtggataaaaggcctaaaactatagtacagacaacaactccagctaccaaagctattttacttttaccagcactgtttttaataggaccaggatcaaccttattgttgccacctgcagtaggataaaatgaaacaaaatagatgttaattataagatgatcacatagaaccaatggctcttgatcaagttaggtaatgaacagtaccataaggagatacacttaatgctgagattaatggcccgtaggatccctgtctaggaatgcaacaagttccttttccagcccagaaaaggtgaatctccatgaaattttctgtaactctaacaacatactgcctcaaaacaacagtataagattttccatttgtttgtttctttatatcgaaatccttttctctgagttctccctgcagtaaattgaaaaatagaaggtgtgaatgcacaagaaaacgtgcaacataactgttgcacactattaaaaggtatacttattttccaaaaataacattcattggacctttataaaaaatccacctgaataaatatgtcgaaaatccttgttcccaagcttgtccatgtcgtgttgtctggaaagaagatctctgcaaattgaagctcgacgttgtaaaatccattctttagtccaatgccatagtatctcaatgaagaggatgacgttctggctgtctggaatagtacactatcaagcgtgtttgtaaactggcgtgaagtgtatactatgaagctaaaattagcggcttccatgaatttccccgtgttgctaataccccatcttgttgagttcgaaacatagtatgatgcctctcctaaattcgtgtcgtcgggttcgtaataagatttatctgagcctataatgggtctagtaccaccggagtcaactgcaaatgaggaatctgcaatttaacagaaaacataagagtgcagatattattattgcggagattaagctggtacagctaatggtgaagagataagtgctcaccatctggagaagcaggtaaacatggagtatttcgctgtaggcaatttagacctgatgacaaaatactacaagcacaaaatagttagaagagttccattgagaataatgaagaaaaacctaaatttaatcaagtaagggaagaaaccttctgtttgaactatctatcatgaagttgttccacaccaaattcctataagagaaatacaatgcagacacagtaatagttacttttgtaattttatagtcgcgtacagaggtggacatgatcacatgaattgatttgtttactttcaaatggacactataacttacaaaaacctacacttgtaaatgtctttccgtgctataccaagaagggaactttccagagagctcgttgtaggagaaatctctgaagaaaaaagaccaacatatttttattaggaaaagaaacaccaacatttatttaaaatatacaagtaaaatcatcatttagatgttgcactagatgatgcgtatacatattgtcagtgcaaagctacgaacaacagttcacaaatagataaaacgtaaaaaggtaggaaaagacttacagaactttaaggctagcaccctttgtgtctggcaagctcccagagaggctgttgtttccaagaaatctgagtgcacaatttttttagagaattacaaaaaaaaatcaagacgttacatgaaagaaaactgatgaaggcattgaattattcaaatatttccttacaggtaaatgagtgaattcagattcaaaaggactgaaggcactttgccagtgatgttgttaaaactcaagtccctgcgccattaattccagatatacaagggggggaagagcaaaaagtaaacactcatttcacttttaaaaagaagcaagtagtaccagaatgcaaacaattggcgaaaatagatcaacaatagtttaattaagttcttacaagtaataaagtcctacaaattttgagaagtccactgaagcaaggttgtcagatatcctgcaattcctcagtgttttgaaagaaaataatgcatagttaaggtcttccacatttgtcaaggcatagctaacccattaaagccaagtgcacaatcaggccaccatacagaacaatcaaggatgtcatgtttgacataaaagccaatgaagaactcccactcactaaatcgcctattcgcctgcatgcaccacataaatagttaatgtactgttgaccattgcacacaagcaaaatgtatcaccaaaactaaagcacgatggacttacaaagatgtcaaattgacgagattagaaaaacttgtagggatgggaccatcaaaattgtttccttgaatcctcctaagattgatatataatccggtcagcaatggaagtaaacaatacaccattctctcgaagggtaagtagataggccaggggttaattatcacgaacataaaacacatcattttattgcaaaggttcatttgaattcacctacaagaaaaaaatatacttacaactctgtcaaatctgataagctcccaatataatcaggtattctcccagtgaaatcattgtcggatgcccatctgaaaccgtaaaacaaagttggcacactaaacataccaagatgaatggaaaaagtccatatactgtcctccattttgatttaaagaccacctaacatcacaaactttaaagccaggcatccctgaacttggcaattccattcatgtatctgcctaaagtggttttacattgtggtttcgccattgttgaagtttaaaacaagcagtttagaggttggcatgcactagtcatcgttgaaagagaaatggggataagcaggagagaaagggaagaattcgacgtatatgtccaatatgtatgccatttaaataaaaccattatgcaaaaaaaccactttaggggttatatgaacggtttgtaaatttcgtagggttggatattcagtttcaaagtttggaccgttagaaatcttccatttaaagtttagtggagtatatgaacttttcccaaataatttttcgcaactgaagttatgttcacaagataatttacaagatcttcagttttctaagtttagacaaggctgatggtagctccccgcttagaccacaactatcgatatatctgcagttggatgatagaaatgattaaggtcaatttatttcaaatacatgtgcaatacaataaaattaggtcaagaagaagaaagattttacagttcctcaagcttggtcatgttttctagtacttcaggaagtggaccgacaaacttatttgtgctaatgcccctaaaacacaaagagagaacagtgagcaagtaaaatatatgtgtgtgggtgtgcccctttttggagcaatcttttctattgcttggcagagtactcttaaaagcaatgagcctctgatcgacaaacagattgaggttttcagaagttcaatatgattataaaatttcaatgctgtttatttattttcttttttccacaatacagaagaaataatcacttacaacgcaaggagattgttgagattgccaagctcccttggtaaaattccagttaacgcattgattcccaccaaacttgtagttttgtaaaaaaaaaaaaaaaaaaagaacatggcaagtgaatatgtcggaagataccatgtaatagcaagttttaagttgaaatgcttcgttattagaaactttagaactgtaattcttacagatactgcaatgccgtcatttctccaataaatgccggtaaagatcctgtcaaataattttgctgtaaattcctgaaagcacaacaattaaaaagcaaaaaataagatatttgaacttgtatctgcagaatctcttattggcaggaaggaagcatcatccattacataagcctttcattgcaatagcaattggaagtagcatgttaaatgttaccaaaatgatatgaggcacaaatgcactgaagtgaacggtaccaatagtggggccttgttgaagttggactacatattattataactactgaaggcaacatatatatgtacttaaaaaaaggcataaaaaagggaagtaaattctgatgaggaattgaacctcctgaaaaccaacatctcaaccaaaatactccctccatctacttttgatagtcatattttatcttggcacacagaccaaggataagtaattatacttatcatccatttaaacatgctactagtaattattttatcgtttgcctggtaactaacaattattattcaaaattagatgggattaattaaattaatatttactgcagaatatttttcaaaagtttgacagtgattgatagtgatacatattaatgtgctttatcatcaacacatacaagttagctagataggtgagattctccagttctgcaggtatcggaccgacaacatccaacgcgtacaccctcctgcataaacaaacacgtcagaaagtttccttgcatgacagtaacaagaaggaaaagaaaagatactgcaacagcgtgttctttgctaaacgatttgggtggtgttcttgtaagttttcagatccaattcattgtgatatgtgaattagtctgagagcattctatgcttgcaattaccagactacagatcttggaggaccctatggcctctctccagatcttcctctcaggcattccgtcgaacacccggcgtgcggtcgaagcaaaggttcagtcaaaggtgtacgtacagcttggtgatgtggcagacggtcgtgttgtcgtaggagcagtcgcacttgatgcccgggttgatggtttcgctgttatcgatgtcggtcgtttcgtcgatggcgatgccgctgcaagggtcgccggtgatgttccatgtcgtcggcggcttcgtgccccacctccccagaatcgcgttcagcgccgccactgtgttgagttcacatgtccacacaaacaccaattttgaatctcaattatgattacctcgctcccggtaatcaattgatgttcaattttaattttaaatctcaattttagattaattttgatgttttttcgtactttattttttaacaggtcgcaaattaatagcacgtctaatgatctaatctatgttttcctacctgttaccgtcgtctgcttcccgtacctacctgttagccactcccgcgcccgtccacccggtggatggcaacggcagcgcccgcttctcccccgcctgcccggcatccctggtggtactggtggacggggacggagtgtcacgatcctagtttctctgcagcagaaaacacttgaaagaaggaagaaattggatcggaagcagaaagaaggggaagaacagagctagagatgaagaacagatgaagaacaggggagagttggaattagatttgagtttgtttgtaatacaatcttcgaattccccaacttgttaccctgtcggcttatatagcaatttactattcagcctctctctctctctgacagtggcccagcctatgactactgggtccactcactctccgggaatcgcgtgttcggtcatcttgtgcacctggaccgacttcccaactgagcctctgttgcttgtcctgcattgtcgtcaggtgaggtcgccaccgtgacattccccccaccttgagacgaagcttgtccccaagcttcagaatgcggaaaacgtcgacgcaattcctggccattttcccaagtgatgacctgtggatcattaccagaccatcgaacttgcaactgctccaccatcttggatcctttccgcacaaaacggcgatccaacacttgagaaggaacagctgtcagaccctcatctttagactgcaaaattggcaactgtgattgaacaaattcagtaggtgctaaggccttcttaagttgagatacataaataactgggtggatcaaactggtagcaggtaaggccaatttgtaagccacagctccaatacgatccagaatctgatagggtccataaaagcgaaatgccaatttgcaattagcccgagtaaccaccgactgctgtgtgaatggctgcaacttgagataaacccaatcaccaactacaaaagatcgttcagaacggtgtttatcagctgggaccttcatgcgagcttgagcccttaacaaatgatcacgaatcaaattctgcatcttatctcgttcctgtagccaatccgacaactctggtgactgacagagagcattaacagataaaccaaaatatttgggtttgcgaccatatagcacttcaaaaggagtagttcccaaggctgagtgaaaggatgtgttgtaccaatactcagccaaagccaaccatctactccatgagaagggcaagcatgcacaaagcaacgaaggaatgtttccaaacattgatttaccctttccgtttgcccatcggatgatacgatgaactcatacgcaattgagtgccagccagtcgaaacaaggtagtccaaagagtgcttgtaaagattctgtcacggttggaaataagggattgaggcaatccatgtagcttatggatgttctgcatataagcttcagccacatcgaaggcagtaaagggatgagcaagaggcacaaaatgactatatttagagaacttatcgataaccaccaaaatacaattgaaagtagcagatttgggcaacccttcaatgaaattcaatgatacaaattgccaggcatgctcaggaactggcaaagtctgtaataatcctggatatttgacatgttcagacttagctcgctgacagattgaacaggcattggcaaactgaaccactattgtgcgcaaatggggcgaagcaaataaggattttacgcgctgataggttatagtaatgccagaatgccccccaactggtgaagagtgaagatttgctaaaattttctgttgaacaaaagaattagtaccaatccacattctgcccttaaaataaagaacacattccttcagagtaaaatcaggcacaacatttgcactaatgcacaaggtttgaagtttactcaaagcatcagaatcattggcatatcctgcaatgatttcctgaatccaatctggaaccatagaagatatcgctgttaactctgaaacagaaggaaatcgtgatagagcatcggttgcaccattctcactgcccttcttataaataatcttgtaacgaagtccaagcagttttgttaaagccttgtgttgccaaggagtagtcaaacgttggtcatccagaaaacataagctccgatgatcagtatgaatgaaaaactcagagtgttgaaggtaaggatgccaatgatcaattgccagaataatagccaaactttccttttcatatgtcgataatccttgatgacgaggacctagggctcgactcaaaaatgcaatgggatgttgtttctgcattaaaatggcaccaattcccttatctgaagcatcggtttccaccacaaatggttcggtaaaatctggcatcgccagcactggggttgtcattaaagcttgtttaagagactgaaaagcttgttcagtagttgcagtccaaatgtaagattgtcccttcctcaacagatttgtcaaaggtttactcaacacaccatagtatcgaacaaatttgcggtaataaccagttaatcccaaaaatccacgcaattccttcacattggtgggagttggccaattcttgaccaccaatatcttatcttcatctgttgacaccccatttggactaataacatgacctagataggccaacctttgttgtgcaaatgaacatttacttctcttaacctccaggtgatgttctgttaagatctgaaacacagattgcagatgctgaacgtggtcagataaggttctgttgtagatcaatatatcattgacaaaaacaagcacaaacttccttaataagggcgacagtatactattcatgcagccttgaaaagttgctggtgcacttgtaaggccaaaaggcattactctaaactcaaaatgcccatggtgagtcttaaatgctgttttatgttcatccatagcctgcatccgaatttgatgacagccaacccttaaatccaatttagtgaaccaccttgctcctgataattcatcaagcaattcatcaataattggcaatgggtacttgtttttcaccgttatagcattgagatgtcgataatccacacaaaatctccaagttccatccttcttcttaaccaaaagaacaggagaagagaaaggactggaactaggctgaataatgcctttgttcaacatctcctgaacctgtgactcgatttcatccttctgagctggagtatatcgataaggtctgacatttactggcattgccccaggaatcagaggaattgagtgatcaaatactctgaagggggtaatccatcaggctcctcaaaaacttgtgcaaattgagacaacagttgctgaacttcagaaggtacagtctctttggaagaagaatctgtaatggaacataactgaatcagatgtgagatagcctgtctatctttgaattcctgaaactgttgaggagaaatccttgcacactgactcattttagattgaattccctgtaaagtcacagattgttgttgccaggtaatggtcaatgttttcttgatccaatccactctcattagactatgctgcattaaccaatccattcctaaaatcatatcataacttccaagattcaagatcttaaagtctgtacagaaaacccttccttgagtcatccattcacaatttggtactgatgcaacacatgacagaactgttccattggctaccttcacctgagatttgttcaataatggcacaactccagaaagcttctaagcaatctgacaactaatgaagctagctgtactgctagaatccaccaaaatcaaaactctttgccttgaatgaatcctaacattctcatataacccacagcttcagatccatgcactgcctgaactgagattgccatcagaccctgattatcagactcctccatactagcctgataagaaaattcatcaaaacccaaagtggtaaacaattcttggacagcatttaactaaacagtactggcacatttgtgtgatggagaccacttctcggcacaaatataacagagtccttgagccctgcgctgagccttcagagctgaaattttgtcagtactgtttccaatcttggaattgtcaactaccttgcggtcatctgctcgagttaaactaccactattcaacacccggtttggtggcaaaggtagaggtaaagcacccttgaaagctggatgtggccgaacctgcaacccattgtcactcttcttcagatttgaagctgattctagaatcacttcttcctgtaaagaagcaattgccaatgctgcctccaaatcctttggccgttgaagaagtactgcatttctgatttctcgacgtagtcccttagtaaaacgatgtgttaggtatctcatattcaaatctggatcataagctagcaattgattcattaactcatcaaacttttcataatattatcacaccgggcctacttgtttaatgttatccatttgtctaatgagcatctcatgaagatctctatcaaacttatttgacacagcaatacaaaagtgctcccaattcgggtacctaacatgagccttagaggaacgtaaccaagatgaggccctcccagaaaagtaaatggtggctatcctaacccaaagtccaggaaaagtattattcacatcaaagtaatgctcatacctcatcttccaatccactggatctgtaccatcgaatttagggaaatctagctttggaactctatggttgtactgacgcccaaattgatccccatcacattccccatttccaaactcagattgatcaaattttttcatcgatgtggagggaaattcgtacgtacccttgaccggagttgggcctagggttgttgccatccctagtacccttccccggtgttcatgagattgcagacggctattcgcccatttgcttccgccttccgccgcagcaacttgagaagaagatggcggcgtaggcagcaacggtgctttcctttcctagtccgtcaacggaactcgaggggaaagcgtcgttggagaagcttgcttcgacttgccgaccagatccagttgcacacggagttcgccgacttcctcccgcgattcctgcacggctgcctccacttgtggcctccaattgttcgtgtcttgatccagcttgacgacggccgcttgagtctcaccttgtgctcgattcagcaacaccagggactcttgaatctccatcagaagcttgccgaagtccacgttctgcttctccatatcttcaacttgaagttgcagacgggaggtgtaccgtggtttctccaggatcgaagcggctctgataccaaaatgtcacgatcctagtttctctgcagcagaaaacacttgaaagaaggaagaaattggatcggaagcaggaagaaggggaagaacagagctagagatgaagaacagatgaagaacaggggagagttggaattagatttgagtttgtttgtaatacaatcttcgaattccccaactcgctaccctgtcggcttatatagcaattcactattcagcctctctctctctgacagtggcccagcctatgactactgggtccactcactctccgggaatcgcgtgttcggtcgtcttgtgcgcttggaccgacttcccaactgagcctttgttgcttgtcatgcattgtcgtcaggtgaggtcgccaccgtgacacggagacagcgacgcccgctactcccggcggggcttgtctggtgtgctcggaggtggcgatggatggccacgtcagccggtactcccacgccagcctggcgcgatggcagcggtggacgcgacggcaccctcagtggtgaaggtggatggtgacggcggcgccaactcccgctactcccatacctgacacagctcggccgtgcgctcacgtcggttgtgcgcgacgaccaccgccacccacgcgctcccgctaccggccaccgaggttgctccctcggctctcctcgccattgccatgggccatggtctccggtgatatgaagatgaggagttggagggaggaagaagaaggacaagggtaaaatagtccaaaatggtattctagcatagtggtattttatcgaagctagtttaagtgatggtattatagaaccactcttttgcgatagtataatctcaaatttctcccgcccaacgccggcagtcctgttcgtcatccgtcgtcgctgctagccatgccgctagatgcaactactgatcgcctccgcttcgtactcccatgccgccgaactagcaggggcaagcaggaaccacagaccttttcatagtgtcaccactcacaaccaggcttgcaagctagcagaccaacccaccatcctgctagcccggaagataagacgttgcaggccagtttagccaccgggcgtcgctcctcccactgcttgcgggcactgctggccagtctactagcggtctagctaaggggcagttattgcaagaaaaaagaagaactggatctggatcttgaggaaaaatgaaggaagaaagaggaaggtgaaggtggctcaaggatcaggggaaaggactagtgttgatgggatgtgggagggaagaggcgccgccacccgccgcgtccgccagcaccgtcgcggcggcggcggcaaggcgcggagtgtgaggagggagcgcaggttaccatgacgagtttgctaattgcaaaccggcaatgataaaagaagaggaagagctcgttgagaaggaattgaagaacacatgttggagacttggagcgactcaatttgataaactgatacgatcttttttgtcataagttgattatccctttttttttttttggattcaaccgtgttgtgcctgaccgattggggggttattcttagtgatttcgaagggttcaagctgttgagaatgccattacgccaatcgaatcaattagaatacataatttgttttatgcttatacgagataatgcatttggtgttgggtatgttttctaattttctgttcatttgttctgcaggtaaggcacgcaacaagagtcggtgtttccggcttgtgttatggttccaacacggttcaaggaggcaggtcacaacaagctttttctttaaatacgtaacgcataatcttcataatattatttttattcctttacgacacatgaacattttttctagtatacaaaagtaatattcacaaaatattctttttaatgttacggcttataatcaactataagtgaaataataggacatgttttagtcacttacagtggaaaaggtgtactagtactaaaatacacaagttgttcatcgccttcataatagagtttaatctatagttttgggcaccaatatggccaaaattttgaccgaaataatagtgtgtgtgggggaggggggtggtattttaaacccttatataataatggaactttgtcgtccaaaattttcttccggaactgtgtgtaatgcattagtacgttatagagtagaagaaaatcatgaaactatcgatctggctagctctgctttcaatagaagcagggttaagtgacctttccttgaagagggaaaaaagatgattctttattttttcaatgagaaaaaggaggtatcttctggaatttggtccaaaaaaataattgaaagaagggacaagaaacagccaagaagaaaagaattctactatcaccgaaaagaagattataattaacaagctaacaggatcaactctgcggtgctaatttgtctttaaacttgtctaggagaatctgtcttcaaactgctagacgcaagaaacaaacatcaaacgcggcggcctctgcttttctgcctggtagcaggcgctttattctcagctaatttgttttttaatcttaatgaatcgataagcgttcagtctccgttccggcgaaaagacaaaacaagaaaacaaacatcaaaacacgtctctgatctgttcccatctctctgaagactcaaagaaacaaaaaaaaaaaagaagagagaagctgacatgtttgcagcacttgtatgtacatatctctccatttctttttttatgatgttggttagatcaaaacattatgggatggggtagtacatagcatataccttcgacaggatcagttctcggtgcctggtgagcctgagcctgagttgctacaacacatgaacacgcgaccaccaggcagtagtacaggccgagctgccaaccatggccgcctccgccgccgccgcaacgccttcccatcgatctcttggcaggctctccgtcgtcgtctctcctcttcctctgcataaaattataaaaatcgaatcttggtatggctatatgtatattagataaacattgcatttagatcgaaccccaaaatttttcacaccgttacatcaaacgtttgaacacctgcatgggtattaaatatagactaaaaaaataactagttgcacagattgcgactaatttacgaaacgaatcttgtaagcctaattgctccatgatttcacaatgtggtgctacaataaatatttgctaataacatattaattagacttgataaattcgtttcgcgttttactgatggattctgtaattagttttttttattagtgtccaaacatctcatgcgacgtcctatataatatctgatgcgacctagcaaaacctttatagatctaaaacacccccttacatttactccagataagcagcaacctgtcggcaccatggatgcgcaacttgagcagcagccagcaagttgcagacaagtcgttcaaaaaaaaagcaagttgcagacagccagacaggtaccagctccagcggaagtggacctcgacaatcaatcgatcaccatgtgattgtactgccattgattatttggaagactaatcaacgccacgtataagatgtgtactgagatgacgattgaactggtgtcaagttgaccttatctgggtcgtaatttcgacttcataggactgttgcttgctttattaatctctgctaaagtcctgagtatattcctggcttctgcgcgctacaaaagtgcacacgatacacacccacgcacttaaagaaaagaaaccaaaagaagctcaaagactatatatccgaagactagatctttacccatgtatcaggataaagaaattctctacttttaaacattatacttgtgtttttacccctgttaatactcgtggtaatccaatatcttctaaatcatccttcattttcatttatttcaccctataatatactaactgcatcttttctcttctatctaccgtataattcactaaactacagtcatagagaccttattcataaaatccgacatcctaaattcttcaaaaccaacgccttggatcatcccacgtttccctctcacgccgcccacctgaaaatcacgttgcctctgcccctcctctctctctctcagcagaaaataccccccccaccctcatgccaatcgccctagaaccgtcgctgtcaccgatccatcaatgcgccatccttggctgtcgtctccacgcctactcctgaatcctcgtcttctcctcgatccaccgtcactactagaaaaatcatttttaatagtgttacacttttattttcactggcgggtttaataaaaatgtgcttgtgaaaataattgagtgggattgcgaaaatccattttcgttgacagttacttaaaagaagtctgcttgcaaaaatagaggtctttttacaagcggacctcttaaataaccgctagcggcagccaagaccgattgcaaaaaaattatttcactatattaacagacgcacaccgcatttcctctctgcttctcacactccgcctcctcccttctccctctcctcttactcctcctcggtgagcagcggcgctctaggcaccggggtcttctcctctccttggtggcattctctgcgcggcaagcttgggaagaggccagatccgccaccatgaggcgtcggcagccgcgcggggaagagggcggtggcggcagcggctctcggcggcagcggcgtgggggagggggcgatggggagcggatccggcgcctcctccctccccaccggcggcggtgaggtggtgatgacgagaggctggcggcggcacggatttgtcgagctcgactagttttttttttctgcctgttgttccatatgatccagatgatgcagatgttttgtgcatgttgtgatgtttgatctgtgctaatgatgattttgtattttgtgtttgaatttggaaatgagcagccatatgcatatgaattgaatttgaatctagatctctagatgtggatttgaattttgaaaatgaatcaatgggcttttctccaaatcttcgctggcggcttggcagcaacatggttttttttgccccaaattagattttcgctgacggccgatttaacacagccaccagcgaaaatgaatttttgctagcggctgatgtaagatgaccgctagcaaagatccatttttgctggtggctggcttaagatgaccatcagcgaaaatgaattatcgctggcggaatcgtgatcttcactagcctttgttttgtggcggctctaaattccgccagtgaaaatctaaaatggccgcaaaaaaaatggttttcgtagtagtgcgtcgtcgccgtcgaatcctcccttatcggcttcgctcattaatctcatctcccttcgatcctctctcatcgcttccgctcattcgagcaggtacaatagcaggctatgtcagctataaacacatatcgatgagatgaaagaagagagagatgaacagcgggctacagatttgtagtcagctgcagcatgggctacaagatgaaatgtatgtatgacaggtgggaccatgtactaatagtgtagtatacatttatatgtgtttatatgttagtactattatataaattggctattaaattgactacaataatttggagccagtagttggctatatattaaacttgctcttaatccaagcaaaccacctgtctccatcaaggaatatttgagcctccatcgtcgtccacggccactgctcaaccaccagtcgccaccgccgccatccacttccaatgtgcttccaccgcctgccgttgtccacatctatcactatgccctcaacgacatccattcaatccaaggagatcaccctctgcccagacccgaagacgaccagctgctgcggagctcttgaatcatggattggatagtggagtgagtgaacctgccggctacggggagctcgccggaccaggtcttgttgccgtctatggtcattacctaagctcgaacacctgcaaacacataaatgtccatctttttttctgtgacaggtagaagatgatgaaattgaagtgttgtcaagtttctccgaggtgtttgtttttccgatggttaaagtgtagtacaaagtgtgcaaataaaatcaatgttttcaactcattcattaagtatccatgactacaaattattaggacttgatctagcctgagatagccaaggatcgattcattttttttcttttcaagctgtgctaatgtatgtatgttcagaattacataccatttgggttcacatgttcagaattatctaatctatgtgtcactagagtaacaggactgacattcatttatcacttctcctgtagtatatttgctgtaaatatatgaaacttgacacaaatctcacatcttaatagctcaaaatatatgtaacagtactcaaataaacttttcctggagttttctattgtgctttatgtattatagttttcagatattcagaacctattttatactgttcattactgataatatgggaagcattggtaagatgtacaggaatgatgattgtagatatacagacggtacaacaaatttgtctattaccaataacatgcaatttgatgattttgtgcagtccttgattaatgacatcttgaagtacatgaacagttagtactccactagaccttgaattatgtctcctcttttatggatatactttctttcattttaggtaagtatcattttatttagagtttgatttggaaaaattggagtaataactcttcctgattagagctaaattttgtacaaaatctttgagtagcagaattgttctgacctaaaatggagtcctaacatgatatcagtgagagttacaaattgtttgtaatgtctgagtacgaggaccgttctaatttggcaactttaatcaggcagtgtgaattatgcatttcttgtgttcatgaacaatatttgtttgagaagtgaaagatcggaggtatgttttgtcgtggtggatgaacagaaagcccggtgaggatggcaaacatggagtgaagagggtatggtgtatgctgtggcccgaagaagggcctcctatgatggaaattgtgagcaaggctggccctcgaatccttttttttcccctgatgaatatgtaatttcgatatgctgttggaatcggttgaaatctatttgtaactccactgtctcatttccgcatcatatatgtatccattgctgaaagaggtgtaaagaggtaaatagatagcgtgtacccgagcggactatgcatcattggattgtatctatgtttctgatggtcttgtgggtttgaggccttgagcttgagaatgtattttttttctttaccggttggtctttccgtcaccttgatggatgattgttactgcagtttttttagtttccttttacctaactcatttatttatgaataaaaatgtagttttaataatttacttattcaattgttttgggataaaattcttatttgcctctaaaggttgacatttaccaaatgctaccatagcattagcacagataagttactagtcaaactaatccaacctctggcagagactgccaaggcccttggtgctaactacatggataaaattcatcaaactaataacatgagctatgaattactcctagaaatcttggcacatatgaaatagcatgattatgaagtgaatcaacaattttgtgttactaacaatatgtttaggatagaaaaatacggatatatccctctatgtttagaaagaaattaagtgcgggcgtgccagtgtatctaaatatacaatgtaaaacaaacacaaaagagacacagaaacacatgatctttattaattgaattaacaagatacagtttccatatataatataaaatatgcgcgccattgcctgtcgttgaacagatccgacatcagtgatgtggtcttctgattcctggggtctcgagagactccccgttaattacctccgcagatttaggcctacaggagcacctcctattaagctgcttgtggtcgtctcatcgtcttcgcttcgcattctccatgcatggttatgatggtgatgtagatgtgggcgccggcaatgcatccacggccttgtcggtccgtgcgccgatgttggtgatgtagccttagggtcggcttcgcccgccctcgtcgtctaacctcatcggtcttgaacgacgtgtcggtgtagattgcttgaagaagacatgcatggaactgcgtagcttggacggctcgacgtcatagcaacagcatcggaatggtgttaaaggtaagatgagttggtgaagtcagttggtgtacacaacagccgaataaacatggctgggcatctcctgactagatgggatcaaacgaacgaagagttgacgaagacagttggtgtagacggcagccggattaaacatggttgggcacctcctaacccgtcatgcctcttatacaacagggacttgtaatgaagatgttgatgaagaagtcggtgtagacagcagccggatgaacgtggctttggcacctctttcggatgatggatcagcccataaaagggctctatgagggtgccgataacaacagcgaccttggaagaagtaaatgcctcatcggcggaacggctgagggcatttgttggagtagattcagcacgaacggttccctggcatcacagataacaccattctttcttcatgttgacgtagacgagcgacgctccaatacgcagatgagcgacagcattaatctccacgaagagggagagcatcacggacgggcggcatctcaccttggcgtaataaagtgaaagcatcacggatggacaacacgacgactccgacctgacgaggtgaagggcatcgcggccggatggcatctcgtagccttggcgcggcggagagaaagacatcgtggatgcacgaaacgacgacctcggcttgacgacgatgcacgggcaccaagcagtagtggcgctccgacgttgcataggttgagtagatgttgatgatgtcgcaatgcataggttgcgaccagcaaagtaaggacgctcgacgtcttgtcgacgtcgtagcactaggtagatgcgatcttcggcacgctccggctgggtggcgtcacaacggccttctccggcaggtggcaggtgatggttagttgacggagatgagctctgcttggcagcgcctcagcgactcagcgaagaatagtcatcgcggacggataatggcatcacaagtccggcgcaatgaagcagaggtgtagtagccgaacggcatgacgacagtgtgcgggctccgggtagcggcgctcactggtggagaaaccctttgtagtcccggttcgtaacccccctttagtcccggtttccaaaccgggagtaccaatccgggactaaagatcgctatctttagtcccgggtgaaataaccgggactaaagatcgagctgacctttttttttttgcatgaccctgttgctgcatggtttatatatatatatatatatatatatatatatatatatatatatatatatatataaaccatgcatatatatgtttcaatacatatatatgcatacatatatatatgtatatatatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctaaggaccggtgaattgtgtttccgtcgtagtagaattcacccatgggatcaaggatttcttcgttgatgaatcccatgagttgttcttgaaccgctgcgataaattccttatgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacctccgcctaaatctttctctccagttgccgcggaccaaatgacggaaccgataccaagccctacatggagtttaaagatatgattcgtagtagaaataattaacataacaagaatttcttaattaacagagaaacttatgccagtacctgtctataagttcgaaaaccttgtcaaacatagactcttttttatccattgagtcatatacattgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtacggtaacagtatgaacgtcttgtaatgctgcgccgtcaggagatggatgagattgtcctctgtttcctgcggatattggtcgagcattgcaacgtttactctccgagggtcgataaatccagtatcgaaaaccctccgccgtcgggccctttgaatctccattctataacgataaaagggagtattttattttatatagtctacttatatacaaggacctaattaattaaaggagacgtagtaattaagaattataattgaacgatatacttacaaagtccagcaactcataatagagacgtcgaaggcgtccagctggtatactttgtagatttccttgaaattgatccagagaatatcatctccttgcaagaagtccgggtccctgatcctcgctccgatcatctctctaccggtggcgctcatctccacgtacagctgatggaacttgtacatttgtgtgggtagggactgcaccagctcgggcttgacaagcggtttaccgagttcgtacatgtatttcaattccgccttttctattggttcaactcctagcaattgatccgtagttagaccggtgtcaataataaattcttctatcgtcatgtctttcccggtcaccaacggctcgatctcctggtttggttgctctccaagctgagagactggtttggactttccagaagatgctttcttcagcgttcgctcatagtccgatagcttgatggcctccttgacaggtgcagacatacccctgaagaagttcatgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccctgtgtgggcaggcggtggagctggggggcccttgactttgaaggtgccggaagaggagcttgcggaggagtaggtgtaggagcacgaggaggagtcgatgcaggatcctgaggaggagtcgatgctggagcctgaggtggagacggtgctggcggagtatgaggaggagacggtgtaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcaaaaaattatttttgtctgtaataaattaagtggataaatcgtaataagcaaatatatgacttataattaataaaaattccaatatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaatttatttatatggataatcaatacatccaaaatagtttacatcgtgtacacaataattacggcattacatcggcggtgacggttgaccgcacgtactttctcctcactattgttccctccttgtgatcgctgcgtgagtaagggatgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaaacagaggaaccttgagaggaccatagtcaagttcccatatgtcctcgatggcaccgtaatacgtggcagttgttccatcatgtcccatggcatcgacacgaacagcactgttttggttcgtgctcttcatgtcttgggctctcgtgtagaatgtgtacccattgatctcatatccctagaatgtcgcgattgacccagacggtcccctcgccaggaaggcaagttgttggttgattgactcgttacccatgagatgttgtcgtagccacgcggggaaagtatcaatgtgatgccgtgtaatccatgcatcggacttaccgacgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttctaggttctcatactcctcaccgtgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcaccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcacagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacatttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttccccacacacattttctctctcatcaacttacaactaaattttggagacaaaaaaaagtgtgcaaaacataggtgcaaatgtagtatgacaaaaaaacattggaggatgaagttgcaaaccttttaggcacctctgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggtagttacgactttagtcccggttggtaatcggggggggcctgacatgacctgacagcattcgaaccgggactaaagcgggactaaagatcaaatatgcccgttacccttttgaaccggaactaaagatcatctttagccccggtttttattgcatccgggactattgtggaaatcggccgaccgacgaaagatggtttctccaccagtggctccgaccagcgatctcctcgagcggctcggcgacgagcgtgagggaaatggccaagtccgcgaaagcaagcgagcatcgatgatgtcgcgaagagactgcgaccggcaaagcgacgacgtcccgcgtctcgacagcatcacgtcgccgggtagagacatcgtgaggaagactgctgcgctggtgaggatgagtagatcttggcggcgtctaaagaagaggttgcggccggcaaggcgatggcgtgcagcgtctcgccgacgtcatagcaacaggtagatgcatcatgagatagaagccgcagccgggccggcgaggacgtcctgcgtcttggcagcgttcctggatgcgggcggctcggcgacattccggcaattcgaacgagacttctgtcgggcacggctcagtagtaaccacagcttgctccggtggggcgcgcggcatgatgatgacctccaaaaactagcatgcccgacgcggtacgaggtggtttgatgtagacggcagccggccatttaatcacagctcagcatctaattgaaaaggcttgaaatcaacaggatttgtttagccatcgcattgacaacttcttgtgcatggcactgaggcatggtgatgatgtgtcacccttcggttggtcggccacgttgccataacatgtatttgctgaatggagttggctcggcatgctgctgctttgcttcggcttgtgctcctgccatgcgatgtgtgtacatgaggccgccgatcgccggtctgatctgtagcctaacgatggcacgtttcttttagcttgggattattataatctaaattattgagtcagattataataagctagattattataatctgtagtagaataaacagttagttattttttttctagattattagagtctagattattgggtttgcaagtctaaagagggagttgagtggcatgatgggtaatttttcacctaataatatggaaaaagctcacctaaatgagcttatcagattataataagctaggctccagattataataagctactttaataagttgtgtttctttcatcttactcctaatattctggattataataatccggcgatatttgttgatgtagatcgataaccaccatcatctgcacgcagcgccgccgccatcgtgaggaagacagtatcgccgtcgtgagaacagtagcagcgccgaacatcggccgcgtcggggggaaggggctgcagccatgatttgatacgctgtgcgtggtggaagcaggagtcttggcaatcgacggtggctccggcgatcctggcgcgctccagcggagcagcgtcacgacgactccgacatggtcagtccgctccgccgcggtgaaacttgcagcaaagcgaggacgtctggcaccttggcgacgtcgcggcttctagtagatgcaccaccagcggcttaaattggcggcgtcgggtccggacgtctcgtcaactcggacgggcgccggcatcgatgaggcttctgtggcgtgtagatgaatcggccagcgcgactttcaccggcggcgaccatatgtgtagatggatgtgtgcatgttgtagatgaaagaaaaacgaaacaatcttgctagcttctagcttggtagccatcaagttccttcttcctcatcgaagtactccctcctgtgcttgccgatgatcgggtcaccgcgcgcgccctctcctaccagacgccggagctccggccgaagtcgctcgctgccgccggtgcgtgtcgtcgctggatggatcactgatgagaattgatggatggatgtgttgacactggtggagaaataatctttgctaggtcgacccaaaaccacaataatcccggttccaaaaagaaccgggactaaaaatgatctttagtcctggttgaaaaccccataggcattctatgatctttagtcccggttggtgttaccaaccgggacttaaaatcatctttagtctcggtttatcccctgtcagattgatgtcatggggccgaagaggtcctggttggtgacaccaaccggaactaaagtgggttggtgttctagtcctggttggtgttcccaaccggactggaactaaaattcaaagcg

SEQ ID NO: 82526 - DNA, 3653 bp, Oryza sativa
ttacaccaagtataacggaattgtttcactaagtagatcgaaaatgttttagtcgtttaaatcgggcgttgtttcaccttatataaaaacaatgtttcagtaaatagcgaaagaatgtttcagttcaccacaacattagatctatacatagtgaaatattgtgagtacactaggtgaaacattttatgtgaaacaacaaataaaacgaattcccttaatagagtatttccaaaatatgtggttgatttgttgcaacgttgtgcgtggtggggacacgtggcaggagcgacgcagtggtggggacacatgcatgggcgcgggcacgggcgggaagcgcggcgcgtggaggtatcacccgattgtttggcgcacggatcgggcgctcgggttcaagcatttttggatattttatcaaatatcggacgcccgcccatccttggcgtctggcacattcgtcaggatgagcatcgtatgccgtttgcatgttggcttgtggcgcatgcatggcgtatgtcacatgcatgtatttttctactttctctctcttttcctttttctaaaatatgtgttcaatatataatctattacaccattttattcgtcataattagatctttataacaagatctcacatggatatattttgataaaaatatttattaaaaaatcaaacttatgttgcaccgtctaaaaaaagtttcaccacttgtgcagatgcgtcaacctagttcataaaatattccagagatgcaacatataaaaagtattgactgcaacggtaattatcactgcatgaaacattatgtcccaattagtgaaacattgaaaaaaaatcatatgatacaatacatttgcaaatatttgattttgttaaaatatttttgtatttagcttgcatcgaattgtaatcgctgaaacataaaatttttttttgctgaaacatataaaaaataatgtgcaacattgctaatgcattagtgaaacattaataaatacttgttggaacatacattaacaatgtgtgcaacatttaaaaagtaaaaaaaaggtcatcagaatatagtcatgtgaaatcttgttataaagatttaactataacaaatccaacgatataattagtttgaaatttagataaatagtttgagagaaaaaatcattttaagtttaaaatatgcttgcatgcacgttcagacttaccatgcatttggattgaggcgtccgattttttcttccgtgtcggacggctaatggtaagcattatcggaaagaagaagtacacggtgtgcccacatagaataggatggctcattatcttgatgaagcaacgcaaaaagtatcgaacgacagccacagaactgatcacattgccaggaaaaatataagtatgtaaacaagcattagagcatgttgaaaaacattaaaaatatatttttaaacgattttacatgaatatataagttggaaagaattgataaaaatatatcatcaccgctgaacgaagatacgaacacgtgacggcgcgtgagttcgctccctcccccacacacacaaaaaaaaaagaacaagttcgcactacgtgcatggaactaaatgcatgtgtccaaacgtagaggagcaatagcacaatacagagaggaggcaaaccctaaattatttttgcgtgtgttgcatagaggtgttgactcggttcatatggagatatcaggatgcgtgatcagaagacatgcacgatctccataagtcataactaaaccagataagccgtgcagtaccatgggtcgacatcgacatgtagcgcccaaatgtagaggagtgatagcgcaatatagaggaggaggcaaactttagattgttttcgtgtgtgttgcatataggtgttgactcggttcatatggagatatcagaatgcgagattagaacacatgcacgatccccaaaagtcataaaaccaaactagataagccgtgcagtatcaggtgtcgacatcgatgtgcagcgcccaaatgtagagtagcgatagcgtaatacagaggaggaggcaaactttatcttgttttgcgcatgtattgcgtagagacgacaactcaaatcatatggaaatatcaagatgtgtgattagaatgcctgcacatgatctccataagtcgtaatgtaggtgtaaggcgagtgagcgcatacacacgtgttcctctaattctctccattatacatggctcaagtcactaggagagccctttccattttaaagagatctctcctagaatgagtaaggtaaggtaatactaaaagttcacatgtctctcttcctgtgaggcattcctttgtgattttcatataaattacacctcatatggactttattccatactataattccaatatttttttatatgagcaaacttactttgctaaaaactataagagctcactactaattgtcagtgtgcatgcccttatttacaatctttcttccatgacagaattgatgtatcggtgtaactagagctgcgattttatcgtgttggttttccactcaaaatcattgcaaaagaatctctagttctactgttctagttgatacgttgtgagaatgtccccctgataatccacgagacaataacatgtagaccatggtaattacatggtgatatactcacactgcacccccaatagacgtggtaggctaacccgtccgttggaagagaagacgagttttctactgctgcacatacactagtacacacaccctatcctatatatcattgtcacaaatatgatctcctctcctctcatcggtccaaccaaatgaagtacccaactaccatgcaacacacaactagctaggagcctaattaaatcacatgcatggctaaaagcaaaagtagtagcccatggggtttgtgtcatgtgcggcctaattaacatcacacatgagccataagcatatcatcagtcaaagctgagatggtaggtgctcagatagctcagctgtccgacgcatgggaggaatagtacgtgggtacgttcgcgagacagcaagagtagtaactaaatactagagtattagaaaagaggaattttaccatactagctacaacaagatgggaggtcctaaatgagtacgggtggatagacaaagctcaaatcttgtggctcggatcaactcgtagcgagcacgattggctcagatcgattcgaacttgtagtcttaatgagttaaatcaaattaggctttcagcttgtgagcttaacaagatagctcgcgaactgctcaattagcttgttagtgcttatattaactaatatttagtcatctaattacattgtgaattctttattagttagtgtgtgttactatatttatatatgacaaaatgataaatttgaaattataaaggagggataaatatgttcacaagcctaactagcctagcagccagctcgcaagatgaattgcgctagactttagcttgttaaagttaacgagtcaagcagagctggctcgttaagacaatgagttcaaaagagacgagcctgagttgtctcgttatacacccttataaataaggatggttgatccacttaattggacgctcccccgctgctcctctcccgtcacgcaagagcacaatgcctcccactcctttctctca

SEQ ID NO: 82527 - DNA, 10481 bp, Oryza sativa
aataaccttacaaagttgcatgaacaaatttaacttcactaatgagttacaaaattaacaaataacactattcatttttttctttttctgctatgtttctcaatttttcacagatgaagttcagtttatccttaaaactttacatggttgttcaatttgtgagatttttttttccaaatcttttgaaaacttttatatctttgtttgaaatgtaaaaatgagaaacatagaagaaataatgatattttttaaaaaaaataaaaaataaaatctcatagatagctaaggtaatagtactttgacaaccatgcaaagttccatgaataaacttaactttatttttgagatataaaatttgagaaacatagtagaaaaagacaaaaataggaatattgttatttgttaatttatatatcattaatgaagttgattttgttcatgcaactttgtagggtcgttcatttacatattacctacatgtgtgattttttaaagaatttttaagaacttttataaaaaaaaaattcaagtttccacctaggatgtgatttccaccatatactttccccatcaggaataacactatatgtgcatcttcggtaagtgtaagagcatctcaaagagaatggccaaatggctctccaagctaaaattggcaagtataaagaaaaatgccctccaacagcctctctattctgttggctaagccgtatggctagccaaatcacagcactcactggccaaacttggagagtcatttcggctggccatccatgggctccaccactcctaccatctctctctgcccaaatagcagaggaccatggcagtggtggtgttacagtaggcttccttgtcgttcgccgccgtcagctctcgccttgtgtgcgtgggatctgtcgcctgcctcacgcgtggggagccacagttgcttcgccgcccgcgcgtcgccgctgtcaccgcccgcgcgcgcgcgaagccgccgccgccgtcgccccccgcctctcgcacacgggggagccaccgcagccgtcgctgctcgcacgcgcggggagccgctacagccgttgctgctcacctcgtcgccgcccgcgcgaggggaagccgccgccgcctgcctggcgtgcggggggatccgtcgccgccgcagtcgatgggctgatgcgggagaagagaaagagaaagaggaggaagaagaaggcaatggaggttgacatgggtcccttttttattttggagatgtaaatagagagactattggagtgaatacctagtttgactgcccaaatcagttagagagttggctataagagtatttaaagagtctaatttagagatgctgttggagatgctctaacagagaagaagggaaaacggttcaagatcctaagaggtcaccgaaagatgtcctctaggatttgaggtcttacgaaatatcctcctgatctccaacagatcagacatgtctccatatagtgaaaaacttcgtgaaggcccaacccgacccatcaatcataaaaggaataagtccatcttacctcactcatctctttcacttcgccgaataacatccctcaaccgcaaaaccggctataatacctcccccatctccgtaaaccggtgcaaatcgactcctccggtggttttgaaagcggtttatgctgatatggcaggttgacttggtccgaatgtgctgatgtggcagccatgtcattaaagggattgaagatagaagtgggtcccacatgtaagtgacaaatgctaaaacaaaacggggccccctgtcagccccatttttttcttatcttcttcctcctttctaccttcttcttgcagccgcacgcacggaggccgattcggccggcttcatccaacactggcgccagttgatatgaggtggaagtcgctgacatgtgggccccaattgccaactcagcgagtcaaccgcggtctagcatccatgtcagcaaatactgcttgctaaaccactaaaggagataatttgcaccggtttttgaagatgagggattcattatacccggttttgtggttgagggaggcaattcaatcaagcgcaagagatgagggagacaaaatggacttattccatcataaaaataatgtggcatctctaggcccagtccattacagttcttcaccaatatttattttcctttttgttttttatccacctaagaaagggggaaactacatccaattcgaatccgataagaagaatcaaatccattgcgtgtagaaatggagaggaacgaattcgccggagatctctggttgttgtttccccggaccagctggtgcatttctccctgatgggaagagaagccagctcggttacaagccatggctccgcaccggcgcgtccggcttctacaccggagctcctcgcatcctcctccttcagtaacggcagcgacaaggttctataaataatgcttgtttgcattgtttgttgatatagaggtcgaaaataatgcttccattatcgttgtctagggagtggattttgatatcccgaggggacgacttctcgttgtttgtacgtcactcaaataattatgaaaaaaatttaaaaaatatattaatatgttatgttatattatatttaacttctacatttcacaacgagaaaaacatattaaactacagcttgttaacatatattcatatgtcaaatttattttttttccgttgcgagatgtaaaagttaaatttaaacttgtatgtttatggattgatatatcacatgctaatacatcttcttaatttatttttcataattatttaagtgacatccaaacaacgagaaagattccacattaattatctaaagcctcaatctctactcactactggagaaaccatctttggtcagttgcctaaaatccacaataatcctggtttgaattttaaccgggactaaagatgactttagtcccggttgaaagagctgacatcactttttactctttagtcccggttggtaaaatcaaccgggactaaagatcatttttagtcccggtttaaaagaagacagactgtgtcagacccttctattatctttagtcccggttggtgatccatttttaatctcggttccttataacaaccgggagaaaaaatgaaaacgaaaaaaaaatcgcagagcaagcgccgcgcctcctcgtcctctcgcgcgcacagccttatcctctcatctctcctcgtctcccttcttatcttctccaatctcctcccttctcaactcctcctcttcccccttcctccccttcacctctcctccccctcccttgcgggcgcggcgcgcggcggacggtggatgcggccgcggcggcgcaggcggtggcgtgcgacagaagcggccgcggcagcggccaggcggtggttgggatgcggcctggcggaggacagcagccgggtagcggaagaggccgcgacggcggccgggcggcagctaggcggcggcccggtggagggcggcggccaggcggtggctgggctgtggccgcggcggcgcaggcagcggcgtgcggaagaagcagccgtggcggcggctaggctgcggcctggtggagggcggcgggcaggcgacggcggcagtggaggatttgtttattttttggatttgtaatgaatttgcttttgagaatttgtgatgtatttgatctgtgtgcgatgtaaatatgtgatgtatttatgatgtttgtatttgaagatggtggatttgtaattgatcgatttgagatttagagatgatgttctgttatgtgattctgggggatgtggtgaaatcaatattcaaagtagaaaacaatacaagaaaagagaaactaccaatcagatctgacttcatctttagtcccggttggtaaatgactttatttttaatctcggttggtgttactaaccgggactaaaaatcgatctttagtaccgggtatttgaaccgggactaaagatagcgatttttagtcctgcattcgtagtctcgatcgaaaaactaagactacagatggttataaaccggtagtaaaaagcctttctctgctagtgacttgatccgatcctctctctcttcacctcgccgccagcctcgggtggcgccgccgcctcctcttcgtcgttcttggcgacgacggcggggctgctaactagccgcgcctccagctcccggttcttctcctccagctccgacagctttgactcgagaaacttcacgtactcccttgctccgatcagtatcgacgacgtcttgtctttctgccattaaaatggatcgagaaataatttaagcaaatattagtgaagatcaatactaatcaattaatacggagtagaagaaaatgttcatgaatatgcatgtatgcatatgcacgtgtatacgttcgtgtataagccagctataaacatatttcgaggagataaaagagaagagagaatggtagcgagctacagatttgtagctaacttcagcacggactccaaggtgcaagtgtatatgacatgtgggaccagatattaattatatagtatatgtttataattaactattatattagttggctattaagttggttatagataatttgaagccagcagttgactgtactactgtattaaacttgctctaattaataattgtacctagcttggagccgggagggaggacgtacggcctggactggagggcgacgaagctgccgttgagcttctcccgccgcttccgctccgacatcgtgtgctgcagctggttgctggacggcggcggccgctgtctgctggtattagcactggcgtacgcctgtacattgttgccgtgtgcatcttggtcagcaccgattctatggctgtgtttagatcacactaaaattaaaagtttaatcgaaattaaaacgatgtgacggaaaagttaaaattttgtatgtgtaggaaagttttgatgtgatggaaaaagttgaagtttaaaaaaaaaactttagaaccaaacacgctctggccctgtttagttccccaaaagttttcgccaaaaacatcacatcgaatatttagacacatgtatgaaacattaaatatagattaaaagaaaaaccaattgcacagttagggggaaattgcgagacgaatcttttaagtctaattagtctatgattagccataagtgctacagtaatccacatatgctaatgacggattaattaggctcaatagattcgtctcgcggtttccagacgagttatgaaattagttttttcattcatattcaaaaacctttttttgacatccggttaaacatccgatattaccacccaaaattttcatttggcaaagtaaacggggcctctatctatagaactggcacctagctataatctttaaaataaaaaaatgtgtcgccgccgtctggtggagctccgacaggaagatgacgccgctgaccgtgacgcccgagaaggcgccgccagcctagcttcttgcactgttcaactcattattaatcgattttgctatatatttgtcgacaaattttcccctaaaaatttgacaggtgtaattacagtacaatcgtaatataattacactgtaacttgcatgtaattacactgtaactatagtgtaacttgtatgtaactttcaaaaatctatccgtaatatgttatttcggtaaattggaggtcgtgggaacaaattctttcacatatgtgtgtgctatgatttattttctttctcaccaaaataaatcttgtaatagatctaatgatttaaaattatgtgaaacttacatataagttacactgtagttacatgcaaattacagtataattacatataagttacagtgtaattacactacgattgtactataattatatctattaaatttttagaagaaaatttatcgataaatgtataggtagtctcttattaattagcgtgcctctccgggcttctccccatccccatgtacgagtacgaccacctcccgcccccggcgcggtggccatccaagcgagagctcgaatcaaccggtccaagaaggaggcgccccacaccaactttgtcagcccgcgccgctggctatgtcaccaccggccgtctacatctgcatctcgttatagtgtaattatgtgtggattacactctagttaattacatagtgtagcatttagattgtaatttttattattgttctatagtataatttctacttattgtttatacatgtgcatctctccctgcttcacacaatcctggtctccacaaccacattgaaatagtgtagtaagccaaatgcgtccttggcccgaggaaccgagaaagttgcagctaaacacaagagtaattagtgtgctcacggataacgaatcaacagagaacgtgccaaagaatcacatatctcaagatgggatctgatggtaaaaaaaatcgtatgatacggtggaaaaaaattctgtcaaatgatttatagcaaaaccgataaaatattataaataccggttttccctttaaaactgacacctatagttaattaaatatatcagttttatatatttttattccgtgaaggttagaggtttaaatgagagaacttttatgttacaatatactacaagtatatactagcagtataaatgatagaacgatatagattgtagctgcaatggcttcaactgcgagcttcttagcctcatgattatgcgctctgcttgctgccaacacacccaccaccgcagctgcgcctcccgctatacttggcctccccgccgtgccgtcgttgcctacacaccgccgccgatgtttgtcgttcggtcaatgccatgggtcgtctctctgctccggatagattaggcatctacgatcaatttgacaattagaatgaagatgaatcacgaattactaaatacccctttaaatttggcagggaatccaaatgtgtcctcatttataatgttagtatatactattagtatatatattgtaccgtaaaattctcttaaatgaaccaacacctataaaccgataattattagaagtgttgtagtagtgcgtattggctgaacgcgccaccgatcgctggcaactccatcgccggtgacggtggcggtggcaggctagcggtgtaatggttgtgctggggctcgctcgttgcacaccaagggtggtggtaacggcacctgcgaggagacctccagctactggaatcccgtcaccgccaccaccgccgacaaggtctttgggctgtatgacctattagggaagagatttgcttcagtccaacaaaaagtatctcgaggtaccagtacctcacggtatcaaatcgtttccgatcgttggatttaagaatatctatcttgcctaactagatccaacgatcgaaaacgatttgatactgtgaggtaccagtacctcgagatactttttattggaccggagtaaatctcattagggaagctaccggcggcgacagcatgcatggtgcgtcgacgaatgcatcaggaggtcgtccaccatggcggcgccgtacaccgcggcaccggctcaccgcggactgatcatcgtcacatcatccatgctcaagctcatgctgatctgcatgtcataatccaaaacccaacaaagttaattctacaatatatttctttgatcttatatgcattgattgttcatgatcgagctagttaatcaataaaaaaaattgtgatataagcttgcctggttgaaatggcgctgaatctgcgaggagctgatgaacagccgctcctgctgctgctccctttgctgaaactcccgggggctgcagctgcaataataatatgcacgacagaacagaggaattcacagaccatatatacattatcgtctcgatcaatcgtgatttgtacagtggtgtagaattcctttaccagtttgacatcatggtcctttacttttcagagaatcttgttataatatttgtgtctgctagctatgactgacgacgaacgttacagtagtattagtcaactttcacgcttgattcttaatgttgacctgaagttactaaagtaccacgttaattagccctccatcattatcgatcggccatcatgcagacttttggggctcgcaggatcgtcagcagagtgaagtaattaattgaggtgtcaaggctaattaattcaagccgtcaagaacattgcatgcccacgtattcgaatcaatttgtttggagagcagttcagtttttatttagttaatttataccttcttagaaccatatctaatatgtttgatggttggcttttgagggttgacaagttcagttctcatctgatctatacctttctagaaccatatctaatatgtttgatggttggcttttgacggttgacaagaaaaagagtaaactcatacttgtaggagcatctgccatatgttgggctctgtggttgagtaaaaatgatatggtatttgacaaatcaccatctatctcatatttacaggtaattttcagagcaacatattggctccgatgttgggtacaactgcaaaagtatgaagatgatggagagcttatgaaggttgcatgtcttaggcttgagacgacagttatgtaactttctgcaaaatatagatggagatttataaatagatttgaataaatgtgtactccttatcttgatttggtcttttattttgttgggtgtgtttatttttattttgaactacactcttcgttagagtgatactttgcaaggccggaatgttttattccattatctaaaaaaagtatgagtatgtgtataaggttttccattatcttagagagaaaaatgtgtacaatcataccgtcaataatgtacatgaaatttcttcttttcttttctttttcttttttctgatcaacgaggtgtgagacagctttggcgtttgacttcaataagaaaatgtttaattagttagttagttataccttgagctgtaatgttaggtttgcactaggagggcggccgccggagccggcgctggtgctcatcgccacgaggctggcgccgtcgccgatctgctctctcaggcactgcagcgtccggagcacaacgtccgtcgtgctcatgcctccgccgccgccgccgcgcaagtccacgttgagcgtgcaacaagtctcttgatctcctcctgtcgccgccgcagccgccgctccgctgccgccgctcgtcgtcgtcacctcgatctctactaggtcctctcgcttcgtctcgtcgccggcttccgccgccgccgtctcgcctttgtcgttcttggcggcggggcggctggctagcctcgcctccagctcccggttcttctcctccagctccgacagctttgactcgagagactttatgtgctctcttgccctgatcagtatcgacgccttgtctttctgccattaaaaaagagaaatattttaagcaaatagtacggtttttttttcggtcagataatacttgtcgttttggataagcgtgagatcaaactttagagtatttaattatgaattatttttaaaatatttattttttaaatatggtaactatagtaaatatatgtatatagagtagtcttaaaaagtactttaataaggttatatatttgttaacacttttatatatattataatgaaaaataatggttaaagttgtttatttaagatcgtgccttttacaaaacaataacccatattatggaattgctacgtatctgtcgacagattttctattaaaaatcagtcgatttgttgaccgcatgatttactttgagatacgtgcatgtgccattgagtgaaaaaaaaaagtcgctagaaaagggaatcaaacccatgacgtcgggatgccacaacatgcactccaccaactgagcaagcagcggacaacagctttatgtctatacttaacatttttaaaactttcaatgcagttacactacacccactcacaccattgttataccacgattaaaatgtaagtgcactacagatacaatgtaatttttaagtacatgcgggtgtagtttttgttttacatgtacggatttactcatcgttgttttgttgcattgtagttaacttaattgtttgaggtgtgatttgatatttttgggactatatataccgttgtatttttcataaaagaagttttacattgcaagtacccaaagttacatatgtaattttaatgtatttacactgtaagttttaaaattacatatgtaagttgatgtaaataggtgtaagttgcttgtttttccttttcttttagcatcattgaagtgattaacgtccggtgactgacgtacgttgatatgttttcatttgaaccgcacgtgggggtggcttgaaaatccgactaattttctacgaaaaatctgtcgaatgatttttagtctgtctaaatattattaacccggagagagtattagtcaaggtggtgaagaaaatgttcataaag
